United States Patent 8,781,750 (CELL-TYPE-SPECIFIC PATTERNS OF GENE EXPRESSION) - sequence listing, part 25

SEQ ID NO: 36777 - DNA, 227561 bp, Homo sapiens
agccagcccttgccgtggccggagccgagcggcgcatccgggccggagaagaggacgacgacgaggtcctcgaagtggacccgtttgcgaagcgccagggagaaggaggagcggacgcatcgtagaaaggggtggtggcgcccgaccccgcgccccggcccgaagctctgagggcttcccggcccccactgcctgcggcatggcccggggctcggcgctcccgcggcggccgctgctgtgcatcccggccgtctgggcggccgccgcgcttctgctctcagtgtcccggacttcaggtaggatctggcgttccggcttgtgcgcagacggtagctcacggctcgcttggccagcccttccgccgccactatgctcccggccgctgcgccggcgcccatgctcctgaacgaggggcgccaggcagggccattcgcatctcgcccgacgccgctcccggcccgcaccccggaccccctcgggctggttacaataagccgcgctctggggacgcctaagtgtttccagagtctgggggcgggcggcggcggctgggagcctctcggtggcgcttcccgagggtcgcgagtgggagtgcgagtgtgaatgtgagtacccgccctgggcccgggacccgagtccgcagatgtgccccgagggtcccaggacccgggcttcctccccgaggtcttcctccttcaagggcacacggccccgagtgtcccccgtctgtctcggagcgtccccccacccccagggcggcctgatgcctggcagaatcctggggtggacgtggccccggagaagcggctcttgcggcgggggtgggggcgccggcggctcccgggtcctgactttcccagcccgcgggccgcttgatggaaacgggctctttggcatcccttttgttggtccctgaaacctcctctcccccaccgctctggggtggccgaagtggtgtgtgatctggattgaaatggtttgtgactgggatcgcgggtccctgagcggctggggcgcggccgccttctggccgcgccggggggacccccgggacctgtaggaggctggcggcgggaggggcggggcccggctcctaggtgggtttcctcccggggccccacttcccccgagtccctgcgcggtttcggctgcttggatccggggcgcagaggaacggcggggaggttcggaagtgcagcttgggacctgcctaggttgcctggaggaggcggcgttagctctggcggtgcagactccgggagcacctcccgcccgcgcgcctcgggccggattctcggcaccctgcgggggtggaggagggcgggcggggccttcaggcccaggagcgccagagacctatggggttcgcctgaagcccccggaatgtgtgagacacttcttactagtaaatgggcttcagtatcccccatccctgcactcctgcaggaaggtgagaatcgggacagtcgcaggctgggagacgctctgcttttcctgcgtcctgctgggagctgcgcgctccaggtatcctggcctgccgccctagccggcccaaggtacgcgagtcagaaaggctgcacagtctttcctgggggggggttttagtttaagcagatgttgattacgtcagacattcctaattacttgatttgggaagggagcttgcgtttatctcactgtgcattaaagcataaaccgctcagagtgcacaataaaataagtagaccacattctaagttggtatccatcactcaagacctctgtcgatttctgcaacccctcccccaagaatctcccaggagatccctttgctgggggagaggggtggcggggaggcggcttaaacacgttgctggacgtgctgttgggcggcttttgctgttcaccctgcggttaattgtcctacaaaaactctgccttgcagaccatgagggttgagcgcagcctttgaggggcggtgctgtggtgggggtttttagatgggtgatgaggaaagcatgatgggtccattgcttaagccaaggtggttgtaacaggaaagttccttgagttttgggtgaaggaatttaaacactcatagtttccagtgaatgtacaaatgtcttatatgaacaaagcaattggagtcgttttctttaatttttgaaccctgttctttttctagtgaaatactcataatctttataggagagggcataggatataattctcttcgttctgtatggctaggttaacaaaatccaaagagtatgataatttttattcaaaataataataaaattatatgattacaggagatttgagtgtttgggatcttttctgctgtgaaaagaggagtccctgttatttgagtgtgttttatccacgaaataatttattatgtaaaactatttaggggtttttctaaaaggatttgtaagttcttattccacattttaatagcaagactctgtttcctctgatgacaaatactgatttgggactatataccaatcctaggtagggtaggtggggaacgatggagcattagggtccccccagcccccatttttggcagtgtagtgtttacttttggcccagatccctggagtgatggtggtaataaataatgatagtgatccgtctagaagaaatccatctagaagaaaataaatggaaacatcttgaataagaagactttgtggaaaaagaaaagtttttatgtatatagtaaggcaacatatttttcttattacggctgtgtaccaagcacagagctacacatttgaaatttttcagtataattgtgagatcctgcttaactctcatgtccacttcataaagcatgtcaccctgaaaatctgatcgccgtggaccctatgtgacactcagtgtaactgagagggctctggaaagccaagctgaacttttaattagtaaagcaaatcatggaaaactgacaagtctgctttatattttatatgtaaaaaagcaacatgggttttttaaaatgtgcgttttccaggggtagtttttggtgactgctctgcagatttttaaggcaatgttaaacaacatttttatttttattgtgaaaccttttttttattgtttattcaaagtgctgctgtaattggtgtttgtatgtctctctcttaagtgtggtttgcagtgaatcacttgttgccccttaaacagttagcctggatttaacctccaagagattaagtctggcagagtctgaattttacactgctcttttctttggaagctcttctgaaatcagtggaatagaaatacaggggtacgaacagctcatctgacaggtagggaagattaatcccctttagaaaggtttcagctggtggactggcactcctttaaaatgcattccctgagaggccaggatgggaaaagttattagtgaaatgggaactggatgtgaaggacttgagctccctaatctgcaggacctggctagtctgttgtagtgctggaaatttgtgtactctttgtaatcctttcccttggagagttctaattatataattccacattgtagtcagggaaaagaaagttaacgctacaaactgttactccttcccagggtttataaccatcttctaaaatggttccttgatgacaggcctttccttttggtgtttatctggttcattccctgggaacctggaggggacactgtgaaggactccctcctcctcctcttccacaccccatcagcgtcttgtggtttccacgtggtgaagggctgggcagcccaattttgggtttaccttgaggtgcctccttgggggctcctcggggcgggctcttccttgctcttgcccattggttgtgactccatacattgtcattaggatatttcctttttgggagccccgtggtgaccaccaagtggagaataccaagcatgtaaggtttcaaagtaaagaaaccagggggctttgttttgcagtggaagcattgctagctaggtctggatttttattggttgcaccccagctgcatggccaatagcaatttcatgaagggactgttgggttgaagggactggctttgaaaacattacttctcagtgaccctttgggctcttaggttctgctttgccccacaacaccaccataacactgttgaggctttcagtgggtagtgtgggcttcttgagttttgaaagtaaaaatccaagcaacaagaggcgctccagcccattaattatagctgcaactggccggggttttgtagcagccgcctttttctagcatgtatttatttggttttgttgaagagcttgccaagttggaaacgagggcgggacagctttgcttgcgtgtgcagttgtcataaaatatgtctggggtgtaatctgtttaaaatcatattcgtagagtggccaaagaattgttgaacagtgttgggaattttcataaagcttttacaaaatagggaattttattggtgtggttggcactgtttttgggatttctgtgggtgttttctttttaagtcctatctctgaaaaaagcaaaaaactcaaaagctaaagggaaggaaataattacagaaaaatgtagcttaattcgactaagtagcttggtcctctagaaatccttaagttctagtgggaagtggtgtgtatgtctttaattgtcgctggaatgagcttcagtaagcactctgtcactttctagatgttatcagaggagaatgtggcggctgcttcaagtcctcctggagtgggggagggttcccctaaatcccaaatactcctagcctaatggtttccacaccctcctggagggatagttaacacaatgggcagttaaaataaggaaatgtttaggcctgaactcctcattgtaggcttgtgctgtggaatatagtagccaccaggcacacacagctatataagttaaaattaattaaaattaaaagaaattaaagattcacttcctccccttcactggcttcatttcaggtgtcagtagccacaaattgctatgcaaaaatgtcactgggattttagtagaggttgcattgaattggtagatggatctgagtagtattaacttttttttttttttttgagttaaggtcttgctctgtcacccaggctggagtgcagtggtgcaaacacggctcactacctctggccttaacctcctgggctaagcctctacctcctgggctcaagttatcctcccatcttagcctctgaagtagctggaaccacaggcacgcgctaccgtgcctggctaattctttgattttttttcgtagagatggaggtccacttgtgttgcccaggctggtcttgaactcctgggctgaagggattccccacccccaccccagtcctgggatcgtaggcatgagccacctcactggccatcatcttaacagtattgtcttcctgtccataaacacaggatgtcttaacatttatttagacctttcatttctttcagcaatgttttttagtttttagtgtatgagtcttttgcctcttaagttaaatctattcctgagtattttattcttttcgagctgttgtaattggaattgtgttttttaaatttccttttcacattgcccactgttagtgcacagaaatgtaacatttttgtgtgttgattttctaacctgcaagcttgtggaatttgcttattagctcaaatagcatttttgtagctcttattctgtatgtaaagtcgtatcatctacaaataggcataattttacttcttcctttacaatttggatgccttttattatttttggtcttgcctaattgctcagcctggaacttccaatacagtcatgggccaaataatgatgttttcagacgatggaccacctatatgacagtggtcccataagataacactactgtatatgactgtgccttttatatggttagatacacaaatgcttcccatcctgttacagttgcctacagtattcagtacagccacatgctgtataggtttgttgtagcctaggagaagtaggctacaccacatagcctaggtgtgcagtttgtgtgagggacactctatgatgttcatatgatgatgaaattgcccagggacacatttcccagaatgtatcgtcatcgttgagcaacgcatgactgtactgtgttgaatagaagaggtgaaaatgggcattcttgtcttgttcctgatcttggaggaaaagctttcagtcttttaacattgagtgtgatgtttgctgggcttgtcgtatatggcttttactatgttgaggtggtttcctttctattagtttattctcattttttggtatatttttgacttttagaacatgctaacattctacaagttcaaaaaataaatcactaagaatagcaggaaactagaattgaatacaaagaagcacataaatgcaaatgtgttgcaaatgagtaacatgactacacagatgggggaaaagaaaccgtaatgttggactcagtgctttgacggtgtatcctcagcctacaggagaaacaacaacctgaaagcaaaactggcacccttcttagtaggtttgattttcatagtggtgtgggtatatccattctgaaatgactttgtgtgaattgtgagattagacagataagaagtgtgttaatagtgttgtagccagggtgctcactgaggaaggagggagatataaggatggaataggggaaggcaaggaagaatctggaggggttgaattggaattggaggtatcagtgtaactcatgctttcatttatatatatatttggtatatattatgttaaattatgcaccgtaatttgtaaaacatactctacacataacagttatttcttagcacctcattagcagtgagctttcttagtgcccagatgttggtttctcaatactgttgcatcttaaaggagctagagaaccttggagaaatgactgaatatgggatggggacagggaaaaatacacaataagcctgaaacgtgttcttgtgttagaacgcaagtgagtggtgaaaagtggtgggggcatggcagatgtactcaggggccaacttgaaggagttgcagccaagtctgggaccatttaggcatcagaataaataaagacaagcatggattatacaaggaacaaaataggcatccaggactcaccattgataataagtacataactatatgtatgagtttcttaggcctgctgtagcaaaatgccataaacggggtgacctaaaaaccagaaatgtattctcccacagttttagaggctagaagtccaaaatcaaggtggcggcagggccacgatccctcccagggctctaggggagaaaacttttttgcctcttttagttcctggtggctcatggtgcccttggtttggagctatatcactttgacttctatcgccattttcacatgaccttttattgtaaggacaccagtgattggatttagggaccactgtaaatacaggatgatttaatctcatgttccttattactactggaaagactatttccaaataaggtcactttctgagcttctgggtggatagggaaacactaatttactacaaaacctaagtgggaggggtggggaagagagggcacttcctagagcaaagtgccaactgataaatgggaggcgagttgggaataatcacattttacagcaataactgtacggattgatttgggcaggcgtcatgaatgagtgctaaactcattaaagaagacatgtttgatgaggagcaggaaatgtctgtggtctcaaaggatttccccacagattccttgttggcaagggacagttgctaactgtagactggcgagatttgcatcccaatacctgggtggtccaggttaatgccacagatttgggcagatggatgccgtccttcccaagagcatacatcatttaggttgctttctatctggggaagagagtctgattatgagcaaaaatcagcaaacgaaatggagggacattctatgaaacaatggtctgtagcaaaaattgtcgaggacatgagcgatgaaacagggcaggccaggtccagcttgaagaagaccacaggggcctggtgtggtggctcacgcctgtaatcctagcactttgggaggctgaggccagcggatcacaaggtcaggaattcaagaccagcctggccaacatggtgaaacctcgtcctcactaaaaatacaaaagttagccgggcgtggtgacatgtgcctgtaattccagctactagggaggctgaagcaggagaatcacttgaacccgggaggtggaggctgcagtgagccgagatcgtgccactacactccagtctgggcagcagagcaacaccctgtctcaaaaatgaaagagaagagaagagaagagaaaggagggcagggcggggctgggcggggtggggagacagtacaatacagtacaccacagggtaggtagagaagacagtacaatacaatacaccacagggacaaggcagtccagtgcatgtgctggccctgaccctgtgctggagggaaaaacatgctgtcgtggatactaacggaaccactgaggaaattggaaggtgagcgtaagttatttaaacgtgttgtcagacttgtctttcctgagtttgttaattgtgcagaggtggtgtaagaggatgtctgtactcataggacatacacgctgccatgttaaaggataaaggggcttgatgtctccagcctactattgtcatctcagaccatgataaagcccatggggcaagagtgacacattagtgaacctgggcaaagagtagagggaagtttcatgcaccattcttgtaacttctctgtaaaggcgaaatggtttcaaagtaaagaattaaggccgggcacggtggctcacgcctgtaatcccagcacttctggaggctgaggcggggggatcacgaggtcagcagatcgagaccatcttggctaacacggtgaaaccccgtctctactaaaaatacaaaaaattagctgggcacggtggtgggcgcctgtagtcccagctacttgggaggctgaggcaggagaatggtgtgaacccaggaggcggagcttgcagtgagccgagatagcgccatggcagtctggcctgggtgaaagagcgagactccatctcaaaaaaaaaaaaaaaaaaaagaattaaaaatgttaaattctaacaatggatggctgaagccagtgcaatgaacaatggagtttagcacatgctgttaaaagaaagactcaaggcccggcgaggtggtggctcacgcctgtaatcccagcactttgggaggctgaggaaggtgaatcacctgaggtcaggggttcaagaccagcctgtccaaaatggtgaaaccccatctctactaaaaatacaaaaattagccgggggtgggggctgggtgcctgtaatcccaactactcgggaggccgagacagagacaggaggatcacttggacccaggaggcagaggtcacagtgagcggagatcgagccactgcactctagcctgggtgacagagcaagactctgtctcaagaaaaaaaaaaaaaaagaattgcacgttatgattttattggaaatggtgtcacagggactgaggatggatgcgatccaggtgcttttgaggccagacagcatttcattgaagggactgaaaatctctgtctttgtctagtttctggattgccccaagttttctgatttttctttcttaagatttttattatagaaattccaacacacataaaattagacgactgcagtgaaccgctgtatatttttcactcagcttcaacagttgccacgttcatttcgtttcatttcccccggcctacttaacagtccccagacagccttaattgtttacctgaaaatacttcagcatgaatggtaagaactgtttttttcacaccatctcaatactgttatcaacaaggagccctggtgttgtctgatacccagccctgctggaaatggcctttcacacttgatttgcgcacagcggggctgagttgccatgaatgcagctgtgctctggggttcccgtgggcttggaagctccgaattctggaaggtgttgcttccctgcatcacataggctgtggccctctgggtgcagagcccaggaacctgggcttggagtggcactgagtctctcttggacatctttgtgcaggtgaatgtggggtggggcccggagattcaggccacgaggcatctgctgagccttgtttaatccagcccttcccagtcccgtttattctggagccctcttttggtgggtgctcttgttaccacctccttcagcacagcctgtggcatggaccagtctccactgtactcagaacactggctttatgaaaacaaatgcagtattaatgcgtagaaaggagggaggaggcactttcacttccgtgtgtttactgcccctcttcttcttttttccagtaacaaacacaaaatactcaattttctccttcttggtgtggaggctttgacatcccactgtgggatggagagatggcctttaccacagagagaacagatgagggatcaacatccagagtatgtaaaagaattcacaagatcagtgagaaaaagatgaacgccccagttaaacgagggacaaaaggtacagtcaggcagtttgcagaagaacaaatacaaaaggccacaaacttgtgaaaagtgtggccttattaggattcaagaaaatgcagattataaaacagttatcccaagctctttgactcattggatcactgaaatcagaagtgggtaataaggagcacgaaaaccatgatgcgggagcatggcattaatggtgcaggactggccacaggtagggccatttggcattacttgttaacatttaatttaatttaattttttttttttgagatggagtctcgctttgtcgccaggctggagtgcagtggcgcaatcttggctcactgcaacctctgccttccgggttcaggcaattcccctgcctcagcctcctgagtagctgggactacaggcacgtgccaccacccctggctaattttttgtatttttagtagagacagggtttcaccatgttggccaggatgctccagatctcctgatcttgtgatccacccgccttggcctcccacagtgctggaattacagacatgagccactgcgcctggccacttgttaacatttaaaatgcacatactccatggcccactctaaggaaatactcatgctcttccttggcaacaccatttgcaggagtgaaacatggaaacatctatgtgtcttttaatgggagccaaataagtggtgctaattctcaactgtgggttattctacaaatgcaagtcaatatggggatctactgatgcaaatagaggaagatttcaaagaagagattctgagtggggagaatgatacagaaggagagatgtgtacttacctatttaaaaactctcgccttcctgctctcatttctgtggagataccaatctctagaataagatccccttcttcctttttgagatgaagtcttgctctgttgcccaggctggagtgcagtggcacaatcatagctcactgtagcctccacctcctgggctcaagtgatcctcctgcctcactctcccacatagctaagattacaggtgtgcacatcacatctggctcacatttgttttctttttgagatggagtgtcactctgtcacccaggctggagtgtggtggtgcaatctcagggtttactgtaacctccacctcctaggttcaagctgattcttctgcctcagcctcccgagtagctgggattagctaccaacatctggctaactaaaaaaaaaatttttgtaagagaaagagtctcactatgttgttcagactggtctccaactcccggactcaagagatccctccactttggcctcccaaagtgttgggattagaggtgtgccactgtgattggcctggaataagatcttaaaatacccaaatattagactaactcgggtcagcctggaggagatgagggggttggtcaaaggtgttgtcttattttagctgaagttgtttatttacttatttactctaacaaggaagctgctctcaagtgtcattaatagaattcaggctgggcacgatggcccttgcctgtaatcccagcacttcgggaggctgaggtgggagggtcacttgcagtcaggagttggagaccagcctgggcaacatagcaagaccctgtttctacaaaaataaaaatgaaaaattagccgggcgtggtggtgcatgcctgtagtcccaactactcgggaggttaagacaggaggatcacttgagcccaggagttcaaggctgtagtgagtgctgtgatcactgcactccagcctgggtgacagagcaaaactcagtctcaaaagaagataaaaagactcagggtcttttttgcctgtctctcctgtgctggtgatcactttgttgaatcctttcttgaagctcctggggaagacatttatctctacaaattggaacaagtgagtcgggctgctgcagtgagggcctctttcccttcatctccctccttgctttgtaagaatcctttgtctggctctgaccagaggagaaggtgggaagtcagcttattgagtaggctgtggcagttcatatgtgagttggggtgcatctagacccctggggcgtctggatctctgggtctggggggcgtcctgtgagctgttagagaaatgggagttcggagttgtcagaaactcgcctcatcctctgggtttgcagactccccacgaggggagtctctgcgctttacaaatatttgatccacattccattttgagcatatttaacatttttaaaatgatcatgaaagcctccactcaagtttgcttcctgccagaccaacagtgggtccacaggcgcctctgggtcagcttgttttagcacagactgaagcagccgtctctgtttaattctataatcccgagtttgcactgtgagctcttgaaaaaatactttagcttgtgttactggctgcagaaaatcataattttcttgatattctgaaactaaagtagaagatgggaaatcttttttttttttttttttgagacggagtctcgctctgtcgcccaggctggagtgcagtggcgggatctcggctcactgcaagctccgcctcccgggttcacgccattcccctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgaagatgggaaatctaaaagattgttgaggtggaaataagattagagctgcttcctaaacttggagtttcaagtttttatggccattataatggaggctcagggttcccacttactgactttttaacagagaatatcacactgttattggttgaattgctcaaaagaagatatgttgaagtcctaacttccagtacctcagaatgtaaccttatttggagaaagagtctttacagaggtgataatttaaaatgaggtctttacggtgggctataatccaatgtgactggtgtccttaagggtcagtttggccacaggccagctcacacaggggcagatgacatgaaaggtggctgaaggtaagagaccacaggcagacgacactcggcttatggacagccgaggaccctcagaaggagccaaccctgccaactcctggcctccagagctgtgagacaacaaattcttgttgtttaagctgcccagtttgtggtgcttagttacggcagccctaggaggctaacacacgcatccacccataagtgcctgtggatcaagtgcagctcactattgattttactttttgggtttctgcctaagaattaacttgaaaaaaaggttctactgctaaactattgctgagcctcgggaagtggggtagtggtggtgagctgtctggccccggccctcagcgctggtcagtgctgcggtcaggagttgggggcacagactcatgaggccagtcctggctggaggcggtgggtgctttgtggagtagctggggctgcggtctgtgtgttcaccgcttgtcatccctgcacttggccagccccttgggcatatggggcacctctgtgcatcctgtcctgtgtccaaggccttctctctgggggtcattgctaggctgcccatctgtctccatcacctccctccagctattggcctggagaagagtcctgagccttgtcacttgtgggctgtgcttggggtacatgatttctgcagcggggcatcccagatgtcagagcagatgaggcagctctccgggggtgggtgctggtagaaagacagtctgcccccagggccaagccccctgatgccaggcgcctagtgctgcccgtcctagggcctttgtttctcttacagggacctgggcaaaaacaaaaaagccaacaaaagcaaacatcctcatggcggctggaattgtggggctgtcagcaagtgtgatttatgcgggacctggaagccctttgaagtaggaggcaaagtggatgcccctggtctcctggggaggctgtgttaggaccaaatggaggaaggagctgccatcctcgccctgggagggtgtgtcagggagctctctcacttttgttccatctccaaagcacaggggtaggccctgaagcagtggacagaaaaagaggtgagctgcgtttgctcctccagcttttgtggagcccgcagggcaggggcaggggtgcttggccagctggctgctcctctgaggtttcctggtgtgtggcagccaagtcatgttgagtgccggaggtggggtatccatggagcggtgcaaggaggagatttgcaatgagcatatttgggggtgtcagtgtggacccaggtggccgccggggacttgggactggaaggtgacttttcacagatggatcctagtggatgctttagattgaaatgagatgcagaattctgtcttctgattgtattaacagtgctgtcaagaacgtaattatgtaagattcaaccagctttcttgacatctcagttttccttcaccatttgcaaaatttagtgtgtcatcattttagtttggaaattttattttggaaataaaatgtcattattattttcttttgaaagaaggaaactccattgttttgcaaggcagagctctgacacaattacgtctaattagtgaagtgttgtatatgttttcagagttcaaataaggttcacgtactctctttttgttgttgttgctgttttctaaactctgagctcatttcttttctttctttttaagaaaataataattttaaaagaactaagtcaagtttctcatagttgaccaaccacacatttctatggggccctaaaaactcagctgtttaaaaataaagcaaaatgaaaaagaaagaacaacagccaaatgagggtatacgttgaactactcaggattaagtttaaacaaatgcttttcataattgctgtcttccccagccagaaactaaggcctgctgtgtgctttgggtgtgtgggtgggtgggttgctgggggaagggtccttgtaatattcggggagttttggctggggccaattatttgttcataattctaagtatttaaacaatgctacgtattttctgtcttttatggaggcagatatctctaagtggcccctcctggtgctggggtatgatcaaaagggacttctgtaagttttcactggactgctttaattttctatcagaacagtgtatttagtacttgattaagtaaaaaacaagaaaaaaccaaaactaaaaatctagtaacacatgttgatgatttgaaaaagaaaccaaaactgagaagggtgtgattgaagagcacctcccacttctcccttttcactcgcccccccgcatccataaacacactgaacagacttgatgcttcattcctgatgttttctgcgcacatgtgcttgtttgtgcttctcctttatttatttttaaaaattctggtaaaattcgcataacataaaatgaatcatgttaaagtgaacaattcaatgtcttttaatccacttttattgttacttgaccattactaccatccagttcattttcatcacccccaaaggaagtcctctacccattaaccatcactccccatttccccgtccccgcctttttcctagcctctggcaaccgctaatctactttctctccctgtggatttgcctattctggaaattttatgtagaaaatgtcatgcagtatgtggccttttgtgtctggcttctttcacttagcataatgttttcaaggttcatccacattgctccattctttctttgtttttatacacagtgagatcataccatacatactgaggtttgctgttttcacctaacgatagttctcataagtctttctgtattagtacatgccaggctacctcatttttaaaaaccattgctaatatctgtcatttatgtatacattggtagtatctgtcattaaaacaatttgctgatagctctcatttggaatttatttccctggtctcctgtggatgtatacttctgatttttagctattacttgaaacaggtctgtagtgaacatctgtaaacatatttttttttttaactctgtgagtatctgtagagccaatttccagtccagtactttgtgcaaagtattatattttttgagacagtctggccctgtcgcccaggctggagtgcagtggcgcaatctcggctcactgcaacctccacctcctgggttcaagcgattcttctgcctcagcatcctgagtagctgggaccacaggcgcgtgccaccatgcccggctaattttttttttgtatttttggtagagacggagtttgaccgtgttagtcaggatagtctcgatgttctgacctcatgatccgcctgccttggccttccaaagtgctgagattacaggctaacgcctgtaatcataggccactgtgcttggcctatgtttaaacttttgatactgtctacaaagttgttttcccagaaggtggcagcaatttattctcccagtaatgatgcatgaactttttgggtttttctaggcccagcaacattggaaatcatctggcattttcatcttaagaagtatgaaaaatagaaatggcatcttaattctgtatgttgacattttaacaattgtccaccaggccaactgtccttataagtaatttgtgtttcttttttctggcaaataagcgttcactttctctactaattttctagcagttattctcagttgcctcactggtttctacaactatttctgttttcttttctttctttcttttttttttttgagacagtctcgctcagttgcccaggctggagtgcaatggcgcaatcttggctcactgcaacctccgcctccctggttcaagtgattctcctgcctcagcctcccaagtagctgggattagaggcatgcgccaccacacccagctaattttttttttttgtatttttagtagagacggagttttgccatgttggccagcctggtcatgaatctaagactatttctaagaatatttagccatgtaccagattctgtgaacgtgtttttttcctcacgttctcctttgattttttttatgatatttgttttcatgcggtaagtcttaagttttatggagtcaaattaagccagcttttgttttatatattttgagttttgagacatatattagaatccctttgccattctaagcttgtttttaaaaaattatgctgttttgggtaggttcttaatgatctttttttgtgtgtgtatggttaaatcttcggttcacatgcaacttagatccagctttattttcctcagaaaaatgaattgtcctgaaattcttcattgtgtaattaattccttatcaaagatttgaaaagcagctccctctttttttgggtattaaaattccatgatagattggtgttatttctggaaaattcagtttttatctcacttttaattaccatagctttctaaattttggtatttggtaggactaactctttactcattgttcccagaactttattggctagtgtcacttatttttctagataaactttagaacaattttattataagtaaggcaagttcttaaggctataaattgtcccatgagtgtagctttagctacagcttttatgttgtgttcatgttgcatgatgtttttagtattgttcttttccaaatagcttgtcatctcaattttatttcttctgcaagacaagaagaaattttaatacttgtagggagttattttgtggttttattgcattttgtgtagatagtgtgatctgctatgttttggttttagggaatttgatttttttttaaatggcttaaaatttggttattaagtgggaccttagatataatctcagttaagagcaacttcattggttatatagtttagtttttctgtatcttcacttacacttttgtcttctttatctgccctaagtagagagaaaagttgaaggtatcctaagccattattttggtctgtttctctgattttgcttcagattttgtgttgtgcttttggacactgggatgtcttttacatatattcatgacagagccttactgagaattctactcttaatcattttaaagtgtcccttttacttctaattaaggagagtatgacattaatattacagttcttccttatttgtgacttgcctggtacatcgttgccatttaaaaattttctatcttctagttgtttggattcagacagattttaaatataacaaatagttttatttggagtttaatcctattgtttttttcttcttgatatttattttccctcagttacacttactgagataacatatttgatctcatttttgtcacatttgggggagcatagtttctatttttagtgcctccttttttctcccttttgtttgttttctttgacttttatgtaaaatatctgtccaaatccaagtgattagaaggtaaaaaagtgaaaagaaaggcaatgatgtaccagacaaatactatgaatttttgagattcagcaacttcaccagttcatgctctgataatgaccagccatatccattcttcttgggaattaggtcttcagtctgcaaattaagtcttgctttattttggcttcattttcatccattaaacgtttgaatccatgtgtttctgtttgctgtattctgtttttcaggaacaccgcttataggtgtgttgtatctcagctgtctgtagccagcatttctgtcctttctctttgacttcccctgacacagtgatttgtcaatcttgcccccatgatgaactcacttttgcagctttacattcctctggtgtgtgttagaaacaagtgcccagtgctgcaaagaaaaaccagcacttaaataggaagtttctcagcaaggcacatttacttctgcagaagagtgctgcttgtgtttgtcacgcttgcaagagcacactgaacaaaggagagaaggggtttttatccctaatgcagcttctgtttctgtttccttctcctattggctgcagtcggaccacacagtctaagctgatcccgactggctgagacttaaacttttccaaacagggtaaatgcgtggaaagaaggggaaagtaggagtagtttacaatttgtgactaaaaagttgagtctttgtttctagcagtttgcacagcaaaggtgggaagcgttattaacagaacaggaaagagcaagaacgtttgaagaggaactgattgtttccagcatgtgggacctaggtctgtataaaagcttccaggtgactctaatgtgtggctagagttgagaatctctgcttttcaggggagctttaaaaaatatggtggctgggttggtttcctcctgcttatgatttcaattgtctggggtgcagcttgggtgcccagatttttttttttaaagcttgcagttaaaactagtgtgcagtaggggttgagcagccactgcagtaggacacagatctgggaatgaaaacaaagacagcacattttcttggcctttccttcatctttgctctctgtgttcaatgatgtgggagtcaggtcccggggaaaactctgtggtactcaggatcttgcacgcccctggccttagcacccaggaagccacttgaggtagtggccgtcctcttcctggggtttatggaggtgtgttttggcttttggtgcccactcttgatttgtttgacctttctgggtggtttagagttgaggctcctttgggttttcttggacttggagcagtgtgaagcaactttgctctgtcctctgtcattgggagccacctgcatgggtgttggaatgtctttgggtcataagttgaattgaaaagaatgcccgtggggaccagaggcaaattctggtgctggttcttttgtgtctctaaacatgacttgttctggaggtgttgcctcagtctcttgatgggatagaacattggctgtgtgggatggaaccccctctccacgggttacaccttgatgcacttgtcttatcctctgagaagctgcaagggcgtccatgctgaccactggcgtcatctcgaagatgccatgcctttgcggagcttttaaattttcctctgtggctgcggtaacgttttgcaaagtggatttcactgtgcccccctcccttgcgttccttcacagaatgacaaagcctccagggtgggcacatttggaaactggtgcagcctgttttacaaaaacctgctttgtattttctaacatagtgtttctcaaacatatttgatcatagcgctcttttattttggggactgtgttaggggaaatacgggtgtggaggtttactgtttctgattctgtggagccacaaaaagtcaaatcgtgttcccatgcaggcacaaagccacagtgcccatgcttccttgctcgacagcatgaacccagccttctgcagagaaaagcagtgatactgtgcaggcatggctggttttcttgccagtctttctattcaacacctgtagcaaaataagcaggataattgacatgacggcttttcaacattcagtcctgatatttattgaactagtgatgtagatgaggaaagtgcagggtgcacattttctcctgtggagcttgcatgattgacaccactgaacgggggtcctccacttactatcatggggttcttcagaagcactcctcagcatgtgattcatgccaggatctgccctgctttttagatgaattatgtcatttagtctttgaaacagtctgtgaggggagatgctgtttgtcccttttacagatggggaaactgaggtagagagaagcagcatgccttgcccagcattatgtccccagaatggtgaatctggattcatctggggcagtttggctttccaagactctgctctcccatgagaagcccacagtctgcctctttccttgcccagggtcagcggtgagcccacgtcagagtggtgtaccttcctttctttatgtggccaccagggcacagtcccacaccgtggtgggtggcatcccagtgatggtgccagagggattttacatggaaagattttgttatttacatttcctaagagaagggtacctgccatgccacgcagggcctcaagggcagcagcaggttgggttgggaggcagaggggcagtgaggggattgggaaatacaaggcagtgggggacggttccagatgggctgatgtgactcttgttggcaggctttggggcctgggggtgggggctgttcctgggtgtctggtgcctggtgcctgccctggggtcacatagggccaagaagttggcttggcgtgtgaatgtaatgcagaaggtggtggcaggtgagtgtgatgcaggaggtggcgggaagtggggctctagggtggttggtttgcataagaaaggcgagctcccagtgggccctttgctgtctctaggatttgccaggcctgggaagggcagtctctagctagtggggccacaaatgcaggagcatcaaggatacagaaaataaaatatagttgatacaattgaccctgtgatgaatggatgccaagtagacagttatagaatctagaggctgggcgcggtggctcacgcctgtaatcctagcactttgggaggccgaggagggtggattgcctgagctcaggagttcaagaccagcctgggcaacatggtgaaaccccgtctctactaaaatacaaaaaattagccaagtgtggtggcatgcacctgtaatcctagctacttgggaggctgaggcaggagaattgcttgaacctgggaggtggaggttgcagtgagctgacatcgcaccactgcactccaacatgggtgacagagagactccgtctcaaaaaaaaaaaaaaaaaaaaagaatctagaaaacacagagccagccacagagggcacagagatagggtacggaggtagcaaatggaggtggtgaatggaggtggggcatggaggtggccctcggacttttttctcccctggtcccccttcagggtcctctggctttggagtttgtgtacggtgtttagttcttcctgcagtgagtgggtcagcaaggacttttcttgcaggcaggctgtgaagttacacttacctgtgtaatggtttggggatttggatgagcttccaaaagccgctgagggcggtgaccaccaagtgaccttaagatcctggtttttgggggagctgtgggtctctgacctggagagtatgacctctaacccagctgtgtccaggacgcagtttgggtcttgaaagacttacggtctgaaaaagatcactttgctctggtgggctgagtatggcccatgaaatggggcaaaagagcaccgttctaccaaatttaatgatataacacttcttataaaaaacgtgttatttttttctttttaaaattttggtattaaaatacacaaaacatagaatgtgccatcttaattggttttgagcatacagttcagcagcatcaagaacattcacgttgctgtgcagccatcaccacctcactaccatccatctccaaaactgtttccccttcccaaacagaagctctctccccatgaaacactacctctttattccccgctcctgagttcctggcaaccccaattctcctttctgtctctatgtatttgactacgctggggacctcgtgtgagtggactcgtatagtgtttgtcctttgtgcctggcctgtttcactgagcgtgatttcatcagggttcacccggacgtaatactcttaatcttttaaagaaggtagatggatttctacatctggctacagtgattggagtttaaaaaaatgtatcccatgtttatgtgtttcaaatcctgttgcaaggataaatataggatgtcttctttttttttttttttttgagatggagtcattctgtcgcccaggctggagtgcagtggtgtgatcttggctcactgctacctccacctcccgggttcaagcaattctccagcttcagcctcctgagtagctggcgttataggcatgtgccaccacgcccagctaattttttttttttttgagacggagtcttgctctgtcgcccaggctagagtgcagtggcatgatcttggctcactgcaagctctgactcccgggttcacaccattctcctgcctcagcctcccaagtagctgggactacaggcgcccgccacatgccctgctaatttttttttttttttaaagtagagatggggtttcaccatgttagccaggatggtctcgatctcctgacctcatgatcctcccgcctcggcctcccaaagtgctgggattacaggcgtgagccaccgcgcctggcctaatgtttgtatttttttagtagagatggggttttgccatgttggccaggctggtcttgaactcttgacctcaggtgatccgcctgcctcggcctcccagagtgctgggattacaggcgtgagcaaccgcgccaggcctaggatgtcttcttaagtgtgcacgcaaatcatgcaggagaaattaggcagagtgcgtggaagccaagtgacttgtttctcaccaggaggaaaccccatctctgaggtcagttggtggcttctctacccaggtgtctgttgaacccagagtggtgtcacacctcaggatcggtcccccaaattctgtgcaatgaaagggtagagtgagcgagttttcttctctctggctctctggcaagcactcttgacataggattgctgttactctgtatttgagttcctatggattatccatctgttggttttctgccatccaagaaacttaggtgtgtgcatgtatttggggttggaggataaggatggcgagggcattgggaattggggcttgtgtggaggtaagtcataagtttgagaagaaatgggtgcatgtgccaggcaccaaaacaagtgcatatgcatgctgcacacacacacacacacacacacacacacacatacaggcagctgacagcattgtcaggggtgtgtacctgtgagctcacttgtgctgagcaaggacagagcttgccgagctgggggctgggtctcgtgggcttgggctgagctgttgggatggctgaaggctgtatcttgggggaagtgcgttcttgagagctgtgtaagttaatgtctatgagatgagcagatggttggtgtcatgagggtgtcctcttctagaagactagggccctacagcgatggttctctcagtggtgtctctggaccactggcatcagcatcacctgggagcttgttaaaaatgcaaacatggtcaggtgcagtggttcacacctgtaatctcagcactttgggggaggccaagatgggaggattactgagcccaagagtttgagaccagcctgggcaacatagtgggatcctatctctacaaataataataataataaaaaatagccaggtgtggtggctcgtgcctgtgatcccagctacttgggaggctaaagtgagaggattgcttgagcctgggaggttgaggctgcagtgaggtatgattgtgccactgcactccagcatgtatgacagagctagaccctgtctcaaacaaacacacaaacaaaacaaaaaaagcaaactcttgggcctgccccgcgtctgttgaatcagaattttttttttttttagatggagtctcgctctgtcgcccaggctggcgtgatcttgtctcactgcaagctccgcctcctgggttcccgccattctcctgcctcagcctcccaagtagctgggactacaggcgcccgctaccacgcctggctagttttttgtatttttagtagagatggggtttcaccgtgttagccaggatggtctcgatctcctgacctcgtgatccgcccgcctctgcctcccaaagtgctgggattacaggcgtaagccatcgtgcccggcctgaatcagaaattttgaggtgaactcagcaatctgtgcctctctaatgcacgtaaaagttgagatccactggctgtgattcccatagagggcctgggacaggaggacgcaggcagaagccactggccttgaagctgcctgtcactccaccacaagggactgagacccgatggacaccttcctccagtcctccccttgcctctctccaccgcagggactaggagggatggccgggcagtccccagcgtgaccacaggatgcctgatgttgggagtggggacaaaggataggaaaagggctgggcagcaggagggatcacctaccatggaggacaaagaccttgccctcaagtgtccctcccattcatggagtaccagctcagttctactcagtgcagacaggcagcagaacagcagcttggggagagcaggaaagaatcagctgccaatgttgtagtggagacggatttcagggcctgatgagggtccaagtatggactgcaattgggatgcatgagaacatcctcaaaccctggaataggaaggcacccatgtgccctgatttctcctcggctctcattccaggagccacacaggacagttgacccaacacttctgccacctgaagaacgacacctgcattcctccatctctgggaccaccaaggaactcagggagcttggaatctctcagatcaaaaagatactgactcatcggatagccatgccatcctgaaaacggccttccttgtgtgtacattatttgcaacaagcaacaagtttataagcactttggtaaaattgcatgtgagggttaaaatattaaagtcagtgcgtcaacttgaaataaatgatgagttattgattactgctaaagaaaaaatgtaatatttgtggtcctgttatggtttagatgtgaattttaaaaagaaagcctttgttcagagttttgcacatttcctcaaccctgggtctccagagctttgttttgcttgccaagtcttaaattagccatctgcaaatttccttaccttgggtatttctggatataggaggatgcccagggtgtgcattgttctgtagctgtaccgtccaattgatagccattaatcacatgtggctatttaattgaagttaactcagactgaataaaattacaaacagacccttggctgcactagccaaacttaagtgctcagttgccacataccacatgtggctggaggccacactggacagtggagatagagacactctccctcttcacagcaagttgggcagtgctgctttatactgcctcatccccagcattttggccagtcataagtactttctgagcacctgctctgtgcctagaggctgctaacttgttagcttattgaataaaatacattgggcatcttctctgtccaggtgatcactgaattccttggcatagctacttaggtaacagacatctattctttggcatgagggagaggctttatgtatgtgaagatggaatggagctgtattgggcagtggggagtggggaggtcatgcccagcagaagtgaggcagagtgagtctgttggaggacagggctttgagaggcaggctgccccagtgtgcacccagaaaggagggcaaaaggctgagcagctggactggggttggatgcagcagctatgcagctgatttggagagcctgacatgagaggacactgaggagtcgacaggttttggagaagattcccatctaatagttttaaaaaatattcttggtcgggcgcggtggctcctgcctgtaatcacagcacttcaagaggccaaggcaggtggatcacgaggtcaggagatcgagaccatcctgactaacatggtgaaatcctgtctctactaaaaatacaaaaaattagccgggcatggtggtacgcgcctgtagtcccagctacttcggaggctgaggccggagaatcgcttgaacctgggtggtagaggttgcagtgagctgagatcatgccactgcactccagcctgggcagcagagtgagactccatctcaaaaaataaaaaataaaaaaattatttaagtagaacaacattcagtatggacatcaaactgttgatatttaacctgtttcttatttgattgcaaggaagatgggactcagagaagacgctgttgatttccaagtaacatttcattcacaagtcttcaatttcttttgggtacatacctagcagtagaatttcggatcacatggtcattccatgtttttttttttggggaactgccagacttttccacagtggctgcaccattttgtattctcaccagcagtattccagggttttaatttctctacgttctcaacagtacttgttttctgtttttgttgttgttgtttgttgttgttgttgttgttgttgttgctgttgtttggttttttggtaatagtcgtcctagtcctaatggctgtggagtggtctctcattgtgattttgatttgcattttcccagtgactaatgatgacatcttttcatgctctttttggccagttgtgtattttttttttttggagaaatgtctattcagatcctttgcccaatctcaccttgggttgtctttttattattgttgttagagtttcatttacttttttttttttttttttgagacggagtctctgttgcccaggctggagtgcagtggcgcgatcttggctcactgcaacctgtctcccgggttcaagcgattctcctgcctcagcctcctgagtagctgcgactacaggcgtgcgccgccacgcctggctacttttgtgtttttagtagagacaggctttcaccatgttggccaggctggtctcctacttctgacctcaagtaatccacccgcctgggcctcccaaagtgctgggattacaggcgtgagctaccacacccggcttcatttacttttaaaagactaaacattaccatccccttgaagttagaagggaagaacttggtgacacaaagaggcctgcggcttggtctgcaattaagcacaggctcttgaaaagtgtcctcttttgccagtgtggtttgggatttccacagcctctgcattctattcctgattctgctttacttttgccatatatgtaagtgtgtgtatacgtgtatatatttaagaacggaggaaaaaatataattacttttaatttggaattcctgttttaactttcccctatattaaagaaggactgattttgcatgtacttaggctgaagtagccacttctttgttgatatggggttgaggtcttgattcattttttcctgcaggtcagagagcactaggacatgcccagggccagtttgtgggaccctttgtggggaagggacagtgcttctcctgtccgctacttcttgtggctggccacctgccatttggcacctggttgaggatgggacatgagtgtccactccacagtgctgtgttcaccccctcgggtggaggtccagtttgttggcaatgatactgcacacaagctgtctgaggcttggctatcctaaacagtctctggctggtttcaatatgagttattttcatattttagtgtataaaacctccaatttacattttgatgcagatcagtgaagcacacccttggtccgtgcctgagtgcctggggccacattaattaaattatgttcacttcagatctttctttgtgccccatagtggggtctccgcctcttctgcctgtagctctgtcacctctgaacatatcgtctgcttgacctatctgtcatgtgtatttgtttttatctgcttcacaccccagagcagacatcttcatttgctttgtcgatatgctcccaagtgcctggaagcacctgagacagaccaggtgtttaggaagtacctgctgaaggagtgaaatgctaggcttcctcacctgatctctgttcccttgcctctttctgaatgtctcctgtgggcagggtaaagcattgtgtacttgttctttttcttttccagacagggtctggttctgttacccaggctggagtgcaggggtgcaatcatagctcactgcagcctcaaactcttgggcacaagtgatcttctcacctcagcctcccgagtagctgagactacaggcatgtgccatcatgcccagctaacttttaaatattttgtagagatagtgtctcgctatgttgccagggctgatcattaactcctgggctctagtgacctcccacttcgacctctcaaagtgctgggattataggcatgagccactacgcccggccatcgtgtttattcttaagcacaagtaagggcttaaagttaaagtaaaaatgctttttaaattttttcctttaatgaacatggaattcattgaggttttgattcttttataattttttatgttactcaaaagagaaggaataatatctcctcaaactttgtttcacaaatggcctgttgatattgggagttgagtgggatttatgtgctggcttctgagggggtcaagggagcctggtggggcaggtgtgggatggcggtgggtgctgctccaaatattcccttctaaactgttcaaaatatttctgaaagttcaggttcagtaaatgctggtaccggttgttggttctactctcctccgagtccaccccagtggttgacacctccatgaaggtgggctgggaaaccttcccaggaagggtacaggaggaaaagtgtgagatcggccaggctgggtgaaaccctccccactccggcccccaccctgcaggatgaaggagcagagtgggctgggggaagcagctgccagtagactttatatcatcaaccaccagaagggcaggttttccaggagacttagagctgaatgggtgtcataggaaccctggtacacatttggtaagaaagaaaaaaaaacctaaatgaggctgaatgatcctctgagaattttgaagaatgttaatactgaaagtgaggttgaggtgtaggattcatggtgggcaggttgtaaacctggtgtttccgttggattcagatggtccagtgctcggagacagcgaggaatttgtgggttctcctgaaccgttgttattacacgagttggcctttgctttgatgtgaatttatcctgaatgaatttggtatttaaagaaagaacagtcaagaaagcagagtcttgtagagatccaaggcataccatattttacgtttgagctcaggaattctggttgcctgagcatcaactgtttaaaagcaaggggatcgtgcctaaaagccctaattattgtcagtagcaattacgaatgtttattaagtgcccatttaaaagccaatattgttatcctggcagtatgaggaagtagtatatttatcatgtagtatttgtccttaaagatttctaatctacctgggaagctggactatatgtgttaaaacatgatgcaaataaaatcctaggcagtctggctgtgttgagtggagtggtctggaaatgaggtcacaggggtgcggactgcagagaggggcggggaagacctcagagagggacactcagtctgtgggcatgacaaggacaggggttggggggctgtgtacgtgtgggcttattgctgaattttgccttattttgctttttcaacttcagtcatctgtaatgaaaggagcttttgctacatgtaagccagccttttagagttgaccaccagttatgtgcacaggacatttgtaggctcttcctgtcccttttattttaacaacagaattcttaaaattaagagatagaatccacaagccaatacaattcagcttttcggagcgtacaattcaccagtttttaagatattcacagaatcgtataaccatcactactatggaattgcagaaaatttttatcacttgcttctgttttgacaacatattacattgtgtcataggagactgcctctctttaagcccgtttcaacctacaaaaatggcagtttcctatgttcaaacctaatttacctactgtcaaacacttgtcttaaaagccctcctctgaaagctagcatgagatttttcctccaccttcttttaaactgtcggaaagtatttagggttagggaaccacatgtgctgagaacagttaagggactttatagggagcctagggttggggtggcttcagatctttgcaagtctgttaagtgggagaacttgacctctggccctgtgcccttcaacaacttcttttttttttttttttgagacgagtctcctgtcgcccaggctggagtgcggtggcgcaatctcagctcactgcaagctccgcctcccggattcacaccattctcctgcctcagcctcccaagtagctgggactacaggcgcctgccaccacgcacagctgatttttatatttagtagagacggggtttcaccttgttagccaggatggtctcgatctcctgacctcgtgatccgcctgtctcggcctcccaaagtgctgggattacaggtgtgagccaccgcgcccggcctgtgcccttcagcttctaatgggaacagttaggatcactgggtggaggttactgggacaccaatttcagtttgatacaagaatgagctttctacttataaagctgcctcactatccagctctgtgcagtgtccaggtgtcattgggtgagcttggatggaggcagaaggatgccctgcactgtggcctccagtaggagtgccctgctggcctgtctggctttgctcacttgtccagatgctctcctgagcaccccaaccccagtgtgcacccacgcatctctctcccctatgcagctctacaccaggtacgctggttttgcccaatgtggggagcaccgttgctgtgctcagcctgcagaagtgggatctgtgcccgctgtggggagggttggccaacgttgggtgcccaggtcttcctgggcatgctttccagggtttctagcacatttccttttcagcacagatgatgctcttaaagattcggggtgtggcccaggggtgccctctcagtgaggacacacgagcttccctgccctctgcataatgtgtcagcgtccacacctccagtctgggtccttttttgtgacatggatcgtacttccccatgaactccagtctctttcttggcgttgtttctctgcacgtatcttcttctcgcacgtgtctgggtttgagattatttttcctatgttgatttttagatggtattggccaaagtgtttagaactaagaaacctacagacccagcgtaagggggtaaatgacagcacaaaaaatagaacagagagtctgtttgaagagggaatttgaaattcatgccagaccaaaaatggttgagctgaagcattgctcttaaattgtttaagggagtgggaagagtgcagtggggtcaggaggaaattaatgaacttcaacgaaatggttggtgatggaaaacatataagcaacacgtgaataaacacggggaattaattttggagctgctgggaaggagtaaaactaaagaataagcaaggaaaagcagagcgtctgtgggggcagggaacattttccactccagcatgggacaacctcgaccatctagtgaagcctcttctttgaaagctcttgagagaatctttctaccatgttggtggccgacttcacctttcttcctcctttgccagtttcttgggagaaaatggtagttaagtatttttgtatgataaggcttcagattctaagagcgattccaagatttttttcttaaattaccaggaaaaaagtccatatatgaaatcccagtgtcaggacctggaaaagggtcccaaacacattggcatccacttagatgctttgctagcagtctgaattaccataaggaaaaaaccgtacataatggaaccagatgggagtggctggctaatatttggaattctttccacttaagaattatcttaatttgaggaggatctttgaagtccaggggaagttgccaggtggggaagagggagttctgtgggtaaaggtgaggggcagggtgggagcccagggtttccctcaggactccctgcagggagtgcatcagggctggcctggctgcgacaggtggggcattgcataggcaaaatgcttggcgagattaaagaattaaccaatataaagtcaggggagcatcacctgaacaaaataagctaacaggatttggaatccacgtaagattatccatgacttagaatttctaattccattccagggattttggctcctagcaagaacacaaaaggtgccaaaaagattagttgcgggggaaacaaatttccgtgattagatcaagacaactttggctgctaggagcagaatcacccttccctcccttcttccttgttgctttcctgcgtggaatgagttacagccaagatgtgacttcacatacatcccagggcctctgctgacagatgctataacacaattaggatggaggtgttagaattgtgcaacactcaattctagatcctgccagagcctaagccaggaacttggtctttgcctcgcctgcccctcattttgagaggtgaagccagctggatttctgggcggggtgaggacttggagaactttttcgttttataggaggattgtaaaatgcactaatcagcattctgtatctaggattgtaaaaagcaccaattagcgctctgcgtctagctagaggtttgtaaaatgtgccaatgactgctcagtaaaaacataccaatcagcactctgtggttagctagaggtttgtaaaatggaccaatcagcaggatgtgggaggggacaaataagggaataaaagctggccacctccccccgccccccacctcccccaagacagcagcagcaacctgctcaggttcccttccatggctgtggaatctttgttctttcgctcttcacaataaatcttgctgctgctcactctttgggtccagtgccacctttgaaagctgtaacactcactgcttcattcttaaagtcaggaagaccacgaacccaccggaagaaaaactccagacacaccacctttaagagctgttaacactcactgtgaaggtccgcagcttcattcttgaagtcagggagactgtgaacctaccggaaggaacaaaactccggacacactttccccattgggagatggaaatgcaccaacctcttccccaggggtgccagagaagatgattccagttaaaagggggctgctgttggtgtctatgggagccgcgtgtggtagtcacagtcctcagttcccttcacggtcctgtgccaggtggaggccgctgcacctaagagtcctcatgttggggatgacaactccgaccagctgctgagcttgggttgagacttcagcaaccataaacgccaggtagcagggtgaggtacggagccgcccctgctgttctcgggatgatgatccctttgttcaaatggctagttcctgatcctagaagcagtgatgattccagatactacatcagagggatggaaatattctgacaggggtgatggacccacctacccatatgaaagatgataaatgtactcttcaatggtgatgctgagtggactggtgacgtttaatccagaatttaggaaagcagctggaaggccaggccctgtgtaagtttgccctgtggacctcctttgtgctcctgttcaggtgctcaggagcaggaaggggccaggtgacccctagtcatgacagatctacacctgccgtggcaatcacggttgcctttgtcagtgattggttgtctgtgactgcaggtcctggttctgaccaatgagatgtaaggggggcggggcttcctttccaggcagaggagttttggggaaaagcctctcccctgccccgccgtactgtttagtcagtagctggtgtgatccctggagcggccactgtgcccacaaggtgaccggcaggaggatggaaagctcattcacaaccccaatgggagggaaagagaacctggacctcggtgacgtcatgaaccacctccccgcagctctcttgttaagggaagattcctttatggtcaagagttttctttcataatacagcccaaaatatcctcactgctagaaatgaaggaagttgtagtacagggtatctcttgggaatttagtttcattctagtgttcgattttctgaactaaattgaggcctcctggaggtttaaactctgcacatttgaaatatggccacgttatgcttggctgggaataagctatcaaccaagtgataggatggccccgtggctcgaagggaagcgcctttgtacttgagttcttagcttacacacagtataaggtggccagacagtggagcgtggcccagcaagcacacgggggcattggcacttggcagcggtggtcagacttggggaataacagcatgagatttttttttggttggcaagagtttctggctggaaactctccagagagactttaccatcttattttgtaaaagtcttttttaacattaaaaaagttaatattcatgcaattgaccaaggggccatttttcagtgtgtacactgggtggcattaagtacagtgttggacagccatcacaaccatccatctcccgaacttttcatgttgggaaactgagactctgtccccattaaacacaactccccacttttcccttcccccaggccctggaaaccacccctctactttctgtatgcatttgattgctgtagatacctcgtatgtgaaagctttttgaaaatcagattttttaaactgtcaagattggtgaaagtacagactggccggaacagaggaggatttggggagtagtttagagagtaaatccattagaggttgaagtagtcccttcccatgccaactatgggtacctgggtttgtcccagttgatgtcaaagtttttattaacggtggatccaggggcagctgttggtaattctgtcttctacctgggcagttttgggtttgagtctccagaaaaattggcaagttcttatctcagctgatacaacatagaattttttgttgttttcatttattagcaaagcaagaatctttttgtctcttctctggaacaaagagagaaaaaaaatcaaattttggaaagactgaaagtgtgattcattccaaagaataaaaatctgctcaaccggtatctactgtgaatcactgttagtggtgcatttgaaggctttgtatcagatactgctgtctgacctgtttttgtagttattttcaattttagtaactatagtcgatttttcttttaaaaagagtaccattgtatactctctgctggcctttttttgttttgttttttgtttgtttgtttcttgtttagatggagtctctcactctgttgctcaggctggagtgcagtggcgtgatctcgactcactgcaacctctgcttcccgggttcaagcgattctcctgcctcagcctcccaagtagctgggattacaggtatgtgccaccacgcccagctactttttgtatttttagtagagacagggtttcgccatgttgggcaggctggtcttgaactcctgaccccaggtaatcctcccgcctcggcctcccaaagtgctgggattacaggcgtgagccaacacgcctggcctgctggcctattttgtaagtattcctatccatttttatggtcttaagattagctaaaaatgaaattattctattaacttgaatacttaagggaaacaatattaaaatattacatttaaaaattatttaaggaatagttatagctgataaatcagaaatattccagatttttcctgttacatgtttgttaatttttttcccaaaacacttaagcttcacattcttttaaatatggagatttttgctttgactttggaagaaagcacatcctggcagaagaatacacagaagcatacttttaattttgaaataattttatttttaatatatttttattgatacatagtagtatatattttgggagcacatacggtattttgatatctgtatacacaatgtgcgatgatcaagtcaaggtaattgcaatatccattacctcaaacacttctttttgtgggaaacattacaattctagccattttggaattcataataaattaactgtaattttgctactgtactaataagtaggaaattttaggcgtacagaaaggttgcaaaaactgttccatattccctttaactcggcttcccttaatgttaatctcttaagtcaattgatacattttatgaaaactagaaagttaatattggtatactagtgatactattaaggaagccacagaccttgtttgaatctctaattagcagttttctcactaatgtctgttttgtgtgatccaggatcccacattgcatttagttcacctgtttttctaatttgtttctagtttgtgacagttcctcagtattgccttgttttcctgaccttgacactttggaggagtacctccgataaattttgttgaatgtcctttaatttgggtttgtggtttttttttttttttttttttgcttagactcaggtaatggacactgggcaggaagacagcagatacaatgttgtgttgtagcaggaagcacgtgaatttctctgttccttttctggggatgtttactttgatcactgggttaaggagctatctgccagatttctccaccttaaagctgctgtttttcctgtcttaactagtatgtatcttgccagaagatactttgagtgtgagtatactgtttctcatcatgttctcctccactaattctagcctccatctgtagtttttgcttgcagtaataatgatttcagcttttgtctagtgtggctttgtatttcaccatctcttctgcatttactaattggaattctttggtccctacttccctatctatttattgaattatttattgaagcttattttaaaagtatggtaatgcgccacgtaatgtttcggtcaacagcagaccacatatacaatggtggtctcatacgattatatcatattttaactgcacttttctgtgttagatgtttagatacacagatacacagtgttgcaatgcctacagtattcagtacagtcacatgctgtacagggttagtgcaggtgtgtagtaagctgtaccatccaggtctgtgtgagtattgtatactctgatgcacgcatggcaacagaatggcctgaagacgcatttctcagaatgtatccctgtccttaggggacacatgactatagtttgttctggtgcattgttttcaaaaagagcctgtgtgtagaacactgcattttgtatattttcaaaggaacaggtggtggggtagtgtgcagatgtggaaatgggcctggcaacggccagatcccttcctttgtcccaggtattgtttggaagcatcatttgtagtgaatgactaatagtgttctgaagcattttctattgttctaagttgtttccatcattctatattattaaaagtattacatagttggctgggcgcggtggctaacgcctgtaatcccagcactttgggaggctgaggagggcagatcatatgaggtcaggagttagagaccagcttggccaacaaggtgaaaccccgtctctactaaaaatacaaaaattagctgggcatggtggtacacgcctctaatctcagctacttaggaggctgaggcaggagaatctcttgaacctggaaggtggaggttgcagtgagctgaaatcaggccactgtactctagcctgggcaacagagtgagacactgtctccaaaaaaaaaaaagtattacatattttatgtatttaatgaaaaccaattttctttgaatatgatgcttctctttatgtagtttggatattaacctgttattagatgtatgatttgcaaatattttctttcattgccttggttgtgttttcactctgttggttgtttgctttgatggatagatgtttttaagtttgatgtagtccagtttgtctgtttttgtttctgttgcctatgtttttgatgtcatatctcaaagtcattatttaagcatagattcccatatgtaaaattagtaagtctcaaagatatttgggggtggagatactagtaatagtagtaataagcccagatattttggagttgtttgataagtctggccagattgccttcagcacacagtcatcaattcaatctccagtctgaaatgtctggaattgcctatttcacatcaccagtgccagcactgggcactgacatttaagtttcttttctgctaaattgacaggttaaaagtaaagattggctgggcatggttgctcacgcctgtaatcccagcactttgggaggctgaggtgggcggatcacaaggtcaggagtttgagaccagcctggccaatatggcaaaaccccatctctactaaaaatacaaaaattagctcagtgtggtggtgggcgcctgtagtcccagctacttgggaggctgaggcaggagaatcacttgaacccgggaggcggaggttatagtgagctggattgcgccactgcacttcagcctgggccacagagcaagactctgattgaaaaaaactaaaaaaaaaaaaaaaaaaaaaaaacaaaacaaacctaaaaaaaaaaaagaataaagattatcagaatgcttataaaatagctaatgatttgaagaaaaagcacagtatgtccagtatgtctttactttagaaagacataaagctttccaagatattaaaacccatagatggaacaggaggaaaaaccagatccttcatacagttaaacataggagcctggggccgagtgtggtggctcatgcctgtaatcccagcactgtgggaggctgaggtgggaggattacttgaggccaggagtttgagagcagcctgggcaacatggtgagaccccgtctctaccaaaaaaaaaaaaaaaaaattagttggatgtggtgatgcatgcctgtggtgccagctactcgggaggatgagtcaggaggattgcttgagcccaggaggttgaggctgtaggccactacactccagccttggcaacacagtgagaccctgactccaaaatcaaaccaaaccatgggagcctgagaggagaggcaggtttggtcttcattcctggttttccaatcagtgatgacagataaaaaagctcctctttccaataagaagaggatgcagagggggtgtgcatcatgcaccccactcctgagatgcacacatttgactcttgttaccctgggtgaggaaatgcacccatgctatgagatcccagacagagcaatggaaatggaaaaggagaagcaattagcaagcaattttcattttctcatcagaaagaaattatataggttgtttctggcaaagcagcatgttgcgttaggccctgtggactccggtgctttgcaaattaaagaggtttggggtcattgtggtttcttcttaaattcctctgttggctcgatactgacaacagctggatcttccaggatgtactaatttggggtgatggaagggaaactccctcatggtcagtggagtttttaactgttcaaagtgtcagttttatgggttttcataatgaaaatataaggtgtttacattttaaggaatttgagtcacttttcttaattggcaccctccgcttgaaatcttagtgctgtttcctttggctctactgaatgtttaaaatctcagtggagctcattttgggtaatcttttaaatatgttattaattttatttgttattagtatcaattttgaattaccagtagagggatgctgaatttattttaaacttatttctttgagactgatattgtttatttcccactggtaatggcgtattccttgattttatgtaaacatcccctcctatagtgtaagtacctggtccctatctacctcctggggttgttgttttggggattaaatgagttaatggttataaggtccttagagccagcacttgacttgcagaaagtgctagatgggtgtttgttaagataactgatactaagcctgcttgttaaaaagtcattaaaacgttatgtttttactattacattttaaaaggccttctgagttgcatggtcaggagatgttctgattgatgttttctgtcagttgctactaaaacatctcaagctggatgtgctgcgggtgccccaggcacagctttaaatacaaacgtgtcccattgtctcccttggagcccttcctggcatagatagcgtccccaccactcaccatgtgaccaagatggaaaccagggagttgctttcaactcctccctccccccattgataatacagctgtgtcacctgtgcctccagactcagtttggattccactctctatcttatccaactttttgtcatagggttttgcggcatttgcagttcccaaaggaagttctttcccacaacaattagtgtcatcacaagtcctggatgtttccctgaagaccagatagtcacctttccctttattctggccccttgccctgtgcccacctggaggcagtcatgtagggtggccctgggtgtggggtggccaagctgacctggggtggggcagcatccgatccacgctgcagctgggtaacctgaagaccttgtgaggcaggaagctcatgactcaatttactgcattcttgggtccactgggaagagaaatgctcctgttaagtatgaggtatcctgataatatgccttctgtttaaggaatggattttggaggatagatctcaggaatttgggaagccagccccctttgtagacattgcagtgagtgggaagcgccaggtttcccagcagaggaggcccttcctgtagctgctcagggtgtggctttctcagaaagatgacttaattgactcaattttgatcccccttttaaaaatatcaccttttttcactgtgcagaatcccacttcagtgataacgaaagaaacttagggtttaacgtgctgatatcctaaaaagaaattgggcaaggcagtcacccagatccccttgccccaggaactcaggagaggcagtgcttcatttccttttgctggtggattttggacacagctgtgtccatttggtttgggaaggacattcccatgtgtgttgcctcccaggtcatcagcactgtcctgcctgttaatgtgaggaggagtctgggggctgcatgccattgtacagggggaaaaattatatgcagagccattgagaatgtaaagaaggggcttttcacctggaacaaatggcttcctgtttatcacttaagacaattatgcagatttcttattttaacggatttcatacgctgctgtgagacagccccctgccaatttgtctccctcaattaaaaaaaaagatagatgaaatccaatggggagttagtgcttaatggggacagagtttcaattttgcaagatgtaaagtgtgctgggggtggagagtggtgatcctgcacaacacagtgaatgttcccaccgccaccaaaccgtccacttaaaagtggcgaagatggcaacttttatggtatactgtttaccacaattagaaaaatataaaagcctgaaaacctgaatccactgagttctaggcgctctaaagctggagcctggaccttggaagtccttggtgcttctcagactgtccgtggtgcagaactatgtagcaggttctccctccagctactgcaaaccaaaacgtttctaaaatataatgaaaaagattaatagaaaataaagaccaaaaaggatagatgaaatccccttaataatgcaacggtcattgaccatgacttaagaaaataacaacaacgaaagaacaaaaccgaggggattttcttgaattccatgaatgaaggggaaatgaatggtggaggtggctcttggaaggtcagagaattgaggggcattctctgcttgcagaagacccttggcgggagctaagactctacctgcagtggacttgtggcagcctgtgaccatgtgccactaagaagggtgctgtgggtttcctgggagctgagacggcagagccaccctttaaggtttcgttttcctcaaatgcgcagactttcctcagaggctgccatgcagagatcttgttctgtgggtcagggtagaattttccttatgaacgggcagtttgtcattccaggtatcctactgggcacagaattgtccagtcctgctctgtcgtgcagcccctctgggtgacctgcatggctgctgcgagtgcacgctgctctccccctcagccctgccacctccttctgcaggcggagttgtggtcacagcctggccacgggagcttcagggacgctgacgcctctcagggttttggtgtggtttaaaaaccctctgagtttaactttattatgcctgctcagcaattattactctgtgtgtgtgtgtggtttttttttttcaaagaattctctttaaggggtgtttttgcttcttcattaataatagtttcttaaaaccaccaattcagggttgcacataaatgtagtctgtaattttctgcattttctttaatatgtaatcttccactgggatcaagaattccccaggagaggctctgctcttagctcttaaaaaaaaaaagttgattggctccctctcttagttcttgggctttcaaatttgctttaatttctattttctctccctaaagagtgtgatggcccctccccccacccccatttatctaccatgtagtggggtttgtggtcttctaaaaagaaaaacagattttggagtgtatgtgtggtgtacgtgtgtgttatgtgtgtttatgtgtgttgggggcatctgtatatgtgttgtgtgtggcatgtgtgatgtttgtgtatgtgttgtatgtttgtgtatgtgttgtattgtgtctgtgtatgttgggttgtgtgtagtgtgtgatgtctgtgtatgtcgtgtatgtggtatgtgttgtgtctttgttgtgtgtggtatgtgttgtgtgttgggttgtgttgtcatctttgtgtgatgtgacatttgtatagtttttgtctctctgtgtgtgtggtatgtgttgtgtgtcttgtgtgtatggtgtgtgatggttgtgtatgtgttgtgtggtatgattgtatgtgtgtggtgtgtctggtgtgtggtattgtgtgtgctgaatttgtgtggtgtgtgatgtttgtgtatgtgttgtatgtggtgtttgtgttgagtggtgtttggtgtatatgtggtgtttgtgtatgtgttgtgtatggtatgtgttgtgtggtgtgtcttgcatgtgtgatatttgtgtggggggtgtgtgtgtgatatgtggtttgtggtgtatgagttttgtgtatgtgctgtgtgtggtatatgttgtatgtctgtgtggtgtgatgtttgcgtatatgttacgtttttgtgtgtggtatatgttgtgtggtatgtgttgtgtgtattgtatgttgtgtggcatgtgacatttgtgtatgtcttgtgtgtggtgtatgtgctgtgtgtgtggtgtgtgtgcgcacacgtgtgttctgcagctgtgcaccttggagccgtcccaggtagtaagccagaatggaggcaataatgagtgatgagcagtttgttttttccctttttggaggctttgcctcattaacttggaaccagaggttcctgaggccacgggtggcagagtcgaggaggcctccaaagccagcagtggagcgtaggagccagggcgctggggtggagatgggatctttacagcctggaagggacatcctgtgtgtcttgctgcctgccactgggtgccctcctatagtgttggtggctgctccaagcgccaaggcacccccaccatgggcctgaagcctgattccacttccttgctccacaaggctgggccaccctctgcctggtctctccaggctgtgactggatggcttttctccagggcgatggcctgttggtcgtggcgcaggtcctaccgctccctaccccagcccttgggccttccagccctttatggactgagcccgcctgactggaacattcttgggctcttggtgctaggagggcagtgggctccacccgctaaacttgtggcatcctcaggtcaggtgaacaaggcacaatggaggcagggagctctgagtttctgatctgaggaacctcctcaccccgggatccttccatgatccctggtgccaaatctggctttgtggttaaaaaaggatgacctgggcccgggtgtggtggtgcatgcctgtaatcccagctactcgggaggctgaggcaggagaattgcctgaacctgggaggtggaggttgcagtgagccgagatcctaccactgtactccagcctatgcggcagagcgagactctgtccccccccccaaaaaaaaacaaaaacaaaaacaaaaaatcaaaaaaaaggatgacctgtcagggcagtgattcctaccttgtgggatggttcacatgtttctttgaatatctaaaaccactctcctttaaaaatatttcagctgttcactgactgtatttttggaaattaaatggatattgttttgagaatgcagcaatatccctttaaatacgtaaaataagtatgggcattttattgccgtggactctctccacgaccccagtctgaggtatttttatgagctcctagtaaaccccgtctcaagccaattgcgtttgtttttgttcctctttgtctacagagttgtcgaatgctcaccgggaaggggtgggcagttgtccctttggggatgttgagaatgtggggaaaccacttcccatttgctgacttaggggctggtttaggagaaaatctttgttcttccctttacagaaaatatttaggttggggttgtttgttccagaagtgtctgccttgaaaatactccatggaagaatttggagatgtaggaatggcttaagttttgacttgaggagaaaaaaaaaagacacaacgaatcgacttcttggggccacagaccactccagcagcctcatttccatttattttgggggcttgtgttgtagaagtgagttgatgcccgatgggaagaactggagcagatcacccttcccagactttcttgggcaggggaagccagcgggttggggtgtgggcatctgagacccctccatgcagcatctatctgggttcctcctgggccgactgcagtcaggggcacagaaaaaaaatcctgttgctctctggatgtggcagttttaattttccatgcactcatactttaggggagaacatgtattttttttatttgcttttgtttaagtatatgtatttttttctttatcatagtaaaatatgcatatcatggaatttaccatcataagtattgtttggtggcattaaatgcattcatattgttttgcaaccatcaccgccatccacagaactcatttcatcatccccgacagaaactctgcacccattaaataatgcctcccccatctcctcccccagaccctggcagccaccgattctaccttctgtttctatgcatttgaccaccctagggaccttgtagaagtggaacatgcagtctatgtccttctgtgactggcccggttcccttagcatgccttcgaggcttatccatgttgcagcatgtgtcagatttccattcctaaggatatggtttttaaatagtcatttgttttgccagtgcagataaaatgtttacatattaactccatgctgatgaagcggtttcttcttacagtgagcttaacagtgtccctttcttgttgcttcagttgagactgagctctccaactgatgctggatgtctcagggagggccccatggtgtctgttgggggtgggggcagggtcgcccaaggagggcccttggtgttaacggagatccttggcagttcaggaggtctcaggcggctcacagccacgaccacccagctccccatcgggaactgcttttgagatctgttttcagtaggggcctgaggcgtgggaaggccctggctgtgagaggtacaagcagggtgggcttggtggagaggtgatggagggcctgggatttgggtttcctggagggaaagaagggaaaagaccctgacagcgaaggggaagtttacttcattttgtgatacctgaggatagaaattgagctttggtttagaaatgagatatttctactatgaagaaagaattaaaggaaaattgagaaaacctttaaaaataattgtttctccttcctcttctttgttgtgtgagtatgcatctcttacttgttgactacttagatgaatcaggccgtcatctgtggtggggagcccttgtgagttactaaatatttcatctccatgagccccagtttctgcatctgaaaaataggaatgttaaccgttgtgtggattaaatgttgggactggttgaatgaattgagggaggtattctgtgcgaatggcctcttttcaagtgcctctggctctgttggcctgctgctccagaattgagggtaggcccccccacctacacctggcaaaggtacaactgacttttcctcacacagtagctatggaaaaataaacaaagctcctttttattttttgcttttttttttttcagagcactcttttttttttttgagatggagtcccaggctggagtgcattcgtgagatcatggctcgctgcaacctccacctcctgggttcaagcagttctcccgcctcagcttcctgagtagctgggattacaagcgcatgccaccatgcctggctaatttttgtatttttagtagagatggggtttcatcatgttggtcaggctggtctcaaactcctcacctcagatgatccgcctgccttagcctcccgaagtgctgggattacaggtatgagccaccacacccatcccagagcacttttatttttaaccccctgtagaaggcagataatgtactgagcccacatttgaaatgacgtgagccttttctcctgttggaaaacaaagatcttagttctaagtgggtgggaagataagccagtgaggaaggacactgttggtttgattatacttgaggcaactagtaaactatcactacctcctagttattggtgtttcatgatatcccacaggtatcagaaacattcacaaactactgacatgcagatttgcatttcccatgggtacagttggagatagtctaacttatactaaatatgctgtataatttatgtgttatacataccatgtaacatagtatacctatttatagtatagtttgcatttcagaagaatatagttgggctgtcaagtaacacagttttacaagacagttcttttctctagttgaaggatggtggagtggagggggattctgcccgaccttcctggctctggattcagtctggctgagctgaggggccccttgtgcagcttcctcgtagtacacattaaaaacccttcagcttaaaaaacaatctgcccagaaaagggatttatagtccagtatctgattaaacgatgtgtgtttcagttcccagaactttgcttcctagttgctctttttaattaataatggatttccttcttaaaaacagatgtgcattcttggcttattatttttttcccttcaagctggaacctatgcctctgtttgcacagaattgaggtgtgaagtgggtctaatggtcctgacaatttgaaggacttttaagcctgtggttttgtgacaagtgctgactctaggtgggagtggccttggcggcccagctgcccccagtccatggaaccgacgtgccccgcgaggagtcctctcctggggcctgtcctggttcactgtcagcactctcttccagaagcttgtcgttttcccgcctccttggctgcttttgaatgttctggatgccacgcggtgccttcctcatttcttgtttcctgcgggtcccacgtgcaggcccggcgccctcgtgtccctgccagcctctcttgctccaggcagccggaggattgccccgcgccgccaccgttccctgcgtgggggggcctgcgccagggtcggctgcctgctgtgcctctcagccgctgtcattgaccatcttgtgcgggaggcagctggaggacttgcgtctgccgtctgcccttcctgcagccccttgcggcgtccagtttgcttctgcttctgcgcttgggcctctggatgcgaggctgctggggccctgccccccaccccctggcggccctgggggacccgctgcatcctgagcttatctgggggcctgcccagcactggagggaggcttatctggagccctgctgacttgctgtctgtcagtttgcaggctttaaaacttatcttactggtgagtgcatctagtgggttccaggctggcattcttttggtctctaggtacttatcgattaatgttttactaaattatcaagcctgcattcacaggtcaaatgtagattttatactttaataaacttgggtctcatattcctagtttcctggtggatgtatgtgttcgagtgtgcagatgtgttgcatatgtaatgtgtatgtgtgtgtatgcacagtgcacctgtgtgtgtgtgtttgcgaccagtttcctggtgtatgtgtacgtgtgcgtacgtgtgagtgcatgtggggattgtggcgcatgtgttgtgtgcacacgtttgtgtgtgagtgtatatgtgtgtgcttgtgtgtagattcctggtgtgtgtgtctaagggttgaggtgtcaggcagagcgtggggaactctgaggaacttggtcccagctgccccctcctccccatctttctccttggggacggaggaggctctgttctctcctgcccacctgctcagtgccagttcccagctctcctgctgctcagctcttaagcagacctttttccccaggtgtatctgcctatacctctttaccccatgtgtgcacctgaaggcaccgggactggtagggtggtgttcacatgcagcacacaggagggacacagggttccatagtctcctttgacagaagaggaaagaggccaagcaggggacattgacctggggccccacacatggtataagtgctgggtcctgctctgtctgctgctccccaaatatttgcacaactgcccagcctcagctgtggcctggtgtctgcagtcgccctttgcagaggctcccagcagataatgccacctatttgcctcatgagttcctgtgcattttctccaagatacactcctgctctgccatcccccgcaccccctgggggccctttccggtccatgtgtttctggaggacagaggtcaggccggagtcagcggaacaggaagaggccacctggtgggctcaggcagctcttggcggctgtttgtcctgacacacgtgctgaagcgggctgccatttccgctgccctctctgtttggaaagcagcctctgctgttgcttcatcagaacagtatcagagtgaagaccaagaagatgctcaggccacgtggcatcgggtgtctgaggcttcttccagtttcctggagttactgtggccttgctcagctgtgtgccaagcgtggaaagcacctggtcatgcccgttctggaggcagccgggcctgcctgccatcatgtgttgctctgtgctgcgtctccttctgcactggggctggagtcagccttgtgactaatagtcaggagaagggtaatctaaattcagctttgcaaacaagattgtccttttaaagtcctgtgagagttggtgatttacgggcatctctgggcagatgccctccttgctagcatttcctcattgttctcattccctggggaagtggggctctgtgttgtgctggccacctggctgtacgtttgtcttgcccttgaatgggaacactttgtcatgtataaatcacacctccataaagttgtcatgaataaaggggtggggttctgtaggacgtcttggggttgtaatcctggctctccagtgtgttttttgggcagatcatttagtatcttgggtctcaaatgtccatctctgaaacggggacaccacttctctccccacagggttttgtgaggtttggggcatgggatatgcacccagcactaagcacagtgccagccacatggtgttatccagatgacagctgtcgtcactctgggctcttagttggccacaggtcacctttcctccgagggaagtttgggatggaagtggttagaaaggctctggacacaagactcatttgcagagaaggaaccagataacggatgcttcactaaattggcaaagccacttgagactttctttccagaaccggtgaccatgaggggatcagtgattgtagacaggcttgtgggagtcagagaggcccaggggtgtggcccgaggggttctcggggtgtgtggaccccgccgtggcaaggtcaggatggagcctgtgggtggcccgtctggtgctccttctcccttcctcttcagtctcaccttctgtggctccaggcagggggactgcactctctgtccacatgtccaccttcctcaccacacatcctcaggtggatgcaatgatacacacagggactccctcagaagcagacccgtcctcagggagggaagtcttggtgaccgggcctgggctgcctttggaactttggtgtggacatcccacttatttctcttgagtgtttttatttagaaagaagggtgaggcttggagtgaggcagcctccccaggcccctttgtgagatgcccctgggcctggaagcctgtcctcagcccacctgtcttctgctccacaagctcaccccacatcttaggctcgccttcacacctttggccaggtggttccccccacctggaatacccccccacccacttccaaatcctgttctttggtcagagcatcacccagtatcactttgttcttatgacaaaattttcctaaagccatggaaggttgtactaactattgacattatcaccaaccccatgagactattattataacgtttactaaccacataacttttggcaatgccttagaggagaacatgccagaagacctggatcaccttctttcctctgtacaagtgggataggcatgtcttccctgcttcccctttgggattattttggcctaaaacaagagaccatgtttgatttcactttgaaaattaaattgtataagtttaattgctaattttaataagtagcttgactatcaagtttaatgggactcgaaaactcccagcctttcccttaatttgggagcagttattctgatcacagtgctgtgtggggaagggtggggctccacaacccacccgtgcttcctatgcacttacggggtctacgtgtgcatccagctgccagtgctgcattgcaccgaacacggaagaggagctttcacgaggagcatgggccttccccttccttccctttgctcccactcgctctttaaatgagctgtgttaccgggcagagaggacttagggagagcagccgagggcggtggagcccaacggtgtttgctggggcctggccaagcagaaagcagaggcctgtcaggaatgattaaagagcccagtgttggaaaagaacaggcctttatgttggtggtaaaatgattagaaagtaataagaaaaatgcaggtttggacagaacattgttttgtttaatcagttctaagcccaaatgaaaaaaaaagtgcccttagaagtaagtttaaaagggattacaacatacatgtgaacatttctcccatctagtttatgagtttaaactttaaggggaagggggcagataagtctcttatttcttggtgtccagtgaggcaatttctctaatgggaaccagaagcagagagagtaagaaacatgctgatgtgagcaggcacttttgaggtataagaaactgtcaagtgattattcacacttctgttggctgcgcaaaatccggatatggtgagatctttccagaagccgaaggaaaaacctggaatctgatcaccttgtgaggagaaatagggatctgaggagaattaattctgttgtttttaaagtggtgtttctgaagataaactggatgaggacagcattgtggggaagcgggggaaccaagattgcatctttgatgttcagccaagacagagtcagggctacaaatatacccagtggagcggcactggcaaggaaggacacgcagtctaaggagagatggtctagggtgatgctgctttttcatcttcacaatattgtatgcactgcgtgaatttctcttctagaggaaggaagacagattttggaaaacttttccagtaatgtgttctatggatttcatccttttttgcaacattaaccttgggcatttgtcaaagatggaggctgtttgaatatttttgaaagattgtgacatgggctcaagttttcttgatacacaagcagtctcagctgccacaggtgtctggtgggaggtactggcacgcgggtgacatggagggaccttggcttccctgtatcaccaaatgcctgaattaccaattaagagtagagtcatttttttaaatagatttatgtatttcttttttcttttttgagacagagtctcgctcagccgcccaggctggagtgcagtggcgcgatctcggctcactgcaaccgccgtctttcatgttcaagcgaattctcccgtgtcagcctcccgagtagctgggattacaggcatctgccatcatgcccgcctaaattttgtattttagtagagatggggtttcaccatgttggccaggctggtcttgaactcctgacctcaagtgatccgcccgcctcagcctccaaagtgctaggattacaggcgtgagccaccgtgcctggcctaaatagatttattttttagaacattttaggttcacaacaaaatagagatgaaggaacagagaattcccatattccctgtaacctgcccaacatcccctaccagagtggtgtgttttctacagttgatgaacctatattgatatatcattatcacccagagtccatagtttaccttagggttcacttttggtgctgtatgttctgtgggtttgaacaaatgtaaaatgatatgtgtctaccatgatagtatcatacagatatttttcaatgccgtaaaaattttctgtactccacttattcatcccttcctccccaatccctggcaatcacatgactccatagttttaccttttctagatgtcttatagttggaatcatatagtatgtagttctttcagattggattctttcatttagcaattggcatttaagtttgctctatctcttttcatggtttgatagctcatttctttttagtgctgaatatttcatccactagatgtaccacaatttgtgtaccctcttacctgctgaaggacatctgcttccaagttttggcaattatgaatgaagctgctgtaaatatccttgtgcaggtttttgtgtggacataagttttcatctccttataccaaggagtgtgattgctagaacatagggtaagagtgtgtttagctttgtaagaaaccatcaaactgtcttcctcagtggccgtaccattttgcattctcatgagcagtgaatgggacctcctgttgctccacatcctcccagcatttggtgtcatcagtgttttggataggaggaactttcaggggagaaataattaagcatactgaaggaactggaaaggacagaattcccctccactctcaagaataacaatggaaatgcccagggcatctgatgtttaaaactatagttctgggcatattttgggcactcacaagttctctgtgagaatgttcagtttaaactcattgtgtttttgcacagccaacagaagtgaataatcacttgacagtttcttatacctcgaatgtgcctgctcacatcagcatgtttcttactctctctgcttctggttcccattagagaaattgcctcactggacaccaagaaataggaatttatatgctcccttccccttaaagtttaagctcattatgtttttctcctcaatggtaatctaaaatccgtgttaatcagttagcagacacacatgttatgatgccaggggagatcagatgaggctgaggccccttgtgcaaacgaaggtggggaacaagggacccaagcattggcatgtctgagagaagagacttcttggtagagggagtggccagtgcaaaggccccgtggctggagcaagcttggtgtgttcaaggaagagcaggggccagtgaacctagaggtgggtgctgggagagtgacggggctggagttggggagcagggaccagtcacaagggctgtgtaggccacagtgagaacttggatttcatcctgtgtgcattgggaagcttttggaaggctttcagcaggggaatgttgtgacttagttttatgctaaaaaaaacaccctctgatgggtacagagtttcagttgtgcaaagtgaaaagaattctggagatagatggtgatggtggttgccaacagtgtgaatgtacttaaagccccagaactgtccatttagagatggttaagatggtaaattttatgctattttgggtaaaaagtctctccgaaatggcaggagagtgtggcaggggagaggatggtggctcggattggatgggtggtatggagtattgatcagtggcgggatacagtttgaaggtagagggagaggcactggccgttgaaggagtcttggatgtgaatatcttctgttacatatgtggtgtattagtctgggccctctgagatgcaaactcccaaaggggattagaggtgcaaaacatttattagggaaatgactaaaatgagtaaaatgggaagaataggcaggggttgttgggagagtcaccagcctgccgtgaggcgtgtcccccagtggaggggtgtggggaagaagggttggtgcaaggacctcagcctgcaaatttttttttttttaagacagagtcacacttactctgccacccaggctggagtgcagtggcatgatcttggctcactgcaaccgccgccttcctggttcaagcaattctcctgcctcggccccctgagtagctgggactacaggcgtgtaccaccacacccagctaatttttgtatttttagattctcctgtcttggcctcccaaagtgctaggattacagacatgagccaccatgcccagcttcagcctggggttctgtctggccaagtcggcaggggtgtctcctagccaaagctagccatcagaggtgtcctgtatcttccagtgccaggcatgctggaatgtccttgtctgtgggaagagtggccttggggtcctgactcagtgtccccttgcagtgagaggtctgagaagcttgctcccatggttaccacaggtggacttttcacttcacccttggtttcttttgttgagcagacgtttaaaaatgattgtaaattcatcaatgtactttatagtatagaccccaggccctcacaaggatagtacaaaagagaaagtatctgtggccaggcatggtggctcacgcctgtattcccagcactttgggaggctgaggcgggtggatcacgaggtcaagagattgagaccatcctggccaacatggtgaaaccccgtctctactaaaaaaatacaaaaattagccgggtgtggtggtgggcacctgtagtcccagctactcagggggctgaggcaggagaattgcttgaacccgggaggtggaggttgcagtgagctgagatcacaccactgcactccagcctggcaacagagcaagactccatctgaaaaaaaaaaaaaaaaaagaaaagaaaagaaaaagaaaaagaatctgccattctgaggtaaaataaaaaaaaaaaatccaacacttaggtcaggtgctggtgtaagctctttatatagtttaatctgtttcatcccctcaagaacccattgagataggtatagagttaccccacttaacaaatgagaaaactgaggcatgggcggggtaagggacttgcccaaggtgggagccagggtgccaggaactggggttctgtcccaggctgctctgcccttctgcagacgatggcagaatttgaagatgccccaagtttcccacctgccggtgcacttacctagggccctacccaaggatgtgctgatggcgggtttccctttcatcactaggttgtgttgtgtggcacggtgagtttagaaagggagattatctggccagtttggcttcatcacaggagcccttaaaatctgggcctagaggttgggacaggaagtcaaagattgaaactgtgagaaggatttgatgtgcctgtgctggctttttttttttttttttttcttcttagacagattcttgttctgttgcccagcctggagtgcagtggcgcgatctcggttcactgcaacctctgcctcctgggttcaagcagttcttctgcctcattctcctaagtagctgggactacaggtgtccaccaccacgcctggctaatttttgtatttttagtagagataggttttcaccatattggccaggctggtcttgaactcctgacctcaagtgattctcccgtcttggcctcctaaagtgctgggattacgggtgtgagccaccatgcccagcccctgtgctggctttaaaggtgaggggcccagggccgggaatgtgggcagcctccaggagccgagaggggctgcagcccacacccagcaaggaaacagggatgcagtcctgcaaccaaaaggaacggaatatggacaacaacctgaatgaacctgcaaaagattctttccctgggcctctagaaaggaacacagctagggccgggtgcggtagctcacgcctgtaatccccgcactttgggaggccgaggcaggtggatcaccagaggtcaggagtttgagaccaccctggccaacatggtgaaaccccgtctctactaaaaatacaaaaattagccgggagtggtgttgggtgcctgtaatcccagctactcaggaggctgaggcagcataattgcttgaacctgggaggcggaggttgcaggagcagaggttgcagtgagatcgtgccactgcactccagcctgggtgacaagtgagactccatctcaaaagaagaaaaaaaaaaaaaaaaagaaaggaacagccctgctgacaacttgatttttagctgtgtaagaggtgggaacccagccatgctcttcttagacttctgatgtacagaaccgtaacttaatacatagttggtgtttagaaaagctgctaagtttgaggcaatttgttatgtaacagtagaaaactaaaatatcaaactacagatgccctctgaacacttgaaaatagagatggaaaagtcctgcatagaatttagcaaataagccctggtactatgttaaaagaacaacagcaattctgggatggttcagcattaaaaaaatccacatgagggcattttaattttagagggaaaaatcatctcagtggatgctataaatgcttgtgctaaatgtcagcattctttgctgacattagcaaaataggcctagttaactccataaaaggattctttcaaagatcttcagtgaatattccatttcaaggtaaaacacaggagaagatacagatttctgttgtcaccgttactgtccagtgctgctctggtcgtcccagccaatacgataattagaaaagataagagcaagctctcactatttgtaggtaataaactggaaaattcaagggaatcaactgacaactattgaaacttaaggagagcaaggtggccacatgttaattaacataggaaacccattagcttccggatgcattgctaggggcctctttgaaccaaaaactataaaacacttaggaataagtttaataaggagtacagcatctataagtttaataaggagtgcagcgtctacgagaagaaaaccataacacttacttatgtttgttgttaatcaaaatcccaaaaggtatgagaagtcttcttagtgaatatcaaagaaaaagaaatgaagaaaaagctttacaggagaagattcctgcctccttatgtggaactcgttcattccacagttagcgtttccctgcttgaggccgacagtggctccctggcccctgtgcctgggtccgtacccaaggtgggtccttgctggtcctgctggtgtctccatcggtggccctttgggctgctctctggttctggattttctcttctgactttcttccagaaagagggaaagaagttgccattttctaagaaaagagcaatccatcctaagaacacctctgaccctcactgggctcttactactcacttggctgaagccactaactcccctgccctggggtccagtcagtgtgggagaaaaagccctggagactttttgcctgttctggttggctcagccaggagctttggctacaggaatggtaaccccctccccgctaatattatacccactgttcttatgggccgaagccaggattattctggagccttttgctgtgcagagtgtgtcttccgtgtgggtcagccataaaacaatatcatttctccctctgaaggctcctcaaggaggcggggtgcacaaatgtagattataaagcttagcgctaagtttttggacttcaagaaattcctgagttagcctttccaaagccaggtccttggcccagttttagggagttagtgtgttgtgtgcagagagttttggcgtctgatgttggctttggcatttgtcatgagcccactgactgcttcagatggaagggaccgtagtggtcttctggcccgccctgtaggtgtgggcagctatgcagcctgtacagagtgagggggtctgtccgggtccacacagagagggtcagcagctctaggtctggagtcgcctggcaacagaaacagagacgccgaggcaccccccaaccacgtctagcatgcagtatgtctagtgtgtgtggacataccttctctgtcctattggggcgccttcatggtatagatttgagacaggcaccttcacagtgtgtccacctgagggtgtgatctgcccagtggcccagcgttgtgtgcctggggccctgggactcctggctcctctgtccttgtccctgtcctcactcagggcttgggagtgggtcccacactcggcagcttcagctttgcaggcagcggttgctccttccttggtaccaggtgttcccactctcaggaagtgtcccaggactgtggaatcctcttactggtctcactggaaagtaagatttagtattttattggctaggcatgggggaatgaagctccagctctctattttattacacggtctctcttccaaatgaggttattctgtgatcatttgtttttccaagaagttgttcagagtcagttagaaagcaaagaaaaaatgggagagccataaacatgaaaaaaatggaagagccataaacatgaaaaaaaaaaggaagaacctcaccaacctgcttcgtggacagcctgtcacactagagtgggctttggcagcagagaggagtgaataaagaaaggacattgcttcccgtgcaggacacagccagccagaggtctctgagcattgccagcccctttccagtcttgccagtgatttcctcctgctcgttttgtccagttgccccttgtttcttattaatgcacatggacacatgttttattctgccatttctgagcaagtggtgtggcctcgatcaccctctgagagcagagtggaagaggacgcatgggcagggaggcagaagtgttgattacagcttcaatcgcatcccagcctggcttcacttgttcctgggtaggacagagacattaagccaggaaggagttttaggagtgtcttgcagtagtggctagagatctaggatgaaatggtgtcttcattgagtcttgcaggagggtatcagcgtccagtggaagaggaggttgtgattcttacccaggtgtgttcctgcatctgcgtcctctaatctggcactatttgcttcccattgagcagtggtgtttgtagtccattgtttgtacctttaagtctttaaatccatgttcagctatgctctaaataaatggatctcaaaaatataaacaggcagttcactaggaggagaccttccaaacactcatgaacctgggaaacacagttaaaatcacaaggaagtaacatcaaattcacaaaagtctagaaaaagcattgatgccatcaaatttacaaaaatatagaagtctgacaatacgaagtgttggcaaaaatgtgttatggaggctgggcatggtggctcacgcttgtaatcccagcactttgggaggccgaggcgggcagatcacgaggtcaggagtttgagaccagcctgaccaacatggcaaaaccccgtctctactaaaaatacaaaaattagctgggagtggtggctcgtgcctgtaatcccagctacgcaggaggctgaggcaggagaattgcttcaacccgggaggcagaggttgcagtgagttgtgatggcaccactgcactccagcctgggcgacagagtgagactccatctcaaaaaaaaaaaaaaaaaaaaagagaaaaaaagtgttatggagagaagaagctgctggagggcgttgaatttgtacgccccgttatacctacattattgggcaatttagcaattactggaaaagctgaatcatgcttctcctactcagtgcaattgcattcccaggcataggtcagagaacccctcagataagggcgcaaggaaaccataaggggaatgttcataacagctttggaatttgcaaaaactgcaagtaacccaaatgttcacccacagaacagtgggaaaaaacttgtgatatatttattgactggagccacatgttcaaacatagatctcacagcttagcattgagcaggaaatacaagttgtaggaggcttgatatttatgtaaaggttaaacctatgcaaggaaatcttgcgtactgctctgggatacatactgtagggaagtactatattaatataaactcaggattgtgggtgccattggaggggggctcgagaaaagaataagcctttcatttggcctggtgtgttcattcacttttttggaatgcatctgaaatattacataccaaattaaaatactgtgtttccaaacctataaaaccgatggcaactttcaaataattggatgttagaaatggaactctcaaaagatttcctcctccccacgaatgtaccctttgcctaggatgggaggctgtcacctggagtagcaacccaaggccctcgaccgcaggggtcctagcaagccttgcctttgtgcatctgctctgggagccagagaagttgaaagcggcctcactcgggatttttgaagaggttgtatttcccgacagtcctggataaaagacacggcaggcagtctgactgtcaggggagtcccttctgggtctgtatttatatatccctaggaatcctctcctgcgggctcttaaatggtaagtagtgggttcgtgacctgtggtgagaagaaagatgccccagcaggtaacgttatcttttcctttcatctgtgaatctccctgctgcaggcaaagcacccctgagtcctgcaattacggccttcccacccccaagctgaaaaacctgattttcttcaggagaagagaaacctcatcccgggagcggaatttggtttgtatttcccgagtagaggcggtgtggtcagggatagcttaaccctccggagcagcccgggccgggggttgccgggaagggcggggcgggggagtggtggtcgcgggtcccctcgtgagggcaggaagaggctgtgactcgggcggaggggctgccgcgccgtgcgtgggtgcacagtcggtggtgtaagcagagaccctggtgtagacagatcgcggtgtggggaggaagcaagtgggtgtgcagaggccgtggtgtagacacacgccgacgtctaccggcccacgctgtcggtccagttctgtctagctctgcaccctggaaatggcgaggggagggggagaatgatggccctggtgggtccccgctggctccaacaatctgggctgttcacatggcctcctctcctgctcctctaaatgtgaaacccctttaagatggcatctttatgtctccagaagataaatgcgccttttaaaaagtaaccatggccgggggcggtagctcatgcctgtaatcccagcactttggggaggctgaggcgggtggatcagttgaggtcaggagttcgagacgagcctgaccaacatggtgaaatcccgtctctactaaaaatacaaaattagccggacgtagtggtgcacacctgtaatcccagctactcgggagaggctgaggcaggaaaatcgcttgaaccccggaagcggaggttgcagtgagctgagattgcgacattgttctccagcctgggcaagaagagtgaaattctgtctcaaaaaaaaaaaaaaaaaaaaaaggaaaccatactgctacttaaaaaggcacttcctaatataaaatattcacagttcacattttcctgtttatttcatgagttttgttttattttgtgtgttattcaacaggatttagataagacctaggtattttgattcgttgatttgatttaaacgcatcacagtggtcatgtgggagaaaaatcagaaccttggggcagggcttttgtagatcacttttagggttccctgttatttctatttggaattacattttggcggggaccagcatgtttccagatctcggtctcacccaggcatttggcctctccttcccttaggtcccatgtcatagccaccctggtgcaggcccaggcgggagccacacgctgctcagtcctggggaatcccaagcccctccactctgtgcaaggaatggagataatgggctgagaattaggttttattaaaagcaaagcccttgaaggatggttattcccgcctggagatcccacagtagggcctttggagtgatagacatccccatctccctccacaccctgccctaccgccccccaacccccaaagcttcaacaaaggctcctttttaaagttttccggtgccctttgctctttgtttgccttcccgctttgttctctggccagctgcaggccacactgccatttggaaaggagtttccttgggtttgattgacaaatgggagagaattgggatgcagaggctcatgccttccagagaatattttggagaaaggtgggaactagagagagctgctggctttgcaatgttgggttctgagaactaccaggggtggggttcgtgagccacacacaggcttgttagctctttaagttcgcgaggctttaagttcttaaggctttgtaagcttgcagtgataacacagaaaataccaagttaaggcaataaaatggtctccccaaccaactgatcacttcccagcacaggaagttgatgacttaatttagaaaatatgattttaaaaattggcctcaaagcgtttttggactcagttctgtgcatgttaatatgtatccagattatatcctgacattcatttagaaaaaaaaaagactaaaaaattttgccaaactggaaatggagacatgttatggtctgtggatgggaagagtcttgaatgtgtatgacagcccgcaggatgtgttagctccagttccagccaaaaatccaagagagtaatgagtttgtcagatatcgtcagatcagggagaagatttagataaaacccttcagcattaatattctggcaatattaaaaattatcttagaaaaccaggcctggggattggggaatggagaatacagaatttctgtacctagaaggccccccgcaagcctttttttttttttttaaaggtaatcaaaggtaagtggagagtaagtaattctttttgtaggccaattagacaagtcatgcctgaagcctccccccaccccccatgactcctggaggagactgagactccctgtcacaggggtacccaccaacacacatccctgctggttgagatctaaaatgcttatctgaacagccttggctggtctgttgctgcctgtgtttatttggatgtatttcagcagaagccatcacacagacaggagaggtgggttttatgagatggtgttgaatgagggacaggtcaaactgaaacctaattgacagatgatcagattggtgaaaccagagagaaaagaaagggattagtactcaagtaccttgacttcagaagtacagagcttccctttggtgactccttcagctccatttttgttgagtgagctttggttctagctccgtggtaggatggtgagtgtgctttctctctgggtttcttttgtgtacttgtctcaatggccataacatggcactgcattggtgtgaaatcccctgagattttacctccagatgcaactcatgctagataggggccctgggtagggggctgagaagggggttccgaggccaccaggaccttggaaggggaagggattttggtggtgatttaagcgctagcaagggctctgttggaaatgattcactaacttcctgcaaggacacttcagaggtgtgatgggcagtagtacagtgggtggggtgtgtttcttgtttggagtgagagagggttctggtgcgtaggagtctcattccaaggcctcttgtccatcaaattctgttgggcagcactgtccaatagaattttctacaatgatagaaatgttctatatttgtcatgtccaaatcagtagcctgcagccacatgtccctattgagcactggaaatatgattagtgtgaatgaagaactgcatttctgatcttactacttgattttaattaatttaaatgtaaagggccccatgtggctagtggctactatattggacagtgctgttacagagctccatctatcaccttaataattttatatcatccgtacaaaacagtgaagaaaatgtgagtgggaaacatgaagagtgatgaaatgaacaagttgagtgactcccaccctgttgaagagattgaacttcatccccagttcctgtgaagctttctggatctcgtcttccaaggtagtgatggtcctctgttttgtgttaataattcctgtactttgtagttttgccatataggacaggccaactatcctttagtctgaaatgcttggaaacagaagtgtttcagatttgggttttgtaccatacatacaggttatgcatctctaatccaaaaatccgaaatctgaagtactccagtgagcatttccttggagcatcatgttggcactctgaaatgttccaaagtctgaaacactttgagttcttgtttcagattagaaatattcaacctgtagtatatatctctattagttttctgggactgccataacgaagtcccacaggctgggctgctgaaacaacaggcatttactttctcccagttctgaaggctggaagtcccagatcaggtgtcagcaggggtgacttctcctgcctttctccttggctggcagatggcgcctttctccctctgttttcacgtgggcacctctctgtgtctgagtcctcatctgctcttcttatgacatctgtcttcgtggattagggtccaccctaatgacttcattttaactgaattactcttttaaaaaccttatccccaaacacagtcatattttgaggtcctggggttaggattttaaggtacaattttggagagacacaattcagttcataacaatccataaacagcagattgcttagttttgcctgtttttgaccttttgataagtggaggcttgttgtatatattttttcgttcagcattttcactgcctcttcatggtcaattggagaccaccttccagctctcatggggagtggattgtcttggtcatgggctagttttttttttttttttgagacagagtctcacattgtcgcctgggctggagtgcaatggcatgatctaggttcactgcaacctccgcctcctgggttcaagtgattctcctgcctcagcctccctagtagctgggattacaggcacccgccaccatgcctgggtaattttttgtatttttagtagagatagggtttcactatgttggccaggcttgtctcaaactcctgacctcaagatccacccgcctcagcctcccaaagtgttagaattacaggcatgatccaccgtgcctggctggtcataggctagttctatagactgagctgtgagctctgggttctcattcaaggtcgaaaggacaggaaccaaactgtcctaattgtaggctcctcaggcttctccctgtacatgacaaggagaggtggctcctgtgtggaaccctacactccatttgcccagctagatagatgcccgacacatactgctgcccagcctgagggcctcgcctgccctcctactcctttagtagaactttctttcaagccctcaaaattcagatgcctcagtgcttttcctcgaatttctcccctcatccttcttcatctcaggaggttctttgcccctgtcgggcttttctctacaaaccctctctccgtgtgataattcccctggtcttgttttgtctttgctaatcaccttcgctaatgaggcctgatagctcaggagtgctcgtcctccctaattttttcacctcatgataaaattaatacatgtatgtcagtatttagaagaaaaatagtataaataaggaaacaaaaattatttgtaactatgctgctggagataactcaccatcaaaaaaggagtactaacagtaagtcttcacttaacagcattgatagactcttggaaactgcgacttcgagtgaaatgacatactgtataacaaaactgattttaccatacactaacagatataaacaagagttaagttcttgcagcatacagtatgtcatttcatttaaagttggagtttctaagaaccttatcaatgatgtcaagtgaggacataggactcattgtactagcattttaacacatttgtgatcatactgacatggttttatttcataaacatgtttttcttgttacctacttggtgtttttataataatcaattttaatggttgcatattatctagtcaagtgccatttcctgtaacagatcaaacactccactcgttttcaatatgtaggattttttcagtttttccaagttatatttgtgaagttcagaacttactggaaagttgcaagtagagtatatggaagttccttctcccccctctagccatctgaaagtaagcggctggcaagatgtcccattacccccaaaatgctttagtatgtattttctacaaacaagaacattcttgtacataatcctaatacaaccatcatgaaaatcacaaaattagaacagatgcatgaccaccatcagaccccaatctggacagttgcaacagcagtcccagtaatgtccctttgagcagcaggattcactgcagggtcatttggctctgtgcttctggagtctcctccagtctggaacatttcccagcctgcccttgaccttcatgaccttgacatttctgaagagtgcaggcaggttattttgtaggaaatcccacaacttctgtttatcaggctttgtatatgggcaggcccattgcagaaacaatgttgtagaaatcgttttcagtgctgtttttgaatggtgcacagggtcactttgtcccctaactgatgagattgactggctgaggtggcatctgttaggccttccctttcaaatgaatcagcatttggtatttggtggggaggttcttggaaaccgtcaacctcatcaggctctcactatattcatggatttacttgtattagtgtgctcacagcactactgttttatccagtgggttataatcctgctttggaatatctatagctgatgcacctacaaatgctttaaatatattttattacggcattagtttgctaggactgctgtaacaatgcaccacagacttaagggcttatacaatggaaatttatttcatcctagttctggaggccagaagtctgaggtccaggtttcagcagggctggtttctcctgtggcctctctccttggcttgcagatggtgtcttcaccctgtgtcttcacatggtcatcctactgtgtgtgtgtcctttttttttcttataaggacacaagtcatactgcattggggcccaccctgatgactttattttagcttaattacttcttcaaaggttctgtctccaaatgcagtcacattctgagctatgggaggttacagcttcaacatacgaattttggaggtcacaattcagccgataataattaggagctatgctttgtattgtagtaacatctgttgacttctactgtgatgaaaaacttagtattgacctccttaacatttctgagaatcttctcagaaaaaatgagtgcaagcagaggcaaaaagctctgattttaagcaaagatggacacgtggaaggagttggaactagactttctgcagttcttgtctaagttaataggactgtctagatacacgatgaggtgttcacttagtctgctgcacccagactttggttagaccctgggcttttcctgggatttgtttcttggtgggcataccttgatgttgcattacttaatatatagaaggaagagagtgggctcttccaaggcccagctgacctcctgctcaggtacctgcataagtgcgtgagtgtatatcaaaagtgttgaagggtttatgaattatttaaagaaagctgaagttattgcctctgcagtgggggacatgggtggctggggaaaaagagtagaagaaagtctttcactcttgtgacttttgaattttgtttcatgtgtccacacacacacacacccccccacacccacacacccacacccactcccactcagaaaataaataaaagataactttggaaaaaggaagtagagaagaaaaagggatcagcattctctcttactgcttgtcctctgtctttaacattataaggacatcatcactttccctgaacctccaaggccctaccaaggtggaggtcttcctgggccaggcccttggtgtggtgcagtggcccagtctgttccgattactcatctcccttcctggaaatggagccctatgtccgtttggtgatgcacccattaagagatccttttcccatgtttgaccaatttctgtggcttttgggaacaatgttgtttggatttgtcttttttttttttattgtttgttttgttttgttttttctttttttgagatggagtctcgctctgtcgcccaggctggagtgcagtggcgcgatctcggctcactgcaagctccgcctcccgggttcacgccattctcctgcctcagcctcctgagtagccgggactacaggcgcctgccaccatggtttcaccgtgttagccaggatggtctcaatctcctgacctcgtgatctgcccgtctcggcctcccaaagtgctgggattacaggcgtgagccactgcgcccggcccccgtctttgtttcttaaagtgcagcttttctgtaatgagtttcttgttgggggattctggaagtgtagttgggttttaattttggtctgtaaggagtaagggctctttccgctgagtgtgcttctcagagaatgatgggctatggtttggcttcagcctccaagtggctttccaaagaggtgaactggaccaatttgagcccagccaggcactggatgtgcaaggggggagcttctgggattactgacaatgaataaacccagactctgtccttaggaaactacattttataataagagtccaagaaatgaataacttgggagatgctctcaggtgggtttgcatgaaacaccatgaggacctaaagaaaaaacccacttctgccaggcaaggctgggaaggctttgcagaagaagagtctggcctcaggagctgaccatgaggggtgaatcatcctcaccaggtggagaagaagggccatggaggtgcgaaggagcccaggaccctgaagcccaggaaagggagggcgcaattttgatctgttgaggcaaaattctttcattcttacctgcttcctgccatttcccttgccccacatcagtgtgcagattaaatgaatttaatgaatgtatcccatctaagggctactctagggtgttttttttcctagcaatgaaaggatttctcagctgctataaatattccatttgctggaggaagccagagccagtactgggtccctgtgaagttctgaacactctggaaatcttgttaaagctggaggcttacataaattatggggtcctcatccttaaaccctttctttgttagcctccttttgatgagaaaataattgattatctttggggaaaagaataccttgagttatttataacccttctccctggggaactctggaactgtttgcaaatgtaatctaattataagcctgacactctcccacccaggttggggcaggtattattacaccgtggtacttccttctcctgttttagcataaatctaaacctgggagatgaagtggcttgcataagtgtaatttagtctgtcaataggcatagcaggaatagctgctatataatgaactccagttataaaatggtttgataaagtcattggtgatggttcttcattagaggctgagtgagaattgactcttaggagtgattgtaattgttgtctggcaacacctaatatgtctcctaaatattcagtattttgggtacatttagatcactcatttcccctgtataggtatctatcttcttttcctgaacaccatagtagttatctgatcttcttcatcctcttctggtcgcaagaccccttactggggaggtcatcctgtgtctttctgtccccgtccacttagattgggcacatgacttatggatagccatgtaccccctgacaggctgatctgaagcattcctggaacttcttgatcaccttctttcaggaagtatggatgaaaccttgtgtgtatggtggtgagtgaggttggaaagagaatagagagggatgggaagaggagacacaaatgtaggaagctgcatttaaagggtaagttttctgagtccttgtaatttccacctgcacgtgcttgatagtttgggtatcattctcagttgcacgtcatgttctttggaatgtcaccccacagtcttcccagcaccctgtgctgccttctgagcggttcactgccacttgaagcctcattccttttctggtgacttgtttttgcttggaggggttttgggatcttctgtgtaccctggagttcattatgatgtgttaaatgtgcatgtcttttgttcgttctcagttgtggcttggcccttttcatatggacacttgagtcgttcagcttggtgatgctcttcgtgtccttttagaaaatattcctctctcccactttttttctgttctttctgaagctcctctttacttctttcttctcctcactgtggaatttcagctttatctttcaatcctacagttgaattttccttttaatgttggaatcctattttgatttcaataccttcttttctattttttattgcattctgatgatattttaagaaggcaatgccttctctaatgtctctggaacttcattttctttcttttggctcttgagtcatctttgtttcctctggagtgatttgttttcttatcttggcacctctgtttcatattgggagctttctgcagatgtctggttattcttggttaattcttggttcaagcaatagctcacaattggagagtttgcatgcgtggatggtgaacttcacttcacatttggtgtcggggactggctattttaccagggaccctgggtaccaagatatacaagtcccttcctgaggccttcactttcatttcactttttttttttggagacagagtctggctctgccgcccgtgctggagtgcagtggtgctatcttggctcgctgcaacctccgcctgctaggttcaagtgattctcctgcctcagtctctcgagtagctgggattacaggcgcctgcacacctggctaatttttgcatttttagtagagatggggttttaccatgttggccaagctggccttgaattcctgacctcaagtgatctacctgccttggcctcccaaagtgctgggattccaggtgggagccactgcatctggccttattttaattttaatgacaaacacacttttttttttttttgccccctgcagggattaggagaaaggtagaaatgcctgagtgccaggtctgctccgagctcagttgagatagcagttggccatttgggtttccatgtgtccatctatacattcacactcaatctcattgtttgttaccccaccttgctttctgatgaacctggtgtttccaggttctgagtcttcctgtggctgagggagccacttggaccccccttataaagctgctttatcttttagtggcactccccatgcaaagatcgtccgtgtgctagcttccctggcttgctgtgctatgtgtctgttgacttgctttcttctgtacatttctggagctctctcacctccagagaatgtctctgaaaacttcattttctttcttttggctcttgaatcatctttgtttcccctggagtgatttgttttcttatcttggcacgtcttgtgacctttctcatgttctctgtatggctatggctttcttactttgtttcattcttatcattttgtaggacttttaggaaggaaaataaagaaagcatggtcaatccagcattgttcactggtgggtatcataatttgagaagtactgcaatagaccttttgctattttctgctggctcttaaaatgagaaaattaaacaattagttcctttagggcactgggacattcttttcaaagcatctacatttccacaactttgttgagtggaatcagagaaatactggcatttctacaatactccctattaccagatgtttgttacttttgatttagtcaaattcttgttcatttaaacaattcttcttcacaaaaatgtgaaagcacttgcaggatatctctaggcatttcatttacggaattacatgttgaagttagagtagaagtctgctcactctctgatcctgggaccgttaattggttggcataactcaaaatgtcttctaaagttggagaaaatgtaataaaatgatccacccatatgttaaacattctgttccatttagatcatgtaagtgtccgttaatttaccaattttttgaggtaggccaaggctttttggtgagaatcagctgatagaggagttctcagttgtctttccttttttttttttttgagacggagtttcgctcttgttgcccaggctggagtgcaatggcgatctcagctcactgcaacctccacctctggggttcaagtgattctcctgcctcagcctcccgagtagctgggattacaggcattcgccaccatgcctggctaattttgtatttttagtggagacagggtttgtccatgttggtcaggctcgtctcaaactcgggacctcaggtgatccacccacctcggcctttctgtgctgggattgcaggtgtgagccaccacgcccggcccagttgtctttcttgcttatagtacagagttttcagttttggtttctttagaagtcatatgacaacgggaagaaatctgtgaagcaggctgaggtcagatgtttacagtattttcctagtcattttctgttttatcgcctaggcttctttcgaacacggattttttttcattgtatggaggcttttcaaagccaacttagtttttctagataaaacttttaatgtttatagttcatcaattaaatacttaattacataatttaatgagtagaataagtgcagctggcctaagcaggtttgtgagcagctgtggttgagtcctgggacacgtgtgccactttcacgaggcagaaatgaggagcgagtgtgcagagcctcctgaaccggtgcaggtggccaagtggccgccacagagcaccttttactggggtaatcctgctctgaagcagattgggtttcatgtcagtggagtgaaaatgaagggtcttttctcttcccctaagtggggtgattccttgaggccctgtctgggagggaggcttcgtcagcccccttccaggtggatgcgatcactttctcatgccctgacttgattttctatgggcagagaccaaattacaggctgtaagtgttcatcagagcaaaagaagcccaactcccccaaccaattcaataggaccccagacagaaagcctttaatctgctctcttagtgccctccttttaaaatttatctctgaggagaagcgaaagttaatttgtcaaaggtaatttacagcctgaatattcaggggaggaaaaggttcccctgaaggcatctcttgatggaagaatctggatgtagaacacggcttcggactctgagattcagctgctcggcgctggataaattacagtgctgtcaacacagctatatatattgctgggctgggtacagtgtgttccagtggaggtggtgtgtacatctgccgtggctcaaatgcacttcagatgtctgtgggattgcaacaaagaaggccctgtgacactttttgttcccattggtggctttttcttttctttcttttttgagatggattcttgctttgtcaccttggctggagtgcagtggcacgatcttggctcactgcaacctccgcctcccgggttcaagcaattctcctgtctcagcctaacgagtagctgggaatgtaggcgcccaccatatgcctggctaatttttctatttttagtacagatggggtttttaccctgttggccaggctgatgtcgaactcctgacctcaggtgatccacccgcctcagcctcccaaagtgctggtgctgggattacaggcgtgagccaccatgcccagccccactggtggctttttaatgctcttgctagagagagcttccagtagtagtctagtgggacatgggcccgatgcacacaggcagtggtagtggtagatgagtcgatgtacagttttatgttaagttcaagaatgacaggggagggtgaaaaccaatgttgacactgtgtatccggaaaagcaagccggacccacaggaccagagactgttgatggagcaagccttatccaatatctgttggaatcgaaagtatgatgatgacaaaaatgttgacattaaatagtcatgtctccaagaagtttaagaatttcagagaaactgtacttaggttcttttacagagttaaaaatgtttgagtcatgccatggtcgaggggacacttggcctgtggacctgcatgggcctggttcctggttccatagattgatgcaaaacacaccagggtgcctttacttttccccagtgtgtaagggaccacagcatccaggtccctctccatcccccagaggatgttggtacttcggccatgagccatgccttcctcatttctactgaagagctgctaagggagttcttactctgcatatttctgtatttccagcccagcctctgtaatataataaaacgcacgccctgtgtttcagcagtcgacagtgctgcttcataagcaatgtgtagtataaggaacacttaataaaatggcctataaacacaccagccccaaggtaggacttgggaaatactagggtgaaagaagaggtaacttactagtagcctcataaaaatctgtacaggaaaaaaatagaacaaattctggctgtgtggtgtaaacactgcctgattcctcgtcaaggtttggcagtaaagtgaggaatagtcattggatgtattggaaatcttggggttcatggacatttgtcaggcttcccttgggtggtggtgcatcattcacagttaaaacgacgagatgcaccccaggacgaacggtgccagcctgagagtgtaactccgagtgtgtttacatgagtggccacaatctgaaaactttccttttgacataaactcaggttatatcataccaagagtgaggagtctcttttatgctgttttccaggaaaagggagaaaaaacaaatgagggtgaataagtaatgtaaatttttttattataattatttgtggagaaaatgaaattcctccacagatctgtttttgttatctgttgctgtgtaacaaaacactactgcacaatttagaggcttaaatggataatgtgttgttacagcacacagttctgtgggttgacagggtctttcctggggtctcttgcgtggctgtcgtcagatgctggctgcggtaagatgctggtgggggctgcagtcatctgaaggctcaactgggccagacatgaagatggcgcactgacatggctggttggtggtgctgttgggtgctgggggggtctctcgacccaagaacccatacgtggcctctccaggtggcttggccttctcacagcatggtggctgggttccaaaaaggactctctcaagagggagtgtgttaagggcagaaagtggaatttggccacttacaggcttcattcagaaccagcactcaaggccactttctttgcattctgggggtcaaagcaatcacagggcccactctgattcaggagagtggggaaacagactccagctcttgttgggggagtgtcggggacaccatatggagagcatgtgagatggaagatattgttgtagccttctttggaaaatacaacctgtcgcaagaatttaaaatggaaattgaatataccatccctttgtcacaggcatatgtatgtttgtattattataggacatgaacacattcttccactgtagggtgattaattaattaattcagccaacttttatctagcacatgctgtgtgatatatcatgccaatccatggcaagatgagggagaatgatagaatgagatagtaagaaacacagatagtggtttagatagaggaagacaaacacacacagtgatatatatggcagacagctgctctacacatggaaggagaccaacatggaaacagagaaagtgagactcttcagaggagagacagcagaggaagctgcatgttagagttttgaggaacaggatgggacagaacatcccaagctgtcctcagctctagagaagaccatgttaaaataaccgagggtttctttggtcaggagagtccctaaacctggacatttctgcctcttcctggaaggcattgctttaaagagtaatttgatctgtagaacaatactatttttaatgctggtattagcagttctttgcgtttatgtttttacttaatgtgaactctgttgatagcattccagaaactaaaggaagatcatgtgttgagttttcttgactctgtgagtgtcactagaaaagacttattctaaaatatttttgccaggtgtataaaaatattctacacactagctcaagctgtcctgcaaaaatcagtgccatagctgtggcttgaggccatttgcaggctatgtgaaataatgcagtccagatttgttgaaatatgaggttttttctttttgacacctgcacttccaacatttagtactttatttgatgttaaaaatctccttttgatcttgagttgttttcaacatcctagaaatgtttccttcttttgtaaaagttatatgggacacgtgctagggaattgaaaggataacagtgtttgtaaatagatagagccctgaaaataagtgaatggtgaattagacattcatttttctttgttaagtgatagatgttgggagccctggctttttgggcagttgcaggggaagttgccatcaagacccggtctggctatccttgcccagccaactggttccctgatcccggtgtgtaccctgctgttgctccgtacgaaggagtttccttggttctaaaatacaggctgtaggcacatgatggtgttctagtctttggacagttgggatcagtcaagaaaaacacaacatttcatatttcatgactaaatgatccaggtattgacttagattgggggtcagcaaaccttttccaaaaaataatcagatagtaaatattttaggctttttgggtcttcagctctgctcctgtgtcaaagcaggcagagatcatatgtaaacaatatgtcttattaaaacttgtggacatataattttatgcatgcctcaaaatcttcttcatttgatgttgttttcaacaattttaaagtgtaaaaactattcttggctctcggaacagatggtgggctgcctttggcccacggattgtaggttactgactacttcccaatatcttgcaggaatagacacacattttaacaggatacttgacttagataacttttatgaatgcttatttttttttcttcttaaaaaagttcctgaggaagattttttaaaattttagttaagttagtacaccgaaatagatttttgtgatatgtagttctatgaattttaacacaagtatgggtagctttgtatagccactgctaaaatcgggatatggagcaattgcagctgccttgtggtacctctttagagttgcctttacctccacccacgagccttggcaaccacttgtctttttttctgtccctatagtagctttgtctttttaagaatgtcaatagtggaatcatacattatttaactttctgagctagacttgtttattcactcagcataatacctttgccattcacccaagttgttgcagttacccatagttcattcctttctattgccgagcagtatttcattgtataggggttcacggttcgcttatccattcacctgttcaagggcatttgggttatttctagtttttgccagttatagatagaggtgctttaatatgcctgtacacaactagccgtggtggctcatgcctgtaatcctggtgacttgagaggctgaggtgggaggattgcttgaggccaagagttgagaccagcctggaatttattgagactctgtttccagaacaatgtataataaattcactgggtgtggtggcacgtgcctgcagtcccaggtgctcaggagtttgaggccaaaggatcacttgagctcagtagttccaggctgcagtgagctatggttgtgtcactgcactccagcctgggtgatagggcgagactctgtctctaaaaaggaaaaaaaaaatatattcacgtgtaggtttttgtgagagcatatgttttcctctctctatggtgaatacctaggagtgggattactggtgacataagtgtatgattaactttataagaaacagccaaactgttttccagactgcattcccaacattgatgtgtgagactgccacttcatcatttttgttcttccttcattcctggtggtccaagttctctttctggtattaattcccttctgcatgaagcacttccttcagcgcttattccactgcaagtctgctgacagtgagttctattagctttccttcatttgagaatgtcaccttcatcccttagtgatgttttcactgggtatagaattctgggttgattgtctgtgtctttgagcactttaaatagtctgtgccacatccttctggccttcattgtttttaacgagaaatctgcagactttaaaatagttttacctctataaataacgtgtttttctctgattgcttttaagattttttccgtttgtctttaattttcatcagtttgattattctgtgtttggatgtagatttatttgggcttatctttttggggattcaccaaatttattttgtgggtttacatttttttgccacatttataaagttcttagtcacttcgtcactctttttttcttcttcttctgggaatctggggatataaatgttggaccatttcattttgtcccacagaagtgatctgtttatttcttttcaatttttttctcttttgttcaccttgtataatttttattgacacttctctgtccttattcccattgatccctttcattgaggtttttcttctagttattatatgttttccttctaaaattttcagttttctcttttttatattttctgggggttttttgttgagacattttatctttctgtttgtttccaaagtgctttacttgttggcaatttttataatagttgtattgaagtctttgtcagataattccaacatctgtgacatcttattgctaatgtccattgattgagattttcctggttctttgtatgttgagtaatgttggattgcatcatggagattttgaatattagattttggtggtgagactctgggtgttgttcagccgttgtggggaatgttgatactgttttacgggcagtcagtctgtttgggttcaggctgcaagttccgaacagccttccgtgtttgcagtcccaatgccggttctactttcaaagcctctatagtgctcttggatctgtcccacatgtgtgccacactgtggccagactgggacgggggtggtgttctgctgtgcagttctgttctcaacatctgcttagggtcagatacacacacacacacacacacacacacacacacacacacacacacagctcatgggtggtctcaggaacttgtaaacaactttaaagggtcacttttctgagttttcccttctccatcatctccctggtattttcaagttccttaaaacacccatttcagtcctctagcccaacatcttgggttttagttcccttgtttggctgcatactcaccttgactatgtccacgtctcagaaaaacagttgaggacacagagagaaaaaacagcaatggagtttgaccacctcttgagaccccagctcctccaattgcagaattaagttatctctcagggttttaagctactgcagttacttgttgccacctccaccatcactggatggggactggagtgcaagagaatgaagaaaagaaagaaaatgaaaaaagaaccatgctttctgtgctcttttagtggggaaagatatacttatcttcaccctgctccagcagagctggaagcctcctctggaagctctcttctgtgctgatgcccttgtatgagtttgggactatgttaagttcaaacctggagatgctaaggagtccctaaagaagtgctcccctattcgttccaggttttatagctccattcatgggagatgtgggcagaatatgccgactgtatgtatcttgtccagaaccagaaccctcaagatattttgatcagagtaatttacaaattttattttctatgtggttttcaagcaagtagcaccaaccctattttgaggaggatgtgcagatttcagatggtttcaaaatcctttccattttctccccaaaattgggttattaaattactagattccgttgtcagttctgccccatagaacttttggggaaaatggaaatattctgtatctgcgtatggtagctgttagccttatgtggcaatattaagctcttgaaatgtgggatgggctaatggaattctaaatcttctttaattttaattaatttaaattttaaaatttaaattttagtagccccatatgtctggtggctcccttactgttcagtgcagcaagtttattctgctgtggaaagcacgctttaaaacatgcagctggtacaaaaattagctaagcgtggtggcgcagctgtaatcccagctacacaggaggctgaggcaggagaatcactcaaacctggcaggtggaggttgcagtgagccaagatcatgccactgcactccagcctgggtgatagagactcagtctcaaaaaaaaaaaaaaaaaaaaaagactgggcgtggtggcttatgcctgtaatcctagccctttgggaggccgaggcgggcagataatgagatcagaagtttgacaccagcctaaccaacatggtgaaaccttgtctctactaaaaatataaaaattagctgggtgtggtggtgcacgcctgtaattccagctactcaggagactgaggcaggagaatcacttgaacccagtaggcaaaggttgaagtgagctgagattgcgccactgcactccagcctgggtgacagagcgagactccatcttaaaaaataaacaaaaaaacaaaacccaaaaaacatgcagctggcagggttggatttgggcagagggaagaatatcactatttcttctttgactgtttcactgtaaatcattttcactgtgatgccaatattgtaccacgcacctggctggagtaatttgatttaggtaattcagaaagtgtcatttattcaatatgtgtagctaaatttggataacatcccatgttagagtcatatatcctctggagcagtttaaagaaaataccttttgtattctattttttggaggtggggccctgttgaacatcactggcaatgctgactgagctcttcccttctttcagaagtcaccttaggcaggttgatgtggcccccaaataagccaccttgttttcacttcacttcctcacccccatgcctccaaccaaaaattaaagtaggacttaatccatagttttgtagtatttcatttaaaataaatggccttgggcccatattttgaaaatgaaatattgtcatggccctttttaaaggaatgacaaaggactgatctgcaaatttgtatctcttccttgcttagaataaggtatttacctaactgcttttgattacttggtgtgcttttaaaaatgaaatgacttgtctcccttccctatgttgactcctacaaagccaatgttttggtattctaatttctgtagaggaggaaaactaatgatactacagtcatgttatttttcagatacattaaagaaagccaaaacgtggtttcacagttgggtcatttgattccttgagtgtctctaatctggagactgttttcttaagcagagtcccagagtaggagaggcgtcactgtaaccgagtgaagagcgctggctggaagtgtgtaacctgccagctgatgggcttaagagcagcaagtgccttcatgtggtttctttctttgttgtcctgtgaaagaactcgtggagatctcttaagctctttattgctgtgtagaattactgtatttgaaaagtatactgcaaaaaaaaaacttttagccttagctttcacattgaggattttgtagattacagagaactctattgaagactttgctgttgaggtgagcattttgcaaagtataaaacttcctggctaaggggagtactgtgtccatttaaacttgccacttgaagaagcccgtccgctaaagtgatgtgacagcactttatcttctgatcatccccctttcccttcagagagaaggaagatgtaaaggggtgtgcaacatctgcttaaataaaacatatgctacagttggaccgaccaagatgtaatttatcttgttactttttttctgtgctcaagttatggtgaaagttacctatctttaataagttattgtctaaaatgagcacatcctgaaaatatcctggccccctggtcccttctgacatgccagcatggacgtgggaagcagttgattcttgagactcacatatggaaggagagagtgggtgtgagtgatcgctctggcagggttgctgattgtcttgatttgtgttgcagtcctggccagaagccttccacatgctttgatctatggcagcgtctctgcaaaatttggcaagaaaatcctaatgtgtttaagtcataattaagattgtgtagcagggctggattgttcattccttctccatgtgtgttgacagtgctccttatcccctcccctgtctctgtccatggctcgtgttcctggcctcctgagggacaggtggacttggggcccagcgtgggcttgtggacttgtggcaggacttaggattctcttcattgcaagaaccaagccttgttctggccagaatcactgataggtggatggaaacaggtggatctctttccctgggtgcagtgtccagtaattcacataatctaacaggaatcctggggcctttcctgtcgaatttgaattcggggaacacagaggtgtgcagtggaaaaggaaattagtctgcacatgaggttaaggatgggacccttgcatatttaagggggtccaggagtttatctcccaaactaagcccgcctgcatcttttcctgaacccaccttattttccactttgtttctgcgtctgcttccttgtgtgtctttctagtttttatgttgccggaatctgttccccttcccttcccatttccagcatctccaaattagtcatttttatatttacactttgagatacaactcatgtatcatgcagttcaccatttaaagtctataacccagtggtttttagtatattcacagagttttgcaaccattaccacaatcaattttagcacattataatcacctgaaaaccatgcccatcagtcatagccccctttctcctatctccccccaggcccagccatctgcgaatctcctttccatctctatggatttgcctattctggacatttcatataaacggagtcgtgcaatatgtggtctgttgtctctagcttctttcactgagcataaggttcccaagcttcatccatgttgtagcctgttttaatggctaaatcatctttcactgtacagatacaccacgtttcttttgttttttgtttttgtttttgttttcttttcttttactttaagttctgggatatattaccacatttctatctatctatctatctatctatagacagtggggatgtttttactttttggctattatgaataatgctcctgtgaatgttcctatctacatttttatgttttcatttctcttggttgtatacctatgagtggaataggcagagtcctctggtaactctgtgcttaaccttcatgcctgcaatcctagcacttcgggggaccaaggcgggaggatcacttgaggccaggagttcagaaccagccttgtcaacatactgagaccctgtctccacagaagaaaaatgtaaaaattagctgggcttgttggcccaaagaactgccagattgtttgccccagcgctgtaccattttacattcccaccagcagcatataagcttgcactttctgcacatcctcactaacacttgttattgtgtgtcttttttattataagcgaactagtaggtgtgaagtatggtatctcattgtggttttgattggcatttcacggatggctaatgatgttgaacatttcttcatgtgcttatttgccatttatgtgttttctttggagaaatgactattcaggtccatattttgacagagttgccttttttactatttagttgtgtttggattagtcagcttgggctgccataacaaaataccgtagactggggggcttaaacaacagaaatgtatttctcacagttctggatgctgggaatccaagatcaaggtgctggaagatttcagggctgccttcttgctgtgtcctcacatggtggagggtgagcaagctctggtttctctttctcttctttttttttgttttttgagacagggactcactctgttgcccaggctgcagtgcggtggtgtgttcatggctcactgcatccttgaactcctgggctcaagcgattctcctgcctcaacctcctgagtagctgggactactggcatgtgccaccatgccaagctaatttttacatgtgtcttctgtagagacagggcctcagtgtgttgacgaggctgtttctgaactcttggcctcaactgatcctcctgccttggtccctcaaagtgctaggattgcaggtatgagccaccactcctggctgctgctcctgctgctcctgctcctcctcctcctccttttttttttggtgatggagtctcgctctgtcacccaggctggagtgcagtggcgtgatgtcagctcactgcaagctccgcttcctgggttcacaccattctcttgcctcagcctcctgagtggctgggactacaggcgcccaccaccacacccggctaatttttttttctttgtatttttagtagagatggggtttcacaatgttagccaggatggtcttgatctcctgacctcgtgatctgccctcctcagcctcccaaagtgctgggattacaggcatgagccaccatgcccggccttcttcttcttcttataagggcaccaatctcatcatgggggccccacccttagggcctcatctaaaacctaatgacttccacaaagccccatctccaaatgccatcacattgggcattagggataagaatttggggtgggggggatacattcagtccataacagcgttctttatataatctaaatacaaatcccttaacaaatatatactttgaaagtactttctcccattttgtgtctttttacttatttaatgttatctgttgaagcacacaagtttttaatattgatgaaacctaatttatgtattttgttgttgctttgtcttttggtattatttcttagaaactgtttaactcaaggttatgaaaaggtacactgtattcttttaacagttttatagttttagtgcttacatggcctgtgatgcattttgagtaaatttttgtgtacttagtgaggaagggctccaacttcattcctttgtgtgcagatgttcatttattccaataccaattgttgaagagactattctttctctggcattgttttggcaactttgtcaaaaatcagctggccataaatgtgagggtttatttctggacctccattccactcatctgtagatctgtatgttaattttatactagtaccatactacttcagttactgagaagtctatgagtcctccaacttagttccttttatttttttcaacattgttttggctattctgtgttcctcacatttccatatgaattagaagcagcaggtcaatctctgcaaaacaaaacaaaacctcaaaaaataggtgaggattttggttggggttgtgttcaatctatagaaaaatttgaggagtatttccatctttaacagtattaagtattctgatccataaacacaggatatttttccatttatttagatctttaaaaaatttctttcaacaatgttcgtagttttcagagtgtaagccttgtacttttttgggaggattaaatttcttcctaagtaatatattattttttaatgctattgtaaatggagttaacttggtttcattttcacatcgtttattgctagcatatagaaatacaaatgatttttgtatattcgttttgtatatacaagtgatggttaattttaggtgtccgctagactaaggagtacctagagaatggtagagcattacctttgggtgtgtctgtgagggtgtttccagaggagactggcgtgggagttggtggactgagtagggaagatctgccctcaatgtgagtggcaccatccaatgggcctggatagaacaaaaaaggtgtctctctcccggagctgagacaccctcctcttgccttcacacgttagtactccaggccttccagcctttggactctaggactcacacatggctccctgggttcttaggcctttggccttgaattgagctgtgccccggcatccccgggtctccagcttgcagactgccgactgcgtattgtgggtctttcagcctccatgatcgctgtgagccagttccccaaatgaatcccctctcatgcatttccatatgtacatcctattggctctgtctctctggccaactctgactaatacattttgtccgttggcatgtgcttgctcaaagatggactatcttccccctcaagccaccgtttctcatgggaaactcccctgtttctcatgagatcccccattcatccagggagccttggggtgcttcagtttctttcacaatcagggagtcaccaagcgctgccgagggcttctctgctaaggatgcccgttgtctcccggcctgctctcaagggaaccccacagcttctctctcacccttccctctcccagatggcgaaggtctaacctggtcagtgcctgatgggaagggcctggaaccgagcctttcctgagagggctcctgtttctccctgtgccttcctcagaccatgccaactggggtccccactcgcctccccaagagaggcccctgcctgtgcttgttttcaggacgagctcccttactcatccggagcagcgtccaggcccgcaggactgagcacaccctggcatctccagtgtgggctcaacggggctgggtcttctagttgtgcttttctttgtgatggtcccgccaggtggagctgcatgtacttattgtggctgaaacacatggttttgtttgtttgtttgtttgtttgagacggagcctcactctgttgccctggctgaagtacagtggcaagatctcagctcactgcaagctctgcctcccaggttcaagcaattctcctgcctcagcctctcaagtagctgggattacaggtgtgcaccaccacgaccggctaattttttcgtcttttcagtagagatgggatttcgccatgttgtccaggctggtcttgaactcctgacttctggtgatccgcctgcctctgcctcccaaagtgctgggattacaggcgtgagccaccctgcctggcctgaaacatgtttttttccaaaagagactgttgttaattgttcccaggaccacagtctggaacactccaaaaaatacccttgccgccttcagatctttcttaggctacaagagaaatactttcgagaccatcctggccaacatggtgaaacaccatctctactaaaaatacaaaattagcaaagcatggtggcgtgcctgaagtcccagctacccgggaggctgaggcaggagaattgcttgaacccgggaggctgtggttgcagtgagccaagatggcaccactgcactccagcctgggcaacagagtgagactctgtctcaaaaaaaaaaaaaaaaaaaaaaggaatactttcagatggtccttcttggcaggaatgagttccatcctggcctagggtctttaccttgccctgaatctctttgtgggtcaccaaacttatggactgaccaggctgggccttgtacttggctggacccatgctgcctggctcccgagccctttgcattaggccttcccagcatttgttcttcatccctccttggtggcaaccctgtttgcctggtgtccccggtgacacctggcactgtgtgtgttcaggaggtgggcaatagagcccgatgcctggctctgattcctcttctgtcccccatagctgcatgatcttgggcgagctgcttaacctttctgtaaacctcatcagtaagctggagttgctggcactggcctcacgggtccttgtggagattacatgacttggttcttgtcgggacttagaactccctgtggcatgcagaggccctgagggatggctaagtgctattgttattattactgcctgtgagctgtagtgcacacacaaaatgtgtccttaagcgaagtgacaatattgtgatcttgtttttcaactcattactttgcctccacgttaatgagccgccctagcagttctcaaattgtagcccagaaggcttgttaagtacacaatgcctggccccacccacagatctgggtgagtctgagattctgcctttctaaggacttccttggggctgcagccgctgctcctcattgggcactttgagaaccactgctctgtggggtgtgtgccctgtgcgcgcctgtgtgtgcctgtgtgaatgtatgcctgtgtgaatgtgtgtgtgtttgtgcgttcgtgtgtgtgcctgtgtgcacgcaggtgcctgcatgtgtgtgcctgtgcttagatgtgtatgcccgtgtggatgcatgcgtgtgtgcaggtgtgcctgtgccttctcatggcccaggtgagctgccagcagttacccgcacccccacctcagttagccctcggtgtggggcacaggagcccaggttggaagctgtaggaactcggggtcctgtctttgggcacagcctggtgaaccgtggtctttgttccccaggtgcttcagtggagcaggccatggccaacctttgtttcttcttccagcgggaggattaggaccggattctgggtgggaagcagccttggtttttatttgctgggcttggcggcctatatccggaggacctgtggtcgtcgtttccaccctctccccctccttctccaagttaacccctttattttctcctgttcatttcaacaggatttatgcttgattaagttactctcttttatcataattaaagaaaaatgtggtgggagagcgctaaatactccgttcaatgaaaaccagattgttgaacctgcagggaaacaagggctgccctgtggctccaggcccctcccagggagattgatcgctgggagctgtggggagggggcggaggggaggggatttaagctcctcagggaggaagttgcctgctcctgccggcccagaagacaggggcctgcctccgggcttgccaccccctcgtcctgggtcctgcctagcagccggtgtgtaacatctcactcctgacgcagtcaggcactgctctgcacacaggccctggatttataaaggcctttttctcatggtgcctgcgagtctcctgctgtagaacacgacctactggaatgtttttaaaaagtgtgtttttagttgactcagttcctcatgctggtcgcagttgctcataaaggcaaggctgtgtaaaaatcctgccgaagccctggcagtcacaaagcccttgctccaagctgggacctggagtggcggggcggcgaggccccaccgcctgcccagtgaggtcaagcctggctgcgggtggttcctgtgcaaaagggaaggctgccttcatgttgcttaggaaattgtttctgtaatatgtgtaggattctaaaaatggttagacctgtgtagttggatgggaggggaggaggtgatgactgcaggctgggtggcctccccgatggtcactcgtgaaacaagatggcaggttcaggagccatggtctagtctcctctctgccacactgcacataagtgtgcatgggcacctggtgaaggggttgttttaggggatgggagtgaacacaggctctgggagtgaacacggattctggagactcaagacaggggccctgccacttaccagtagtagggtgacctcaagtgagtaccttagtagagaatggtggaatttgttcctcgtccattgtggatggttaaaataatacccctggcatgggactgttgtggggactctatgagcttgagcagtgaggcagccagcacagcaagcatcccagtgcatgttgggaattgccattgttatgggccatctgtttaggaggtagagcctcagacaaggacatcgtatttgtcagctcagtctgccgtaagtaccccagactgggcagcttaaacaacgttcattctctcacagccctggaggtggaagtgtgagatcaaggtgtcagcagggttggtttctcctgaggccttgctccttggcttgcagttggctgtcctctccctgactcatcacgtggtcgtccctctgtgtgtgtctgtgtcatctcttctccttataggacaccagtcaggttggggtagggcccactcatatgaccttgtttttaccttaatctcctctttaaaagtctgtctccaaatgcattctaaggtactaggagttagggcttcagcctgtgaattttggaggaacacaatttagcccagacatgcaatttaacttacagcattttgagcatattaaggtctcgttttgttgcccaggctagagtgcagtggtgcaaccacagctcactgaagcctccacctgctgggctaggtgatcctcctgcctcagctgcacaagtagctgggactacaggcacacaccaccatgcctggctaattttactttgttcgtggagacagggtcttgccatgttgcccaggctggtctcaaactcctggcctcaagcccacctcagcctcctgagttgctgggattacaggcttgagccactgcacccagcttatttatgggttacaaggacaattcgtttttcttttaaatttactttttgttgggaagtcccaacaaatgctaggaagacctagcattccaagattttatgggtaacctctggaacctgtttatttctgcctctctggctcactgggggctcctggaacccagagccccaggatcattctggtggtgcggccccggtgcctcacccggccggcaggtgtatcagacttctgtgcagcagtgtctcttgggggtgctgaccccaaggccgccctggtccctcctctctgaggtagcatcccagagttgtgtagttacgctggtcctctgcttccagatgcttctcccccataccacccccattcccctcatccatgccaccatgtcatgatgtccgtaaaccagcagccagaggaggaagcctgttcacactgctccccgctggggagaagcattcctccagcaaaggcaggctgattgcccctgggtgtcccttccttctctaagatgcttaccctgccactgggggcaggaaactgggggtggaggtcactgttccatggaaagggctgttccagtgctgtgggagatgaaccttcacccctcccttctcggcctgggatcaggacttttcagcctgcatgatctcccgacctcgcctagggccaggctgccctggcgggagggccgaacgccgtgccctgatctctctgggctgagtcctgtctcaggagcacttgtcatgcacgctcagacactcctgtgggaggaaagttgcagggcctgggctttctgggcacgtgctgctctcttgctaggagtgaggatggatggactctaggagcaactattagcaatccagcaggagcttcctccagcctgcgagcattgagtctaatgtgaacgtgggtcctgtgggataaggggaggcacttgttgggatggggtgtggggtgataatttgacttaaagttaagatatttttaagagtaattaagttaaattttatgttcacgaggcctacagaacagttccattctcctgaaaatgttgtttgaagcattttaatatcagttgtaatataagctattgatgtgtcttttcatttgcctttactaaaatattggaggcatatcttctagttactaattattctaattgatggattaaagtagtttttaaaataaaaggctttgctaattccctgctggctcatccaagccaaatggccggtggcaatgctatttaaacagcactctaccattcaaaccttacctctaacgagaggcaaagcagtgaggtcttattctaaaagtgcatgtgtaagtggttttgcttgatccagcgtttaggtctgagacctccagcttaccaaccgccttccactttgcagccctctcagaggcagcggagactccagggccctgagattctgatcctgcactcctcctatcacgtgacctcggctccttaaaagaggacacttgctcttaattttcttgtctacaaaactggggcagcaataggaaggccagtctccttcactgagggattccgggtaaaatgaaatgactgcctcattaccttgcagtgacaactctgcaaatggagtactgtctttgaacagaaggtcagcagcagcagagtgtgctgtctgtgcttgtctgtgacaagaaaagaccatgccagtcaagtcttggtcgttatgtagtggagagtgttgccattggcccctatcctacgcctcaccacctcctgcaggctgctgactccacgcccttgtgacttggtcacaggactttcctggccagggtacttggtctacaggcaaggtacagtcgggtgctgggagccagtgcatccccctgctatcagcaatcctccaacaataagccctcattgggtagtgaatgctccagctgccttgcctatgggggtgggcagctctgagacgtagggtctgtgtggcctcccacaggggcccagtgtcttgcgtggtgttgcccatagcaggaacctactcatgcactacctctgggcctcttccccttctcctctccttcctactccacttcagggccccctggcttcatctcccaaatgcactctggattgacttcttggggagcccaatctatgatggaaatattacagatattggccaaggaacactttgttcctcagcgtctcatgcaccctcactctgctcacagcttgctgcttccttttagatttcatgtctctctgccatttcccacagtccttgctgcccacagccccatcaggccgagttgaatattcatgcatgaaaatttgaccaactcggctcttcatgcgctactgtcacagcatcagcccgggcactgtagattctcagagtgggatgtcgagtgggacgtgtcctgttgtcttgaattagcagccagtacccagagtgaggaccaagggggtgaggtagcccttggtctcaggagcactgcctgtcataggggtggatactactcctcggggcttcagagcgggtcctgcacccacctgagtctcttgtgttgatcagggtgtagtggagggctggaggctggacagcacctgccctcccaacttgacttgtcacagtactgtgtctgcaaaggccatctatgtggagccacacctcccgggaccttctgcttcactctgccccggtgccacctttttgaccccaggctgtgtcctctggtgccacctcccctccttcttccacctcacctgttggggccaccttacctattcacagcacggtcacctttcccagtaactctggttgggtcgttaaactcgcccgccctctggccgttgagtcctggtgccctctgatcaggcccatcccggaggagccctgctgttttggtctccggactcaggcctggcaatcccaggggcaaaggcccaaccccaggcatagatcagacccctcatgcctcagccccagtccccagccagtctcccacagcctggctgcctcatcgccttgctctggggctggtcctccacgctccatggtggttatttttaccctcacccccgcccacaacctcgcgctccgccagcctttctggagtgtgctcacagagcatgcgctgaagagggagcaaggaaggtggcgaacgcaggaggggcagccgtgtccagtgctgcactgtgtccggtggcagaggcctgtgccagtgggaaggtcagaaatctcccttctcttcactctcttcagaggagaaagaagtcttcagaaggggaatcccccaagttcttggtccattttcctataggcatccttgtcctcttctttcctgttaggataggaatgatttctttaactttttgaagacagtgccttggcctgttacacggaccctattttttaccgacttcttatggacttacattgtgtgtgtgggtgtgtgtgtgtgtgtgtgtgtgtgtttgtgtgttttccatttatttgtaactctgccctttcaactgaatccagatgggctcaagttccctggtgtgaagagaagacaaaatgctgccctccgcacctctttcaggaaatcctcctgtattatattttgaatgcagctccctccaccatctgggatggagtcattgctttacagcagtcatagctgctgtcatgaaagatgaagctggtctccaggacactaggaggttgcaaagagccacatgagtttattggatatgacagaatttctccaagtggggaagctaaattaagcaaatggtaagtatacattttgtaaaatgataaaactctcattagttgtggttggttcagttgtctatttagaaaatgcaagggactcaactgaaaatgttagcaccaatacagagatgtagtatgttggctggaggattcaggaccaacttagaaacatcagtggcatttttatatatctgtaaccataaaaataagtaatagaaaaaaaaccagtagcagcaaagccattcagatacccaggaataaccttagtgagaaaggcacaacactcctgagacttcactgaaaaatttgaaagaagattagactaactggagaagaaaaccctattgtcttttttttttttttttaacagagtcttgcaccgtcacccaggctggcgtgcaatggtgccatctcggctcactgcaacttccgtctcccaggttcacgcgattctcctgtctcagcctcccgagtagctgtgattacaggcgcgcactaccacatccggctaattctttgtacttttagtagagacagggtttcgctctgttggccacactggtctggaactactgacctcatgatctgcccgcttcggcctcccaaagtgctgggattacaggcatgaaccaccatgcccggccagaaaaccctattgttaacgggaaagtaatattgtaacgatatctgttctcccaaaattaaaatacaaatttaatacagttccaactagcaccccagtaagttattttatagaatttggcttgctgtttctgaagtccacgtagaactgaaaatgagcaagaagaaccaagacagaaaaagtgaaattatcgtgagaaccttgctctacccagtgtcaaaatgtattgtcataattaaatagacaaatagatcaaaagaagagaatagataatccacacacagacctatggaatatatggaattttttttctttttcttttcttttcttttttttttttttgagacggagtcttgctctgtcgcccagggtggagtgtgcagtggcgtgatttcagctcactgctagctccacctcccgggttcaagcgattctcctgcctcagcctcctgagtagctgggactacaggcatgtgctaccatacctggctaattttttgtatttttagtagagatggagtttcaacgtgttagcctggatggtctcgatctcctgacctcttgatccatctgcctcggcctcccaaagtgctgggattacaggcatgagccaccgcgcccggccggaatctatggaatttattaagtgataaattcactcacttttccaatgagtggggaaatagtgaagttttaaataaatgatgttagaacaattgagtgtgcctttgggagaagatcatattagacatctgttttaataccagtcaccccctgaaaaaaatagatgagaatttgtttatgacattgaggtaggaaaatcgttcttaataagtcaacaagaactgtaatagaaataattggtaaatcttaatagaagccctattgaaggggcaaaggacaatttttaaagggattctcaaaaaataatatataaatagtaaaattagagaagagactcatctttgcgagttacgttaatttcctctggctgctgtgaccaatacacacttagttgcttaaaacaagacaaatttatccccttacagttctgcaggccagaagtctagcctgggtgggtgtggcctcacagccccacagcctcttcccatttcctggccttctctggcttccagacccacctgggttcatggccccttgtccatcttcagagccagcagcatggtttccctgtctccttccctttgcttcagcgtcacagtcttttcttgtggtcctgaaggacctttgtgggtactttgggcccacctgattgtccagggtcgtctcttcatctcaggattcttaatttaatcacacccacaaagtccccttagccatgtaaggccacatggtcacaggttctggggattacaatgtggccatcttgggtggatccttactctgtcttccacactatattaggaaacataaaataacataagttatgatttctaactatattagcagggtttaaggtgagggtatggggaaatgggcattttaataaactgtggagtatagattaccacatccactttggaggacagtcagctgtccttaaaatcaataacaggtgcacccacaaacccagtaattctgtgtcttgggatttgccttccagacatactgagctcagggcacagagaagtcgatatgaggatattcatagcaatgctgtttgtgggagaaaaagaaataacttaagtgtttattgctttggaaatgaccagaaaaccaactcataaatatggaatattagtgctagggaatattacacagcaatgaagaaaatgaggtgactcaaacctcaaagatctccaagtagcatgcagatagtgatgctatttaggccaaacaacatgttcaaaacacgatattcctacaggcagaggaagatttgaaagcgtaaatgacacagtactaactggttctatctggggaggttgaagtcatgtccaagagacttcagctttatctacaagtgtgactcaaagagaggagtgtattcacgtaatacttgcatagtataaaagaaagtttcaaatgtaagggtataatgaaacacaataaagggcataatgaaacaaaaggtcagatattctgtagtaatctccagaagtccacattctttaggaaatcaaatttgattctagggctgtggattacatatgaacatggccatgtggcctagggtgggaatcagggtcagagcccagggttctttctagccggcttccttggaagtgttagttttaacaggaaagttgaagagaagaggggagcttggaagcacatctttgaaagtgaagagattgcgttttcgccagtcaagatattttccatgtggcagtttatttctacctacagggcccctttatttgatctcttgttctctttcctcacccctggattgattctccatgttgaaatcaagaaaagcctgggaatctcatctgaccgtagttgggaggtaaagaagagcttgtgggaacatttcctgtgattctcttgaaattacaaaaccactcaagaaagggtttggtcccatggtaaggttggccaaggtgatctcaagcaagccctagagtcacttccgaagtgtgggcacctgctagacatgcctgctagatatctgttcggatgggatgatggagggtggtcgctgtggaactgcacttagggctggggaatgtttccctgtagactcactgcagtccattgtaagagtcctgatgttcctagacaataataccttttaaggaattgtaattgctttaaaaatctccaaacactagaatgtgtatctcccctttgtatgctacctggataatagtataaacatgttcccaactctcagccagcatgagtctagtacagtatttcaactacagccttaggtccaactgttttttttttttttttttttttcttcccccctgagacggagtctcactctgtcgcccagcctggagtgcaatggagcgatctcagctcactgcaacctctgcctcccaggttcaagcgattctccctgcctcagtctcccgagtatctgggattatgggcatgcaccaccacacctggctaattttgtatttttagtagtgtttcgccatgttggccaggctggtcttgaacttccgacctcaggtgatccacccaactcggcctcctaaagttctgggattacaggcatgagccaccttgcctggccccaaatgttatttttaaaaaattaagcgttagccagattgattaaaacacagatggcactgagcagagcccccatatatctacgtccatcatctgatgccctgcctccagatgggtggacagacagaggtccactccttttctgaaaaaccagcagagtttacatacagctccgctcccctggtttaatttaatttaatttccatgcttcactgttaatactgaccttcaaggtaggggattcgcaggaaaagagttctttgtcagcttattgaatggcattctgtcttgattaggactggcatgcatacgttatcagaagtagaaatcaagaaatagcatcaaaccaacatatttccttgttatgttttggtaaaatcacatccatttccatggtgagagaagactcgagtatccttggttttgtgccccaggtgataaggctcttcaagtttctgcttgctctgaaagattccacaatataaataactttctttaaaaggctcatctgtttcacattttgagacagtttctgtactgccaggcagagctgctagccaggagttctgctgaagctggctcctgcatccttcccgtcctggagagtgagtctgcgtgggtgtttcctgcaagatcaaagcctgacttgagcttggtcgagcggaacttgagttctggggagtgtgattcttggtggcagcgaagacgtgaaggatgtcttcctgcgaccagcatctcctggccggcaagggcaggatccatcatgtgctgggagtggggttcattctcaggcctgctctcgaccctcagccctggcaggctgcacacggaaatgagaaaagcggctctggaggagagctggggtgcagttgggtcccgcctgcctgggcttactttgaaagactggaactgttgctgtatgagctggctcctgcagggcctcctctggcgccctcaagtctctttatgtgggaagtggggggactgcattagggagccctttctgggggagtatatgtgtggtatgcaaatgaagcctgcttcccatgttttggtgccttgtacagaggagcaagggggcgtcgagggacctggcagtagatcttgtctgcaaaggactacctctggaatttggggagatggtagcgaggcctaatgaggggtccaggagggagggaaagtggcctcccagaggggtcaggctttctgtccagtgggacaggcacttctcccgtctttctggttctaagtctgtctgtgctgtctgcagacctgcacatactgatgccttaaagctctcatttcatttctctgttgaatcttgctttaagaaggatggggccacacccaccttgagcccacattccctccttgtagtcatcctccatcttcccccatttccccccggcccaatccatgccatttgtgtctgtgagcctttgcatgtgctgttccctcagcttgtgatgtctgcagctctgccccatggtgaatccatgcggtaccctgtggttatctgggtaccagaagggcacctcttcttaaacatgtctatagccgctttgacagataatttctggaggcacagttctgttcctgaagtcattgatatttgagccccatctgccctagaaggcaacggagtggtacctgaaaagacagactccagcccagtggctttccaagggtcttctccagagctctggagttcaaacaaggttcagggaccaccgcaaatgaggttcagggaccaccgcagagggtgcttatcagggggctgagggtacaggcaagactcgaaacttgaaatccgaaacctctggcctgcttgaatggagcagctccattgcattgtggttactgaggtttctcctgagatttccttgagaaccttcaattctctgcagaaagtctgctctgtaggctccagatgccctgacaaagcaccgagactgggcggcttaaacagcagacattgatttcctacagtttggaggctggaggtccatagtgaaggtgttagcagatttggtttctggtgagggctctcttcttggcttgtagatggccgccttctcactgcatcctcatggggtggaaagagtgagtgccagtgtctcttccccttcttgtaggatgccaactatattgaattggaagctcccttttgtcccttttaaccttgactgcctccctacaggccccgactccaaacaccgtcttactgaggttcaggctttgacatattttgtggggacacgcctcagtccatggcaaagcctgtaatccactctacagtattccaagctttaagatgaagagacaggcttaacttctcaaggtcgtccagagagagaacagcaggccttgcctgggccccattgttgtagaagcccagccgggaggcatcctggggttggtatcacccagtggctccctgtgtgagtgttagtcacctctggctgcaaccaccatgggattgcttcttctgccagctgcttctcagtggggactgtggtggtggttgcatccgtgtagacatttgtcagagctcttcataaggtacacctatttttttttttttttttttttttttttttttgagatggattcttgctctgttgcccaggctggagtgcagtggcatgatctcagctcactgcaacctccacctcctgggttcaagcaattctcctgtgtcggctgagtagctgggatgatagacacctgccaccatgcccggctaatttttgtatttttagtagagatggggtttcgccatgttggccaggctcttctcaaacgcctgacctcaggtgatccgcccgcctcagcctcccacagtgctgggattacagatgcgagcaaccgcgcccagcctgggtgtgtgttattatatgtagattataccccagcaaagctgattaaaaccatgctttggtgtgagcatgctttgggtgtgcatgagggtgggggttggcttctgaaaggtgctgactgggaactcccctagtgcatatgcttgtcctgtggtgagttttgggtaagaattagatgggatggtgcgctggtatggatgtctctctgaacatcctcttgcctgggatccacacagtgagatcacctgaaagacttggatttgggggcaggcatggccttgtggctctggctggttgcagcatccctagaagagacttaccaggtggtcagggcctggcttccccaggacaggctctcaccctgggcagcccaggccctacactgggagtgagggtgctgggtggtggggaggggtgcgtgcagaggctttcactgtgctcttgagtcgctggacagagggcccttttctgagaaagtttcctcattacaccttgggcgtagggtggggagggcagaaaatacaaaactgcccctccccttacaggccaccgtaactttctctgctggattggattcataattttgaactgtgtcatgaatgcattttgctttgtctggcaatcttttgcaaaccatgaaatagttgctttacattaggatgcgtgtgtagaaaatgcaggaatgacatttccccttcccgcacccccttccccccgccccgccttccctgtcccatgggagcatgcaaggacctggggcgaggcttgctattctgtataccgtgggggagtatagaaaatcattactaaacacagcctttttgacccgtgaacttattcagcttctggttttcttttcaaccttcctaacagtgtaggttctggtagccacgaacctattacacctattaagacaacatcccgccagtatgggggctggacatggggcccatccggggctgcagttctttaggacaactttgagcaagttcagccccagccgctgcctcctaaaactaagaatatcgtacagtggatttcagatttgctgtggactgaattgcgtccttcccaaaattcatatgttctcttcagacacagagagagcctgatatttggaggacggcaggaggaagtaaaaccacagcctgcgtgacagcaagtggcacgaaggaggcggtgtctttggggctggcagctccctgggcgaggaacaagcgctggtctgtggaaggtgcaggagcgtggaggccgagagcccatcttgtgtgccggcccagaggaggcccccaggaacctgcaaacagtgtttctttgtgctctcggatcccaggacagacgacctgaaactggtagctagaagtctagccaccaggcagcagtttaaatcaaaataatcactttaagaaacggtagggaactttgctggagaaccatttcctccaccctgaaataggaaaacacattctgatttatgctgctggctcagggcagcttgctgaaacgtgtgcagctccgcgtttgatggccccctcccttcatccgccccgctgcagggatgaaaaagcatttagaaggagagtgtggggacggccgttagtgccagagtggctgttgaaaggccccgctctgcaggaaagtggccttcagaggccagaggtgcagacagcagggccggcatcccagggttgggagcagctggaaccaatgtgggggttggttgtgttttgaattgagatttttagaaaaactctgccaagcccttctaactaaacgaggtcactcattcctcaatgagaagcagacatggtccagccaggcggggcatgtgcagactctggagccgggggtggtgccacggggcttgtctctactggggctcctcctgctgcccctgtgttccctgtgatttatcacctgcagacatcgacatgcatgcggaggaactgtagttgtgtggagtctctagacatatagtaatttctaagtgcgagcaagctagtgggattgggggtcacagccctttaggagaagtccattttctccttacaaagcagagaattgaagtcagcagcccctactccccacctgcgcctctcatctagatcagcatttcttaaaggcactgagggctgtcaggaaggacgtattatgtcggaaataagaacatttctggaaaaataagtctaggatacaacagactgtcttgatggggccatctgagtctttaacctggtcatgcacctgacctgccccacgggggagcgtggagggccctctggctcagaccccactgactttagggctcctggacagcacctgcttgtgttctgaggccctcattccaggggagccatgagaggttgaggacatcctctagttcctgtacgtgtcttcagggtctttgcagggccgcaggccactgtgttttttctgtattccctggataactggctgctccctccagctccaacatgctctttccctcctgcgcatgtaaacacattctctgtgggttttttttctctcatttttgcttctagttgttctcttttaaattcatatccttttagcaaatagtttgtaaatgtaaagaggaaaagaaaccccagagtgccccatctgaggggctcacgtgcaagggtgtttaggcagctctcaattgggagcatctgtgttttcacctctgctcgagagagggggaagacacctcttgaggggatgcccccctcaccactgctgcaggaaagcaaagagctgcagagaattaggtggcacctgtgtgccagctggatgcagagcagcacatcagtgacaggtggctggaggtggcctctgggctctcgggaaaggaggaggggggtggcaggagccctggcacctcctgcctgctgccctctgattccagaggtggaattaagatactggaatattcaaagtgcctgtctgggcaaacccagcccatttctcctcattgcctcagaggcagagaagctgtggacaattggaagtgggctggctgtgctgttctttaggtcacagttggtggagagtgcccatgcctgtggcgtccgattggcctctggcatgagacactaacgcacggggtgaggacacggcccccaagggccagcatttgggttcttgtgcctgtgctattgacttgcattcttggtgcctcagtttcctcagctgataatcgggataatgatggggtcattgtgaggattaaaggagataacacatgcatggcacctggcatacatgtgttggctgttcctaatcttgacagcagtaatagtaatcaggacagtagatgtttgtgacacttggggatcaggagtatgctcgagtaattaggggatgaggaaaataactccttccttcacctgctgtccatttcttgaagatacttgcttttgaccatctctcctctttatgctttttctctcctttctttccttacttctctttctctctcttctttattctgcacttgctttgcaggcatgggtctgcacaggggcagtatggatccaagtcctgttactggaagcctggcctggtgaggctggtgggtggggctggcagggtgagtccatcagaggtccacatccttccccgccctgacttcattgcttggccttgggtaaggcattctgtcttttctttggaaaatgcagacagagatgactctcatggtggctgccagggccatgcacagaatgtggaggaaatgcataggctgctggcagttgaggtgccattaatataagaaacagtctaagaagaggaaacccagtggggatggcagggaggtctggtgcaaaccccaccaggctggcatccgagggcactgaagattgaaggagtcccctgccaaagcttgctcccaggagaggtcatgcagacgtgtggagggcagagggacgagggaggctgctcaggagcccaccgggctgtactgctgagcaccagcttttgcatggaaatacacatttacagactttttcacagacctcacccatttgcaaaccacctgatggttagatttaaaacattatcaccttaaaccaataaaaataatcttttaaaattaatactttgaagagcttccggcctttgccagtctgtgtcagggactgcagctttggctgtgactttaggggcagtctcatgggcattcaggcagaagccacattccgagacctaagagaatttatgaattggtagaggagcatttaaagtgttggtgtggcagcttagaagagggactgctgtgagttttaaaaagctcctggtcaaactctagaaaatgttgagttttccgtggactcatgtatttattaatgtgttaatcacttccatcactctgggagtgaacacccacaaagttccaggtcatccgtgcagatccctctgtattctgtgctttgttttgctttgtaaaatgaggataaaaggagcatacgtgagctcaagggcggtcaactgatgggccaatggccggggaatgagactggacccacgtgatgcctgtttcagtctatgatttggctgtgggtgcacaagctctgctgtattacatataaggagctgtttcagcttgtctttggtagttggacacagtcttgcaaatcatgccattaatgcatacagcccatgaccacacatctataatggtctcacatgtataggatacaacaaatgcatgcaatgaaatggctagagaatgaaacagagctggagcatggggtgtggatctcaggtccttgcgtaggaacaaggggctgccgctatctcatttggacacgcagaggggatttggatgctccaggcctgcctgggagacagttgagagagtcacccaggctggcatttggttctggccatcaccgcctcacctgtcttggttgttggtgtgtttgtctctcctcattccctgtgcgctgggcagatactgactgagaaagtatgggcggtgctgttgtagggccagggagcatggccagctcaggaggaaggcccccagctggggatccagcctcgctgcatgtggccccaggcctgaaagaggggagctggcatcaaaactggaaagaaaacgtcagacatctctcctgtctcagtgatgtgggtttattttaatgaacagaggcctccttgaagcaattgggtatggtgggcccgtctggagggtgcctttggaagtgtttgttcttgtctggggtctgtcactggaaggctctgggttttcagtgcactgcagaactacaggtttcctcattcataagaagagaaggttagaaagagaaagagaaacgggtaacgttatcccgggccgttgtggcattttaatgtcacacgtgtgttcctgtgcagctgctggtccttgctctcccgggtccctccgctctgattcctctactacccactcccaatgtgcctcccaggacagcggggcctcgggagtgccccttaagcagccaggtactctctgctctgccagatgaagtgggcatttcccgggcagggtgaggctctccctgagaaatgctgggcagtccagggaacgggggccagtacagtgtggggtgatacagcgctgtgggcaacgcaggtggggatgtttcatcaccagagccttttgtgagtgatggaaagaaacacatttatgaaaagaaaggggtgcacttttggtggggtgtccccaagtaaaaggtggttgagaaggggaattgtattaaacagatcaccctcaggagtgtcggtggagaaaaccgacttctggctcccgaggctcccccgggacacatcacccagtagagaggcagacacacatgtatgcacgccacactcacataccacacacaccacacatacagcacacacacaccacatacaacacacacacacccacaccatatgcacaaacatgtatccccacatatatacctctcacaccacacacacaatatataccacatacttccatagacaaactcaaagaaacacacaaacacactccctcacattcatataccagacacaccacactcatatacctccccacaacatacacgcaccacacatacccacagcatgtgcacacatatcctcacgcgtatacacctcacatatacacacacacatagacaccccacaccacacatacacacacaccccacagacccacactcacaacacacaccacatacatacacacatacaccatatacacacagacacacccctcccacattcatacaccacacatatacacacaggcacacatgcctgtacttacacacacacacacacacacacacacacacacacacacacacacccccgatctgacagcaccaggaatcaggccaggatattggaggaggtgttttggtaaacacgaaatacacccagcctcctgctgccccccagaaccccttcatcttgttaattggtgaattctttcctaagctgctgtcatcccacgcttgtgttgctatgtgcctgcgcgtagccagtgcggagggccttgcatgttgtgtagtgtgtgctttttgtgtctttattttaatgccatttttgactcgttgcccaggattccgttgttagatttccctctctcccaaactgaaatttatctaattctcccttagagtccaccgggaacttctctctagtttctgctgaagcagacttctactgtgtgccgaaagacgattttcttgttctttgtgcccgtttatttaaaactccagaatggagcactgcttttatgaatgctgggtttcacgataactcataacatctgtcatggttaatgcttggacacacaatgcctttactcttttaaaaagggtctaacgggagagatcctattttccgactgcagcggggtctcctgcgccggccgtggtgctcggggtctctattcccaaggggccgagacagccatgctggggtggctgcctgcgagcctggtgagggacccattccccagtggtaacatcagaagcagagggttctgaagatgagatcttaactcggaatgaaaccccgcagtccgatctcagggtgttttcgtgtcttgtctatacaaaagatagcttatgccaaggagagaaaagatagcggctgtgaccaggcgtggcatgactggtgagtcaggaatgtttcaggtgccaggaggggaggggctgcaggagatgcagaagggcgtctcagcccttcactcaacactgtgtgcgcacttggccctggtcccagctctcggggccttcaggttaatccatagtctgagtggctcacttggttcagaaatggcctggtggtgcctggtttaatttgcttttataagctaataggctaagttgagcatttcaaaggggcgatttttccttcttaaagttgcagtgaacacatctttcaggatccagagggagaattacacacataaggtatgcccaggttaaggaacacggtaaagattttaactgcctaataaactgtaaatccctaaataaactcccagacaaggcagtaaaagctagacgtcaacatgcaaaaatgaaactagttttgtgagggtagggggagtatgggtaatttctgtttttcctaaaatacatatttaaagtggcagttcgacaatgaaaagaaaagtatggttcggtgattttttttcttttatgtgttccacttagaatgtgtgaacacgtggcgctgtagcctacattccttattcttttacttctaccttatagcttaaaattaaaaaacctacaacagtgattaaaactatatatttttttctacttgccaaatgtgtgtagatcaatctaagaacactggacattaagaaattttcttatgcacaagtggaatttgtcttctccttttaaaacacgttaaacatcttgaaaatgagacaactgggacatgaaaaatttatgagatggctttgagaataactgctgatcctttaattgattggccttcttccccaagccccttaagatcgcttacctttgggtagtgttcataaagtgcaaagagcagggggattgttttaatatggcaaggcttctccccgcctcccttcttaaacagctaagtttcagccagtcatatttggtgatttttttattgttacaagttttggttttttatagtggatgtgatgtgatctcatgacatggctgtttgttttaagaccagtaagcaggctgggcacagtggctcacgcctgtaatcccagcactttgggaggctgaggcgggccgatcatgaggtcaggagatcaagaccatcctggctaacatggtgaaaccccgtctgtactaaaaatacaaaaaactagctgggcgtggtggctgagatcgcgccactgcactcgcttgggcgacagagtgagactccatctcaaaaaacaacaacaacaacaaaaaaaaaaacagtaagcaatgcagaacagaaattcctaaggaaccatttattaccatgtacacatctcgagtgaacttttaaagttgttttccttgaatacagtttttttaaagaaaaattattttattttcttgtgatgattttccaatctaataatcttaaattactgtaatttctttcctctagaaaaacatggtatataccattgaccaaagctgcaaacaaaaatctgcagctagtaagtggaatatagcagacagactgaatggacagggcttgtgtgatttgaggggttcctgcctggcacctggctgaggccactgcccaggcggcagaggtggaggagcgagctgccattcataactgggcagcctggaaaaaccaaggcttcaagaagttccagaactcgccccaatgcaggatcctgtgagccgcagctcctcctgccaccctcagagctgacatcagctggcacagcccccagaccgggggtggggcaggggcaggcagttagctgcgttgtcgcaccagaggacagaggagacctgggctttcttagcattgctgctcctgaacatccatcagctgcagactgtttttttttttttttgagatggaatctcactctgtcttccaggctggagtgcagtggtgcgatcttggcttactgcagtctctgcctcctgggttcaagcgattctcctgcctcagcctcccaagtagctgggactacaggcacgcaccactacgactggctaatttttgtatttttagtagaaagggggtttcaccatgttggccaggctggcttcgaactcctgacctcaagtgatctgcccgcctcagcctcccaaagtgctgggattacaggcgtgaaccatgatgcctggtccagactggattaataattggtacctcttcccaggacaaagtgccatacgacaataaaaacaaatgaacttcacccacaagctacactgtgggtgaatcccaccaccagatgacaaaggaaagaaggaggccacagagaagcatggtgggattccatgtgcaaagttttgtgtgtttttaaaataggtgaaaccaaactctgttgtttagcgggggaatgcaggaagtaaaacctcattgcttgcatgtgccttggattttaccaaacacggctggggaaagctgttttcaagctatacagaaaggtagggaagtgacgatcacaaaagcgttgtcctagcgcccagaaattaagcaattactatagaagtgaaaggcggacatgtggaggagacatctcgtgagagtgtttttgtggtgtcttcttgagaaaggttttgtgggagaccttcccaggctggcaggtggcttggcctccaccagtcagcccctgagctccacaggtgcacccttccgcctcctgcagctgcaagtagtggtagcttttccctcccacccctgctggtcttcctggagagatttagttcattttaatgattttacaggtcttatggaaagatgctcactgctgttgctgcaggctcctgagtttactgcgatgagtcggtagccttactgggaacattttcactcataggagatggggatcagggatggggcagcagggccgtggagagagttccaatctacatttaactctgagcatgtcagggcagcccccagtggctctgacaggctgtttttgctccttctgcttttccagtatatggaatgagggctgggggcagtgtgtgtgcagagaagagagcaatggagcccataaatcagtgcaaccgtcatggtgaaattgtacatgtctccttaaagaagccacggaaatggaagtgttttaagacagaggagccaaggctattttggggtggcctagcatgtttgtttcatgaggcacatctttgcttccattagcaaatggcactgctgtgaactggctggattggtgcaggacccttggaggtgagggggcagcaggttgtggagagaggcttccaacaagggggcagcacatgaagactgcaggggctgtgtctgcaggggctgtgtctgcaggggtctctttaggcatcttcagctccatcaccatgtgttgtaagacatgcctggcctcaggctcctcatccctggcccacccacccacagtgacgtttgtgcccagagacataaggcagggtgcattcctgtgctggactggaaaagcaatcatttcctggcagagtgcttggtcaagttgtaaagtggtctcacttgaacagagcccatgctatcgggttttattggagctgtgtttatcttgagctctgcaggagtcaaaagctcactggaacttttaggtaaaacctgtgtgtgtgcagatgggccacaccttccttggtttcaggacaacagttttgctcggctttaaaatcgcaagagctctcatttgggatccatacctttggagaaggtcctgacaatttgactccacttaggtttttcatgttggaatcttaagtgttttgatagatgggtccctttctcagtgctgtgtgtctgcatgaatctcgctgacctttgcttctcatggctgtcacagagcagccctgctgacgacgggactggtggggtattttgtcccagctattccatgcataaggtgtagagaatatgtcttctgccatggctagagttaaataaaggaaaattcatgccaggctgagttcaggattgatgtttgctctgtgtctgcattaaaaaataaaccacaaacatggttgtcctccagcagggctggtgttgagttagcagctgccaaatgacttgtggatggtgggtttgcacgcggggacgtggtcctgggcatctgtggcacagggaagggaggagatgaaacacagctggggctctgggcaagtccacccagcgatgctcaggaaagccaggacctgagtgggctcccgtagcccacagtttctggtcttgtttcctgagccaggctgtgcctttttctctgggtaacaagatagatttactgacctttgccatggagatcatgtactttggaacccgagacctgtttttactttccatttgtcagctggaacaaaagccggaatgagctttacagtctgcaggcccagggggacggcctacccactctccacgcagtgtcctccctggaaccatccctgacctcagcctgtgggtgcttgaggctgggggagagaacacaaagagaaatcccatggctcgaatatgcctcagatttccctgaacactgggctggggaaagctgttttcagacacagtgaggggacgtccctccctccatatcccttcaagctgagtcttgcagcaggactcgggtctgctcttggctgcgtggggcagaggggatgctccagcagatgtccaggacagctccttctgcgtgttgaggccccagggagctctcgggggctgagcagagctgatcagttggaggctggcaggagtgcaggcagctcgaggcgggcatgcaggtctgcagggtgcgctggccatgggctgcttctcttcgatagggggtcattgagggatgtgcatggaaaggagtgctcagctactccaggggcctggggggcacggctctggcgtgtggcggtgctggtggtgggactgggagttgtctttgtcttggaatcagttgagggtgacctcaagagatttgacttgagcgcctgaaaggacatggccgccatttgctgggaaagggacagtagcggttggggcaaagctgggagtcacgatacaggcacagtgcactcggcatgccatttggacacccagctgggggtggcaggatgaggacctgttgcagaagtgcagagcaggacgctggagcccagcgtggatgcgtcgggagcatccggcaggctggatggacaagcagctgagcagccttgggggtccttcctccctcccaagcatttatgtctgtgggttggtgtcgtggtgacgcatctgcagccaccctgatgccatgcctcttgcccactcggcagagaacacctgggtgttttgtctctcagcccaccttccctgtccctctttgggggtgttgcagggcttaggggagcccactctgagcccctcacctgcttttgtgtaccacatcctgacttgctggtgggctcctacccaggagggctgtgctgacctgggcagggctcaggtctggcactgcagcgtcttctcttggcatctctcttcctcctttcccctccactgaggtttggggctataggaggccccgatttctgccaagatggacgttgtatttctagttgctgtttctctccattgttttggggtgatttgaggagtgtacctgtcagggtccaactagagaaacaaaactcgtaggagatatatatgaaaagatttgtcacagggaatcgacttacttggttgttgggtctgaccaggcgcatttgaaatccatggggccgaccacagggaagggtggctggaactgtgggcaccgctgaggctactgtccctggtgggagtttcctctttctcagaaaagccgctgctttgcttttgaggccttctactcactgagccaggcccacctgggtcatcaaagattatctcccttacttaaagtcagtcacatgacagccgacctcagtcatgtgacagcatacctggagagcagcacctagagttgcatttgactgatggctggaccgtggaccctggccgtcatgggtaggggacacagcctttttttttttttttttttttttttttgccattgtgaccccagaagttgacaaagactcctccaaacttctcatttaacatctcatggatgtttgaaaacataacataatctgtgatatttcttctgtcgctagtcactgtgtttaaattttaaagtagtgaattgtaccagtgttaatccaaagaagaattaagaattatttttccctcacacctggaatggcagtgaacatggctggagttgattggctgtgagtgccttgggctctatgagagattcattaggggatctccattcctcatcctgctctacagggtcagccttgtggtgactttatggtcaagcccaccagtggtcagcttgcaagtccaaacaggacagaacatgtgtggcccagcctgaaggaggcacccgttggtctggggctctctgacttggacttctttcttaggtcagggacatgattggcttgcatttgaccgcacacacagcatctttttacagggaagggagatggcaccatctcctctggcagggcaagctgaagtctgcagtccttcccttgcttttttatttttttgagacagttttgctcttgttgcccaggctggagtgcaatggtgtgatctcagctcactgcaagctccgcctcctgggttcaagcgattctcctgcctcagcctcccaagtagctgagattataggattctcctgcctcagcctcccaagtagctgagattacaggcatgcgccaccatgccaggctaattttgtatttttagtagagatagagtttcaccacgttggtgagattggtctcaaactcctgaccttatgtgatccacccacctcggcctcccaaaatgctgggattacagttgagagccaccacacctggcctgttcacttgcttttttgcaggggaatggatgttgtccccccaggtgcctctaaggaaaagcagcacagaatcctcacctcatttccaccaaacgcggctggtcccttccaagaagatatttgattcctctcagcccaaaacatgacttcatgcttgtgttctttttcttaaaaataataacaaacttacgttacaaaagtattaatacaattttttttttttgtttttttgagatggagtttcgctcttgttgcctaggcttggagtgcagtggtgcaatctcggctcaccacagcctccgcctccctggttcaagcaattcgcctgcctcagcctcccgagtaggtgggattacaggcatgcaccaccacaccaggctaattttgtatttttagtagagatggggtttctccatgttggtcaggctggtcttgaactcctgacctcaggtgatccgcctgtctcagcctcccaaagtgctggggttacaggcgtgagccaccatacccagccacaaattttttaagaaattgaaatcatagaaagtgtgtactgtcaatcccttcccaggtctcaaaggccaaatgtagctcctggtaacagtttgatgtctaccttttcaaacttgagtttctctacacacacacacacacacacacacacacacacacacacacacacacggacacagttatttagttttggtaaaatgtattcatactaacttttttttcaaaatttgttccctcaatataataacataaacttccatgaacgatggatgcataattctttcttatctttttaatggctgcaaaataaactcgaagctccatttcctctgcaaataaacaagaccattgcccactatacccagtttggggaggctggtgggctccagtctactttcctgcttctgcagttgggttttgtgttgttagtgctgtgtgctctgaaacctgcttatgggagttgtgtttgttattgtacagacatagctttcttttcttttcttgttttagagacagagtctcactctgttgcccagactggagtgcagtggtgtggtcatacctcactgcagcattgaactcctggactcaagtgatcctcccacttcagcctctagggtagcttggactaacaggttcataccaccatatctggctaatttttaaatttttatcgtttgtagagacagggtgtcactgtgttgcccaggctggtctcgaactcctgggctcaggcgatccacctgccttgcacagccaaattgctggaattacaggcaagagccaccacacccaatcagaaatagtataaatgacataatctataaattcaatgggtgtaaagaaaggaaaaactcaagttgactgatttgaaaatacaggatgaggaaaacttttaaagataatttttgttgaattagatatgagtcataatgaaaattgattagggttttgtattcagatgcataggtgcatttagacactttaagaaaaccaaaccaggaaacagatgaaatatgtgatttgtgaagaaattaatgtgaacggcaatgagtagattttttactcaaagaaagggctgggctgcacatctgttgattgattaatgatggttcatttatttgtattacgttaaaaatatttattgtgggtgtggatcattatttatagtacctaactatcatttttaatgtttccattaatgaacattcatatgaatgaagattcgtatggatcttggttatatccgtaggaaggcgtcagctggtccagttccagaatatgactgtgccttcatttcattgctccctgctctagttatttacaactttctttcccttggtttcaggtaacctggaaatattcacagattacacctgagctcacagccttctttgagatgtgtgcttttttttttttttttttttttttgagacggagtctcgctgtgtcacccaggctggagtgcaatggcgtgattttggctcactgcaacctccgccttctgggttcaagtgattctcctgcttcagcctcccgagcagctgggattacagttgcatgccaccatgcccagctaatttttgtgtgtgtgtgttttagtagagacggggtttcaccgtgttgcccaggctggtctcgaactcctgagctcaggcaattcatctgcctcagtctcccaaagtgcaaggattataggcgtgagccaccgtgcccagccaacatgtctgcattttattacaaatgtgcccatacacttctgagaagggtagagcatgttaatctgtatgtctcactctggctgcactccgcggaagcgactgcctgtgaagtttaattggcttggaggtgggacagtgccatgatgtctagttaacatatatttaagttataccttgaggtcatttgaaaatggaattctccctagtgcccagctagtgtttatcctctgatgtttctaatcatttagccatttaaaatagggagatgatgagacacttggaaggcttttaagaaattaatctcccacttagctttttataatgttaattaatgtctataccaaactcaaagcaaacattaatgatgtaataatctaagtagtctctttaatatcaaggctaattcaaaaagccttgtatgaggttgctcagcaagtcttgtcagtgtattaagacaggaaacagaaacaaggggcgagctaatggattgtagaagatgcaattactatttttaagagaatatgtgctttatttatttatttatttgagacagggtcttgctctgttactcaggctggagtgcagtggtacaatcttggctcagggcagcctcttcctcccgggttcaagtgattctccctcctcagcctcccgagtacctgggattacaggcgtgcactaccacgccaagctaatttttgtatttttagtggagatcgggttttgccatgttggccaggctggtctcgaactcctgaactcgagtaatccacccacttcggcatcacaaagtgctgggattacaggtgtgagccaccgcaccctgccgagaatatgtacattaaagcccaagtaaatagactaaaaacttttagaattaatttgtgaacttactaatgaatttacatacaatatattggagaagatttcctatgtatcatcaataatcagaagatgtacaggggaaacattccattgcaaaagcaaaatagataagccacaccactgtaccatcaaaaatatgcaggtgctgttgaagttacctaaaaacttcaccaaacaataagaaagtatgtaagaataatgaaattttcaaaagtacaataatttatttatgctctggaagactgaatgttttaaagatgtcagttcttctgaaggtagcaaacatttaaaataaccccagtgggacttttcagggatgctggacaaaaggatcctatgactcatttggaggaataaagaaatggcaaatgccaaagaaaattttgagtctgataaatggtgaaaggagatctttactgtgttttcaaatacataaaaaagctgcaaaaactacaacaacatggcactgcccaaaatgatggatactgataggagaacaggcaaaggagacaaatacatttcttcagaagaaaactactatggttgttataacaattttaaaagtcctgagaatcattgattccagaactagaaattaagcctaccgatggaacacgttttggttatcaaattgaacaaaattatattcttagacactgctgatcgatctgtacattggaccgatctgtacattggactgatctgtacattggaccagtctcttgagggaacgttttgggccatgcatcctgaacccaccccctgctccttggacccagtactttcacttctaggaatccgtcctgagtagatgggaagagaaataaagatttacagatggaagtgtatcatagctttatttggtgcagttgacaattagaaatgaacctagtgttcagaagcaggaaaatacttaagtagatttcataagctacatagagaaatgtttatttatttatttacgagttggggttttactcttgttgcccaggctggagtgcaatggtgtgatctctgctcactgcaacctccgccttttaaaagtcacattaaaaaaaaatgatatagcaaaaccttcaaaatgtaatattcatctataatgatatgggaaaatttttataatataatgttgatttagtcaactaagctaagctcacaggagatacttgactacatagaagaattgggttccttatggagcatatagttagggggcaatataacaaaatattattaatattatattaaaagttaatgtagcaggaagttcaatttatgaaatgagtctaatcgtgtaacaaaaagtgaactatagagtgcgtatatagttagggaagtcagaaggccatgcgtcaatgctttaataatggtcttgtctggtaaacatatggcagatgatttttgttccttcattattctttctagcactttcccaattttctgtaaaagctgacttgcattttaataatcagagcaaagttataaaagaaccttcagagtctccccttctcaaaatgttactggatgcagtacatacacatttacaaaagatcacattcttttttcttttttcttttttctttttttttttgagacggagtctctctctgttgcccaggctggagtgcagtggcgcgatctcagctcactgcaagctccgcctcccgggttcacgccattctcgtgcctcagcctcccgagtagctgggactacaggctcccaccaccacgcccggctaatttctttttgtatttttagtagagacggggtttcactgtgttagccaggatggtctcgatctcctgaccttgtgatccgcccgcctcagcctcccaaagtggtgggattacgggtgtgaggcaccacgcccagccacatttatttaacccagtaactaaccactgatttctgcatagttatgctggtacaatggcaggatcatgtaattaaccagtatatttctttttgttgttgttgttttttaaggaacacaaataaaaatgtaaggtttacgtcaaggttaaaaacacgatgaaataagaaagggggtctggagtatgtgtggagatatacctgggtataacaatgaaatggcgtgattgctggtagaatgttcactatgccgcaccatgttctatgctccatacattcagtcctatgaatgggaagggctcatttcccccattctgtagatgagaaaactgaagcctggtagtcacgcttcttgggagtatcctgggtagccctggccaaggtgggctttgaacccagggagcctgggctgttaactacaaaaccacaggatacgtacaacataagacatcgacattccttgtccaaatcgccagcaggcaggggggcgaagccacccagtgagagttcctaagagccagaaaggaggagacccacactcctgctggatcaaagctgatgtaagtcagcattaaagcttttcattggtttattcgccgatggaaggaccttctctttctttctcttgcctcagaatcagtgtttgcccaagacagcaatttgtggaaatggagaaaatctgagaattcttctgtggctttgctaaattgaggcttgtcctccacagtccatcctaccctcccccactttttttccagcaaaataagtgatagttcactcaccttctaggcataagagtcatcctttctctgtggtcaaaccagttcagagctgactcaaaagtcctgtgacttgttgaaatacaacattggatgtgtgccccctgttctctcccggcatcccgaatactggcgttgggatgtttcctgacacccaccttctccccctgcctgggtctcaggcagatgttcctgtccaagtctttctgcatcgtctgggcaatggcagctgtccaggtcttccaagtgcaagatctcaggatggtttcacaagtacattgcactctgttttatgttctcaccacaggggaattagaggtgaattacaggtgagtggagcccaccgggtgccccacaagtttgacaccttcgccccaggtgtccaggtgggtgaatagcccatcacatgccccgcacttccagggagagtctctcctagcacctgggagcatctgctcccaagtggggtgtggctcgagcaagctttaactttattgcgtgtcctcagccttccctgattaccgaaggctttcttacgtatcctgggaggggcgccttgctttaagggcttctgtgtgttacagacatgctgccagcggtggaaacagatgtgtttttcttgttggcccccatgtctgaaagacacatgttatttgtcattggcttacttaaggccacaaagaaacattgacagcccagccctgtggcctgtctgacttgggaacaggacccaagcccagatcgccccccttccttttcatttccttggggccagcgggccgggggtgccctgtgggcagcgctgttcactaggttaagggggccctgttttgtcagagaagaaaatacagctggcaagaggccttgcccgtcaccccctcctgccagggcaggctgtttcctaattgcaaacacatgggctggttccagagcgtggggacggattccatgtcccgcctgggagagctgtgtgtgtcccaccccgatgccctgtttctcatcaaggaaatgggggtgttgcataccagggccagaggacagctgcctcgggtgggggagttcccgggcactcccagatgtgcctgctgggaacatttttggtgtgcgttgaaacattgggatttggttgcatttcatcgtcctctgtttcctactacatttttggtgagtgcttttgaaatttttctccctttcgcttttcttcctgtgtttgccactatgaagtagacctgttgaatgcactgtgtcctgcagaggggatgccctgcccccggcgtgtgcacattcctacctgttagtgaggtttagtgcccacttcactgggaacatgaagtgccaggggatgctgatgctgcagtcccaaaaggccacaccctgagtggagaggcccctctagcaggaagcacagtgagtttggctgggggaaccccacaggcatgtaatccaaggggcttggatgtaatgcccagcttcatcatttccttgtggctctgagcatttgtttacctgcctgaggcccatcctttatctgtaagatgccggtaatggtgtctctctgggaaggtggcctggtcgtgatgattacctgggaactgtgaagtagagaaagtctggcagattctatcgtcggcacatgaaattcttattttctctgcccatcgacttagacacactgctgtgaagcaccagctcattgtgaaaagcctgttttctctgagctctgctagtggaggtagaagcaggctgactctgagcacaggcatggaagaacagcaacaaactgcaaggatcttagaggaaccgctggtgaatccggcagagattgtgtatttcagagaaatttaggagattgagatgccttgggcatttggagctctgggggcaccttccctgacgccccagcctaactaaatgtaatcctgtttattcattgtcaccttgggaatgtgggcctccttattccttcccgtcttttcattatgagagttttcaaatatgcacaaaagttgaaagataatactgcaaacacacacataaactctccacccagattcagcggttgttgatagtatgctgtttcttgcccccacttcctctctgctccttaaatccatattttataaaaatttgttgctgaggctgggcacggtggctcatgcctgtaatcccagcacttggggaggctgaggcaggtggatcatgaggtcaggagtttgaaaaaaaaaaatcagctggcgtggtggcatgcgccggcaatcccagctacttgggaggctgaggcaggagaattgcttgaacctaggaggtggaggttgcagtgggccgagatcatgtcactccagcctgggcgagagagcaagattccgtcttgaaaaaaaaaaaaagtgttgctgaacagtttgaaaataagttgttgacatcatgacatgcccctgccccaaatatgtgagcatccatctcctctaagaaaaactgtcattctccataatggcagcaccattcttacatggaacaaaattaacagcagtcccatgatatcgtctaatggttacttgatattcacctttctccagttctcttcagaatgtgtttaatagcttctctctctgcaaacctggatctgcttgttataactgcttagactctttaatctaaaatagcccttcctttttgttcttacctttgtgacattaactgttagaagaggaaaagctagttatcttccagaatgtcgcacctttgaattagtgtgactgttccctccggtgatgtttcttactgtctcccttactgtctttctctgcccttgtgtttgctgtcagactggatgtctctgcgtctgtggccagaagacttattggagaagctgtgcacgtctggctgcatcacacgtaggggtcagtggtcccactgtgtcagagatgctaaatccgaccacctggtgaaagtggtggctgcccccttctcccactcctctgaaaagccatgttgtatttctgcctgtcctgagtatgaaatctgtaggacgatacttggacattctgtatctatcttgttccccaaacagccttctgctcagtggttttcgcatccagtgagtcttgcctgaatcaggaattttatggcaggttgcaaaatgacaattttctaattttgccatttctactgaaaagaaaagcctcctctgcttttgagaatcattgatggctgatgatatttttaaaaactcagtgtattacagaatcatttttgttcttcctgatgctcaaattcagtctatgggagccctggaagcaggtgcctttgttcttttagtttttgagtctttcttccaatctggcacagtgaggtaccccagctcaccttgtattatacatccacatcgtccagagtgaagatgaactgtttttccaaggaactctgatccttggtggtggtgtgtaaacaccaatgcatggatgctggtgtgctcagggaccctgagtggccactgcctccaggcccttcagtaaccagctccaggagaaaacatgttttaaaaatcttgactttgtatagctggttccagttcaaatttcatattcaaatgttggcctctttacatttccatcacttcatggatttctctcatcccgatttgggtcaactgccgtgtttacaatttgttttgaagcgcctttttttctagccttttcttggtttttgtttaactgtgaggcttttttgtatatatatattttagctgtcttccttccatctttcctttgcttgtgtccacctttcactaaacatacattcagcatcagttttatccaagaaataggaagccttgaaagacaaggaccctcggtcccagtgcctgggaactgctgagtagatgccttggacctgctgagtagatagtatagtgggcatgatgagtgctgtgtaatgacgccggggctggagtccttgtctaaggcagagacgtgaggatcttcgccagggcagtaatatttgtgtcctggggtgaatgtctgagccaagatgatgtttgaggatagcagaaagactaagggttggcactgacaatggttgactcacatttggaagggctggagaacgaggacagggggagtaagtgactcacaggtgagcatgtgggcctttcaggggtgcatggctgtggaggggagctgtggggcagggggtactactgtatggggcagtctgatctgcaggtgttgctgagggagcaggctgctgggaagaccaggcagccaatgtggaaaggagaccaccaggaagggtacagacagcagaatggtggttccatggtggaggggaggtgctttttaactaaaggagttgggcaataataacgaagcaatgcatgcctatcacatactgtatttatttgcacaggctgctgtaataaaatgccacagactgggtggcttaaacaaccgaaatttgctttctcctaattctgggggccagaagtccaagatcaaggtgtgggcagggttggttctcctgagcctctccatggattgcagatgctgtcttctccctgtgtcctcacatggctgtccctttgtgcgtgtctgtgtcctcacttccccttctttttttttttttttgagacgaagtctcattctgttgcccaggcgggaatgcagtggcatgatctcagctcactgcaacctctgcctcctgggttcaagcaattctcctgcctcagcttcctgagtagctgggactgcaggcatgtgccaccatgcctggctaattttttatttttagtagagacggggtttcaccatgttgtccaggctggtcttgaactcctgacctcaggtgatccacccgccttggcctcccaaagcgctgggattacagtgagtgagccaccacacctggcctgacctccccttcttataaagccatgggtcatagtggattagggcccatgtatagaacttcagtttaactttgcaaagaccctaaagaataaggtcacattctgagggactggaggttttaacttcaatatgtgattttgggggacacaagtcaacccataacacacccatcgataggaagcacttggctatgtaataacccactgactgtgaaacagcattgcgcacgtgggtgtggaggggaggggagggagggagccagcgtagtggtggactctcctggtagattgcctgccgtggctcctgactgtagatctggggaccacactgaagccactgtgcattttctctgctcagggctggggaggtgactgcctggctctttgtgagttccccaggacaccccagatgaatgtgttcagggcattgaattctgcttccattggtctctgctggggccctggtgtccatcttgctcagattcccggctgacttgtagagggcatcctgccgtgggagcgtggctttgctcgggtcttgaggatgagacttggagcctcaggagaaacacgtccatcttcccagacattgttttgtttattaaattaaaatttgaggtgggggcagtgcattttaaaaaccaaaacaaacatggacatgtaataaagaatgcaaaatgtacgttaatttttaagtagaaaggaaaaagattacaaagatagctgtagtgttgaaggcagcattgtgagagactcatcaccatcccgaccttcttactgccccttcttcttcatatgacaggtgtgcacacacagacacacacgggtacagacacacaggtacagacactgtcaaagacagacacatacacactcagaggcacacacacagacacatactccaagacagacacacatacagaacactaaacagacacacacacacaaatacagacatacacagagaacacacttagagacacaatgacattcaaagacagacaaacacaggcacacacagaacaaagacacagacatacacacagaacactgagacacacacacagaatattgaatgacacacagatacatactcaaaagacacacacagaacacactgaaaaacacacaaagacagatacacagacactgaaagacacagacacagagaacacagaaacacaccaacacacactcactcaaagacagacaaacacagacacacagaacactcagagacacacagaatattcagacacacacaaagatacacactcaaagacagacacacaaagacagacacagaacacacgccaagacacgcagagacacaaagatacacaaagagacacacagacacatacacagacacacacagaacacacacagagactaacagacacactcaaagacacacacgtagacacgtgcatcgtcacagacatagacacacatacagatgaacagccttgcctgtagccccgaaggttggcatctgggaagcaggaccctctctgtgcagcgacagctctgctaggagcctgggggtgggggtcagcagctcagtgacaaggttggtgcttctgtggtgttcccatgctgtgtcagtcctggccttgggctgacacctcattgcccgccagctccctgtggctgcgggggctgcagagatcattcaccagggctcatctttgggccgagtccattcacgccactgtggccatttccctcccctagacccaccaggcttctggctgggaagagaggaagaggcggaccacctctttgggactgaccggacagagctgtggggaccgtgggttcttcttgggatggaagaaggagtcatccttcaagaacagagacagaatagcatgacctgcagaagagggagggggcaggactctgcaggctggggaggccctggtcccccaagctgctcatgggtagggctcagggtgggagggagttgagttggtggcttcctgtgcaactaagagaggccagaggtgaggctgcccaaggctgtgtgtgggctgttctccacgccattggtatttccatctccaggactgctggggcagtcgctaagaccccctgagcccactctgttctttctgttttctcatggatacagtgttaggcttactatgccagcgtgggccatggtctcttttcttctagagagtcccagggacttcctttgtggcatatgcttcctctcggccacctcagaaggctctgttaggaatggttcagtcattgcagacattgccatgtcacctgaggggtctccagctcccctggggtccaggtggcatgaggggcccttttggagagggctggctactggtggggtgggggggcgtggtgggcgggagttggtggttgtggtggagtacagggagatagcctgtgggggggtgtggcattttgttccagttaaagatattgcaaaagatacgtggttgtgctgttgcaaaaaaaagtttagtatttctgtcctccctgaatgaaagacatttagccttgcatatcaaagaataggaatctgtcatcttagaagttactaatttgcagttctgtgacacagatttgcgtaattagaggatttgatcgccaggcatgtgaaacctatacaaatgttggtccatgttcttggaaagaagtcaaactttgaggctgtttgagcgagtcatgattctttaaagttgccacaagctgaattgatttagtttggcagaaactacaaaaacaaacacggagtttagaaaaagcaaaggctcatgtgatcaccgctctggccccagagaaaaggaaatgcttcgtaagttgcattgcggaccagagcgtgttgaggctccctttcccccacctgataattttcagatcgtctggaacagctataaacaaaagctggagacgctaaaacagcccatagccccttcccctccctctcctccctctttcccctcctcctccctccccttaacaactagctgggcctttgttttctttttgcttttactccctaagtaaatcttaatcactgtcgttaaacccagccttgactttctttccgttcccatggataccagatggggcctcatattggcgaggtggccataggactgcaggacccaggaggccccgacgggtgcctggcaggcgaagggggtgctgctcctggcgctggtggccgggtaggatgatcctgagcatcagtgcctggcccagtacagcttgagagacccccttcactccccggaggagacgtgcacaggtggccaagctggaggagcctgcaagttgcaggggtcagatgtagcaggtggcagccatcaggatctgtccaagccgaaccccttccctggtgccttgaggtagagaccatctctgtcttgcaggtcactgtctctatcttgcacggccacctgcagtggtcctatagctgcattggtctgggatttaccaggagccctggaccccacgaaggtctcctgccttccttggtggaggcacgccagggtcctggcatgaactcagggtggggacagtccagttctgcccctccctgctgggtcccggccttccttctcgactctatttcagtaaagtcaggttggctgagagaaatgccaagccaaccgcctcaccagcactgagcccctggggttgtgtttgaaacggcagatgtcagctctgccctctgcctgctcagaggccccgagtgaagcttctggaaggcaggcagagccacagcccatgggtctccccacaggcagtctatatctctccttctgagatgttcaaagtgatttagaagtacagatggtcagttaaagacacctcttcaaatgctttgtcacatttttaggagatttaagatcatgtcaacttaaggtagggcagctttgctgtgggatggttatctttctctccaagtgtcttgtctctgtgaagtggggctgaaaaccaatggtgagtggtaaatgctggtctcttcccccttctcccataccctcactcctttatctcatgtttaaatcctccatggactgacatgtcatatctctggaaatatgtagaaccaggcaattctagagtgtgtgtgttgggggggtgggggggtggtaaacaaggacccactgaaggaggggatcgcggatgccagggagggccctgcataccacagcggggagctgtggggtggtgtgggagccttggcaggtgggcaggaagcctggcggggggaggtggcttctgcaaggagatcaggtccaggctgggggacagagctggcattcggggcaaggccgaggaagcacaagtgtccacgtctcaagacaagaaagagcgtgggtgatctgagaccagccagaggggaaagggggctactcttgtgggaggtgaggctgcccaaagagcctgggcaggtcctcggctggggttggtgaagatttggagcttagttgaggtaggtggaaacgccttggagggtttcagcaaggaggagatgtgatctgattgatctcttgaagggtctcctgtggctgtgaacatttgggtaatgtggtagagcatggaggtggggccaggccacagcagtgagcccgagcaaggttgctggtggctaccgtgagggcaggcccagggagaaagacaggggacactggctccgagacctgtattgggatagaactgatgaccgatggaccggcttgaggaatccagggaagagggagccagatggcatcgggtgtttgccttgagccactgggtagaaggtgaggctgcttaccgtttatggagaagggttttctgagagaggagatgcacaggctttgggggtgaccgtgagcaggtagagagtggccagtagggtcccatggggcaggccgagtttgtgccgtgagagccagtctcagggcaaccccttccacgggcgctgatggttttgtgttgctgttgggtttttgagacatgcctatctccatacatctgtgttgcctagggatgtgatgatatccttccgatcaactgagaagggccttgggaccgtaccctgcattgcagggtggtttggcatcctgtgaaatggttttcctttgcagggaatttatccaaagaccatgggtttcagaggctgacggtcacagtgccatcacactgttcgtcaagaatacctctcgatagccagcaggtaatttctgagttaagaacagtatttacactgtttatttgaggattagtgaaaatcctgtaactcactatatgcctgtcaaaggcaagaggagcttgattgaatgcctcagtctggttgtattcattctacgtgtgaacatttaatgttctcttttaagcacctttttttttgacccatgtattgtaattgcctttaaagtttatttttcaaaccatgtgacaacttttattatgaatgaaaatgcctgtggtttctttgctcctgagaggaagctataccgctctgtaataactgatcataagagaaaaatcattttatacacaccatgaatctgtaacatggcatgttggaaaccatagatcattttaaaatgtaatgcatatcatttattatggaaaaaggtattttttaatgttactggatttccttcttgaaacataatctatataaccatgaactttttcttaaacccattcagtaagcaggactcctcaattccctacaagaattaaattacttgtattacctggttctgccttatagctgttaatatttttctgtgtcctgttttctgaacaggcagtgagagggcacacctctgagtcattgctggggacaatcacttgcaggtgcttcgaggcattgtcaccgactgtgtcagcccttgtggggtgaggagggggcccagagtgcttctctaagcccgtggaaaccagccgggcctgggtttcagctgggttgtctttgttttgtgttttacgttccacggcccatgggcccatcgtccagccatgccggaggtgtgtgttacttcatggccacactggctcccttcctgggagttttccttcttcacagcatcacccagatccttgaaaggcagaaccctgtcatttttatcttacagagaagaaattaggagcacatggtggtaatgccctaccatttgacttaatgagggagcctgtaaacgtgggggatctcaggttaactttttgtctttaatttgtggatttcttccaaagagtggtatgtaacagctggtctgctttaatggtatcgcttatagtgatgttatttttgtgttcagaagtcatggcttgtcagcggctggcagtcatggagggggccagattctaggatgatgctgtcatgccagggccctccggagcctgtctcacctgaatgatggatggccgctcttctccctggagtgtgcgtggggtaaggggaggctagagtgcgtggcctctgacgaacggacaggagtggtttctgttctctggggaagtgacagagccaggctgttgccttctagaggcagagggatgccttccacgatcaaaaatagatcaaggtttctttcactttgatttttttcctcaaacattctcctttcttcttccttcttttattcttatgttcagaggcagggtgtccctctgttacccaggctggagtgcagaggtatgatctctgctcactgcaacctcgacctcccagcctcaagcgatcctcttgccttagcctcctaagtaactgggactacaggtgtgtgccaccatacccggctggaacatttttcttcttgacagagcatcttattttgcaatatcttctcctttaggagggaaaatgcagtacagctcaggattatacttcagtgccaccatgtcccataggccctcagctctcattcttgctgccccctttaagttttctgagtgagttttgctcatttccagtgtccaagggccttctgaactctggcatggggaagcctcatttttcccaggcggtaaacacgctctctgaggacttagagtttaggatggagtgttttggtgaagggagtcagaaagggctctcagagaggtttctagagggggccctgaattcatatggagtggcaaagcgcagctgaggaaatgggacacgctggaatcttccagaagctgctctgggttcaaggcggggcccattgggtttctggggttgggtgttttctgacattgcgttgcagtttggttcctcaaggatccacagtgtaggcctagtttcagttttcacaaagcccctttcttgactcccactttgccctcgccagtttctgtggctccttccacccagtgggccctgagtgctgttccacagacggcaaacccatcctgacccagacgcgccagccccaaacaatctggttactgtttaaacaaccagtgtaaataatgagccctccattaccaagagtataaatacatttagacaagtcagagttttgtagagtgaaagtttaggttatgggaaaacatcaacagctgtaatttgtaggcctttgtagagcgaggggtgtgagtgatgtcaactgtagaaggtcgacatttcgtttatgtgtttttttgtcattgtgccaggaggagatctttgttatatttcctttgctgagaattaatcttgagggggcagcacctgccagaatttttattttttttttctaaaagtaaatgtcacctaggtggccagtgttgatgggcaccctggcagggctgttgtgggcaatgatgatgaactttgtatggaggattgcatttggttagcctctcctagtattgaaaaaataattaagggcaaaccacagaggcatatgattgaggtgaattctacggtaaggagacagatgtacatgtgaaaaagaaccacaaacattggctccaggtagagagcctaatgctatggctttcagagcataataaattgagctctgtaagtcaacacagtctttggctgggtctctctttggtgaaggggtagaatgaagcctccctctttttattttttggccaaagtgggaattatctgaagacctgtaaaattaactatttttctttacaaggagaaagggacaaggcagaaagtcccacgggtgtgagggattactgggtttctctccaccaatagcacagttcacacacacccagctccaatccaaggcctatttcagtgggccccagtgtgtgcgacaggccacacacacgtgtgtgtggggggggtggggcggggaggacaggccacacacacgtgtgtgcctgaccctcagaggtgctgatcccgccttatgttggaaataacattcagtgttggttttcacagtcaccatcaatccgtggattagcttctgaggcctcccctgacatcccccctccccacatgcccggcccccgcgcaggagcctgaggatgtatttgttttaagattacctacttgggaaaaatagaaggatcgggtaatctcaacgacctgtttgctaaatccgcccgttttcttctgcatctctacttccaagagatgtgatgtagggatttcacacaaacacacacaaggagccgaagggattgtgtagatttcagcagagacgaggagtcaagtgaatggaacaccgagaccaagtttgtccagcctgtgggccacttgtggccaaggatagctttgaatgtggcccaacacaaattcttacactttcttaaaacagtataagattttttttttttttttgcatttttttaagctcatcagctgtcattagtgttagtgtattttatgtgtggcccaagacaattcttcttccagtgtggcccaaggaagccaaaagattggatatccctgactaagaccaaaccagagtaaaaaggaggcaggcacttggagtgtgtggggagctcccctgggagcaaggccccattttaaagtgtgccgggatctgttttaaccaggaatagaaagacacacagatacggaaatggcttgtgtcacaaaccctagaagaggaggcttgctgtgagggaccactctgagatcagcaggaggctgagggagtgcagggaaacagggcaggcatgtcagcatgttccaggtgtggggctgcccctggctgtcggatccccggccctgggtgtctgtggccaggaaatggtggcccagggtgagagctgcatgaggaggtagttgggtggcttccgtgtggttggtttgcctatgaaggcccactagcaggtgatgagtgcttccctctaggaattggccagcccttctagcaattgagaggggccatatctctaggatcagcaaggccccagatgtcaaaatatccagaaatacagcaaatataaaggcatgattaacacagccccttcctcagagagaccctccccctcactggagaagcgctggggcggacctggggcagtggccagctttccacacgggccgaatgagcacccccggccacacaaaaggatgtccccatgtgggccctgcgctcccccgtggttcccgtgcagtctgggcctgggttcccctggagggacagcttttcccacctttgcctgtcactactgcacggagggctggcagaggccctgacagcttttcccccaccagcgccgctgtcccggcctaggggaggtgtgggaaggaaagattcgtatgggcatttgcttcctgtcccccagctgccagagccagtgtcccttttcctcctagccagcctcctcaggccgaagagagggggaattcccatgagtttgccacttgctctgttgatgagaaactgcatcttatagtttctgctgagaaaaagaaccacgtgacgtgtgacaccagaatcgataccacttgtccttgtaccttcctatgccaggtggggcttaggtcctagcctctgtgcagcatgagagtgccgatgtctcccctctgggtctgtcttcctcacagcgaagtggggtcctaattagggccgcattccctgtgtgtgacccgcaaacgtagactccactgggatgcagaggccagcgtcgtccctcctgttccggccacacctggtgacacagaccgcagggctcccggtgctgcctgcggttgtccttgtggcagcctttattgctgagcatgcagcctctgccgagagtgaccggacaggcgtcctgtgtgaatgccctgtctgaggtggaatttactgaggtgttgctgccgctaacggtaaagaacacaagggcctgggccgggccctgcttgcagctgaagtgcagagcagagggtcccagctgggttggcatgtttaggcactgtctgcggaagtagatgatcgtgtcttacaaggaggtaaagcccgggagaacatctgttcaagcagaaggcaaaaccgcacccgtcaatcccgcaggtgcttcgggcctgaaactcgcctctgggaaggcatttgctgatggcttctcatgtttgccacgtgaactctctcacctgagtgcttgagaacatgtctggcttgctgcatacactagatagtgtagctgttcaaactcttcccaaagacgccagcccagtaccgatgccaagccctggtgaacttcaggaaaccatagaccccattctgattctgtcgccaccgtagcctcgggcatggtgggaaatgtctcagcccagggttgctggtgctggctccgccgacatgggggctggaggccctgtgcctgctgtcttgccctggggcatctgaagggcgggactgggggtcatgtgtggcgtggccgatttagtcgctgagcagcctgtgtggggtctcacttgctcctcggtgcattgcaagatcagctttaccaagttgccacaaatgacgtgtgagagaggcactcgtttcaattccagctgcccttggacactggacactgttgctgagtcaagatgtgcggagggcagtttgtggtgatgcccttcccattcccagcaaggttagcagtgacccttgaaggtggcagtggagccgggagcctcaccagcctggtctgtgggcatgtgggctctgaacatgcagtggtgaggacgcccacggcgcctgcccactcttgctgccggctgtaccccagacgcctcaagccaagatgttgctgcatgtctgtgaattgctaaaaatgagtcacactggcgagtgccgctggccactgagcaggatttggctttggccctggacctgcccggttggtgctaactgcgtgggctgcactgctgcacccccagctctctgtggggctgaggggtcagtggcttattaagagctgtgcggagagaactgtgaagcagaattgttgcttttgccctaacagtggctgtgaaaatgaatgtggccatttgcaaagaagctgaaataacagaaggcagagaaaagctgtgtgcctggtgcccactgttcctggtgggttcacaatggcagagggttggggtcagctgaaaaggagtctcaactgtgtactgactcaggagcaaaatgttagacttcacactgacactcccattgagcaaattatctgcatgtatccttttggtttttccagggaatattggcataaaagaacacctggtggggagagatggaagggaggagtgacattgtagactatttggggacccctgaaggaagtcagctacagggatgtgcaacatggaggcaagaggatttgatttaatattcttaggggagaggaaacctttcatcccctagggcatgtccatttccaaatgacagcccaaaacagtttaatacttcacacttttttttttttgagatggagtctcactctgttgcccaggctggagtgcagtggcgcgatctcagctcactgcaagctccgcctcccgggttcatgccattctcctgcctcagcctcctgagtagctgggactacaggcacgtgccaccacgcccggctaattttttatatttttagtatatattttttatatttttagtaaaaaaaaatatgtatattttttatatttttagtttcaccgtgttagccaggatggtctcgatctcctgacctcgtgatccgccctcctcggcctccgaaagtgctgggattacagacgtgagccaccgtgcccagcctacttcacacattttaccttacttacaatgcatgataatttatgatttttttttgagatggagtcttgctctgtcaccaggctggagtgcagtggcacgatctcggctcactgcaagctccaccttccgggttcaagtgattctcctgcctcagcctccccagtagctgggtggcatgtgccaccacacccagctaattttgtatttttagtacagacgggctttcaccatgttggccaggatggtcttgatctcctgacctcttccgcccgcctcggcctcccaaaatgctaggattgcaggtgtcagccacctcgcctggccaatttatgaagattttaattgaggagaggcttactgattggaatgccaccttatgtttctcacatcaaccacattcaaagtgcatatttagtgattctcaggtttcagttcctttaaaatgggcaaaaactcttaagacacttggaaaatgcaggatcctaatagattttcaccccctcacttcagtgttttactgtcatcatatgcacaagtagctgttttaagcaacccacttttttttttcctaaagcattccgcttagtgtttatagaaataattttcttcttgttagctgtcaggtgacgtcacattttgcaataggtacctaaacaacataattatagtaacaaatacaactggtatagacaggcttgcgaccgagctagccctgggtgagcacaagtcttagctggtgcaagaggcattcatccatcagcacctttcacagaagaaatggacagtgtcatctgtcagatcagcttggagagggtcgccgtgtcatagtgtacagtgatctcactgacttccccaacaggcctgttctggaaaaactctcaagtatttttcctctgctctcacaccacagcaacaatcaccaacatagacgaagacttctgtgaccaaatgtggagatttttgtgcacatacaagcagtggacgccagctgggtgtcctccagtccactttagacactgtctacctggaggtagcgtctgatcccccctcattgaggattcagttctgcaagactgcctcttcttcccaccagttgcaagtctaggtctccagaacttccaactgacctactggcttcaggttggggttttcacagctctctctttgagtttgtttaatttgctggagtgtctcacagaacttggggaaaacacacttactggtttatttgaagggtattacaaaggatccagatgaacagccaggtgaagggatacacagggcgaggtctggaagggtccccagtgtaggagcttctgttcctgtggagttggggtgccccaccctcccagcacgtggatgagttcttcaccttcctgttggcctccacgtgttcatctctcaggaagctctccaaaccctgtcttttgggcctttcatggaggcttcattggttgtccaggctgcagcgtggacaaccatgtcaaaatgtgattggataaaaaggatatgatctaactccagcaaggaccgtctgttcaaattcttcctggcctctctatgtagccttccttctctacatagccttccagggtagggggcaggaccccttctggaatgagagttttatgaccctaagtctgattaagtcctgctttgggcaggtgaaaggagggcaggagaaggtcagagattctgtttcccaagtctgcttctgaagcctaaagcaccccaacattataacaaaaaattatgagcaaggagctgtggacaaaactcaatatgatcggccaggcgcgatggcttatgcctgtaatcccagcactttgggtggccgaggcgggcggatcacaaggtcaggagatcgagaccatcctggctaacacggtgaaaccccgtctctactaaaaatacaaaaaattagccgggtgtggtggtgggtgcctgtagtcccagctacttgggaggctgaggcaggagaatggcgtgaacccgggaggcagagcttgtagtaagctgagatcgtgccactgcactccagcctgggcgacagagcgagactctgtcacaaacaaacaaacaaacaaaactaatatgatcataatatcacaaggtccaaaatagaacttgctgttttcctctctccaaaccactgttgccccctgccatggtctgaatgtttgtgtctccgtaaaatgcctatattgaaatcctcacccccaaggtgatggtattaggaggtgtagggaccttgggagatgatgagatcaggagggtggaaccctcatacgtgagattagcacccttaacaaagaggcctcagagagacccctttctccttctgccatgtgaggacacagccaggaggtactgtctatgaaccaagaagtggaccctcatcagacatgaattcaccagtgccttgatgttgggctttccagcctccagcactgaaaacggatctctgttgcctataagctgcctggtctatggtatgctgttagagtggctcaggtgcactgagagaaccccctgtccctatttctgctaataagccatgctgggtcctttcttcagccctccacacccgaacagtcacacaaagcagccggttctaccttgaaaaggcacattgtatgcagttgtactttttcatcatcaaattaaaatcaggcttgttgaattgcactgaatcctcaagtgcccctcaactgcccgaatatacttactgaggctttggacttctctggagtggtgatagtttgtgcgattccatcagttttgtccctgtgaggatgtcatctgggcatagtctgtacctgcaccctcatggggagggcagtgttggtgaaggaatgcaatctcgctggacatttttgagtggaatttcatcttcccatctttcttctttctgtattcacccctcggcgttgggttgaaaggtgtgcatatgtgtgtgtgtgggtgtgtgtacgtatgttcatacttgtgtgtgagcatgtgcatgggtgtgtacatgtacttctgctgccatcctatgaagacatgcccaggccacgctggcatttcttcctctgccactccttaggttggtgagtgtgatttagatttccagctttcatgtggagagtgtgtgcctctccggctagggggagcagcctgtttaggcttcctgctctagctgagaagtagagacttattcaggaacaggagaagagaaggagggaagctgaaactaatggaaggagaggggctgataggagaacttggaatcccaggagcagccgctgactgccatgaggctgtgtcttggggtcctcacctgtgtacctgggccccaggctgggagaaggaatgctggatgatggtctctcaaatctgttctcccctgcccctaactccgtgtcttggagtggatggacagaactgcatggccatgtgactgtcccaggccgagcaaaggtgtccagaggcctgcaggtggtgctggcaccagaggcttctgcatgaccttatgtgcagtggtcactgaggcagacagggcttctgaggggcctcaccctcagggaactcgaggatagtcatgtggctttggaaggccagaagccatttaattgggtgtcatcattaaatactactttcgtcctaccatgtgaagtactttgaataaatgcttttttctgtgagaaaggagggctaagggtacataccttattcctatgaagcattttggttttagcttttaaatcacaaaggaaagaaaaaggaatttcctagggggtgggtgtgcagtcatagagagggctagatagtagaatgaagcgtttgaatgatctagctaacttaagtaaaaataactcagtcaactgacagaggagcctgacagcccgttctcattcatgcttctcatctcagagtgcagttctgtgaccacccccccactctgaatccattgctgtagtttcatctctaaagattggccctagttggtgaattgggaatttaggaattagccctgggcaggagccggcaggagcccaaggcagctgcacagtgaaggcatgcctggaactgaagtacaggccgcatgacgctctgccaccctggctaaagcgtggcccatgtgagccgcctttctctctcctcaggagatgagcatgcagtctccaaggacggccgcaggggtgctaagcccttgacacttggaggctccctggcctggcagttccatgaggctggagtttaataagaggctgtcgagcaaaggtcccccaagggtggctttgtggccttggcagctgtggggctggcacacgcactgctacaatagcttctgggaattagggctgtgttaattgcctcaacgtttcaaatcagagggttgctggaacacaggagagagagaggcaaaggtggtggtaaactcttccctcctgccagttcctgagcctgccattcctgctgctagccttgatagtggcaatgcttgcaatgggaccctgacggagccgtgtggcaggcctggctctgtgctgagcagctttgaagggtggatgataccatgatggttcctattttcagatgagtagactcagccacaagccactctcctaatgtcaaaaggtcagaaatgagtgtgtttctggtgattttagggtcatagcaaattaataacgaaatctcaaatcttttcatccagagaagagatcatcccagaaaatatgtggtgtgtcctcaaagtcaactccctaataaggtgttttatgccatggagttgcacattcagcagagattgtaaggtctaccatgaagcaggacttgcacagtcaaagcaattcttgaaaatgactgaaggtccctggaaagtataagctgtcggttttatgcacaaggccacatgctgtcatgagggaggcacatctgtgtgtacgcccacgtagggctgtgggccccccaaggacccatacgcaaggccacatgcagtcatgaagggaaacacatccgtgtatgtccatgcctggctgtggttccacccagggcatgcttctcttcttggaatgttctatgtgggtttttttgttgttgtctccttctgtgaaattctcatagtttgcatggtttttaaaaaattgtgttaaaaaatacataacagaaaatttagcatcttaaccatttctgagtgtacagttctgatacattcacgttgttgtgtgaccagtctccaaaactgttttcatcctgcatagcagaaacattaaacaactccctgtcccctcctccagcctctggcagcctccattctgttttctgtttctgtggatttgattgctctggatatttcacagaagtgattcacatagcctttgtcgttttgtggctggcatatttagcataatgtcctcaaggttcatccctgatgtagcaaatgacagaattttctttcttttcaaggctgaatcatattctgttgtggaatataccacatttgtttatctcttcatccgacctgagggcacttgggttgcctccccgtctttgtaatttttttctgtaccattttctacagaggctgcaccattttgcacccccaccagcagtgcacagggttccagtttctccacctcctcaccaaaacttgttattttctgtttttacggctgccttagtgggtgtgagctgataacctgttgtcgtggttgtgatttgcgtttccttaacggctaacgatgttgagcatctttcggtgtgctcggtggccatatacatgtcttctttggagaaatgtctgctgaagtttgttgcccattttgtggttggtttgttcttgtgtggcccctgaatgcctttcgccttcctcttggagtcatagtgtggtggttcctccacttccacagtgattgggagaccaggaaaacctctcacgttctttccaccttggctttctgcgcacctcgtgccactgcaggctggattcagtccgtttcccttgggcagaaggggaggcattgctggtgctgttgaaactggagttttgtaagccttgccctctctctccccagctctctccatttccttctctttgccaagccctgtggttgaagttgcctgtgtttaaatggtgtttacagaaactgctgcccagagacaatgctgcccttatgtcttttgggtgtaagcagtgatgcctctggaagtcgctccttttccctgcagttgagactgggcaggggtctcaaacccaaatgcctccaagttctgctgggtgatacaaaaggacaggttgggccaagtgagccaaattggccaggcgcggtggctcacgcctgtaatctcagcactttgagaggccgaggcaggcggatcatgaggtcagcagatcgagaccatcctggctaacatggtgaaaccccatctctactaaaaatacaaaaaaaagttagccgggcctggtggcgggcgcctgtagtcccagctacctggaagactgaggcaggagaatggcgtgaacctgggaggcagagcttgcagtaagtggagatcacgccactgcactccagcctgggcaacagagcgagactccatctccaaaaaaaaaaaaaaaaaaaaaaacaccttccaaattaagaaaaggtttgtttatgatgggcttcgtcaagcaaatggcttgggctcggctgtcagtcctaagcccagtcacgcaaacctgcaaggatgcactggggcatggccccatctgcccagacgctgagaacctgctgtgcgcgatggtccccaaacatttcagtccaggtcctttaccctgccttgccaagctcatgctttggcatgagcccgcccgttcatgttcagcatatccagtcaaggaacccttttcagaggtcaaagctgctggaaaatcctttgactccttagcgtcctcctgtggggtctgtctgtgttgagtgaacttgtggaatatagcagtttctagtgtagggaggtagaattcctcctctcccctcctggggattccggcatgagatagatggacaaggagaaaagcatgcaggccaggagctgtggctcacgccggtaatcctagcactttgggaggccaaggggggtgatcacgaggtcaagagatcaagaccatcgtggccaacatggcgaaatcccgtctctacaaaaaatacaaaaattagctgggtgtggtggcgggcgcctgtagtcccagctgttcggtaggctgaggcaggagaattgcttgaacccgtgaggtggaggtggcagtgagctgagattgcgccactgcactccagcctgatgacagagtgagactccatctcaaaaataaaataaaataaaaaagcgtgcaaattttatttagtaagcttttcatggacacgagagccttcacatgaagaatgaagactcaaagcaacatttggagctgaacgcttctatcccagattgaacaaagagcagtaaactatggaaacatggcaagacagaggggtttgggctagggtggttaattatggagaagtgtccaattaaactcctccatgctttgaattctttacatatgaaaatgatggtgggagcaaaaatgtaagtgggggtgggagggggtgagattctgttccctctgtaggtttcatgcatgcccataggtagcagagttcccaggggcccttcctggctgcattggtctcatatcctcatttctgcaaaactttcccctccaagaggagagtgttccaggccttttctcctcatccactttttacatggtgtcagacttggcatctgttttggtaaatattttaaatagggctgaagcccatgaagggctccttgctgtctgcaagccagtgtgtgtttgcacaaataacgagtctctttggaagcgtggctgtgaactttactgtggcctcgtaactacacgtgaagcccgctgggaatggcttgggaggacaacagcagtgcgtgggcgtgatgcccacgtgctgtgctctggtccctcgccccttcctgttttccatcttgatcaggaagctgatctgcctcgatggcctcagttttgtgttaacatttttaatacagtaagctcagtaactcaaattagagaccacagagaaagaggggccacaaagaaattgctcctttccttgaggccacgtgtgtcctcaaggagttgacgtttctggacatctcaggtctctctccagtcagcaactgtcatgttcccatcgttggctaagagaggtgctggccaacagtgctttgcagtacaccacagatgacagaaatatctgcactggtattattctctctctctctttttttttttttgagacggagtcttgctcttgtcacccaggctagagggcagtggtgcgatttcggctcattgcaacctccgcctcccgggttcaagcgattctcctgcctcagcctcctgagtagctgggattataggcgtgtgccaccgcccccggctaatttttgtacttttagtagagacagggtttcaccatgttggccggactggtctcgaactcctgacctcaggtgatccacccacttcagcctcccaaagtgctgggattacaggcatgagccactgcaccgggccagtgatgttattctctaagaggctgatgagttatgaatgaacaaatgtccaaaagtcacaaaaaaggaaagtaaggcctgaacggcttgtgctgccccatgtgtctcccttcactcctcagctgtggccttgctgtttggtggaccctggccacgcacacctggggctagagctgggtgccactgtgtgggggttccttgagaagggagccatggcccctgctgaggggtacagtgggccaggagcattgctggcatcagggatttttcccaaatgagtggtgagaggtggaaaaattagaaaaggggagagatggagaaaaacaactggcatttatggacttgtgtgtcaggaatgtgagacacagttcagtaagctggagagagctttccttgtccctacttggtatttaaggagatggaggcagagaagctgtgtttcctgccttggctcagggctggtaggtggcagaggcaggctctgcatggcccccatctggccagaacctcctaagggctccgtttctgagtgcacatggggagagggtgcagcacagagttgatggctggactccgttatagctgcattttatttcaactctaaggctggccacctccgtgctgagagcccgcagggagaatgtaaggtgggctggaggggaatgcgtgcccccgtctcggcactgtccacacttgggacggtcatactccatgctgggctgtcctgtgtgttggggggagtgagcagcgtccctggattccactcatgagaggccaaggggcacctcccaagtctgatcatcaaaaatgtcttcggctttggcagtgtcccctggggcagtgtcattgaaaaccactggagtagaggaaagataccttccagagggtggggagagaactgcaacagaaaaggaaaccactccatcacaacttggctccaccacacacaggtggattcagaacaagaaaaggaacaatgccaaatcagagtgacagggcgcgaggggcatgtgtgagacagagtgggtggggaatggatctctcttcagcttggtgtttctgtgtggaaattcttaatcgcaagtctccaagaggttgctctttctctgtgaaggcacttgcaggtgcacagggtcagagcgtctctgctgcgtggtgtatctctcccgcctgcttctccaatcccaagggtcacccacttcacagatacagaactgagtcacaatagaaagcacaggatttcctccacactgtgttctggcaaaacgaaagtagacaaaagtagagcacagagctggaggatgagagggggcatctcacactgaaaaattcatggacaagatagcagggcccagggtgtcagccccgcccacagagcccagggtgtcagccccacccacagagcccagggtgtcagctcgcccacagagcccagggtgtcattccccacccacagagcccagggtgtcagctccactcactagcccagggcgtcagctgcacccacagatcccagggtgtcattccccacccacagagcccagggtgtcagccccacccacagatcccagggtgtcattccccacctacagagcccagggtgtcagccccgcccacagagcccagggtgtcagccccacccacagagcccagggtgtcagccccgcccactagcccagggtgtcattccccacccacagagcccagggtgtcagctccactcactagcccagggcgtcagccgcacccacagatcccagggtgtcattccccacccacagagcctagggtgtcagccccgcccacagaatgcagggtgtcagccccacccacagagcccagggtgtcattccccactaacagaccccatggtgtcaactccacccactagcccagggtgtcagcctcgcccacagagcccagtgtgtcattccccacccacagagcccagggtgtcagccccacccacagagcccagggtgtcagccctatccacagatcccagggtgtcagccccacccacagagcccagggtgtcagccccacccacagatcccagggtgtcattccccacccacagagcccagggtgtcagccctgcccacagaatgcagggtgtcagccccacccacagagcccagggtgtcattccccactaacagaccccatggtgtcaactctacccactagcccagggtgtcagcctctcccacaaagcccagtgtgtcattccccacccacagagcccagggtgtcagccccacccacagagcccagggtgtcagccctatccacagatcccagggtgtcagccccgcccacagagcccagggtgtcagccccacccacagagcccagggtgtcagccctatccacagatcccagggtgtcagccccacccacagagcccagggtgtcagccccacccacagatcccagggtgtcattccccacccacagagcctagggtgtcagccccgcccacagaatgcagggtgtcagccccacccacagagcccagggtgtcattccccactaacagaccccatggtgtcaactccacccactagcccagggtgtcagcctcgcccacagagcccagtgtgtcattccccacccacagagcccagggtgtcagccccacccacagagcccagggtgtcagccctatccacagatcccagggtgtcagccccacccacagagcccagggtgtcagccccacccacagatcccagggtgtcattccccacccacagagcccagggtgtcagccctgcccacagaatgcagggtgtcagccccacccacagagcccagggtgtcattccccactaacagaccccatggtgtcaactctacccactagcccagggtgtcagcctctcccacaaagcccagtgtgtcattccccacccacagagcccagggtgtcagccccacccacagagcccagggtgtcagccctatccacagatcccagggtgtcagccccgcccacagagccagggtgtcagccccatccacagatcccagggtgtcagccccgcccacagagcccagggtgtcagccccacccacagagcccagggtgtcagccctatccacagatcccagggtgtcagccccgcccacagagccagggtgtcagccccatccacagatcccagggtgtcagccccgcccacagagccagggtgtcagccccacccacagagcccagggtgtcagccccacccacagatcccagggtgtcattccccacccacagagcccagggtgtcagccctgcccacagaatgcagggtgtcagccccgcccacagagcccagggtgtcagccccacctactagtcccagtgtatcagccccatctactagcccagactgtcaggcccacctactgaatccaggatgtcaacccctcccactgagcccagggcgtcagcgtcccacccaggtacccaggcatagcttagtcacactggaacctcaaatagacattatcacaactactccagaagacagatctgggaagacacaaaaattgtagagtgaagatgtgccatgagaatttggaaagaaaaggtaaaacatgtgaaaatgtttttttttttttttttttccttgggacaaggtctcactctgttgcccaggctgcagtgcagtattgccatctcggctcactgcagccttgacctcccagactcaagcagtcctcccacttcagcctccagagtagctgagattactggcgtgcgtcaccatgcccagctaatttttgtagagatgaggttttgccatgttgcccaagctggtctcaaactcctgagctcaagcattccacctgcctcagcctctcaaagtgctgggattacaggcatgattcactgtgcctggccaaaagtgttctttagaagcatacagatcttccctggggaacgtgttcagtctcaagtgagccctgcaccgatgcccaggccctctgacccttgaggttttgctctggttttcttcaggcgccaactcctccagcctggggatctttgcctgggagtgccaccagcacttgttcttttcatggtctcatcttccaagtcacttaacactgtgaggatggcatcaccgggagcctctgagtcaggggtcatgggtgtgagtgtgcacgtgtttcctaggctgtcccacctgtatgtacattcatgcttatttttgccataacagaggttcctgtgtgctatttggttgttcagacaaaagtgctttaaaataccaagctgagagtttccctttagcctggagaaacaggaggcacatcacccagtggtaattacccatgacatgatgccatgattgattagtttagggcttctggctgtgaaaataaaaaggcctcaaggaaaagctcggaaacaaccatgatttatgagtttatgagtctcaattagggaaaacaatgtattgaaaaatgttcttttttataggggcgtgggaagtaagcagtgtctggtgatatgattgctaacttaattcattcaataaattcttttaaaaggagaaagcttagaagtgactaatccattagtttaaagaaaaaattcatagttggcaattacatgtatttttatgataatcacaaacagtagtttaaactgcttaagtatattcaacatcagtgccacaatacagtcaccataaaatatacatttctgtcctcattccaaaattctcgttcttcttattgtagaaatcagacatcagctaatggcactgaatatgtaaagacggtggatggaagatattcagaaaacagaatgtaaagactctgtctcatattagaaatgcatggggcgattagaggcagagaaatctaaatgcagctacatatagtttcatgcagttgatattttgttatataatgcattacttttttttttttctattgagatggagtcttgctatgttgcccaggctggagtgcagtggcacagtcttggctcactgcaacctccacctcctgagtttaagcaagcctcctcaacctccggagtagctgggattacaggcgcctgccaccacacccagctaatctttgtatttttagtagagactgggtttcactatgttgcccaggctggtctcgaagtcttgacctcaagtcatctgcctgccttggcctccgaaagtgctgggattacaggtatgagccactgcgcctggcctataatacattaatatttaaaaatttttagagaactagagaatctcattaaaatcagaatttccaaggtgaattattttgttttacttttttattagaaaaattaaactagttttttttttaattgaaaaagaaatgcctaaggagaatcgcttgaacctgggaggcagaggttgcagtgagccaagatcacgccactgcactccagcctgggcctgggtgacagagactctgcctcaagaaaaaagagaaagacaaaaagaaatgcctaaatgtgctaaaatacttaagacagcagctcactgggtttccctccctaaagcctctatgtggatttgtttcttctgggatttctggtgactgtaacaggtcaagctgtgtgtgtccaggaatggcaggaaagggacacactgtggttctcaccttgctttacttactggtgagtctgccgactttctgcatctcatgcacagatttacttcaagctgcaagcccagtgaagtgtgacaattaattcagtggtgatggggtgacagtagaaacttagtgttgttttgagagttaaacaaaataactaaggagaagtggtttagccagtgcccagcactcaaaacttgtgaatattgctgtccttattgtatttttattatatccactgttatctatttcatttaacaattgtgtgtctatactgtaattcgttaatgaatttgggcttgattggtatttggatagtctcccatcttttgctgtgacaaccagagctggaacaagcatccttatagttgcacctccagatagcctggaagataaattcctggctgtggaactgtgcataggcacatggctggttttggtagaagtccttatggtgcagcagagattttgaggcatcgttcacaccatggaccaggctataggtatccgactcccagcccttccattgtcatgcatgaactctctttcctatcccagtttacctctgtttaattagcactgtagttttgaatcttttcatatttattagctattgcaattttatttttatgtaaactctttgtgtctttttttttttttttgaaacggagtctcacactgtcgcccgggctggagtgcaatggcatgatcatggcttactgcaacctccccctcccaggttcaggcaattctcctgcctcagcctcctgagtagctgggattacaggcacctgccaccatgcccggctaattttttgtatttttagtagagacagagtttcactatgttggccaggctggccttggactcctgacctcatgatccacccgcaccagcctcccaaagtgcttttggttttctatagtcttttttctcattaatgaacagagctgttcactcatggttttgtattatatgcttaagtctgtgatcatttggaatttactttttatgaagaaggagataggacttcagcttttttttttctcaaataactgtcctgttccagtgatttatggattcatccttcatcttcccatttagttgaaaaattgccttattaataatctttgttttcatacatatttggatcatttctctattctcaaattccatcctattgatctgtcaatccatgtgttagacttcatggagtaatagacattactccaaggaagatgtgcttgtctgtttgcattttcttggactttcgtgtctatattcattagagatactgatgtatagttttgtttccttcgatgtttttgtctggtttggtattagggtaatactgacctcatagaataagttggaaagtatcccctcttcttctaggaagagactatgaaggattgaccttaactcttctctaaacatttgatagaattcacgaggaaagccttttagtcctttgtgttcctttctgggaagggttttttggttttgtttcattttgttttgtttttgtttttaataaattcaacctctttacttaatagagatctatatagattttctgtgtcttcatgagtcagtttagtggttttcatttctgtaggaatttgtccatttcctctaggttatctaatttgttgggacacaattgttcttaatattcctttatagtcctttttatttctgaaggtcaacgtaatccctgcctttcattcttaatattcttaatattaataatttgagtcttctcttggtcagtctagctaaagtttgccagtatcttttcaaagaaccaggccttggctgggcgcatggctcatgcctgtaatcccagcactttgggaggccaaggtgggcggatcacaaggtcaggagatcgagaccatcttggctaacacggtgaaacccagtgtctactaaaagtacaaaaaattagctgggcgtggtggcgggcgcctgtagtcccagctactcaggaggctgaggcaggagaatggtgtgaacccgggaggcgggagcttgcagtgagctgagattgcactactgcactccaacctgggcgacagagcgagactccgtctcaaaaaaaaaaaaaaaaaaaatagaaccaacttttggtctcgatttttctctgttgttttgctgatttctattttatttatctcccttcaaatctttgttatttccttccttctgctagctttaggtttagtttgttcttccttctctaattccttaaggtgtaaagttaggctgttgatttaaaatcttctaaaaagtagactgaaaatttagagctgtaaatttttctctgctttagctgtgccccttaaattttatgttgtgtttcatttctgttcatcccaaagtattttctaatttttgtgtgtgatttcttctgtgccttgttggttatttaagaatgttttgtttagttttcgtatatttgtgaatttcctaaattttcttctgctgatttctaatttcattccattgtggttaaacatactttttgatttttaatctttttaaatgtattaaaggttatgtattaaatgtattaaaggttatgtattaaatgtattaaaggcctagtatcttggagaatgttttatgtgcacttaggaaaaacatacattctgcacttgggtcgagtgttctgttcgtgttgtatctagttggtttataatgttgttcaagtcttctattttcttactgatatattgtctagttcttctgttatcgaaagtggagtgttgacatctccagttattgttgaattatctatgtctccttttatttctgtaagtttctgcttcacatattgtgggtctctgttgttaagttcatatacatttataatagattgatgggttgaccctcttagcagtataaaatgtccttctttgtttctagtaatgatttttgccttatacgatcatgcatctcttagtggtaggaaacattctgaaaaaatatgtcaccaggctattttgtcattgtgtgagcatcatagagtgtatttacacaaacctagaaggtttagcctactatacccctcagctatatggtagagcttattgcttcaaggctattaacctgtacagcatgttactggactgaatattataggcaattataacacagtggtattcgtgtatctaaatatagaaaaagtacagtaaaaatatagtataaaagatttcaatgcaccatctgcatagggcacttaccacgaatggagcttgcaggactggaagttgctctgggtgaatcagtgagtgagtcgtgagtgaatgtgaaggcttagggcattactgtacactgctgtcgattttataaacactggacacttaggctagactgtttataaaaatatttatttcttcaataataaattaaccttagcttaaggtaacctttttactatataaattttttaaactttctgttgtaaaaacacttaaagcactaacacatgcacagctgtataaagatatttcttctttatgtttttattctagaagctttcttattttcagttttttaaaactaaaaacgaaggcacaaacacacacattagcctaggccaacacaaggtccataccatccatatcactgtcgtccacctccacatcttgtcccactgcagggtctcaaggacagtagcacacatggagctgtcaactcctgtgataataatgccttctcctggatacctcctgagggacctgcctggggctgtttaacagttgaaagtaggagtacactgtaaaatgatgatagaaagtatagtatagtaagtacataaaccaacaacatagtcctttattgtcattatcaagtattatgtactggacataattttatgtgctgtacttttttttttttttttaattgagacggagtctcgctctgtcaccaggctggagtgcagtggcgcgatcttggctcactgcagtctccttctcccaggttcaagcgattattctgcctcagcctcccgagtagctgggattacaggctttcgccaccacacccagctaatttttgtatttttttttttttcagtagagatgggggtttcatcatgttggccaggatggtcttgatctcctgaccttgtgatctgccctcctcggcctcccaaagtgctgggattacagacatgagccactgtgcccggcctgtgctgtacttttatatgactggtagagcagtgggtttgcttagacagcatcactataagcctgtgagtaatgcatcacactacaatgtaactaggtgataagaattttccagctccattgtaatcttatgggaccactgttttatatgtggttcttagttatggagcacatgactgtagattattttgtctgatactagtgtagccactccagatttctcatggtggttgttttatgatacatcttttaaacctatttgtgtttttgaattcgaagtgtgttgcttgtaggcagcctatgtttgggtagtgttttttttaaatccattctgccagtcttggtgttttgatttgccttttttacccacttacatttaacttacttaccaatatggtacgctttacttctaccattttgctacttgttttctgcatgtcataattgtgtcttttttatttctctatttctgcccttgtttgcattagatagttcttaatatacttttaaaattcccttattatttgtttatatatatttgatggggttattttcttagtgacttcatcttaaattttttaaaatctagtttggattagtactaacttaattttggtagcatacaaaaattttcctgcaaaatatcttgcttcccttccctctcttttgaactattagtgtcatagactttatatctgatgtgctattagtccatcagcacggtcttacaattggggcttaatgcagtagtcttttaaaacaagtaaatgaataaaagaattacaaaaaaacatgtttatactgtctttcacagtacctacttagttacctttactagtactcttttatttatctcttcatgtgaataaaattcctatccagtgttcttttatttcatcttgaaggactcttgactatttcttatagggtagtctgctaatgatagattttctcattttttaaatttaatttttatgtaaaattgatgcaataattctgtatttttatgaggcacagtctgatatttcagtgcatgtatgcattgtataataatcaaattggggtaagtaccatgtccatcactttaaacatttattatttcattgtggtaacaacattaaaaaacttctcttctagctatcgtgaagtatacattacattgttactcaccagaactcactctttgtaactgtaactttgaacccattgaccgacctcccccaatcctttcttctccttcccctacccaccctttagtggccactattctactctctacttctatgatcaacctttttaaattgtccttcatttctgaagaagagtttggctggatattgatttttttttttttttttttgagacagagtctcgctctgtcacccaggctggagtgcggcaccatctcagctcactgcaacctccgcctcccaggttcaagcgattctccacctcagcctcctgagtagctgggattacaggtgcccgccaccacgcttgactaatttttgtatttttagtagagagggggtttcaccatgttggccaggctggtcttgaactcctgatctcaggtgatctgcccacctcggcctcccgaagtgctgggattacaggagtgagccaccacgcctggcctgcatattgaattcttgattgaaaaatctttttttttttttccccaacactatgattgtgttgtccccctgggttctgatgagaagccagcttttaacattattgaagatcccttttatgagataaaccgcttctcctgctgctttcaagattctgtctttcaacagtctatgatgtgcctggtcgtggatatcttagagtttatccaacttggagttctttgagtttctcaaatgtgtaaattaatacttttatcaaacttggtgagttttcagttatgttttcttcaagtatttttttctccttctttctcttctcttactggactcctattatgtatgtgttggtattcttgatagtgccctatgggtctcttaggctctgttcatttttcttcattctgttttctttgcagactagataatctctattgacctgccttccagttcactgattctttcttctgcctgctcaaatctgttgttgagtctgtctagtgaatttcacttatggcactttcaactccagaatttctgtttgatgcttttaatcaccttattactattctctattcaggaagataaagttattgtaatttaaaattcttcacatatccttttctttatttttttgaacatatttataacatcctatttaaagtctttgttgtatggctggttagctcagttggttagcatgtggtgctgataaagtgtttgtctgttaagtcccaaatcttggcctcttagggacattttctgttggccactttctcccccccattctgtgcatgtgacatactttcttgtttcctggcatgtcttgtgattctctgttaaaaattggacaattcaggtagcaaatcaccatacccttcaaagtttgttgttgatgctgtgttttttctttttgttttttatttgatggttgatggtgtttgcctcgttactgttagtttagcagctttccttgactagttctctggtttatgtatttcctgtaatgtgtgaccactgagttatctgctaatttttaaataaataaataaaaagaaagattttatttatttatttattttgagacagagtcttgttccgtctcccaggctgaagtgcagtggcctgatctctgctcactgcagcctccagggttcaagtgattctcctgcctcagcctcctgagtagctgggattacaggcacccaccaccactcatggctaatttttgtatttttggtagagatggggtttcagcatattatgcaggctggtcttgaactcctgacctcaagtgatccacccacctcagcctcccaaagtgctgggattacaggcgtgagccaccacacccagcctctttttatttttaaaccctggattctgtggggtcacatctgagccagtataattgtatataattagccagtcactgttcacatttcctttccatacatgccttgcctgtgtttctgacacctttcatcaaagatctgtatgagacggagatgacatgctgtccagcttcagggagtttgtaaagacggcttcagctttcatttccggattgcacagggtctcattgtcacccagagaggagtgactgtggtgtcctctcctgtcccaggtcttttctgagcatgcatacaacctcttcccttccccgggagtgtgtcagagcttttgaagttccgtagctcctctaattctttaggatttcattttaaattcagggtcaggctcatgttgactgcagttatagtcagctctaggcagctgaggttgccagcagtttgctgttgttttcataatgccccaggggtatctgccatctgccaccttccctacccctccgcccccagctgagttctgaggcgaatctagagatttcccagagtgctgcaagtccagacaaaatgttgactctgttatggggccagtacttttcacagagctccacaagtggagtctctcactgtttgcgaggttggtggccttggctacttcaccattgagctggggagggaggggcagtgggagtagcccaggttaactggtcacagacccaccttcttatcaaggttcagcaggttcccttgaacagacaattttcacctcatatttttgttggtgtcagcagagagcaagttcatcctagatatcactctgccactctggaagtggattctctagtatattgcccatttatttatttatttatttatttatttacttattgattgattgattgattgattgattgacagagtcttgctctgttgcccagactggagtgcagtggcatgatcatggctcactgctgcctcaacctcccaggctcaagcgatcttctcacctcagtctgtggagtgtcagggttcacaaatgcacaccaccatacctggcttttttttttttttttttttttggtagaaacagggtttccgtatgttacccaggctagtcttgaactcctaggctcaagtggtcctccctaagtgctggggttataggcatgagccacgggtgccagctatattgccttttgagtctggcttctttcacttagtgaaatgtattggagacacttctgtcgtgtgtatgttgtatcagttggctctttctatggttgagtagtgtatggtagagttttaaagttatgggagtttctttggagttgtaaagatatatatgcacatgtaaaaggggatgttgtcagagagattgtggaaccttgggcctgccacagttcctggagaatttcggggcatttcaggttcaaagccagtggagcaggtcagtgctctccagtgttgtggaggaacaggagcccatgccctgcagcagatctcaagggccacagagccgtgtcgcaggggctctgaactgtgacactgtcattggcctctggtgtagcaggcaccaccccacatctggagcagatatgagtcctggccccagccttcagacagtgagccaaaactcagagactcctcgtgcaaaatgaacatgatggtggtcaccaaagtatttgtttactcatcagatatttttcgagtgcctagtgcatcttgggctctattccaggggtgggacagaccaccatcacctagactctggagtttcattctgatgcaaagacagatggtgaaccagatgcatgtgtgcacacacagtgctctggaaagaaatacagcaaggaagacagcagtctgagagtagggctaagtaggcttcaggttgtccaggggaggccttgtgtaggaactcacattgaaacaggggcctgaaacaacgtgaggggtgaaccatatgcacagggaccctgaaacaagtgaggcgtcgaaccacatgcacatatggggaagcattttccaggcagaggaaagaataaatgcaaactgcaggggagcagctggaattggagctaagggagggagagatgaggagtggaggccaccccaggagcaaactctgtgtgtgtgtgtgtatacgtgtgtgtacccatgtccatgtgtgtagggctagtgaagggagctagcttttcctctgagcaagtgggaagatgctggaaagtactgagtacaggagcattcattcattcattcattcatccacctaatgagcaacttgcatgctgctcttcaggtgctggggctggcagtgagcacacagatagaatctcctggccccatgaaggcgagacagaaaaataaacagccagttacctcatggaagacattaagggaaaagttaaacagaaaagcaagttgggagtggttaggttaggactttgtgtgtacatgtggagggaagtatttgacattttgagtagggccagggagggccttgctcaaggatgtagtgttgtatgagaaagatttttaaaaattcggtaaactttgtaaatgtaatttacgtctacaaaagtacataaattgccagtgtatagtttgatgaatgttaacgtggtatatacacccactaacagcagccacaccagcaactcccagcaacctgctcccacccaggcattgaagccaactgtgttctgactgccatcaccacggatgacgtctgcctgcctttgaacttagtgtgagtggaactgcacagcacgcatctttgtatctggcttcctgcaccccacctgatgcatctgaacttcacccatgttttgtaggtgacaggatttgaagcccctttgagaggcttcctgtggctgctgcatggagagcaggtgggggccagggggtgctgcagtcgcccacagcatgttagcagggcaggtcctgatacattctgcagatagagcaaacagcatttcgtgatggattgggtgtgggatttgagaggaaaggagtcaagacgaactccagccttgtggccttagctgggagcagggtggaatcagcactgttgcagctgggcagctccgcagggcacaggtgtgtaacgggaggccgggctgtggtgtggacaggtcaagcatggtgtctcctggacatgcaagtggaggtgtgagcaggtggcgggatttctgagttggctttcaggggagcggtctggcctggacaggtggtttgggagttgtaggtgttctggtgttatttaaagcaagccctcaaggagtcaggatggaaagagagggaaagcttttccattcagaggactggggaggaggacagacttacaagcgggtggaggcaggaaaagatccagacgtgggcagtggagtggggaggttgtgagcacgatgtgcgtggaatgggggctgtgtgaatgctgaatagggtcgttacccacagcagtcaggctgcagaaggccaactccacctccatccctggtgtgccctccaggctcgcagagccgtggagtggcattggtgtaaatattatgagaaaaagaaatgtcagccaaggaggtaagagctgaaaagctcatttgggcacaagactaggcctagggcggggctgcagctgcagctgaaaccctggaggggtgaagtgggaggactgccggtctcagcagatggctgtgagggttggaggtggcttccatataagtgagagttggcctcagaagggaggggtttggggcactagagtcactaacaagttggcagttcctgggcatgcgagcagtcccagcacacctgtacttagcccagagagcctatccatcccttctcagcgaggcactcactgtgaggctgagccttgccattgtgtgtgtcattctcaagtcagcactaagttttgaagacaaataatgctttcccttatgggttgaattgtgtccctgaaaatagaaacacaggagtcctagtcctctgtgtctcagaatgtgcccttatttggagatcgggtttttacacaggtaattaaggtaaaaggaggtcatcagggctctcatcctatgggactggtgacctgtaggaagagagatttggacggaaagacggtgtgcatggagggacaatgaggagatggaaggagaagccatggtctgccagcaaggagtgacctgcagcagatcctctctcccagccgcagaaggaacctgccctactgacaccttgatcctggccttccagcctcctgaactgagacaaggcgtttccattgtttaggctgccccatctgtgcggctttgttgtggctgccttaggaaaccaacacagaagctgccttaaaaagaatcactgctacttcctgtgatcatagcagacatttacccctgtttgattccaagactctgaagcaaattctggctaccagagaatcttctgcttttgaaccccctctgggttagcctctggctacatggcctgggacctggattcctggttgatggaggtggagcctgctccagacctggccttaacttaaagcaagcttgtctaacccgtggcacatgcagcccaggacggctttgaatgcagcccaacacaacttctttcttaaaacattatgagggttttttttttttttttttttttgctatcagctatcgttagtgttagtatattttacgtgtggcccaagacaattattcttcttccagtgtggcccagggaagccaaaagattggacacccctgaaaagccttaagcaaatggaagacatctgcttttgctgccaaaggataatgcagtttcttttctaatcagggtgttttttttttcttttttacatccctccctttaattaaaaactttccagagattcaaggtgacaaagtaaccttttgtatgcatgggagtaactaatattcaagagctacttccttgaaactagatgaaaagatacaataaacctggagcctttacttagcatttctgtttgctccttttctgctggttttggtgcagaaacaagcagccacttaagagaaagcaagcctcagctccctgtcacagggaggggacctcaccttctcactgtatctggtgggggtggaggtgcggcatttggcctcccagcccggccaggctcaccgctgccagggctgtggatgctgggaagagagaaggtctgtgaaaggcctcaattcagctgcctgagtggcctctctcccccttcacctaaatattcctttggcccctgacagtgggcttttgttgggggctctgggggctgtcagagacagaaagtagaaagagctttatgaaggcaatattgaagggagttgggctggtacattgactcacttggaggtttaatacgtttgctttagaagtggaatcacagcaaagttcaaattggtgaaacggttactccattttcaagttgatgagttttaactccctatttccaaagtagagttaagccagcccttgaaggaatataagaacagaggctagtatttactcaactcaaagttagaaataatgaaaataaaaaattacagactgttaagaccactaccaattaggtactggcagcccacctggaatgctgtttggttttctagctgcaattgaaacacagggtgcagtgtcttagtaagagcattccccgaaacagtctcaaggctctttgctattgacatacttctcctgacccaggtcccagactaataatggccttaccctttcgggactttatacgctgctccttcccaatttttaacttttcttccttaactgttgcctttctagcatcatgggtgttttcgatctgacgtgttgccgagctgagtagttgttgtggaacacatgagtgacatttgcacgtgcaagtgggacagtgggtgcacagagcttgctcgcagcgtagctcattgtgaaatctgtccttgccattcattcagggggtgtctggtttgcagcaccgtcactttctcaggctgtgctttttccctgccgtgacttctgttcttaaacacatcctgcaaattataccttcacatgaggacaaccaaatccaagaatgccaagctctggtgaataaaatacccttactaattaaaaagaggctgctttgaagttgtctgaacatcctgaagactgcatctaattgcatcacagtaagcataccgattcagatcaacaggtgaagagatgaatggatgaacagtctgaataacaaagcatgtttaaaagaaacgcaaatcaaaaccagaatagcaccatggactcaaatccaagggcataggtgaaacttcattaataaatgcttgcttaatggtgtgactgctgttaatgagagaatgattgtgatactagaggtagagccttggaatcagaacagacgtgcttgctactttgcagatataaatttatcttttttttgagatggagtcttgctctgtcacccaggctggagtgcaatggcaccatcttgtctcactgcaacctccacctcccagattcaagtgattctcctgcctcagcctcccaagtagctgggattacaggcacctgccaccacgcctggctaatttttgtatttttagtacagatgggatttcaccacgttggccaggctggtctcaaactcctgacctcaggtgatccacccgaggcctcgacctcccaaagtgctgggattacaggcatgagccaccacgccagcccaattaatcttatcttgttgatgccataaatcaagatgtcacatcagaggtctgtgttgaaagaaggttttcagaagagttttgtttgatggttatataatttctttctttctttctttcattttttttttagacggagtcttgctctgtcgcctaggctggagtagtgtggcgtgatctcggctcactgcaagctccgcctcccagcttcacgccattctcctgcctcagcctcccgagtagctgggactacaggctcctgccaccatgcccggctaattttttgtatttttagtagagacggggtttcactgtgttagccaggatggtctcgtgatccacccgccttggcctcccaaagtgatgggattacaggcgtgagccactgtgcctggcctggttatataatttctaattcttcagaatctgcacctccagctattgcaggcctgatgtgactctcttaacagcaaccgggcatcatccctatcaacagtgaaccctttcactttggccattctgtagacaccaattggttcagcctggaatatacaagacattcataaagtgcttccaagaatatgctacaaattcctgcttaagagctgatgtctccatgccaatgacaattcctgtaggactcagctgaaaaatccaacattttccaaaatgttttaatttctaaatatttgccagcatgctgtataaatcattgaataacatattaaatccagtgaatctgtgtcagattctgttcatagggttagggtgcatacttggctttgaggccatttaccagggattgcatcattaagaatgtaaagtattggccaggcacggtggcacggtggctcatgcctgtaatcctagcactttgggaggctgaggtgggtggatcatttaaggtcaggagttcgagaccagcctggccaacatggtgaaacactacctctactaaaaatacaaaaattagccgggcgtggtggtgggcacctgcagtcctagctacttgggaggcggaggcaggagaatcgcttggacccgggaggcagaggttgcagtgagctgagatcccaccactgcactccagcctgggcaacaagagcgaaactctgtctcgaaaaaaaaaaaaaaaaaagaaaagtataagtgtttggaggtagaatgttttatgcagttctacttgtgagccttggttttaagggattgaacaaggtgatggaaatgtgtaattgttcttcagtaagctttttactttagttttagatttatagaaaagttgtgatgacagtacatagagcccccacacaccccacacccagtttcccctattgttaacaccttaccttggcatggtacatttgccccataatacgggtgcattattcttgactaacgttcacactattcattttcccttagtttttacctaatatcccttttctgttccagggtcctgaccaggataccacattatatttagtctttgcttctagagtgtcatgtgtgtttttgacatggataaaactagatattgaatgtgtcatttcattataccagccacacttaaatttttgtttcatattaaatgttttcctctctttaaaaagtatcaaaaaactaaaagaagcttataaatcactactcccctactcatctacccaagggttgagtttccctctggcttcacctcgccactctgtgatgtttttacagtgaaaatgacccaggtccagcggagaaaagtcagggcactgtgcctgtcatacggatgacattcttgatggtcatgtagggcacacttaagagcattttacccaaacggaggacgtgtgggtttggctagagtagtgtcctcatattcaggagaaaaatatattgaagtcctgaagagtcaggacagatgaatctcctctcagaatctcttttctgatggtccagaaggccacgtggcctcttctcttgctcctccagctaaatccaggcaactaacgaggacagggaccttgcctggtgagctcatcatctagctggggtgcaagggtgcctgcaccaggtgaaaaccgaaaaggcctttatgtaaagaatgactcaggacaggcaccgaggagatgttgcagggcgcacgaccgtgatcattcaccagccatatcgggttggcagtcaccaccaaggcaagttgtggtgttgtgaggttgtcacaaagtcattcggtcaggaacgatgatagcccattaggtgcagaagcacgtgctcagtatgtgtacccattgcaacatccgttgtggtggcccctaaactggccaagttgaaagtgttccctgatcctgcgagtcaccagccattcctcccagcttgtgtgcagcaggagtgagggcatgtgcaggtctccttaccaggccagcctggctgctcctaaattgccccaccttgggagcagcaatcctagtagctctggcattttggggtagttcctccctttcatacttcagtcatctctgcggcctcatgtatgttttccacatccccttctccttgtggagacagaccccccgagtctgggaagtggtctgagtgagccaaattaatggccttgtttactaatcccgtggtacagcatgctttcttctttttttttctttttgctactacagggcatgcattttgaaaagtataattataaaattgatgcttgtttagaatactgcatattatatgatttcatttatagaaaatgtccagaataggtaaatccatagagacagcagattcgtggttaccaggggctgaaggagacaggatagagttggcggggggatgactgctaatgggaatgaggttttttggggagatgatgaaatgttctggaatttcatagtggtgatcgttgcacaaccttgagaatgtactgaaaaccactcaattgcacactttaaaatggtgaattttatagtgtgtgaattatgtctcacacaccattaaaaaattgatacttgttcacagtagagccatttaaatggaaataaaagaaatttaaattacctataattccagataactaataataacattttgatgatgatgatgatgatgatggggtgtgtgtgtgtgtgtgtggcagttttgttgttattatttccatgttttgtttattttggaggaaaggtggtattcttagctctttttacgggttaggagaaaccctattgggttctgctgaaaacactgagccctgttttcacttgtacccattctactagttcacatacttcctgtcacattttgcttattgactttagaaggctgcagtatctggagtgagcccaaactatgtagtataggaagataacactttaaaatttcgaaatataagtggtgtcttagtttctcagattagcaataacaacctagttttgttgaaacttaaagtgtcagttctaaagatctcgtgattggacatgctgagtttattaaccacatttgactggcagaggaagtgaaatttccacacgtgaaaatgcctccatttctgaattagaagctgacttgggaagagctaggactcttttccacagggaaattgggctagtgaagcttatttttctttggggtatgtatttatttgagtgtttcagaccatttgtcaatttctaagcagttaataatttttgtctcttttcgatgtgtgtatatagtgcaagtatgtttgatttcatgtggtctctctacatttaaacagtgctgagtgatggtgtgtgtaatgtgctgatgtaaaatttcaaatccaaactgaagtctttaatacttcagcagaagtccatggactgccttgcatagctgatgtcagcctctgttatgtagcaggaggtgcttctgtctgggtttccatgatgggaccactcgtcctcccccaggggtgcagcaccagctgtccccatgtggtttacctattgttgaggaagagtaaaatgcatgcaactgttaacctgaggaagaatggtaggattgccccgggagaggtgtatggtttgcagggagacttagagaatagaaacttttcttctaaatggctggtcatggacattttatgaaagatggctcagggcttggcttttggggacgggtaaatttggactagaaatgataggaagaatggaagtgaaaagccacagcgcccatttatgtcctttacattgtggggtgggtacttggctgctgccagtgggtctggggatggggaggggaatgagttgcttaagaaattctccaactctgaatttattacccagttaccaggacctccatctggagggcagtctgcggcatctggctacagaagtgtttgattttgccagccagtgctttggtttctttctctccctctccttcccgctctctgtccctctctgaatgaagcccaggctccactgacttatttccatacctgtgttgcaaagcccccgcatttgctattcttgtgataagcttcaaaatcacttttactgttacatcatatctttatatcactataaaatccctctagaggttaccataatgtcttatccctctgtgttttctacaaatactgggtagttttgctagaatgctgttgtctttgcataagaagcaaattaaaggctcctgaaaggaaaacttgtttaatacctatcctggtttctttttcccaggtgaagtggaggttctggatccgaacgaccctttaggaccccttgatgggcaggacggcccgattccaactctgaaaggtgagctgggacatgcaggtgctctccatgtcctccaaatgccctgtgctgaggctcatcttgcactgccattgcctgaaggaaggcgctgggggtcctctggccccttggtgccccctggtggtgggtatggtggaatgccaccttgattcctgtgtttcttgacttggagggcattgagggcctgttggggccacaggtgggaggtgacacgcagggaggcatgggtggacagatggcggcctggcagatggggaaagggcctgagcggagccttaggagctggattcctgttgcatgtgactccagaggtgtgtgtacgtctcagtgggcagatggacggccctcctcctcccagccacctggaattctgtcttgtggcttcagttcttcccctgggcctgtggtcagagccatgctcacttggcacaccttgcaggaatgcaccatagatttgtagggtcaatagaacaagtttcccccggatgcagacctgtggcttgaggaactgacgtgtttgctaatgcatatagtgttaccccatagccacagatagcctgtctcagtcagctcaggctgccttagcaagcaccacagaccaggaagctgaaacaacacacacacttcctagttctggaggctggaggtccaagatcaaggtgccagcacagttgggttctggagaggaccctcctcctggcttgcaggcagctgccgccttgctgtgtcctcttacggtggagagacagaggtctgtttgattctcttctcataaggacactattcctgtcatggaggccccgctgaaaccgacccaatagtcctataggcggttctttgggataaacagagaaattgacccttctggtcttaaagtttgaaacttacatttgttttatcttgacttccttcttcaggaaaaggatgcccagacccctcaaaaaagtatcgaatcatgcttctccaggccctccttcatcatgtctgcttccttacccctccctagttcctgttttctcacacatagttacatttcttctctgatgtataaaccccaaattttagtccattggggagatggatttgagactgagttctcatctccttggctgcagcacctgattaaagccgattaaaatccttttccttggcactgcttgttgtttcagtgattggctttctgtttggggagcaggaggacctagaccgaatcccggtgttttcataacacccccatcatgacctcatctaatcctaattaccttccaaaggcctcacctgcaaatatcatcacattgagggatagagcttcaacttatgggtttggggggcaccactgctcagtccataacaatcaactgccagaacagccactttatttctgtccaatctacagagtggctctgcacagcttcctcatggaggtcagttgtttaaaaccaagagcaggtggagctctgcccagcatgcagggtggcagtgaggctggtgcctggtgcttggaggcttaagaggattccatcctctgtaggatgttaaatgtagtaaacgcatgctctgaaagcttgtttagtacactggccttggggaccacatttccttaggaagaaaaatagtttttgttggttagattctcaacttctttctcaaaagcctgacttaacccacagtgcagacagaccacagatacttactgattgtccccatagctggctctgcgcaagatcctaggacgtgttggctgaactgtgctctctgctgtgtggattttacaggtctggggaaaggcaagctgtcaggtcatgataaaattctgagttgtggccaagtggcctaaaggaagagatcaggttttgggagggtagaagaggaacacatctcttgatctgggcacagatggttgtgctgagatctgaagagtggacactggccaagtgaaaacgagagggaagtgtgtgcgaagcccagtgggggccctgggtcaagcgggacttggtgtcatggtggtaccgcaggggagatgcctggcttatgggctggggcaaggtggaggtcagagtcagccggggttgaacccatgaatctcaatagggcagctggaaggctcttgaaattcaagtcagttagaataaataaaattacgatttcagttccttggttgtactagctacatttcagtttggcaagaggctcccacaatgggtagcacaaatctaaaacgttccagtatcacggaaagttcatggggcagccctgggctacgccctgcacagcactttaggtcctggaatttgtgtttgattgtcggttgttgagggcgtctggtgtcgggggtggtgcagtttgatttactctgtgaaaaaatcacacggcagctgtgaagcacggtttgaggagaagcagaggatgcagttgagggggagggggcgagtgatgagaagcagacaggccatattaacggccgagaatccaacttgagtcattccatagactctgatatttccttgggaaaatgtattgcagtcctttgtttcagatgcgctgcaaacctctcacccgggggcttccttgtgggcctggggcggggctgtgccaaggcttctggagcagagggctgcaggggccctgggactgcatgtgggatgggagctgttctttaagtggagtgatcacaaataaccctgcgaggcagaaacagctgcatattcatgatgcacttaggaagatgcatttgcttatcaaggtgaaaaaatgaccatcagatgaaatttgacagaaaattttattccctggatgctgcaagctcctggcatttataagtcaaattcagtgctctaaggtaggattctctcagttccatttctgggagtggagcaacttctcaagcgtagaatagaatgctttctaccgtgctttttgtttgttgggatttgataatctcttgacttttttgttgttgttgttaacccacaagtgaatggtttaaaaaccatgtgtgttcagtgcgttcccatgaccgaaaggagttgattgattacagagtttggaagtttgcctcggacctgtccagagcacagaaacacggacgctaaaggtggcccgtcaagtgggcacatctgtacatacatgcatgtttatgaaagggtagtacaaaaagaaagcaaagaaccacagaaggccgggctgcctttctttgcagtagcaggatagagtagtatagtatcacagttctgagcctgggtttgcaagaggatgggcctggataaatggtggcttcacccttccccctggggtcagggccttgggcatggcactgctctcagcacagtttcaagatgggagcacccccagcataggcgggatgaaagggcttgctcagttcactgcaagcacctagaaacagtagctgatgctggcgccatttgttagcatcaccatcgtgatgattggtggatcatcagcactcttagcgggacaggatctgtagtgaactgccccccagaagtctcagggtaggggccccaatctttcccttgctcatgaattatctggtcctgtagtgtgattttacttccttttgagttcttgctcctgcacaaatggagactcactccacccgtccttctactcctggccccttccttatatgattagtaatagaaggagtcggcctggcaaagccagactcattcttcctgcacgtttttgctcatagagcttctgggaatgtcacgcttggccacatttggcctaatcacatgtataatcatagctgaatgtactatattagctatttatttaacccaatcatcagtcatgatgtataaacatctgcaaaatcactggcaggtgacattggcctgtggaccagttcatcagtgatatgacagctttacctttggccaagcaaaagcgaatctaagaattagctggaaaatgtgtttttgttcagatgtcctgggtcagtatttggcatgaagcttatatttggtagatggtatcgagagagagagagagaagagagagaggagagagagagagagacagagagagagattctcagagcaaaaagcctatatagagaaaatgagcactaaggatgttgtgatttacagatgaaaagtttgccttcagttttcatatgccaaagtactgtcattgtttaagactgcaggcgactgtaggacttggttataaccgggttaacatgtgagtgaatatttaacagagctttgtcttcgttgttacattagacgtccaggagacatacacacatacatgctttagaattatcattctgttacttacagaggcttatatctgacctagaaaccacatgctctttcgttccaagactgtgttttaaatgcacatggaatacagcttgtgttttgaaagatcagtactttggaatgtttgtgggaagtggataatttctgaaggctggggcggggtgatgtgggctcgcccgtctgctggcctcctgttctggctcagccaaaatagacccggcgagctgtgtctctcgacttcagagaagagctgctcctcgtccacactgcagccagcagggggattcctgactttgcccatatgaggttgtgttgcaattataggtgatctcaagtggattctaaataacagggtagtgaaaccagtgcctgggttactaggctgttccctgctatttgtgccatgtcaggctgtggtgctgaactaaaatttccttggaaagagaaaacaaagcagtcagcagagctccctgagctgacatggagaccatgcctattggtctctgtttaccaagcatcagtttcccagttcatgtaggtcatatcggccgaattattgtgtgtgcttctggtttattctggaactcctggcatgcgtgcctgtgtgtacgtatgatagtttgttaggtttaacatagagtgagggtctccaaggctaaaagggtacaaatgaaaatgggatcatccctgcaaacatagtcagcataaagtctgtcaggcttgttattcacaacttgggctcagcatcaggatgtgccatgcaactctgctaggtgtgtctcctctggccagggaccccacagaaagttacttttcaggctccagtttctgaatctacagactgggcatgatgaatgttagttgttctgagcgtgcacagagatggcagttgtgtgtcagctgctgggtgcacgcctggttccaggaggcaataacgttgttgtgcctgggcttgttgtttccttagaatacggaagacactccctggagtgggtgtgctccaggtgcccagaccagaatgtgagaggcaccctgcccccgcccataccgagtgaggctggggtgggcccccgtgctgaccgccagcaggcgagccagggtaaagattatgaggaatgtcctcctgccaggtgattgtagcctgtcctcagaattcttttcatcttgagaacataaagattgaacacagaggtgacgcttaggtttaccagatacccacaaggggtactcaggcacaaataaggatgcacaggggagcgtggtgcagtccccagggccaccatgagggcatccccctgcagcagactgctctgttattccttaataatttccctgcaaagagagaaagtacagggtctagacacatagaacaataaagagaaaataacgtgaagagtacggtgcagcagaaatgcacatggaactgctggtggtctggatgtccaaggcggtactcggatgggcacggggggtttctgggaggatgtggcccctgaactgaggcttcttgcattcagcaagtatttaccgaagcccacagcatgctgggcgctcagagtctctgaaaacgtcccagtatgaggcggcgtggtctctgcccctccgggctctctgagtgtctttctaaatgggagaagcaagtgtgggaaccacaggaggacctcagatcatgaaggtactggagggaggcggggccgggacgggagtgagcggtgctggctgtcacagttggggtggtcgagaggctgagccccactgagagaggacgtaggggcaatggctggcaaaggccccacagctcaggatgctccaggcaggaggcgggcgtgggagaggaagggaacgtagagtcccgctcagagcagcaaggctatgacacccagtctcacggtgggcacgcagggtcagactcgggtttcattctggccacttcagctgttatgtagccaagggcaggagtggggggtggtgtcccacatgccctgcgtgctcagggaacccccaggacagctctgaaggtgctgatatgcttaaggggcacaggtagggagaggaccaggctgccaccaaggaggccagggtgggctccatgctcattgtggggcatctcagccctgcgggtgtcggctggagctagaaactccttttacgaggacacgggaggcttgcactgagcccagtgtccagtgtccacatccacatccaccctgggctggggattgctaggggtacattttgtgggcgcaaagagaagctccaggatgacatggggagggagcagctgtcgagcactaggacttggtggagggaagcttccaggcaggtcattcttaggttccaagtcagcagccagttcagcccctgccagtcttgtctgcctccgcccggcccacagccacgcaatcccaagcaaacctttccctaagacgttttctaacatccattggacaaaacaaacatgagatgtccaggttgtgagcgttgcaccactctggaggctgaaggccatgttcgaggcacctttgatccaagtaggggaccctttatcctcctattggctgtgagtctgcaatgcctattgggttgtctggatctggagccactgaatggtcttggaagaaaactctaccccacaaataggaggtttcaaagtgtgcaccgttggttattcggggcagagtttgggccgggcacctgagactgtctggactgtctggagacccacagcggcttcctgccatcgatgaggctgatttctgcctccgaaccttccctgcagtcctcgatcagcccctgtctttctcccaggggtagcgttctgacaacctgcgcccagcggggtggcgtccctatggtgggcggccgtttccctcatctgactggtattgtcagtggctattgttcttcctcctgcgggtgacacacacggacagcagtgattcttcctgagcttgctggatttgagaccatactgcaaagggctgtgccaccacctgtctgtctctgtctgtccccagggtgtgcacacacccatgtctctgtctctttgggtgggtgtggatgtcacctgtgtgtaggtcttaactttagtttcttgggctgtctccttccttctacagccgttcttctttcttcttcaattcctctaccctagcaaaggatgaggacctttgtcatagcaaaggacttcaagacgaggtgccttaagacatcagaatgttttctctcagctctggagaccggaagtctgaaatcaaggtttgttggcagagtcggttccttctgaaggctctggggacagtctgtgccatgcttcggtctgagctccaggcattgctggcaacccttggtgcccatggtgctctgtggctgtggcggcatcactccatctctgctctttcttccctctaggtccgtgtctgaaattccctcttcctgtaaggacagtgttgttggattagggccctctctaatcaagtaggactcctcttaacttcgttacatctgcagtgaccctgtttccaaataaagttacactcacgggttgcggggatgaggacttcagcatgagtggctgggggacacgggtcaccccaccatactctcagtttcttcaaaggtacaaacactcttaggtggttttcttcatctcgcaagtccccatgcttctagttttccccgttttatctgactcccatccttcctgacactgcccctggttttctgcagctggctgcatgcaccactcaacagctcagtgggaaagcccgagtggagtggccactgttccacacccgcaacggatttattaacctggaagtatcttcccttgggaggagcagctttatgtccttcctgcagctctcaggatttccattccatgtgcccttccaggaaatttgttttatttcccgctaatcaaagcgccatgacctcatgatctctaatatgtaaagttttcttgatcttcctggactgatcagtgtgacctggtaaaagcagatcctcaatgcctaagtaatttgaccaagttggtgaatacttggatgattggctggatttaaaaatcgtaagtcggctggacatggtggctcacacctgtaatcccagcactttgggaggctgaggcgggtggatcacgaggtcaggagatcaagaccatcatggccaacatagtgaaaccccgtctctattaaaaacacaaaaattagctgggcgtggtggtgcatgcctataatcccagctactcgggaggctgaggcaggagaattgtttgaaccagggagttgaaggttgtggtgagccgagatcacgccactgcactccagtctggcgacagagcgagcctccgcctcaaaaaaaaaaaaaccgtaagtcattgatctgactctgactgtgagacagagcagtgaggggattcctctgttactttgcctttgggttgttttgatgcttggactcagctccctgtccagagatttgcagtgcacagagagctgacgtgggcactggggagatgagcctgtaccatcagttgctaaagttgtgccactgttaagttagaaaggggaagttttttggttcaattaaaagggaagacttctgttctgtgtaacgctatggagtgtgagtgctgcccaaatccaagtgagccgaaacctcagtcagccatgcctggctccttttggcctggcaaattgtttctggagaggtttagggcagctacaaaggaatgtttttgtgagttggaggagagcttagaaaatggttaatacaaaccccgtattttgcacataaaggaaatgaagccaagagaggctaaatgactggctataaattaaacaccaatggagaaagaaatattgtgcttaatctctagagagctttctttcccgctttcatgtttggcccctagagaatcgatgacgttgaaaatggtggaccagactcatttggcagccctcccacataaattacatatgagtgctcaataaaatactagtaaaagatgcaaatgcttatatgaatgtgcaagggaggtggagaaatgcccaggagccaggaatggaaaggaagcagaattataagtgacagccctgggctgccgcagcagaagccacttgaggtagcccactacgtttgcagctttggagaacagcccaattttcctaggtcctcaaaaagagtttatctgagaccaagggccgaattctgaaggcgtcatggagttgtaacatgagctcaccaacagtgaaaagtggtgtcaccacatggccgtggcacacatgtggacgtgtctgtgggccacagagcagagagggcaccaagacgtggacacagcaaatcctgcagggctttaatgtcagaataggctcgggaacataaatgctacacttgagaatatgcagggatagggaaatcctgatggagagtaaatgaaataagaaacctaaagttactgatttcacttggaattggatgtactaagtttcttctaatcaggagaaatgagggactaggagaaaaatctagcttggttttaggaaaataaaggaatgtgcattttttgcaccctgatataaggcctatgaaatatcatctctaatatagaaacgattctgctaggtccagtttcatcaagagccttgggtttccacaccaagccacgagggaacccatgggctctacagaaccaaagctttgttgacaagcttacctgtgaagctaggagacctgcgagctgcagtcctggagaagagggatgagcacattgccacagggtcagcccctggaggtcagatgagagatttcctccaccctggctccagatgggaaacacagaaggctctcccatgagaaatcagttgggactggcatctctggaagccagatttacattaccagcatgctataggaaattccaagccaaaaagttaagataaaacttggcactgcctgtcaagggaacccagtcctcaagggattccctcagaaaaaccagccttacaataaaaaaattacacagcacacttgtcgaggcccaggatgagtggcaagctagtaaacaatgaagccagaaggattaaagatgaaaggaggaaacagaaaccacatagaagaaaaagcagtggtggatttgaaaaggaaccaaacagaccttctagaaaagaaagatatagtccatgaaatgagaaacttgatgggtatgttacagggtagatgcacacagctaaagacaaaaagggtaaggagtattaaaaatagggagagagcacagtggaattatcatatgaggaaaaccagcatatacctagaaggatatttaatattttatgaaatactgatagaggttttatagaattgacagaaagcacaaatcttcagatttgaggaagagcactgagacctgaggaggctaaaataaaaataaatttactattaatgatagacaatttggaatggcaaagacaaaggaaaaatattgaaaatagcctaagaaggggaaagttcagaatacttgcaaagggaacaagaactgcaggacttccaacagtcaccatagaagccagaggacagtattgcctcaaattctatacccaacgaaactatcattcacgtgtgaaagtcatggatgttttcagaccaagactaagagtgtttgcagccttagtcctttacccaaagaatgaatgttattcaggatgagctcaattgaacctaagaggaaggagtgagatgcaggatgtgttggtgaggaaagaagttggtagatctcaaaatactctgacagtaaaaataacaataattggaggcttaaaatcagagtgtatctaagcagtaggaagcagttcaatgtgtgtggtgtgtgtgtgtgtgtgtgtgtgtgtgtaagtgattatagctcatagcatttaaagtcttttgtaattgggggactttgctaaattaggtaagcctataaaaagtagttaagctagccacttatgtataactttcaaataagcagaggggaaaaatggagcatttaaaaatccaatagaagataggaaagaaaaaataaaaggcaatggaaatattaaaaataaaactcatcagttaaaaatgtagactcaaaatgtaaaattatatgccacttataagagttatatctaatacagaatcataaaaatgataaagatattaaaaagataaaagtagggctatgttaaccaaaggttccctgaggatggctataataatatcagataaaatgattttctaggcagaattgttgcttagtgatgtatggaccaaatgatgtaataaaactgaagttgggaatgcatccagccccatcatttcccatatatcaactcaacttgacagaattactaaaagctatttgacaaatgcaaagtctttgaatctagtagataaacatattaaaaatatgaaaaacaaaatcaacaagcttgatcaaatgggcacttaaaactctgccatgaatgtagaataagcacattcttactacgcatatgtggaccatcttcaggaagccgactctgcggagcatatctcagtggcttcaaagaattgtgatcacacagaccatgttctgtgacaacagtgcaattaaagcacactttaaataactcatagctaaaagaaaaatgtcataagatatattacacaatatttgggtctgactaatgatgtgaagattaattaattggatggctaaagaagagtggaaggaaaattttacacttaatgcatacatagaaaaggaaaaagatataaaatgaattaactacagaagttggaaaaagcatcagaatagagagatgaacaggcagttacacaaggggagccccaatgacgagaaatattccaaaggatgtggaagctcacgaggaattcataagatgcgaactaaaactgtagcgcagcacctatcagattggcaaatattttaaagcacccaaacaccaaattctggcacagctgtagggaagcactttaactcagatattgttagtgaagtacaaattgtttcaagcacttttgagactcagatcaatgaaagatttcaagactctatgacaccacatccaagtggatacttttttccccttccaactttcattttaggttcggaggtacatgtacaggtttgtgacatgggtaaattgtgtgccgtgggggtttggtgtacagattactttgtcacctaggtaatgagcatagtacccaataggtagttttttaatcctcaccctcctcctaccttcagtcctcccgtaggccctggtgtctgttgttcccttctttatgtccatgtgtactcagtgttttattcccacttataagtgagaacatgaggtatttggggttttgttcctgtgttaatttgcttagggtaatggcctccagctgcatccatgttgcgcaaaggatatgattttttttatggctgcattgtattccatggtgtataagtaccacattttctttatccagtcatgtatgtacttttgagagactcttgtatatgcacaggacaagacatctatataggtggtcattaaatgttacaatagcaataatgtggaaatagcttacagtccttcaactgggaaatggataaggaaattgtggcttgtttgtataatgggctattctattacacagtaattaaaataaatggagcacatcaaccaacatagatgggtgaaatcaactagcaaatatgacctttcagggaaaatttctaaaagcataaaataatataaatatgcattggaatgatgcatacaagttctctggagaaaaataagcaagagtaggttttggttgcattctagaattttttttaagtgttcaaagtgaaatatgggaaaattaatgtcaaatctttatacgttttgttcatggttattgtttgatagctgtgttttttctgtatgtttgcagcattttagcatttaacatttttaaatcaaaaaagaatgttgaaaaaacaattaggcaaaaagatatgggagatatgaattttgaaagcaaaaaggttatgttattgttatttgaggaagatggtatctatgtggaaaatccaaggcaatcaactcagaaactgttataactaagatagctgagtaaagtggcaagatctttaaaaacttgcaaatgggattaagttaattattttgagaaaagaggatcattctctcttatccgggtaggcccagtgtaaccacagaggtccttaggaaaccggggctggaagactggattcagcagtagatgtgacaatggaagcagagggtggagtgatgcaatgaggaatcactggccaaggaaagagggggtccctaatgttactgaaacaccggggtttggtctaggtcctgctgctcaccacacggaaagccaatcactgagacaacaattattgccaagaaagaaggctttaatccggtgatgcagctgaggagatgggagctcagcttcaaatccatctccctgtctgattaaaatgagggctttatatagcagggaagaaaggtagctatgtgtgggaaaacaggaacatggaaggggtaaggaagccatcctgatgatggaggggcctagtgtcttattgtctggatgtgatgtgatgatctggtgagtttcaattctttgatacttttttgagaggtcctttcctgaggaagggtcaatttctatgtttatccaaaagaactgtctatggcagtggtcctcaacctcccagccatggactggtactggtgcgtggcctgttaggaactgggctacacagcaggaggtgagcagtaggtgagaaagtgaagcttcatctgtatttacagccactccctatcaattacattaccacctgagcgccacctcctgtcagatcaacagtggcattagcttctcataggagctcaaaccctattgtgaactgtgcatctgagggatctagggtgtgcgcttatgagagtctaatgcctgattatctgtcactgtctcctgtcactcccagacgggactactagttgcaggagaacaagctcagggctcccactgattctacacattatggtgagttgtataaataaatagaaataaagtgcacaataaatgtaatgctcttgaattatccccaaaccaaggcccctacctcaggccatggaaagattatcttccatgagactggtccctggtgctaaaaagactggggaccactggtctatgggactgttgggttggtttcattggaaacctggcaaggtttgaggaaagcagttctcacacagagcctctagaaggaaggcagcccgtgtcacatggatatgaggactttgacccccataactgtaagatgaaagatatgtgttgctttacacccctgtttgtggtaacttgtcacagcagccacaggaaattagtacactatgtagatgattgctatctaatagtttccctataaacctaaagtcatttagacagaaataatagaaaaagtatttacaatagtaagaaaaattagagaacagctagaaatctacctaaaaatatatgtgaagatctatattaagaaaattacaaagcttttctgaatacttcagaaggtctgaaatagatacatagaccatgctttctcaatatcatgaagtgggtagttttatgcaaattatccattaaagtcctacttttaaaatggaacttgctgggatgattttaaaatttagaagagaaaagtagcaatgaaattgagaatattgccctcaaaaagtaacagttgtttttcttttctttttttttttttttgagacagagtctcgctctgtcacccaggccggagtgcagtggcgcgatctcggctcactgcaagctccgcctcccgggttcacgccattctcctgcctcagcctcccgagtagcaaggagtacaggcgcccgccacctcgcctggctaatttttttttatttttagtggagacagggtttcactgtgttagccaggattgtctccatctcctgacctcatgatccactcgcttcggcctcccagagtgctgggattacaggcgtgagccaccgcacctagcccacagttgtttttcttaatgtccaaacgtacttcagtcatcataatttaacaaatgtgatgttgccacagcaacaagccaagtgatttagtggggaggggaaaggcaaggttagaagtgaatagagcttgttttagatgggcagccagaaaacaccttccatggaggggacatttcagcaggtgtgatacatgagagacagcaaagaacactgaggagtggccttggccaactgaacaacaaggaaccagcttgctgtgctttggagagagcaagggactccctgtccagtggggaagaagtgtggggaggttagagaaaaatttgggagcgttgatactgtggatataatctagttattctccattatctgtctttctgatttctttctgaaggctcaattttactcacctacttggggagacagctgtaaattatcaggttacctaatgatggccccatctgagtactggtcccactgagcttccaatataatgtgaagatggctgcctcaaggcctggctggaacgtggtgctgtccgtgagactctatcctggtcccttcccacctgggcaggcctttatatgccactgcctcagcaccttcccaggtatagctgctggccatttagcaatattcttttcaatgctagtctggccagaacacagtgaaatgatatgctgggatgggcagcccagattatatcaaaaccaccacttcacatcgtcacagcagattagatactgcattcaacagagaaacaaagacatgggatccagtagacgggagcatggggaatgcagattccccatgctgtgcctgtatggttgagttaatgaagatcatacatacagaactttaccctgcctgattcagcctatctttttaaagaattgtcatcagcattttagtgaccttccagctttatgttgtcaataagaagtaccttctataacttaattcagtgaatggaaaagggttggctaggagagtatccaggtagaacctaatgatgttaataataattataagtagtggtctctgctcattaatgactactctgcagacaggtgcgtttccactgtcccgtgaatgaagaccgtctcctcatcttaaatccaccgcctggcttcccccacctctccatcacctccacctccacagatgctggaggatcctacaacacttcttacccttagggttcactagaaatactataattttccgattaaatctgtaacaacagatgcctgccatctttcaacttcacttgaaaagaaaggatcaaggccaaccagaaatgagccaaaagattcagaacatggatgtatctgttttgaagtcattttcagattgctgtgttgttttagctttgtctgatgtaagttcatgttgatgattaactttcttgtccaacattagttttccctacatgttacattaacagaattgtatttgcatgttcctcttaagagacggagtagttctccagcctcttgaccacaccacacacctgcgtgtgcaggcacacacatacatgtgcaccacacaaacaccacacatgcatactcacacacatccctcctcctttgtccctttcacttccccttgttccctgtagccttgcgttgccccctagagctcctgcctgtggctgtactgggctccccacttatcagggcagtgtttccagctcctattttaggagcagcccactcactccccattctgggtgctttaagaccctgtgtgccccctagtgtgtgtgcgcgggactgcttctgtctgctctggacctgggtgcagcaggacaaagccttcagctccccctcatcagcattgtaacttctgttctatttacaggactgtgattagcttggtttggggatgtccatgttttgtcacacatctttttttaatattttacttctgtggctttgtgcttaatgatatggtaggcaaggaggagggactttctgagcgtgaatttacatcattttgaccagcctgggttagatgtagtgtttggaaagagaagcacagttgatcctcatcatttgcagattccgtaattgtgagttcacctaatacctaaagtctatttgtaacctccaaatcaatacttacggtgcttttgtggcctttcacagacacacgcccacggcagtgaaaaatttgtgtcccagctggggctaaacaaggcgatggtctgctccctggtttctgccctcatattgtgaacatgtggccttttcttggtctatttagtgccaagtttcttgcatatttgggctttttgttggtgattttattgtttatgatggcccccaggcacagcactgaagtggtctggtgttcctaagtgcaagaaagctgcgacatgccttatggagaaaaaaatgtgtgtgagagaagcttcgttcaggcatgagttatgaggctgttggccatgggttcaatgtgaaggaatcaacagtacacattgaatatggtgtctttaaacagaaacacacataaaccaaggttatgtattggttggttggtgaaagtattatgacgagaggctcacaggaatttgactctgtatttcccataggagcagtggttcagtattcactaattcagtgttccctgtagctttctagaagataattaccgcagataacaacctattttagtaggtgacaaaaatcgaaaccttcccttggaagagttcatagcagagcccccaggtagcccttccttccagccctcactgacgcttgctcttttgtgaccgctctccttggcaggttactttctgaattttctggagccagtaaacaatatcaccattgtccaaggccagacggcaattctgcactgcaaggtggcaggaaacccaccccctaacgtgcggtggctaaagaatgatgccccggtggtgcaggagccgcggcggatcatcatccggaagacagaatatggttcacgactgcgaatccaggacctggacacgacagacactggctactaccagtgcgtggccaccaacgggatgaagaccattaccgccactggcgtcctgtttgtgcggctgggtgagttggacagtgaaattgtgtgggttagcagatatgaaggttcccagccaccgagcaagaggtccagttgctatttgaaactgaacacacaccagtcagcacgaggggagagcaatgaaaccgttccctagggccttccccatgtgccccagggcccagcttgacctgttacccatttactagtaataagagaaaatagggcgaggcacggtggctcacgcctgtaattccagcactttgggaggccgaggtgggcggatcacctgaggtcaggagtttgagatcagcctagccaacatggtagtagttggccagtttagtagaaactccatctctactaaaaatacaaaattagcctggcatggtggcgggcgcctgtaatcccagctactcaggaggctgaggcaggagaatcgcttgaacctgggaggtggaggttgcagtgagccgagatcacgccattgcattccagcatgggtgacaagagtgaaactctgtctcaaaaaaaaaaaaaaaaaaaaaaaagagaacaaaaagaaaataggtgcagatggagaggtttatggacctggagcccagaagacaatcccaggcacacacgaggagctgaggtgtttagcaggaaggctgtttgttaggaggtcaggtgtcagtgggagagtggccacactgcaggacggctaggtagggcccgaggctgacctggctggggtggggagagagctgagtgcgatgaccagagattctgagtctctgtgctcgtcacacctggtgaaggaattaagtggcaggaaggactgtgtcccccttcatcccacctgtgaaaaactcccaggcagcaaacgccccggccctgccaccgaagcccacgccatccgatcataagtagtaaaacagattttgtgtgtaaagactagatgagaagagagagagtaaggacagcaaaaactccaaaaacaaagatatcctcagtgacaaagcaccccttcccttgtgtgtggtttccagccttgctgacgtaatcacgagtggagcctgaggcccgaggacagctgcccaccagtgagcccgctggcttcagcctgtttgccactggcctgatttgaagaaggttgtattccaaatcatggagtattaataacttgtctttttgtttcctctttttaggtccaacgcacagcccaaatcataactttcagtaagtatctgttttccccaagccgtgttctgctgctctgagggtttttgttatgtaggaatccggggtttaaatcctgccagctcatgtctttgccgaatttgctagaagttggctgggcttcacacaggggtggccacgtgcttgcttagggttgggaaacatttacatttttcatgtttcttgtacagaaaaaaagtcagaaaaacaaaaatggttaatttctttctgtgattgtgaccttacacagggctactgagaggagtataaatatacaggccaggttgcctgggcaccaggaaggataccggctcattaggacattgggaaacagggacgtaattcactctgaaatcccagcactaccagctgcagttaataaatgtgtgcccctgagccttgggccaccccgtggcagtgggtgggagtctcaaccccaccttgcagatgaggagaccgaggctcacagccaggctcacactccttcacgagctgctgacagcagtggctttgaactcaggcctctggtttcccagtacgaggttattccactgtggccaggctgtcttgggagagtcccctctgaactgcccacactctcccatcgtgtacccagaggagtgctcattccattgccggtgtttgagatgagcagtgactgtccgggtttcctgcatttcctcctcagacatattggagagcagtgcttcactttgagatgttctgaacaatagcatgaacactatatggttggtaaagtgtgcagtgttggctgatttctgtttccctgggccttgtacccattacccacccatgatgtgctgcaacaccacgttgggaggctgggcagggcagcgacctgtctcagcagacatcagcagcttgcttgcagagggcagatttttttccccccccaaatagacaggcctggcttttcacccagactggagtgcagtggcacgatcacagcttactgtagtcttgtactcctgggctcaggccatcctcccccttcagcctcccaagtagctgggactgcaggtgcgtgccaccacacacccggataattttttcttattttttgtagagatggggtctcactatgctgtccagactggtgacaaactcttgcctcgagcaatcctcctgtctcgccctcccaaatcactgggattgtaggtgtgtgccaccacacctgacctagagggaagatatttgggaagattctgtgctgagcaatagtgatggagcatttttccttaatagtccttcagacacagagtaaggaaagaagaaattgcatcatgagcacaattatggggctttggaaaaaggcatataagtcatttcaaaagttgaactattgttctctcttattttatatttatgtcttttattttagttattttattttttgagacagagtctcgccctgtcacccaggctggagtgcagtggtgcagtctccgctcactgcaacctctgcctgccaagttcaggcaattctcctgtctgagcctcgagtagctgaaattacagatgcgcaccaccatgcccggctaatgtttgtatttttagtagagacggggtttcaccatgttggccagactggtctcgaactcctgacctcaagtgatccgtccaccttggcctcccaaagtgctgagattacaggcatgagccactgcacccggcctatatttatgtattttataaataaaacttttatagttcatttatatatagttacataaatatattatgtaactatataatatattgtaaatacataacatataattacagagctataattatacaaatattaaacattcatatatttatatacaaattgtaaatatatatatttatataaattatttcacaatatttttacattgactttcttctcactttaagttatggatttaatccacacattgatgtaaatgactggggcagtttcggaaagtcccgcctgacctcccatccttccaggcctcctgcctcccttgtcataaaggtaaatcatccagggagtttgtaggcactcagtacatacatacatctacctaaggaaatacaaaacaatcaacttgaaaaaaggtctaaaagcacataaattactcagtattattgaggcaatgaagaaatatgcttacctatacactattgatgagaaatttctggagtgctatttgacaataaacacaaaaatatttttaaaaagaaatacctcttatcagttttatatacttttttacataaatgatgctatacttgacatgtttagttaacagtattcacagaaatctttccatctcagtgtatttgaggtttccagatgctctctttccctgtttctggactcatgtgcagagcatgtgactgttccattgtgacaggcattcccatcagggaagcctcatcccagccactcgtgccaccgcgtctcccttccctggccctgagacctgtggctgggtttctctaggagagattctgaagaggaaaaactaaaggggcacaggcatcccctttttaaaactgatactgccaaatggtcattcgtaggttactttcccgacaacgtcaaaggacccatttctccttatcttccataagatgacttccaaacttgttaacttctgccactctgaaggatgaaaaatgaataaatgacctgctttgttctccatttccctggttactagtgaggctgagcatgtggacacacattgcttggcactcatgtctcctctttgtcaattgccacttcatattcttcgctcatttttcctttacattgtttcttaatgaattttgataattctttatgtcttatttcttgatcatatagaaattaaaacttttacaaattaataatttgtttttcatgttatgtcttgttaaagaatgtcatgatttccttgaaagattctgatggtagtttgattggaattacaatgaatttttaggtcagtttggtgagaattaatatctaaattgaattttcttatcaaggactactttcctttgtgttttgaggtgttttctttttcttaacattttataatgaaaaatttcaaacatacggttgaaagaattttatagtgggctcctgtatactcaccagctagatgctagcatttacattttactgtgctaactttatcacttatcgttccatccagcctccatctgtccatcaatccatctgatttttcattcatttcactgagttgcagatacttgtacatttaccctgaaatacttcagcatatatatcattaatgagagttcagtatctgtttatgattcttgctcctccttcttcagttaaaatttgcataccagtgaaatgcacacatcttaagtatagcactataaggtctgacaaatgcataaatctctgcaatcgaaacaccctatccagatacagaatctctgtcacgcttgcaggctctgtcgtgcaacttcctagtcaactcccttctaccccaggcacccactattctgattttttaagtaatggactagtttttcctgttattaaacatcacagaaatgaaatccttcaggatgtagccacttaagcctggcgtccttttagcatagtgcttttgagattcatctgtgttgtacatgtatcagtaggttacagctgtttattgctgaatagcattttatggtatgaacatacgcgttgatttatccattctcctgttgaaggacacctaagcagattccaggcttgactactatgaataaagttccttgtataggaatactctatactttttgtggacatgcattttcatttctgttagtgttaactaggcgtagaattgctgcattatagggcatgtgtgtgcttaattttataagacattcctgggccttctcctgaactctttttacctccacccacagtgtgggagacttgtgatgactccacatatttcccaacattggtgtggtcagcctttttaagtgtagctattccggtgtatgcagtgattcaagtgattttttatatcattccagcctcttgaaaaagcaatttttactagtcatttttaaattttcaaataaatgtatttaaagctgtaaagtttcctctgaataccatctccctgcttccaccacgcatttaggcttctgttgtttgatactgttttctgatttttgttgcattattattagtgaatatgggctgtttatgttttattcttgataatttattgagatttttctttgtaaccagttagatacggtccatttttgtgaatcttgcctgttgtttcaaaaatacgtgtgctttgatgtatctgcacatttcttgactcatctgtgagattgagtattaagtatgttattaaaaatatctatatattttttatccacatgagtaccagatacctgaagatttgtgaaagtcacccacactcaatctggatttgctagtttctattagttctctatttttaatattttgtgtgtattttaaggttatataggtttttgtggggttttttggtttctttttacagtcccttttagtgctttttgccttgaattcagttttgcctaacaataatagagttccacatgctttttaaatttgcatttgccaggaaccgtttttatgattcctgtcccactctttagtctttcacctttttgtgttctgttttatgtaggtctcttgtaaatgatgcataactagactttttttgggaggttgatgtggagacctttccagtctgaaagtccatgttaatacatagttaaattcattttaactaatatacagtattccattctgtgagtcagtttccacttgaatcatgcattgactgccgagtgaaggttagttcttttcactgatagggaccctcttatagtgactgtgcatcccaagtctctttgtccctatgggtgaaagtcctccagggacagagatcaggaagcaggattacgggtgtgcatctcccacctctcccaggaatggccagattgccctctatgatggccaagtcattcatagcctcacctgcaacacatgagttattatttcctcatgttttctagcacatggtattatcagaacttaaaatgttgccagcatcttaggtgtcaaatagtaattttacattacatttcaccagtaaatagtgaggttgaacatcattttgtcgttctaaaagccattgcattgcctgtgtgtatccagcctatcctcattattttcagattccatatttgcaaatttgcttattcactaaacttcgtgtcccccaaatcaacactcgtggtattttcatggtcattcttggacatgcacagagtggagaaaaacctgagctccctgacacatgtttccagctgagactgaaccaaactacactgccttcttgttctagtcctcatactgtgagcacatatcctttctgtctacttagtgtcacgtttttcctatttgtgtgctttctgttggtgattctgctgttgtaaatggctcccaggcgtggcgctgaagtgccatctggtgtcccaagtgcagggagctgtgatgtgccttacggagaagatgtgttgttagaggctgtgcgttttccacgaatcaataatatacatcaaataagatgtctttaaccaaaaatgtacataaaacaagatgtgtattgattggttgaagcaaatgttttaaccagaggctctcagaaaactaactgtattttccctgggaacagtggctcaatattcactaattcagtgtttgtcgtgacattatagaaaataactatggtagataactaaaatagcctgcactttgtccatgtttctgttaggatatgtgtttttcggccgggtgcagcggctcatgcctgtaataccaacactttgggaggccaaggcgggtggatcacctgaggtcacgagttcaagaccagcctggccaacatcgtgaaaccccatctctactaaaaatataaaaattagctgggcatggtggcacatgcctgtaattccagctacttgggaggcggagacaggagaattgcttgaacctgggaggcggaggttgcagtgagccaagatcacgccacttcactccagcctgggcgacagaacaatacttagtctcaaaaaaaagaaagaatatgtgtttttcttgctttataagagtttcaaaataatttctaggtatatgcctttacatagttattactccatctagaatttatttttatgctggtataagctagtattctcctataacatttttctctacagatggcctggagtcttggcatcatctaatgaattacctaatctgtaatcattaaatttaatatcacccctgtcctgtgtgaaatttctatagatgggggtctgcttataggctgttttgtccctatagcttctgttcctggacgaattccacagtatgctaacagtacagctttgtaatatatcttgccatatatagggaaacataccctcctctactgctatggactgaaatgtgtttcccaccaaattcatgtggtgacagagcctgtactggagacaggacctttagaaaggtggttaaggttaaataaggtcataagggtggagccctgatccaagagtactggtgtctttatacaagaggaagagatacagagatctcaggtgccatctggaaggcaggaggagaacccccaccaggagccaaagtggctggcaccttgatgttggacttccagcctccagagtgtgagaaaatacattctgttgcttaagccaccgtctatgatattagttatggcagcctaaactgatgattgacccaccttattaccataccatttttctaaattatctttcctgttatttgccttgttcttttccttgtgaattttatatctttgtattagaattgaatagaagtttgattgattaggggagaactaatgctgctgtttctagtttgtagtttgatatttctttaagttgtctgtgtgcttttattttttttctttcctttctttggagacggagtttcgctcttgttgcccaggctgcagtgcagtggcacggtatcggctcactgcagcctccgcctcccaggttcaagtgattctctgcctcagcctcctgagtagctgggattacaggcgcctgccaccacgcccggctaatttttgtatttttagtagagacagggttccaccatgttggtcaggctggtctcctgacctcaggtgatccacacgcctcagcctcccaaaatgctgggattgcaggcgtgagccaccaggcccggcctctgtgccctttgcaatatagttttataattttctccatgacgacccggcatatctttcttaagtatgtttccaggtggttcattgattctgctaatgatactgataatctttctctcccaaattttatttttaaattgtgtgctagtggtggttgagaaaggcattaaattttaaatacaaatcttacacccacaactttgttgaactttttcattattttttcctgaagtatcttttggattttttttccatgggggaattaaagttttctacaaatacttttttctattcccacctttatgtattcaataaaaattatctatattccagtgtacaacacgatgttttgatatatgtgtacattgtgaaatggctaaatcaagttaatggacatatgtctcacttgacaactcatcattttcttgtagtgaaaacacttaaagtctattctctttggcatttttttttttttgagacagcgtctcgctttttcgcccaggctggagtgcagcagtgcacagtcttggctcactgaaacctccgcctcccaggttcaagcaattcttctgcctcagtctcccgaggagctgggattacaggcgtgcaccaccatgcctggctaatttttttgtttgttggttggttttttagtagagacagggtttcatcatattggccaggctgatctcgaactcctgaccccaggtgatctgccaatacattgttattcactatagtcatgttgtaaaaccgatctcttgaccttagtcctccttctaactgaaattttgtatcctttgaccaacatctccccagttccacagtcccagcctctggtaaccaccactgtgctttctggcagagggcttttccacacgaggacatcctttgactttgtagtgtgtagtagcagcccactggctgtcatctttctgcagccatgagtttcttttccccagtgaccctgattctgtttcagtagactgactcctcccccgccccaccgtgatgatatgcttacgatatctctggaccttaaccaaagataggagagaatcagtgagcttaaaacaataatccacagtttctctgattcttttactcgaccagtttatcaatcagtgacacctcttttgggccacttctatagaaaatgcacaacagttcgcattctttcattgttggtcaagaggtgtgtcctgtctgtataaatggagagttgaacagcgaatagtagtatcgccttggcttagccctgtgtgcagcgtgacagcaagacatggtaccatggattcttagccatgaactctgatggttgctaactcaggccttccactcgtggctcttccttgggtgctgccctggcctgtccacacgcgtgagcgctgtgatgtgtgggactaaagcttgtgcatgttgagggaggtggatatccttgaaggttaaaggatttaccaccataagacattgctttcccttctatccctgtttaattgggggtgaggagggtgtgtatatggagaacaaagcttgaagaaaaggcggtgcctccacagatggaccttccgaggcccgggttatccaagctgactcagcggcagtgttggtcgtgcttggagattaatgctaggctgcctgtctcatatttcatatgtgggttttgtttttcctgctctgctgaaacgtggcacatttagatgagtataggcccatacacaggtcctgcttctagtgggagggaagtggtggggtggggcgtgctgccttcccgaagtcagagcaccagagcccttggctggcgtgtgttgctgtcctggacccaccccatggcccacaggtgtgtgcatgcatattgtgctacacacacacacacacacacacacacacacacctgctcaaggaaagtgtgttattcttttgaataatgaaaagttatgttaattattggcctctgggaaatcaccttcctggggccatggccctgttattttcttatgggaacaagaatcagttaattccaagacttcagccgttctccatccagatgtttgtgacccgggactccttgttttcaagtctgacttatctccccagctccagccccatatgtttcacccacataatgagcctctccaggtggatgatttgaaggcacctctcgccaagtggatgattcgaaggcaccgctcgccaagtgtgtctacacggaattcggccagctgccagcccaaactccttccattgctattttcggggagttttcataagtctagttcagagtttatcctaattacaggaaaacagcactataaaattgaaagtgccaagtaagaagctggtaattagaaatgacgtgagcagaaaccaggccaggccaggcatggtggctcaggcctgtaatcccagcactttgggaggccagggcgggctgatcacttgaagtcaggagatggaaaccagccgggccaacttggtgaaaccctctttctactaaaaatacaaacattagccaggcgtggtggtgcgtgcctgtaatcccaggtactagggaggctgatgcctgagaattgcttgaacctgggaggtggaggttgcagtgagccgagatcacaccactgcactccagcctggccaacagagcgagactccatgttttaaaaaataaataaataaataaacaaacaaaaaaaccaagccaccttattgctgacaaactcaggcaaaaggctgacatttggcatttgatattaaagccctcagaccaccaacctaatcaagttcaacttaattcagacagaacttgaaggagggaagccagtctaatttttttctcagtgacatctttttatggtaagttctgttttctagaaaatacaactttccttaaatcccatagtacagaaccggaataaaagctagaaactgaatttaaggttatgtgatacaagcagtaggtgactaaatagacaatcatcagtaagataattcgagaatagatacacatttctaaatgcagactataggctgggcgcggtggctcaatgcctgtaatcccaacactttgggaggccgaggtgggcggatcacctgaggtcaggagttcaataccagtctggccaacatggtgaaaccccatccctactaaaaatagaaaaattagccaggtgtggtggcacacacctgtaatcccagctgcttgggagtctgaggcagaactgcttgaaccagggaggtggaggttgcagtgagctgagagcgcgccattgcactccagcctaggcaacgagcaaaactccatctcaaaaaaaaaaaaaaaaaaaaataggctgggcatggtggctcatgcctgtaatcctagcactttgggaagccaaggtgggtggatcatctgaggtcgggagtttgagaccagcctgaccaacatggagaaaccccgtctctactaaaaatacaaaattagtccggtatggtggcagatgcctgtgatcccagctacttgggagactgaggcaggagaattgcttgaacccaggaggtggaggttgcagtgagccgagatcgcgccactgcattctaccctgggcaaaaagagcgagacttcgtctcaaaaatatatatatataatataattaataaataataaatgagaccatatggtgacacaggatatttgcatttcaacaataatgaaaatgtgcacacttgatgtgcactcacacatggaatgccgctttaggttgttttgtttccacccgagcccgtggattccaggggctagctcttacaccatattatgcacagtgagagccttttaccaactgacttcagggtttttcaaggatacagcaaccttccaagggggaaagtgtttggcttacctgggagggactagccacctgaacagcgtaggggaaaataaaatttacttcccagggaactggcaccctcagagccattgtcttctctgcctctggccaccttatgtgatcctggccttagaggtggccattgcaaaagccagtatttccaaggttctgctgacttggatttttatgatatcaaacattggtgttgggcatgtttagttggatcaagtggatgtttttgccacatctgttatcagtacagtcagatattcagagtatttcattttggaagcagagagtaatatacagcgtctaattctcaaggaaatcattcattcagttaacacatttcagcttcagctgggcgtggtggctcacgcgtgtaatcccagcactttgggaggctgaggtgggcttatcacctgaggtccggagtttgagaccagcctggccaacatatgatgaaactctatctctactaaaaaatacaaaaattagctgggtgtggtggtgactgcctgtagtcccagctacttgggaagctgggcagaagaatcaacctccaggaggtggaggtggcagtgagccaagatcgtgatactgcactccagcctgggcgagcgacagagcaatactctgtctctcaaaaaaaaaaaaaaaaaaaaaaaagttaacaaatttctgtggagggtcaactgtgcgccaggtcccattcaagacattgaggatacaacaatgaatgcaacagataaaaactaaaaattcctgccttgtgctgttgacattttgtttggagactcttatgtctggcctctttcattaaatgtaatgtctgaaagatttattctggttaactatacagcacttcattcctgtttattgagaagtattctgttgtatgaatgtactacaatatgtttattcacctattgatgagcatttgggggcaattataaataaagccatgaacatttgttttcacatatttttgtgaacatgttttcatttcaatattgtgatttttgaagtttcaagtgtggaggccttggacatcttttgttaggtttattcccaggtattttaaccattttcaaatatagagtgcagtggcattaaattaaccccagttggtccatgggcctctttagtattgtctgtgtttattttgctggattcagtttgctaatgttttgaggaggacgttgccccttttgatggtaggcattttggtctgtaacgctcttgtggtgtccttgttagatactcttgtgatgtccttatcgtatttttcttttcttttttctttttttttgagatggagtcctactctgtcacccaggctgtagtgcaatggcatgatcttggctcatggcaacttccaccttccaggttcaagcgattgtcctgcctcagccttctgagtaactgggattacaggcacgcatcaccacgcctggctaattttgtatttttagtagagatggcgtttcacaatgttggccaggctggtcttgaactcctgacctcaagtgattcacctgcctcggcctcccaaaatgctgggattacagatgtgagccactgcacccggcccttatcatatttttctgatgtccttgttagatatttgtatcagagttgtcagtctttttgtctctttgcttcagtttggaaatctcctgttgatctgtcttcaagttcatagatttttttcttctgctgtatccactctgttatacagtcatgcatcatgtaacagtggagatacgttgtgagaaatgcattagtgattttctccttgtagggacatcatagagtgtactcacacaaacctagatgatttcccctactgcacacctaggctatatggtacagcctgttgctcctaggctacagacttgtacagcatatgactatactgaatactgtaggcaacagtaacgtaatggtatttgtatatctaaacacagcaaaggtacagtaaaaatatggtataaaaattaagaaatggtacacttacatagggcacttaccatgaatggagcttgcaggactggaagctgttgctggtgagtcagtgagtaagtcgcgagtgaatgtgaaggcccaggacattacacattactgtacactactgtagactgtgtaaacgctatacatttaggctacagtgagtttattaaaaattgagtaattgcactacagtgttatgacagctccgatgtcactaggcgatgaggatttttcagctccattgtaatcttagggggccaccattgtgtatgtggtctgctgttaaccaaaaacatcgttatgtggtgcatggctgcaccatccaatgaatcttttattgtagactcttatgtttcagttctaggcttcctgtttagttcttttatagtttccatccctcctgaaataccccacatcttcactacaccttcttctgtgttttccacatctattactttaaagccctgtgatacggtttggctgtgtccccacccaaatctcaacttgaattgtatctcccagaattcccacatgttgcaggagggatccagggggaggtaattgaatcacccacatgtagcgggagggacccagggggaggtaattgaatcatgggggtcggtctttcctgtgctgttcttgtcacagtaagtctcacgaggtctgatgggtttatcaggggtttccacttttgcttcttcctcatttttctcttgccgctgccaatgtaagaagtgccttgtgcctcccaccatgattctgaggcctccacagccatgtggaactgtaagtccaattaaactcctttttgctcacagtctcaggtatgtcttttatcagtggtatgaaaatggcctaatccaacctgctctgctgattcttacatctaggttatctttgtgtttgtttctcttgaccacgggttatattttcctgtttctttgcatgtctggtaattttattgtatagtggacatcatggtttgtatgctaggttttgcattcaaagtaaagagtattgagttttgatacagctgcatattagcttactgtcagagcacccaatgcttagggagtttttgctttgtgaatgtggctggtctgctctgtctcctggtgagtcacagattgagcttcctctgcttcacctaggcaggcagcccatttagacagtcagcctctctcataataagataaacaattatgagaatgggttactactttgtaacaaaacaattaggggaaaatgttaacttcctatgcaatatgtagctacatttgaattttgacatggattccttttcaaccttaaaaaagccttagtttcctttaaacctccttcattattaatacccatgaatttttattctcagcatgtgtcatctaggggaaggctgtggatccccaccatcttgccagtcttggtggaggagcacctgccatcacagtctgctggcccctgcctctgtttctccctgatctcctacccctctcctgttgcttttcttacccagggttgtcattattttattattattattattattattattattattattattactacttgagacagagtcttgctctgtcaccaggctggagtgcagtggcacaatctctgctcactgcaacctctgcctcccgggttcaagcgattcccctgcctcagcctcccgagtagctgggactacaggtgtgcaccaccacacccggctaattgtttgtattttaatagagacggagtttcatcatgttggccaggatggtctcgatcgcctgacctcatgatccacccaccttggcctcccaaagttctgggattacaggcgtgagccaccgcacccggccgagttgtctttatttagcaccctctctcctccctgacaatcacttcttggtgtagaagtttcttcttcatccatgtcccgtcaggccttggatcagtgcctggcagcatgaggggcaggggatttccacacttcatttctgaaacgtggatgctccaccagctggtgagcatgtctactgcacttacgttgctgaaggaattttatagctgccaaattccgtttcagtcctttccttgctttcccagggatccacttaacagactctctccagctctgttcctcttccaaggccccaaatgtgccagataaagataaaatataattgttggaaaatagaaagcaactcccatagttttctcagacaattcaaaagcaaagatgccattttccaagcacttctatctggctttttggggatatatatatgtatatatatatatacatatatatattcccccccccgcccgaaacagagtcttgctttgtcacccaggctggagtgcagtggcgtattctcggctcactgcaagctccgcctcctgggttcacgccattctcctgccccagcctcccgagtagctgggactacaggtacccaccactacgcctggctaattttgtttttgtatttttagtagagatggggtttcaccgtgttagccaggatggtctcgatcttctgaccttgtgatcctcccaccttggcctcccaaagtgctgggattacaggtttgagccaccgcgcccagcctggatattgtctattcagattgaaagcccgcttcggtgagggaagtgtgagcggggtatgatggcaggagcaccctccaccccagcacccccttgtcatcttccttacatcccttgctctctctgtcctgtgggcacctgaccagcggccagggagaagcctgcaacagggggaacaaccttctcttccttgactcttgcaaggtagaaaagaaatggcttacacttgtgggggcatcccaagggactgatctgaatctcatagcttaggcatagctgacattaatctgatcaggcatgtcttaatgatttttctagcagagtggacaaagcaccctgagcccgcctccagacagggacatgtccagcacatacccaggcagaggtgacttccatttatgttggtagtgtggccagtgtctaatcagcagttaactccagtgcaaaaagagtgaaagctgggcaggcaggctcgcattgttaacacatgtgctgcctatttaaactacctttaaggaacccttaacccaaggaaacaatggctggtgagctggagttaacaccaaaatctctttcttgaagtatttatagctccaggttctgttctttgagaaaagggttttctgcagaagcttgagaaggtcttcactattgcaagtgttcagcctctgccttagcaagagagttcagatagggattttaaatccatgtggttaaactgaacacattcttttttttttttttttttttttttaaatttaaagacagggtcttgctcttgtcacccaggctggagcccagtagtttgatctcggctcactgcagcctctgtctcccagttcaagtgatcctcccacttcagcctcctgagtagctgagactacaggcacacgccaccacgcccagctagtttttgtattttttatagaggtggggtttcaccatgttgcccagactggtctcgatctcctgggctcaagtgattcaccagccttggcctcccaaagtgctgggattacaggcacgagccactgtgcctagccttaaattgaacagaattcagatttcatttggggatggtctactctaaatggatgtagaatggaaagccgagtgctctcaggcttatggggtaggttccagattttctggaaaacaagctacaggcttgaggtgctcatgcaaggcttgtccgagcatcttcagtcccctcttctgccagcagtggcagcccccgatgtgtctgctgtggctcattggcgtcaatggacctttggagggtcctgagcaccactttaaaatcctccaggatacttatcatgatggctttcattggctgaagccagaccaacagtttctgcagaaaataattcagcacaaactccaacctggggacctgggaaaggattaccccatcttcccatccatgcaggctgaccgggaggagcaggagggagaacagcctgtccgtgtctctccctcttctgacctcctacgcctgtgacatgcagtctgtgccgtccatgcagcggtggccaggtcgcacttctgcgtagagtaggcatgcatgtatgccattctgtgagttctttgaggcttggacttcttggagtccctaccatcacctttgaacatagtagagaatacatttgtgtattgcttttctccttttcaaatatttctgctgtttaccttgtggattgtcatcgttatcataaaagccttgtttgcaaacaagggaagtttgcaggggcattgccataatgtccctgatgtattaaatagttcaagggtaaggtgaaacacgtgcctgatgttctgggtatgtgcatgtatacacaaacacatacccatccccgtgtacccttcacctcaagaatcatcctcacccttaaccagtcctcccattctttttccatactcccttaaagatgtggaattttttgaaattaataggcattttttagaacagttgtaggtttatagaaaaattgaacagaaaatccagagtcttcccgccctccttctcatagtttcccttattttaatgtcttgcattcatgtgagacatttattgctgctgagccaatattgataacattattattaactaaaatcagtagtttacattagggcttattctttatgttttaccttctatgggttttgcccaatgtatagtgacgtgtgctcaccattacagtatcatacagaatatttcactgccctaaaaccccagtgtgtctcttggaatccatccctccctccctcataacccctggcatccactgacatttctctataaccagtctctatagttttgctgtccatggttttgcactttctagaatgtcatatgattggaatcatacagtatgtatgtagccttcagattggctcttttcacctagtaatatgcatgtaagtttcctctctttttgtggcttgatagctcatttttttttagcactaaataataccagtgtctggatgtaccacagtttgtttatccattcacctacagaaagacatcttattgcttccaagttttgacaattatgaataaagctgccataaacatttacatacaggtttttgtgtgacttatgtgttctacttatttaaatttacttatataaataccaagtaacaaaattgctggatcgcaagatgctggatcataaaagaagtcattggcgggacctggcacctcccagagctctaacagactttgtgtgtttcttaccagggatgattaccacgaggatgggttctgccagccttaccggggaattgcctgtgcacgcttcattggcaaccggaccatttatgtggactcgcttcagatgcagggggagattgaaaaccgaatcacaggtaggagctgcagacctttctcccaggatgataagcatgcacacagccatctgtcgcacagatggtggccactgtgtttcatcagttaatggcatggtcagtgggtgcctcttccatttcatttgtggtagaaaccagagatcttttttagaagtagtggcaattgctaacatgatttgccctaaaaatgttcctggcctgtatgtttaaattagcaagtgtgggttgcttggaatatacttctgcacttttaactcagccaaaccgtgtgggtccaaagcactgtcctcactgcaacgccagggcctcctgccccgggcctgccacactggcgcagatagcctcagcgcccccacactcactctgcttgacttctcattctgtacttcctgactcttctatcctctctgagccacgtttggtccaaaggcacccaggcctgattgcagctgttttggggaaagagtcgcgggtcatcagtggtagggatgctgcagtgaacacacactttgtcagtcctgggtttccagagaacaaagccacgtctttgggtacctggttcagggtctgagaaagtggcaagtcaattaggaactgcagctgctcatccttggtctcattaggacttaacttctctgattggctgtcccagttcccagcatacaactcgaacacattgatggggtccggggtccttcttaggggaaaggccttggaaaggaagaaaattaattagacaatagtcctacagagccctcctcctgctgtctctactctctccacaaacacatacacattttctctccagatcccataaggagcaagacacatcctgtgcagatggccggtgccccagcacctcagtttagttggatcctctccatgggagcgggaggctctgctgcagattagagtcagtgggtgatctctgatgcctgcgctcctgggagagtgtggtggggcaaaggggatacagggcactgacctgttaaggggtgacaatgaggatccaaggcagaaagtcacctcatgtcactgacaagcccttctaagttcaggtcaccctcggactagagagtcgaacatcacattcacggtcacagaagagactgcctggcccatgtgctggtacagagacctctgaggacagggccagggggtcctgtgcaaactgaaagagccatcatgagacagagaggaacctggagatgccatcctgttccagcgggagatggttttgaaaatatggctacctctcactgcaaaagctttctttgccattaaagtaggacttctcaaaggtttttaccgaaacacacagtggaaaatagagaatatactttacgccatgacttagtgtacacatacatgtatttcacacaactgacataggttacagggaataactttcacccttcgtaaaagcggtgcacttggatttttcttttcagttttatttcattaaataaaaaagtggccgggcacggtggctcacgcctgtaatcctagcactttcggaggctgaggcgggcaaatcacgaggtcaggagttcaagaccagcctgaccaacatggtgaaaccccatctctactaaaaacacaaaaaattagctgggcatggtggcgggtgcctgtaatcccagctacttgggaggctgaggcagaagaatcacttaaacccgagaggtggaagttgcagatcgcgccactgcactccagccccagagacagagcaagactctgtctcaaaaaaaaaaaaaaaaaaaaaaaaaaaaaaaaaaaaagttagagcccttagtaggaaccgtgcattctgacatcctctagtctgttcttaccatcttttaaaatgctagctgcagactctcagaattaattagacaccctactaattggcaagcactgatccagggcacaagattgtccctcagttatctcttcaggagttgtttaaggaatcagcttgcatccaagcagcctggttttatagcatcttttagagaagagtttagaatgaagattttctaggtgggtggctttttgaaaacagtaaatttgaagttgctctcaacagacttgtggttttgaaataagcatagtaatgactgcgttgtgtgcagtgttgtgttggaaagtgttgtgtgacattcagggtgtggacagataacaggatgtgagttgttggatctctttgtgcctagaattgcactttcagaaataagcagtacattctcagggtgaggagaaggagaaagagaaatcctataaagatcagcagagacatcctatcagtggattagcccaagagaagtgacagctttggcattcttagacaatctttccctgcctggaggtcaaggcctacctacatttttgacagccatccatataatcccaaatctgtaatgatgggattgaacagggttgaagcctcagttcttcctccaaatccaagacatcctgtactgtaactgcttgccctctctgttcctccatttaaatatcggccacaggaacccagaggaggggaggtgatgtgatgagcacagtagtgcctgcacacaatcaggacagcgtggctgctcccgcccactgacgccgccttttaccagacccctgggcccattcacgctgagggccactttataggctctgtgtgcactctcattccccagtgtggggtctcaaatcactcttcaggtacagaaacaggcccggaaaggcatgagtgataccacaaagtgatcacgcacaaggctgttcccacacagctgcccatcccgttcctgggtgggttcccagggaatgactgacagcggcactgccacctgctggccaaacctggcacagcacttacacgctttccttgcctggaggtcaaggccagcattcttgacagccctctgtataatcaccaaataatcgccaaatctgtaatgatgggattgaactgcattcgtgggtggagttagggctcctcagggactaaatgccagcttctgggttttctgccacgctggaggacacagcctctgctgggtgtgcaggcaaaggggcctgtctgcctccactgtccccaagctcaattgttgtaagccagcctttcacaggtgaaaatggggtagtgagcccagggcaggctgatgcattccttagagccctgccttggccagcttcttcacccttaccagtgtccagccatgcaccccaggtgcagcagatctctccccaacacccccactttgttcccgaactcaccccatcttctaaccaccaaactgcatcctctgacatcttgcccttaaaaaacaaaccgccctaccaaagggggctctggatcttcgggtttttctgctcccccttatcacagaaccttccagagttgtaacgcggctctcctcccactttgctgctctcaccctcttggctttccgcattttaccaactgtctcctccagctgcagttcacagagctgagctgactccctcttccgggacagccttctccccagacagatctgggacattgggaagcctggggctcggtactgcacttcttggcctgcgctctccacacatggcgggtccttaggatctgcttttgcatctgaagtctgaaccctcttgtcctggaagaagcacctagcggagtgagctagggggccgagttttccttctttcttgttctgcttctgatgtttctaagtgaggccctgggaccagggacttttctgtgactgctgcaaatcagagcaggtgatgggcaggctggcctgctggtggggagcctctccagggtggtgtgcggggctcggggttggggagtctggggcggggcggggcatcagggggctgagtgggcagtctgggatgccaggctgggggtggggactggatgaatgtcaagggcgcaaggtgggtcccccgctaacgcgagtctcgcgggctctgcagcggccttcaccatgatcggcacgtctacgcacctgtcggaccagtgctcacagttcgccatcccatccttctgccacttcgtgtttcctctgtgcgacgcgcgctcccggacacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctgtgagtgcccgagggcccggggcgggaccggggggcgcagggagtgtagggcccttgaaatgtgtatgggggtgtcggtgaagcccagggagccccatctgtccaggccccacagaacccccttagcagccgagggccccacagcctaggcctccattccagcagggcagcaggcggggcctcggatcaggggctttggagccattcagccccaggctcgcatgtgggcttgcactgtgtccagctgtgggactcaggtgaagtccctccacctgcttgagcctgggatttcccttctctgaaatgggagtgatctcacttcctgtggaaatggctgttgcgggcatgagaggagacagggccagcttcctaacttgcccgacggtcagcacgcactcgggccgccaggcgaaaatgcagactctcaactcctgccccaacctcctgaaacctggaggatcagtccccagaaacctgtaggatccttagccttggatgaatgtgaggcccacggagatgctgcaggactggcctgggagggcacctgagaagaacctgtaacaatcaggcatcactagggaaggaaatacagggaagcaccgtgcacctttctacaggtccctgaatcgtggggcctaagggatgagcgtgggggagggggacagttctgagcccggggcctgggtgtggcctgtttggggtctgcacaggacgaagagcatgctccccactgcccctcttgctggcagcagcccctgccctctggaggcttagtaaaccccaagttgtgagccccagcagggtggccatggccagtcaggatggcagacacaggacagggagcgctgcttatgtctccgaggaaaaccattggctgacatcactgcatccatacgggttgttgcctccctgaggagtgagacctagggaacgggccacctccgccacagctccggggctgtatttagcatcgttggctaatctgggggtccaggaatggccaggactccttaccaggaccagccagggcctggtccttgggcccgttgcctgcattcagaccctcattgtgaccctggacaagttgctaagctctcatatccttatattccgtggggatgacaccagtactaacccgtggggctgaaatgaaggtcaaatgaggcaatatttaggaaggtggtttttttgtttgttttgtttttttgagacagagtctcactctgtcactgaggctggagtgcagtggcataatcttggctcactgcaacctccacctctcaggttcgagcgattcccctgcctcagcctcctgagtagctgggactacaggcgtgcgttaccacatctggctaatttttgtatttttagcagggacggagtttcaccatgttggccaggctggtcttgaactcctgacctcaagtgatccacccgccttgttagccacggtgccccagccaggagggtttagagcagcgccccacacatggtaaacactacagaaatgttcaccaaatgcacaccccaaccccagggttcctccatggaggtggcgtggcctgcactgttctcacccatggctgagcagggtgtcctgagatggaggggccaggcccttcttgcttgcacagttggctttcttcctagagcaagttgatcctgaggctggggagacatccccattctggtggggtggtggtgtgcaggtgcctcgtgggtcccaagagatggttctggggctgtggaataactttagacaagtttccttccccatgcctatccctgatgtgccctgcatttaatttgtgggcttgggacttcattaagccattacttttaatgcctcttttctggtaagttatgtaaaatccttggatcttttggaaattctagtttgggcatgtgtaggcagaatggttttgttgtaccccggaggttttcctaacgtgttttccttgttcagaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtatgtattctctctctctttttttaatgtgttgattgttgagtgaaccttgtgatgagggcgttctgtcctgacctgggttggggtgtgcctctgtacggtggcgaccagagacccctgatcttaccacagtgaccattttaaataaagctgttgggccacgcgtagtggctgatgcctataatcccagcactttgggaggccgaggtgggcagatcacttgaggtcaggagttcaagaccagcctggtcaacatggtgaaaccccataaaaatacaaaaattagccaggtgcggtggcacatgcctgtaatcccagctactcaagagactgaggcaggagaatcacttgagcctgggaagcggaggttgcagtgagccaagattgtgacactgcactccagcatggacagcagagtgagaccctgtctcaaaaataaataaataaataacgcaagttattggttgttatgaaagtaacatctgaccattacaagacattttaaaatatagaaaagtctgaagagtaatgtcagatcacccctaatgttaccacccagtagtgacttgtttgcgttttggcccacccccttccatcagcccttttcccatgtatggatggtcctgggatattcactttgacattttgtttctccattaacattatctcccagtgcggtggctcacaacctgtaatcccagtactttgggaggccaagacgggtggatctcttgaacccaggagcttgaaaccagtctgagcaacatggcaaaaacccgtctctacaaaaaatacaaaaattgtccaggcgtggtggcacacctacttgggtggtggaggtgggaggattgcttgagcccagtagttcaaggctgcagtgagccatcatggtgccactacgctccagtctaggcaacaaaacaagaccttttctcaaaaacaaaaaacaaaaaacaccattattgctcagtagttcctaatattcgtaaaaatatttcccttccacccaccagcttttgagcttttcactgcttctcagattttacacttaggtttggtggagtgaggcgaaaatagaattcattgcttgtcctcattccttgcaagtgtgtctgtaatgtcatgaatatggaagctcacgtggctgatggttgacagcttcgacagttctcacctctgtcttagtcatgcccggttcaccagtccaggcagcagggtaaccaaggctgggctgggagctggaagcagcaattggtgaatgagtgggcacccgcggataaagagagagcagccggtgaagcgaggctgggctcaccatgcacctggagatctcctcctggggtgcaggcccgcgtgtctctactccgaagtgcaggaaataaacactggcactaatgaccttcctgatgtgtgattcagcagctccagatttggcattgcctctggctcagcagatcagacacaaatcttcaagaatgtgttcattatgggagaacaaattttaagaatgaaattatcagtcattcaaattgcggtctaggcactctggagcactccagaccttaaagctgtcctgcaatgaaggatggccctgtgccctgtaaggaacaaaagcaggttgtaggacagaactgtgttagaggtgcttttttgcttattgttttgtttctggcaaaaggaaaatgagtgggagtttgtgtgtgagcacacacaggctcctgacttttacgaggttttggaaagatggatatcaaacttttagcagtgatttccccagacctacaaaagtgttcaaatacaagacttttttttttttttttacagtgagtaggaattacttttgtaattaaaaataaatcaaagcatgaaaaaaatgtatgattttggaccagtcaattcttagaatcttgtatcgcaggtttgtacttacagggcataaatggaaggatatttattgcagaatcacttgtgagagctaaacataaaacagactgtttatcagtagggctggatggggcagttggagacgcctgtgctgtggagtggcatgcagctgtgggagaacacacatatctatctgctccaacatgagctgctgtccaagagattttattctgccaaaaaaacaggagcaggaaaatatggatgacacgattctatttaaaatcaagttcatttaggccgggtgtggtggctcacgcctgtaatcccagcactttgggaggccaaggcaggcggatcacctgaggtcaggagttcaagaccaggctggccaacagtgcaaaaccctgtctctactaaacatataaaaattagccaggcatggtggcgggcgcctgtaatcccagctagtcgggaggctaaggcaggagaatcacttgaacccagggggcagaggttgcagtgaactgagatcccaccactgccctccagcctaggagatagagcgagactccatctcaaaaataaataaataaacaaacactctgtctcaaaaataaataaaataaagttcattcaacattcgaattaagaaaaccatataaaactactgtgtctatatgtcagaatagttgaatatcggttgttccatgtggttcaacctaaaatatacataaagttaggagaacacgaaacttaaccatttatagcctttgggaaagaggactgttagaaatactatcttttgaaaggccacatttctgtaatactacagtttttcccagtaagcatgagtcatgttggtaatgttaagtagataataaaagcaggtgatggtgtcagtgtgagctcacacctctggtcttggcgtgagagtggcctggactctcctgctaaccttaataatgaaaaatgaaccaaaccctagtaaaaaagaatgaatcggcatccccagtgccccgaagatttctggaacacctgcctcagaaccctttcagaggggaagctgctaggtggggccagaagaaagttttgtttgtggttttacttgatttcttcttatttgggggagcaggggtggggcaaggctgggttttgggacaaggtgcttttttcctaaggtggcagtagcatgttcacttttagaaccgagttagctcttttaggcctcacactgaccagaaatcacttgtttgcttccagatgagaagcgctttgccccctggccatggggccctctaagtctgatatagttatttgcaaggttaaggagaaaacagaacaccgtggttttctggggatgtgggaaagtggctctctagagaactcaccttccaccaggcttagggtcagcgtcctgaaacggcaccactttgtcttacattcaattgctttgacgtgtggggtgcttggggccacgcagcctgggaggagccagccctgcctggagtcctgctcagaatctgaggtcacctcagcctgcctggtgtgccccctgtacctttctgtaaatcctgtagagggagacaaagagttacttttccctgtgatttaaaaaaaaaaaaaatgcagggaaggtagctggtggccttgaatcttggtacccagtgctttccaagaattcttgtgcccctgttgcatattgtattgggtcaagagcatggactactggtgctcttttaaatctagtgcatgtttaattattaccctaaaagaatctgtcatcattagataaaaatgtgaagaaaacattaaaatgttgaatgaggaaaaggatcgtgtctaatcccagtaccaagtttcactcaccttggacaagggtctccagtgaatttcatgaacttgtcagtagctggggagaccttgataaaagtgaaattgggcagagcacctatctccgatggtattcaaacatcaggaacagaaagcggatgtggtcgttattaagatcattagaattcatttactttttatactgcatattcccgcttgtttccaggttgggcagttttgggttttgtttccccaggatgcagccgggtgtgcattttttggtgcatcatgttttttaaggtgtggtgtgcccttttaccccattgtgtaacttaggtgatgacacacgtgcacgtgaagattttggctggaggtggagagtgggttggtagagaacttagagtagaaaagggatgttttctgaaaaatcacgaaagccttattgttcacaggtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggtctccatgccttacattttctacccgggtggctcttccaggtttaatcctcaggggttgtttcccccaacattaaatgtcttaatttacttgatacatagcacataattattttaaactccgcttcattttgccattttttttttctgtaaactagatcaggacatgtgtgctttagaaaataaatggcaggcgtgttgggaattcactgccccagagtccatgggcctccttctgcctggaccatgctgcccctgtgggccccagcgagtgtcctcactgtccaggtgcctcagctctgcccagaagacacacaagaacaacagggctccaatgctccccataatttttcttgacacttttgggttgggttggttttgctttgttttgtttacagggaaggataggagaatagctcttaaatgggagtaggtggacaggctaccactaaaaggccacccctcatcccagagcagccttagatgggggtggggcactgaaatacaacagatgagaacatgtgctgcagcctctccaggttgtgttgtaaaagggcatttacactcattgcaagccgtaggtaacatcattctcagccagctttgcaggggctcttcaaggtggccaggagggagctgatgcacttggctcttcagtcccagagtcggtgagagtttgctatgggcaggggctggccagcgaggagggcacagagccccggggcttgcacggaggcccaggaacctctggggaggatgagggctggccacacgggaggagctggtgtcatagaggccgagagagatgcagggttctcagggctcctatcacctgtggggtactctttccaggaacatgtttaacagagaccctagtcaagaggcccatggacaggcccattgagggaacctctgtagaacaactggcttggactcttataagtgacaaaattgccaagacaaaaatgtcgtgggaaagcctctgtggggtccatgagaaaaagacatcacatctcacgtgatgtgtcggcacacatgggggttggagggaacctggcagggtatgtccggggcagccccagggcagctggtgcctgggcctggctgtagggtgtgtgtgtgtgtccacacatgcacaagtgggaaggaagtcagtgtgtcccagctggattttggagggaccttatttgtagcctggttgggatctgtggaagattgcagatgggaagcaaccttggcatcagagccgtatttaaggttaactagagagctgtgggtgggcaggccaaggctgggtgggcaaaaccagcgggtcttctgcaaggcccccctagtcgtggccgcacagggactccactcctcccggctgctctgcagcttcctccagggctgcggtgacagtgatgtttcacgtggggcttttcttcttgacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgtgagcaacgcccgctacgtggggcccaagcagaaggccccgcccttcccacagccccagttcatccccatgaagggccagatcagacccatggtgcccccgccgcagctctacgtccccgtcaacggctaccagccggtgccggcctatggggcctacctgcccaacttctacccggtgcagatcccaatgcagatggccccgcagcaggtgcctcctcagatggtccccaagcccagctcacaccacagtggcagtggctccaccagcacaggctacgtcaccacggccccctccaacacatccatggcagacagggcagccctgctctcagagggcgctgatgacacacagaacgccccagaagatggggcccagagcaccgtgcaggaagcagaggaggaggaggaaggctctgtcccagagactgagctgctgggggactgtgacactctgcaggtggacgaggcccaagtccagctggaagcttgagtggcaccagggcccggggttcggggatagaagccccgccgagaccccacagggacctcagtcacctttgagaagacaccatactcagcaatcacaagagcccgccggccagtgggcttgtttgcagactgggtgaggtggagccctgctcctctctgtcctctgacacagagagctgccctgcctaggagcacccaagccaggcagggggtctggcagcacggcgtcctggggagcaggacacatggtcatccccagggctgtatacattgattctggtggtagactggtagtgagcagcaaatgcctttcaagaaaataggtggcagcttcactccatgtcatatatggagtgaatatttcaaaacgttgggaataagggcctgcaaaaggcagcgaggaggcacctcgggtcttgaggttcctgacaaccgatctggtctgttggtttgaggatgaaggggctccatttctgctgcctccctgctgagaatattctccctttagcagccaaagattcgctggaacggaggctgccctctgctgcctgttggggtcggaagacaaggggcttctgaaatgggagttcctgagatacaacaaaatgtgtgccttcaaagaaactgacagctttgtatttggtgaaatggttttaattatactccatgtgtattttgcccactttttttgggaattcaagggaaagtgtttcttgggtttggaatgttcagaggaagcagtattgtacagaacacggtattgttatttttgttaagaatcatgtacagagcttaaatgtaatttatatgtttttaatatgccattttcattgaagtattttggtcttaagatgactttagtaatttaactgtttatgttacccacgttgggatccagttggtcttggtttgcttctctctgtaccacgtgcacatgaggtccattcattttacagcccctgttacacacagacccacaggcagccgtctgtgccccgcacacattgttggtcctatttgtaaatcccacacccggtgtatccaataaagtgaaacaaagc

SEQ ID NO: 36778 - DNA, 121755 bp, Homo sapiens
tcccgcggcggctggcgtcgggaaagtacagtaaaaagtccgagtgcagccgccgggcgcaggatgggatccggctcctccagctaccggcccaaggccatctacctggacatcgatggacgcattcagaaggtagcccctcccccacccagacaccccctcctccccccgggtgacagcgccggggccgggcgcggcggggcgggactgtccgtgcgtctgccggtccaggctgcggcctccgtgcgctccgccagctctggtcgggggcgggggtccccacgcgccggctccccggggaaaggggcgactcgccctggggggtggggggtgggggggcgggctagtgtttccgtttcacaggcagagcttttctttttgaaaatctgattaggctgagtttttacattcaagggctggcacatgaagcctttaatttccggtggatcggcccgccgggcagccccggggtcgtggtccgcggagggggcgagcagccgccgcttcctgtcgcgcgggggcaggtgcggggggcgccggcggggacactgctcccccgcaggtgagtagctccgactgcagagggggactcgggccgctgcacctccggggccccgcggagagcctggggggcagcgggtccggctctcccctgctgtgcggagataggaagtccctcgaatgtccagcgttcctagcggacttgagttacacgggagaggggttcagaatagaccccctttgttcgtggccccctctgacgggcagggagggacaatgagcgcgccggcttggaaggggctctcatgagctccccctaaagtccccagggaaaagccattgtgaggaaatccctcaaacctcagctgggcgtttcaggaagcccttgcagctgcttctcacctttctgcccacggagtactccactgaaggaggccagggagagatgccccagccaggcacagagcaggtgccggccaggcttgagtctttcctgttcccagaggtgcatttggccagtttaatcagtagatttaagccaacaagcctccctcaccctgtgcccggcttgatccccgtgaaatggaaagtacagccctctcccaccgtagcccgctttgagagactcagataaccgggaggaggaagcatcttcaaggacaggtggtcacccccttatttaatcagtgctgggcagctgggcagctgggcagcggcagacgcacaactagacccaggtccctgactccaggactaggcgtctgcaattgcatgggactgtaacagcctcctttctccccaaaggaaggagtggccctcccttgaatatgtcactgcaccagcatgcacactcacacacacacacacatgctccaatgctcacacatccactcacaaacacacacacgcacacacgtgcatacacacacgtgcacatgagcacacagacatgcacaccacataggcacatgcacacacactttttctgcccgatagatgagaatgtatcaaagacctgcctttaaaagcaaaagtctttttaaagtgagttgtcaccagatcaacagtagcaggtccgtcctaagaacttcctaaagatgtcccgggagcagctctcttggaagcaggtgaaaagtggaggagagcttcaggaggggtgggaggaggacgctgggcatggcaggccaggctgttattgtgggcagggtagcttttcacagtggacacgctgaggttggggtgatctccagaaaagcagcctgcaggtgggccctggggaagacatggcatgtggcacctttgcgggggagaggcggattgactgccagctctaccacttcctgtaccacgagcaagcccctgggctccccaagctggcatccccgtccataaagaagggataataaaatctgctttatagactggaatgagaagggaatgagtgaatgtaaacactgcctggaacactgcagaacacgatgagcattattcttccctcagttccttccataaacgtccttttgtggtgcaaacagggaggcgccagacgggtctccaacccccaccccgccccccatctccacgaggtctgttgcttgctcctgagctgcccccgccctctgccccttgctgtgaaccccgttggaagctcctagctggactgtgagtcctggttgaagctgaatcgtttgcccaagccatgtgccgggcaaagcatgataacttctcgctcacctcccaggctgcacacccagcagtgctgtcacggatgggttgcaccgggctcagctgagagcactttcagtgccgctgccatcagccgccattccttctcttaaagtaccaggcactgggtaaatcctggaatttccagcgtgaatctgtctccctgccatccgccccatctcctctccatcaaaggtcatggaaacaaacccatgttgcttcctaggagggagccctgggggtcactgggtgcaggagataagggatgtgttgctttccgtcactgtgttcgtcggcaccacctggccatgagtcctggcgatgggcacacccgccccttcgttatctctgctctttgtccctctggttacctgacccctggccatctcagtttccccctgagaccgcagagacggggaggaaggagggaacattagaaactgggggttctgccgagttctgtgctccggcaaagctccaggttgacaatctgaagttgtctgagggaggccccgggcagcaagtgccggtgtctcctggcttggccttacctgtgcaggtaaccctgcagacatgcccagtgattcagaggagccgctgcagccacttggcgccaggccaatgctttatttatatgaagaaaactccagacacgcacaggtgtcacatcaccagagtgacacagtgggagtcagcaacaggaatttgggggattgtcttccctcctcaggagcttttccttcagaggttgtgcagaggaagctgggcgtgtgaagtgagtcggaggttgcctcctgagccctacacgaaggcaggactctgtgccctggagtccaactgaggctccgttttcagtgctcccctctcatctcgagaaccttgggtcagttacttcactctgtgcccctgtgctgctgtgctaataattaaatgggataaggcagattgcctggtcaatgagcccgccgtgtttattgagcatctactatgtgctgagtgctggggtccatgggaagctgagtgctggcggaatgggaaggcaactacaaatgataaacagcagcagacgttgcaggctgggtgggccagccccgtgtggggcctgatgaacaggtttttttccctgacgatcggctttgcaggctttgtgggctttgtggggaaggagccctttgtgcagaactggtagccatgaggatggcctggtgagaagctgctgaagggctggggacagcctccacccagccagcagcatctgcaccggcctgttcccgtcatctgttccttggcttgccagggtgcacagatcaggacttggcacttccccagcaccaggtgaagccctcctgtcacccccaaccccgtgtctagaccctcaggtgggctgttaaagaaggggagaggtggaagccaggtccccaaacctagggtgctgaggtccttgcttcagagagactgtgtcctctaggagctgaagcgcttcgtctttccccagaggattcgttttttcctttcctcagctgcccctaccctggggggccctggctgcagcacctgctcctttctcttgcctatggagaaagggtttgctcagctgagctgcccatggagtgacagggacgacgcactcagcactggggagctggagggggtcccacctggtggcacatccaggcttgggtttgccaatcttccgaatcggggaagagagaggcctttgggacccctgggccaggctgtgggctcgggtgtggtgaggagccacatctgggcaagactgaatgctccggggcctctgtggtgccactgccctgacctggcggccccctcgggacactcgcactgtgcgcggcctccctggcgcctctgggctgtggtgttctggtcttggccttgctctgcagctggaacccaggtctgaacacatcggtggccgcttgagtttgcggggctgtttctactgtaaaccagagcagtgaatgcgcacagcccaaagggaggagccgcgctagaaagtgttcaagcgtccgcagaagtcggctcccagttcttaatagtttgccacccaccgtggctacgccacacctacgcttgcctccacccgacctatgcctgcccccttcacatgcgggagcccagggctccgtgccctgggcagctggtggggtctgcccaggccttctcgtgatgcttccacccagcctggtcctggcacccaaggccaacctctgcgggccccagagctgtgcctttttggctcaggtcctccccgcagtgcttggagtccaggcctctgcaccctgctggggtggtctgtggtcctggcccaagggaatgtcgctccctgctgcctggttctactgatctgtcctgttcaggcccctctgccttcatttcttgctttggcacaagcatgagctgctgtttcccccagctcctcaggggagaggagtgcactgccccaaccttgtctggtgtggttagcatggtggggccttaagccctacccggctcctgcgtgcctttcccctctcctgcccacgacatggtcaaatgcaaacctcctttcattttagaaggcatgggctgctcagcccacacgcgcagtgccctttcctgtggctgcaggcatctctgctcaattgtgcagggctgcgtcccccggccacactgactcctctccaggtttctcggctccagcaccactgtctgcgccctccttcccaggtggacggcggctctcctcgccatcctctccacttccagcctatcatctgtctgcctgttacatgtttgtaacttttgacctttaaattggtataaaaatggtactgtaagttcactgaaccaagaaaatctgctgaaggaagggggtcagtcacacccttttggggtttccagtgtatgaatggagggggtggcggtggtggagggacagggagcaatgagagttgccagccttattgctgtcctgacccctggctggggacgactcccctgtctccacctgaattgaagctgggctgtgaaaagtagtaagaaccctcggtttttggttcctttttcaaccagcaatcagccatgaagtgcctgaccacttgagagctacagcaggtgctgtctcggagagggcacaggaaactgggcccttcccaattttagcccaagggtgccgaaaagtcagggagctgctggcctccacactccttcccattggtgtggtccgaattcccctttagccagacatttccaatgtccagaggcccaggaggggacagctggaagccagaagcccacctgacgccatcaggaatttccatgaatgacctggaaacctctcagactaaaccaatgccgcccaatctgggaatccaggagggctggtcccatagagtggtggggacatggtgctgagacggacagcctcgcctcatccgcctttcccacttgccagccgggaggcctgggcaaaatcactttctccccagggaagtggaggctcactgtgcagtccacgcggagcaatggggtgaagtttccagagcagggcagggcatgtggggaggctcaggaatgccacccttgccctcaggcctgggcacagcatagcccccatgacgcttctctcatcctggacccatcagcccggaagactctggaagcagcagtggcagcaccttcctgtcacttgtcttgtcactccccgagtccactgtgagctagaaccacaggctcccatgaagaaggagccagaaccacaggccccatgagcccaggtcccacagcccgcaccttcgtcttccagccagcctctccggagctcagtgtgggtggaggggctgtctggcctcagaaatgggcaaaagacagctctcgttgtcagcgaggtaaatctagcgcagaggaagggcacactgtccccgtcagacgcctcagatgaactgacatgcaaatgagagatgaaacggggacgagccgggcagctgatctcagtgcagcaactgggacacctcggggcataagccgggcagggaggcggcaggaactgggccccagggggccaagacttcctgagaggctgggcccggtagcccagtcctgggcttgcttcccagggggtggtgggcaaccctgaaccctctctcacccaatcacctgctcccctgggtgcaggtgacccagcaagccgcactcctgggaaatttcagaaggttttgggcaagaagggcccagagagcccccagagaccagacggcacagcccgatagctgggcctgccccagacaaagcgtgtctgcactccttggctttctccccagacaaacccaccctgagctcaggatccctccagcttccaggagcaggtgcggggcctgcagggacggctcgcagagaaggcagtttgcgagtcagtgcctggcttgtggaggttgagaccaaggccagttgggtgcttgcatttccaggggtccaaatatttttgagaagaaaatgttctaagaaagtgcacagggtggtggatgaaagaccacgctctgggtaccgtgtacaccgctcgggtgacagtgcaccagaatctcagaaatcaccactaaagaacttacccatgtaaccaaacaccaccccttccccaaacactattggaattaaaaaaaaaaaaaaagattaaaatggttaaaaatagaaagtgcacaagcaagggtccatctgcaggagttggaggagcgcatgcctgtattcctggcactgcgggcacagtcatgccatgggcaccagggacgcccagtgcactcagccacccaggggtggctcccaacattttcaagctcaaaaagaaatattttcacttgagggtgcaacttatttgtcttgaacccatccctgactgcctgtctcccccctcaccctgaccacatctccccaaatcccgaagctggtcacgcaacgggagcattggccctgaacagaaacccgcagtacccctgaaaactcggtctagaaacaactaaaagaagaaccacagcattttattccgtttgctttagattctctgccaatttttttttttttttgagatggagtctcgctctgtcgcccaggctagagtgcagtggcgtgatctcggctcactgcaacctccgcctcccaggttcaaggaattctcctgcctcagcctccggagtagctgggactacaggcgcctgccaccaggcccggctaattttttatttttagtagagacggggtttcagcaccttgaccaggctggtctcgaactcctgaccatgtgatccgcccgcctcagcctcccaaagtgctgggattataggcgtgagccaccacgcccagccttttttttttttttaattttaaattgtggtaaaatatatgaacaataaaccctccctccccatccccctcccccagcccctgacccccactgtacattccgctttctatctccatgaaactgctgagtgcggggacctcacagaagtggaatcacacaggatcgccctgctgtgcctggcctccttcactcggatcatgccctcaggtgcatccatgttgtagcacgtgtccgaatttcctgcctttttaaggccgagcggtattccattgtgtgcgtggaccacattttgtgtttccattcaaaacggatgaatcgatgaaactgcctgatatttttaaagcctcagtcattttcattcttagttcttcagtttgcaaagggccggcctgttgtgatgggtttattgttgcatcttctgaaaaactttgtgagttcccgaaggcctctccacgtcttgagtcatggctgtgctgctttgcgaagctgtgtgcatgtctgtggtgtagcctgtgtacagcctgtgatgcgtcgcagcggaagggtagggggctgcccagggaagacagatgcgccaggttccgctccacggagctcagctaccagccctggtggagagcgcagatggggccgatttgtcatttgtctgcgcttgagcccagcagctgtgtggcctccctggggcaagtcattcaccctctctgtgcctcagtgtctctgtgaagtggggggaagtttttggaagattaagtgggctaatacgcgtcaaatgctagaacacactggcacttggtaaatgctatataagtgttatcatttttgtttgtttattatttatttatccatgtcatggatttaaggcagtctaatctcagtgcctggtggagacccgggcgccacccccccaggttgtcaagtggtccctgtgcctcccactatcgtccccagcacggtgccgtgtccgggcgtgcgtgaagggccagctcacctcacagctctgcttcccaggttagctcccatccaccctccccctacctgtttcctcaccgaaggaaggggcagaaagatgccctccatgccccttccgactgttgcagagggatggaggactatggtacatacacacatatacacgcacacacccaccacacacacacaccatgcacatgcacatcacacacacgcacacaccatgcacacacaccacacacgtacacaccatgcacatcacacacaagcacaccacacacaccaagcacacgcacatcatacacatgcacacacaccacacacaccacacaccacacacacgcacatcccacaccatgcacacacacaccacgcacacgcactgcacacacatgcacacaccatgcacacgcacatcacacacttgtacacaccaggcacatcacacacaagaacgcacaccacacacaaggacacacaccacacacacacaccaagcacacacacaccacacacacgcacacacacgcacacacccaccacacaccacacacatgcacatcacacacgtacacaccacacacagcacacacaaaaacacaccacacacaccatgcacatgcacatcacacacatgcacaccacgcacacgcacatcacatgcacacgccacgcgcctcacacacaagaacacacaccacacacacgcacaccacacacacgcacatatcacacacatgcacatcacatacatgcacacaccacacttacacacatgcacatcacacacaagaatgcacaccacatacacgcacatcacacacatgcacacaccacacatgcacatcacacacctgcatatacatcacacacacatcacacacatccacatgcaccacacccaccacacacatgcacgcacctaccacacatgcatatcacacacatgcacacacaccacacacaagcacatcacaaacaccacacaggcacatcacacacatacatacacaccgcgcacacatcacacacatgcacacacaccacacacgcacagtatgaagatgacagagaagtcagcagagcccctgggggtttcaggagttgagtggggacgaggcaggtggccacacagctcggagggagggcagaaggcacccgtcttcgcagagtcacagtggggcttgcctcctatacgtgccggaagggtgaagccccttatctcattgcccgatgtgatgaggtttgaagtggttgagcttggagggtatgggctgagcccacagcagacaggcctggcagtgccccccgtcttcccaccctgcggtcatgcagcccgactcttgggggcggggtgccaccgtgatgtgccgtcacttgcagcagtatgtcctcatgccaggctgagaccagcactgtgtgaccagcctgccccatgtccctcagcgctgtgtcacactccacactgaggccccactgaagcatgccaggccccatcctatttcttccaggtagtcgtctgcccagcacctcccctcccaggccttgccctaaagcccaggcctctcagcatccaggactctggaatctcccaggtgttgatggctgaggtcatcagctggatgccaggacacccaggatgctccaggtccttgctggggtctggagtttgtgattcagcctcagtccctgtggtgagtccaccatgtgtcctcagacaatggatcagagagcccccagaggacggcccggggccgagtcgggtccagatgccaaaggggcttctcgaggcatctccagctcccacctgcccctcggagtgccaggcttggcttctggaagagaaagctgggggtttagtgactccagccaactgctgtgagcccaaggcatcaaactaaaaatagcgaggccaagagggagtctttgtgttcggctcagtgggcaatggtgcctcacctcgcagcatgacacagggctgatgacacggggcacgttggtcacaaagtgccagtctcagcctggcacagggacgtgccacctgcaggtgatgacacatcacagtggcagccgctcctgatggtgctgctgcattgagtaggagcccagatccagggagacagttgcagcagatgaggcaggaggccagcgaggggttctacctgctttccgggctggcctctgcatggacacaaagcagaaagggcataaaggtgaccctggccaccaaagcagacctggagcaaactggaccagcgcaaggccccggtgccagcactcagagacatttcttttctggcaggaaatttgtgcttcattttctaatgaaattccaaggcaatcaaaaggcaaggaaagaggagggaaaggaagggagggagggagggggttccattcccatccgaatggaagcccccaaggcttctgtagctccccccatcaccaacttcactcaccactcttatctgatgcctcctatttgggtacacacggccgggtcggccttgcgagagactcagtttcctctcgacttccgcccgcctgcactgtcaccacgtcctgccattgacctctgttcatccactcatggtcactgctgtgagttgaattgtgtctcccaaaaaagtggatttctgtgctaacctgtgaatgtcccgttagttggaaatagggtatttgcagacataatcacatcaagatgaggtcatactgcattgggatgggcctcaagcccatatgcccgccatccttctaaggagagggaaaggcagacacacatttgtccatggaaatgagaacggaagacgtagagacagaatcaggccatgtaaagacagactcagagaccagagtgatgcatgtacaagccaggctctgcgggcagcccctagaagctggaagaggcaagcctcctccctggagtcctgggaaggagccagccccgcccatgcctcgagctcaggcttcaggcctccggagccaagagagataaacctctgtggtttcatgtcacccagtttgtggtctttgttatagcagccccaggacactcagggggttgccttgtccacccccatcctggccctctgagggactggttggctcttagaagaccgttcaacctgccctctggtcctcctcccccacccagagacccctggctacaccctgcccaagggagctcaccaaagcccacagggtccctgtgatcttgtcacctgggctcccacaggccagcagtgttggaacctggacatctggctccagccttggtggccacccccgaccttgctctgctcctacagctcccggccttccctgccctggccggcccttgctgaatgtccccgctcctaggaagccggatgtgtcgcgtgcaggtgcctctctgcactgtaataactcctcaccaggcacccttggagcccaggatcaagtcactcaccttccaaccctgcccctgcccagagactggcacgagaaccagtaacagttgttgaataatgaacaatggatgcatgcagctcacccgtgagagggcgttgctcggctgggccagggatgaagcttctcccgcgtggctccaccgtctatccctcaagctcctgatgctcccctgggcacctctgcgccatgaggccccgttgaagtcagttggggaggcagtgtggaccgtgagaagggagtcctaagcacaggaaacgctgccttcctggggccctaaagaacaggctcaccttccccaagggccttcaggccctgacatctaaaaagatgttctttatcaaaggggaaagcagccctggggtgggggcgtggccaccagtgcagtgggcgtggccacaaccgagagggcgtggtcattcgtgcagtgggcgtggtcatcaagaaagggcgtggctgcagccggaagggcgtggctatcagctccagaaggcccttcttgctgtccttggacttgggttctccttgtcgacgaggatctcagctggagctgccaggggcagggctggcaccaaagcacttctgaagtctccccgcctcccaagtgtgaggctgtggggaaggagggagggcagctggcttgtttctggatgagcccatctgactcagcagctgggacccagcaggagcgcagagcaggtcctgaaggtgccgaggccccacccgcagctccgtctcagctttgtgagggctgcactcccccgtgtgcatccggcgtcacaaaggaccacaggcccggcggcctccacagcagacaccaaggccctcgcggtctgaaggccgaattcccaggtcaggctgcagcagggctggttcctgaggcctctcctgggctggcacctcctccccgtgtccatgcagggccgagcctctgcatgtctgtgtcctcggcgcctcgttttacaaggacatctcattttaaaggcccggtctccaaataaggtcatatcgtgaagtgctggggtcagaactacagcatgaattttgacgggacacagttcagtccatagcacccgctttgggaagtgggaatgacctctcccttccccatcttctggcctttgtaaccctaatgtgggaaagcaggagggatccagaacgacattgggtcaccaaagagagcatcgcagcccaaaaggttgaaaggcggcaccaaggtcccgcgcctggtgaccgccgactcgccctcccgggctccaggctgtccccactcccccccgccccaaccccagcatgttgaggcgcctggtcccaactgcccattcactccctgtacacagactgcttctttgtcctccagccaggggtgaagggccatgctggcgaaacagcaaacaaccccaacatgctttgcagcctggccaaccacatgaccagtttgaggaggttggctggagatcacaatgaggaagttggatgagggggtccaacttctagcagcccataagcctatccattcagacaccaaatccatggaaaacagagagacaatatactgattttcaaaagggagacataccccagcaagtacagaccagggaacagggtgctgacgtggccacagttcttaaactactcgacttcatggatggggcacagttttttttaaaggaggatttagaattctatttggcaggtggcatgaaaaagagttttgaatagaaacacacccctccctcccagttgcctgcccagtatgtttgttttgttctcttgaaacaaaggaagagagtggtgaggagggagggaagatgaaccaggaagaatgaaagcacttggcctgcttctcagatggtcttggactgtctccgctcacaggagttgcaggtttttgggttttatgcaagttcggatcacaacaggcctcttgcaagaaccaggcattacctttattccaaaagccttgctgggccttcttgaaaggactggcagccaccacttccctagaaacccgtggcaagttccctcctcccgaccccctgctgtttggtccaggaccccctgcagtcctgactgggacccacttggcccttctcaagggacccagcacaggacgtgtgtttctgctttgatgaaccgccctttcccccctgcagttctagtggaatctcccctcccttatcccattcccacttggaaatgatgatgatggaatgggcgatgccggcttaccaagacatccaagctctctgggtcgaagttggagagaggggtgcacaaaaaggattccactcctgtctgccttcccctgcctccccgctggggtgtccctttcccatggtttcctctaaatcttttcacccatgtccagccacaccattctcacatactgccttgaaactgggctcgaaggggctgcgtgctgagagaaggtcctctcccccagtgatcctccagaggggctgccgcctgggtcccccgagcacctcctaccccaccctccccattcctgccatccccagggtccagggagcccagattccagggaagggttgcattagctcccactcggagtcctgatgcagcagagacagacagaggccctgggagaagtgagcatgaattattaagacaagacaagggtgaggccccagagagggggtggcggaagggtcatgttcatgcagcgagagttgcttcgagcttgaaccgcgtatccaggagtcaagcagattgcaactggcgagaggccttcagaaatgccccgtgagagtcctgtgtgcagagctccatctcagcacacttcctgttcttttggttcgtcgatttttgcattttcagtcccctgtgatccattatttataacagtggagattggcctcagacactagcagtgaggaaaacaaaagcgaagctacgcagaaaaatgacaagagtgatgagcacagcagtcatgacaaatgagccctgtgcggaggcccgggatccgcgcagatgccggcgcgggggaaatgggccctgaaatcccaccgtcaggccaggcagctctgagcgtgacctggagggctgttcagacggtctgggtagccgtgtcctgcgcatgaacatcctccgtcgggagaggaattccccacggattatcagagctgctccctccaccccccgccacgtcccacgcgggccacatcaactccctctgcagcctctggccagcggctgagccctccgtgtctcccctcgttaatgcctccttcaccatcccctcctgaagtttcccccattgcatacacgcgctgaggcccacccggtatcaaggactcccattgcttgcgaaaaagattccacccctcttagaacagagaccagggccgctgtagcaaatggccataaatgccacagcttaaaacaacagaaacggattatctcgcagctctggaggatggagtccaaaatctgaatcgctgggctgaaatccaggtgtgggcagggccgcgctccctctagaggctcccccggagattcccttccttgcctcttccagctgctggtggctgccagcagtttgggaattgcggccgcatcacaccacctttctgtttgttgttgacatccccgcctcccctgcctgcggggtcttagatgtctctctccttcccactgagtttcactccacatttgaattggattaactcatgccatgttaggcaaacgtgcccctcaaatccttccacttaacagacatttattgaaggttcctgtgtgcggggcccaagagaagggacattaaattaggagatgaaccttgggaggccatggcatgcttcggagcctcggcgtcaaaatgacaacccacaccccacttggcggttcatctggggccctggaatcagcagactgaggctggaacccagcaatggcacatgctggctgtatgttctcgggcctcagtttcaacatcagtgacatggggatagaatctgcccagcggagttaagtcaccgcatcccggagagccgagtgtctcatagaggctcctggtgtggtctccatgctgctgctcagcacggaatgaagaggttcaggaacttgcccacagccacggataatgagggacagagctggaattgagcccgggaacctgcacacacagcccagtgtgaccgtgccttctagagagaggccagccctggcaccaggtgggcatgccagcatcaccttcaaggtgtgctttaaggatccaagataatgtgggtgcttcaacagatgcatggcaataaaaggaaagcaccatgtttcaccttcacacacacacacttacacattcacacactcacatacttacacacattctcatacactcacacatatgcttacacacattcacaggctcacacatgcttacacacacattcacacgcacacacattcacacgcacacatacacttacacacattcacacacatacacttacattcacacacatacacttacattcacactcatacacatacatacattcacacacatattcacacattcacacatacacattcacacacatacacttagacaccacactcacattcacacacattcacatacatttacacacacatccacacacacattcacacacattcacatttacattcacaaacattcacacatacattcacacgcacttacagtcacacatacacttatacacagtcacacagacttgcacatagacttacacacatacacttacacacgcactcacaccttcacacacacaggcaatcacacattcacactcacgtacacttacccacacattcacacatacacacaccacatacacgcatacacttacacatgcactcacacactatcacattcacacacacatacacttacaaactatcattcacacacatacacacatacacatgcattcacacacatgctcacacactcacacatacacttacactcacagtcacatacacccacattcacacacatacactcacattcacacgcacatacactctgacacacatatacatacattcactcacacatacattcacacacacacggatgcattagttttcaagtcaggatcctagcacagcccacaccctgcatttgcttggtgtctcctgaggtctctagttatacttcccatcccttttcttgccatgtatttcctgaacacatgttatctttgatccttaaaccatgacttagagatacagatgtatgacaagctgagagatgatgtgagactgttgttaattttttctccatgtactaattacattgtggttatcttaaccacaaaggaagcgttctactccagagaaccgcgtggaaacagtgcagatggactagcacgatacctgagaggagctttaggataactccggtgctggggaggttggggcccagttcaagcaggaggggaggcgtggggacaggtgttgaagctgtgggtgtgcagcggaggcttcatgacgctttcctcctgctcttgtgtacgtctgagcatttccataacagggaagtgttttgttttgttttttaaataacattttaaatgcctctggcacatgggaatccatggtaatttctgtcgttgttgtatattctttttcaaatgcaaggacctgaaaaatatctcctaaactggaaaaggaaatgaggctgaatacagattttattttagcaaatagagaagcagtgattgtctggcggttaactgtaatccattctgagtgtgactttactgttaagtattctaaaaacaagagaccaaacaaaatgaacaatatgtccaaatgtgtatatatataatttgtaactagaggtaaattgcagatgaattgcagatgtacacagacagatggatggacagatgattgatatagattgattgacagatgattcatagataacttgcaatgtttcttcagtgaacgcatatttatttcttgggtaataagaaaaaacaatagaatgtggaatttggggcttggcctcttttagctcatttaaaaaaatattaaacacttggaattatcgagcgctgaaaaaggcaatagaaaattcaccttttaactccctcaaagatagaaatgtgtgaatctgctagtgggttgcgtttggctggtcctgcaggctgatttggtctgttctctctcccagagagatccccaagcccggctgagatgtgcctgtttgtcttgagggcagacaaagcctagcaaaatcttatggaagctgatataaaagcttaatagcttataaaagctctaaaaatgattcacagtctaggatagagaaaataaaaggaatttgaattggtttattttcctttagaggagcctaaatcaatatttattctgagtatgcaatcagaaatatcagtaatttgagaacaaggcaaacagagctgcacatcccgttatggccacgagcccacctcgccttcgttcagaccacagctgaaggtctgacttaggtgcagcacgcacccctggagctgagggcctggagcagggccaggccgggctcttctctctcttgtctgtcctcgtctgtgggggaatgaagatgacacagcactcaggaggtccttttcaggacccagagtcactgggcttttagggcgtttggctctggttctagcccgagtgtggtctcagtccccattggtggttgtggttgtggcatgggcatcattagtcacacaacataaaaccacagaacgcagaatttgctcaccctggttcacacaggagcaagcttgggcaccagcaccccctgaacgcatgccaaagggcaggtccagctcagtgctggggtgtggaggaacccacctggggcctgcctgcaaagacagatgccctgccgtgtttagaaaaagagaaaactggcctaaaccacagtgaggtcaaatggatcatttaacccgtcgagtttggtttcttgttcatccgacgcggttgatcttattaacgcatatgtgtttgtgttgatgtggcctccagcttctgtcgcactgtggacacagttggatgtggctgctaatcaatgcggggctccgtaggtcagtgagagcaatcagagcctgctgtgcggtggcatccccgagttaagacaggcttttgtcccatactctattgaaacacccagaaatgctgacatgttgaagttaaggccatgtgccttggtgctacttgcttgcgaaacagcctttgaaggaaaaaggaggaggaggatccatgagtttcaagggtcccctcctgtaatcacggctgccactcaacggagtaagtaatgtgtagcgggccctctatctgcatgacgaatcctcctaacattcctgtgggcgaggtaggatttgtctcgctttgcagccgaagaatcagagcctcagaaaagttaagaaatcttccctgggtcaagctggtaggaggagggactggaactgaactcacatctccacctcctctcttcctactcctctgcctttcttgcacctagagcagtgtacaacatcaacaactgaccagggcgatcctagaggtaagagacagccgaatggcacggacccagccaagcccaggcctgcccaggtggaacagagccagctaggagcattcggtagcagaggtcagtccgctgattgactgttctcacttccaggcccacagcctcctccaccctgatggtctatgagtctagtgcggccctttgcacaattttagcaactgaacccttttcctcacagaattgtgataccgtcctaacatatgaagcatatataaacagttgggcaaatcataatagtttccattatttcataaatttgcatttgtggcaccaaggagagaattaatgggaacaagagggttcttgtgtgagttccgcatttggatttgggggttcgaggtggcagctataggctcacattagtgtctgcatcactttgcttcagtttgtcacggtggccccccaaatccagaaccgccctcctcgctgtgtgaggagggtcctgcctgcaccgctttgcagacatgggccagcctggatgcctgggcgacgctgccctgcgactcgctggcctgcaggacatctgcaaaacattcaggtctcacggcagtggccatgaacggcctcacagacactgagtggacctgaccccaaagagaatgcgtcgtccttgaacgtgtcgatatttaggttattacacaatgagtgtgttgctttgcaattagtgtctgaaagagttagagcagatgtacatatagaaacgaagaaacgaaatctgaatccatgctgacagattccccctccccaaaccttgctcaaggtaacacaggcgaccaggagcaagtcccggccggccccctgctagcgtggtctgagtggcccaagcaggacccctgcccaggctcactggactctcctggagcccccagacacgacacccttcctcatcactgaaaatccacttccacagtgtaggagatgcatggatctgagggccagtaggaagtgctggagctttaggctttagacattctttttttttttttttttgagacagggtctccatttgtggcccaggctggggtacagtggcgtgagaaattctttaacactctgccgagtcctggcccttggggagtgaggcctggctatgaggcttcttgtcagaactccgtgtgactctcaggatggaagaacagggtgggggctgctcctcccctccctccctccagcccctggcctttgtaaaacggctccgcctacgcgcctgtagccagtgcagaaccagggaggcctctccccttcccttcccaggaggggccccgccttgtcctccatgccggattctgttcgtcctcccccaggtcctctctgctgcctcccactgccccatttcctccaggaaccttcctctctcctaccaccagcctctctcctacccccagacacacactctttacatgccgatttctgtcctctggttaactggcgtttaattttctcagctgcttggcttaatgccaaagagtgttcttccaaataaaaatggtaaagaccttttttctcccatgagaattttatgtaaacgcagtgcagcatgctcgtaggctggttctgttatcaatttctaagctcagcttccagagctagagaacttttttattggttataaaaaccctacatattcagtgcagaaattctgaaaaatgcagaacagtatcagggagaaaataactcatcccccactacccagagaaaaccgctgttaacaccgaagtgccacagttgctggcgttctcacacaggtgtgcgtttaggagtgtgtaagtgcgtgtaagtgtgtgtctggctttctttcacataattttgtgtcctgatcattttcactcagcattacatcagcagcggtttccaatatagcattaaattgtcttcaaaaacatgattttaatgcctctataaagttccatcatggaggctcactaaaatgtaatcacttcattgtttatgagatactcagcttaattccatttctctgcagtgaataatccagaggaacacgctcagtgtgcatctttgcttgcagcagggcagcgcagggcattggttggggtataaatccgggggtgcagtggagattagattagatcgtccgtggaaagcaccagaatggtgcctggcacttaataaatgctcttattagtatgtttatcttcattatgtccctaagagccattcctggaaatgagactgtgagtcaaagggcacaaataccgccaacctgctttccgacagcgctgtgtggatacacgggcccgaacggcgccagcctcactgcctctgcgttagtgccgccacttcatctcagatactctcctgaagataagaggagagtcccatgcagccataagaaagacaacggagagatctgtgtaccctccacccagtctcccctactgggactgtcgtgcaaaattatggcccagtcttacaaccagggtattgacagcgagacaagcccccatctgatccagattctccagttgtacttgctgatgtcgtttagatatttgtccccgccaaatctcatgttgaattggtatcctcagtgttggagtggggcctggtgggaggtgactggatcgtggggtgggtttctcacaaatggtttagtgccatccccttggtgctatccttgagatagtgaattcttgcaagatctggttgtttatgtgtgaaggtagaaggcatctcctctctctccctcacgggtgtgcacgcctcccttcatcatgtgatatgcctgctcctgtttcaccttccatcctgagtgaaagctccctgaggcctccccagaagcccagtgatgtcggtgccatgcttatacagcctgcagaactgtgagccaattagaaattggctttataaatgacccagtctcagatatttctttatagcaatgcaagaacagcctcatgcacttgtactcacttgagcatgtgcacttacttctgcacgatgttcttgcctgtgtagactcttacatccacaaccacagtcacagtctagaacattccatcgccgcaaggctgcctcttataaccaaccacatcccctacctgcacccatttccaacaccccatgcctaactcgatttccagcaccccgtcctggtgaacatgaatctgttctctatctcttcaattccgtcatttcaagaatattatataaatgggattacacagtatgtaacctcttgagactggctttttccaactggcatcattcccttgagatccatccaagtggttgtgtgcaccttttccttgctgagccgtgttccatgttgtgggccgaccccagtttagcactcgcccattggagggttggagggcatccgactcatctctagtgtggggcagtgcgtcaccttctcacaattgtcaacgggattgtcactagtatttgccttccatgtcttggaggccaatgtggctgctcttagaaatcagtcctccttattttggttggggagatttctgatgtcagtttgacgtttataattaataagcatcatcatcaagttacaagagtaaataaaaatatgaggcagggtgaaatgtaagatgctcgagaggctgagatcagtagctgtgtgaatacagcagggcgggcaccagcagtgagctccacggggcccagcgtccggcctcattaaccagctgcccttggggaggagcagagcccgctcttccctcctggggaagggtagtgtgatggaaagacaggctgcccttctctcctgcaggagctcagcatcatgctgtgtacatgcctgggctctcttcttcagccctagccacttaaaaccacttggagggaaagattgtagaataattataatgaggaaaatttcgctccagattcgttactccaagttcagagaagctctgtaaaaattgttgctaaggcaattgaataaagaatgtcagccgatgtaagcgataacagcaagacaatgaacataattgcatgttttacaacaaccaacctcaaagcatgacttccctgacatagatatgttttttaatgattttgaaaggtaacacagacattttcagggatttggagaggaaactaatgccatcctggtttaccagctttatggggtcatctctccggtgaaaaagactgcagccagccttgcagagagggcgctgtcttagggaggcacctccaactgtccccgcgacccagcccctaagtgcttcacatcaacactgttcttttgtgacggtgctgctgtctttcattcgccagcctgtcatgctcaactcaaacctcagttgccatccagttatcttttttttttttcttgagatggagtcttgctctgttgcccaggctggaatgcagtggcacaatcttggctcaccgcagtctccacatcccgggttcaagtgattctcctgcctcggcctcctgaggagctgggactacaggcacatgcccccacgcccagctaatttttgtatttttagtagagatgggatttcgccacactggccaggctgggctcaaactcctaaccttgggtgatccacccacctcagtctcccaaagagctaggatcacaggcgtgagccactgagcccagcctagttatcttgtttgtccaggaattggagcatttctaggtagcaccacaaatgtctgtgcaagaaacccacaatttccagtggtcattggctttgtgccaatccaaactagagtctgacaaacccagcaagaaatattcgcggcagctgcaaggaagctcctcaaatagaaatagaaaaatgaaccagggtctgctcttcccttccgggtgtggaatcaacggaagccgactcaacacagagccctgggggcgtgaggggtttggcgggatctctgccggctgcagatctctgctctgttattaccagcccttctgcccagctcctaattgctctgaagagggaataattttctcagcagccattgccagccacatttggactgaatagatgctgaaatggcaagggtaaatggggcagagacagtgaaaagccattttctatctggagcccaaataaaatcttcctcccacactcctgcctggctcctccgcagcctcaatgcccttctgagagctgcctgccccagtaggaggccaggctgggaccaaggacacccagttctgggtaaccatcttcccatggctccttggacaaccaccttaaagaagggaaaggcaagaagcagaaggaaagcagaggctggacattggaatcagcctttctttaaactaaaaaaaagttttcacatatgtgaatgcgtgtgtgaatttgaagtcgtatgtggaaggggccatatatccgtcaatgcatgctccaaaaatcagaactgatggacggcaaacagcatcggatgtgcagccagcattcttccggcggccacctcccgggggaaataggtgcagcagacaggaccgtctgtgggacggggacaggcaagcatgacagcaggtaccacagatcagggtgcacagacagggctgggggaggcagcgtggcacggcacccacttcccctcggcgtgtctgggctgaagcccagtggactcccgctgatcagaaggatcctccactagaaggatctcactggacgagtcccctccaaactggaacatgcaggtgccttgggcttcatgctgcacctttcagataaaaacacacaggtgagctgggagagctggagtcccatggaccccagagatccaggtcacgaggaggggatcgcgctgcaccaggacacattcaccaaggtgagccctggttcctccccacaggctgtgggcaaggaagtgtcgatgccaggctggctcagtaggtggaagaaccttccggaatgcctgcccgcaggctgctgctggcatcgagtctgtgtcctattttccattcactgcatgcatcctccaagtatgatttccactcggaaccctgagctgcctcatccctcgctccgtctcccctccctcccgcccagctcacactgaaatcacgcctcgcgttcagcggctggagtcctggtggattgctgcttcggggctctcagaaatccctttacttgagtcttggttttacaggaagaccatgaagcaccccccaggagctggagctcctccttctggacccagtgtctcttctcagcctcacgacgaggagacctgctcatggagctgctgcgccggcctgagctctgatccctcctccgacccagcctcaccctgcaagcagcaccatgtggggctcagaatggggatcttaagggacccttcccacaacctcccgataagcctttccacggagggcccaagcggagacaggagaacactgtatttgataaaatagagtcaaatccaggaaaatgcctctggacccggaaaggaaacgactcaccccccacccatgagagacccttctgtcctgtcccttaacccagaggccctgggcatgggtttcgcagccccctggaggccagaccctcaaactccagccttgtttcttctaagtgtgccagtcaagatgcttctcactgcaagaaacagactctttctcaagccagttcaagaagatctgcgttgctgcagaggccgatgggtgtggggagcaggctcagtgagagactgtcgtaaggaggctgagaggtcttcagaaaaatccccaggacctggggtgccaggagcctgggcgggcctgggctctcgcagcctgcagcccctcccctccctctcacagcctccgctgcccccgggctcagggcccctgcctgtgccttctcctgaggcttctcctttttacctctcagggtcccagtgtggccagcccggcactaaacccatgcgaccctggctcactgacagtcgccaccagctccacatctctcagtaaaagttcccccaaaagagtgtgattgggagctagccagcggggcttaaggcagccccctgctccagtccccttggccatggagacagggcagggttagcaggaggcaaggcatgcgcaggacagctggccggcagaggtcccgtgtgctgtcatgggtgcagggtggacactgtgaccctgggtcccccacttggaaggggtgatctagagggacttttgtcagaaagacccccacccagccaatctgactgatggggccatcaccttgacaacaggcttggtggcaaagcaagagggtacaaccgaccagagccccgggtcccctgtgccctcctgcactgcctgacagggctgggccatggcccgtaccaaccgtgagctgagccaggaatccagtcaaaccgtgtgcctgagtgacacgtagctctcttccttctctggattcactgctgatcaaccccaacaagcagcaggactgtcttgctgtgaacccaccgcttgcggacccctccccaggcctccattcccgcctttctgaaggtcaaggcagcgccctccccaagaaacggtgggaacagaggagccaggtgttcgttcttcccagctccggaaacgctgcagattgcgcactcgagttcctgctgacataacagtggctgccagacaaaatgtggcgaaaagtttttctaggtgcctttgttcactcagagacttcctagagacttgtgtgaaaatcacaggatttgcaaccagtggggacgttgagattcgtggcaactgaaatgatacaaacttgaactttgtgtcaaaccagtagtgttttgtgtaattcttttcaaacctgtcatttcacttactgcttctcacagccccaaggggcaggtggagttgatgccatcaaccctatttacagaatggtaaactgaggctcccactggttatgcgcttgcccacagggttgaaagagaagccatggacaaaaggagtcactggttacccaaagggcttcctgttctcaaatccactgctccttccattacgtggtgtctagaaggaggctcttttggatatagacattaaataatctgggagtcagtgtatgctgtgatcaagcatgtgcggtccgcagccgatggcccaggatgcagtcctgatgtacacttctggctgggtgcgtgggagccacacacatctctgtgtgccttggtttccgtgtgtaaacatcttagactagtgcttgcctgtggttggcacctggtaagtgtcagccttctctaatgtaggcagcttgagggctcccagacagtgatgttcccgctgacattcccaggtctcagctgattatgaagaggcatcaatttccagtgggggagccgccctctgtctcatcatttgtttctctcatcttgctttaatatcacagcactgccagtcaaaccacacaaaagggtttgtgatgacctgccgtgcattctcgtaagctccagccctgactcgcctgcaagccagaagccaacataaaactttcgtttttcccttaatcttgctgcctctgcatctcattttcaaatttcattttatcaactttttttgcactatttgtttctggataaaggatttgcaaaattcttcagcatgtggtcaggaagccctatggcctcctgacgaggcagcctaggggtcctcccgtggtctgaagctgcagccgggctggcctcccacagtcaggagcagcatcaggctgggtgcttctgacaccagcgaagagcgcggctgtccaagcccccatccctagggctcacgcctcatgcccaaactcgcacccactttggcgccgctggagactaatgaacagcaaaagctgaagtcatgactctcatccagatctaaaatgaccgtgtgtcaaacatttttactgaactgatgaatcgaatgggaactggtaagaaggtacgaccagttcaaaagagaaatccaagaaccctaaatgtataaggagtgaagcaatgttgaaatggacttacaaacggatgcagctatattctccagtggagacagccagtgccaacttttgtgcttattccaaatttcctgacagcctccccaccttttttccaacataatctcaaagagagattattctggatggcagaataaggctggtccccctaggtgtggcatccttgcttgcatagaggtggcaagagtgccaccataccaaacaggcctttttcagtttgttttgctggaagacctcagaagatatcagaagcaaaagcctctgttgtttgctatcctaaggttaggaagccaagcataaaaagctctcctccagatttcaccggcagtacttataaatttgatgaacccctctcttctcaaggcccccacgatattccaaaaccctggcctgccagagtagagccttttttcccatcttggaggctgtgaccctgagagcccctaccctcccccaggggactttgtgggcatggacgttgcacagtcaccctcggcccctcaagagcggtcacagcccagcaaatgagcgtcgttctcacgcacgtctctcaggcttaggctcggttgcataaaccttccccaattttatcctggcaaggaggaggacagatccttccggaacctttgcagatattgccaccaaaagtaaagccttcataaaagtttgcatttggggaggaaggagagcagatggtgaaaatcagatatcacttaagaattactcatttcagtttacaaaaaatctaggtcgttaaaggtgactgatagcttaagaagacagggaaagggcttcataacagagccggaaagtccaacagtacaacgacacgcatgatgccaaaaagtaaagcgttcctcactcattccactcagtgctccgtaactgattctccactggctcctgggctgcagcctcatgaagccagctgttcctcaactgaaaagagccctggaagccctgggcagcccactggcagggtctgaatatcatctgagcgaggccatcagaagctgtccccaggagtctgtgcttgggggtcagtcatcggaggtgcttactgcggtccttttccatggggctcgaagcttctgcattgaatcacgagctctggcctccagcctggtgcagaaccttccagggggcattggagtaaaagcttctgtagatgacagctaccccttttttggtccattttatagcagaggaaatttaggttcaaagaagttgagttgagagtcccaggagtaagaagcagtcaaggatccccccaggcctccggggccgcctgggctgcctggcctcacgacctggccccatgctcctgagatggagaagccccaggcccatgagcctgttgcccttggcaaagccacttcccttctgagtaaagtcagacgagcctgcccagtcccaagagactgcgattccgtaatcgccctcccctcgccttttgaggtcttgctggtaggtgcacccccttcaagccagcccaaggagccatgatttgagtcggtcttgccagatgtgtctggagagaatttaactccaagatcatcccccgtgcactctgaggggctgggacaggatgtggtgccctttgtgcccaggaggagaagcacccagtggggcggggtggggcgaggactttataaaggcgtcatttgctgcggccacccaggttggaacacagggaccacagggccccccgccttctgcaggaccaccccgctcatctgagggagacactgtagaaacacatctttgagcagtggcttctaatccaagaaacccaatagaagtcaaacgcagattcctagggcccaacccggacccactgcgtgggaatccctcagccggggccagaagcacgctttgaagacaccaacctcctcagcaagcctcttgcaaaccacatcctgcttctccagaagctgcagatccagaatgttcaaagaaagagccctccttgccttcctcttcttccacccctgccctctgcagactggggttctgtagacccccaaagtaagtccgccacaccggaaggaagtgagttacacaggggcccacatgggaaccgctttttgtcctgtcttggtgggaaaatggccacgaccccagcccaggctctgccacgccacaactccacgggcatagcctgggaggccgcagcgtgaactgtgactagggctgaggatggtgccatggtagaagtgagggcctggcacccggccaagtgcaggactcctcggcagtggggttgggagaagcagcctctgcaggcgaggccaggaaccaggacacaggaggagaagcacatctcagaggagggagctctgggaggagccagcagagtcctgcaaaggaggatgtgggggaaatggggtgaggccaaagtgggggctgctgaaggggctactgcacccgtgcgagcagggccaggaccaagctgcataggcagccagggacacagccgatgccacagacgtcaggaaccacgcaatgacacaggccacctttgaccgaccgttacccctggggcaaataccagtggggataacgggcaaggagaggtgctgtttactgtcttattgttgccagttcagcagcccacaggaaatggtgttagtcacagaaaaaaaaaatctgttttctatatttcactgtttccaagtaaagaaaaaagaaaactaatcttagcttaaaaaaaaaaaaaatggtgcgctgggcaccgaaaaataaccatcttcctaggcctgcgtttcccccacaccggggacttgtgctggaaagaaaagctgcgttggcagccaggagccggggaaactgtccagggaggcatcctctgcgatgaaggcggggcctcggcgtggcccgttccgcgctctgtccagccctggagaagccccaccctcaccgagctcgaaataccccctccctgagagccgagactcatggccgggaccccttggacagaagatgcggatgctaacccggcgcttccaccacagccccggcggcactggggagcgagcgcggccatcccgcgcgtaggtggtgtttctctgcaggcgccagtttcaccgcgggcgcccaggatcctcaacggttctgttgtgatgtgattcccctcttcgacttcgtcattcagcctcagtccctcagtccccaaataccgaaaggcagtcttttttttttttttttgagacggagtttcactcttgttgcccaggctggagtgcaatggtgcgatctcggttcactgcaacctccgtctccctggctcaagcgattctcccggctcagcctcccgagtagctgggattacaggcacctgccaccacgcccggctaattttttgtatttttagtagagacggggtttcaccatgttggccaggatggtctggaactcctgatctcaggtgatccacccgcctctgcctcccaaagtgctgggattacaggcgtgagccaccgcgcccggcctttttttcttttttcttttgaagttaatgaacttgaattttattttatttacagaatagcccccatgagatacttgaagacccggtgccaagcgacagtgttgaccccaggtggtcagtcctgcctggccccttccgagggatgcgccttcaccataaccatgtcacggacaggcgtgtgggcaagggggcatcgctgtatttttcacaactctttccactgaacacgacaatgacatttttcaccacccgtatgcatcaaccaaatgaaaagatgagcctgtgacattcccgtgcgtagagttacagcttttcttttcaaaacgaaccttcagtttggagccgaagcggaagcacgtggcgtctgacgtctccagggagacccgccgccctcgctgccgcctcaccgcgcttctgttttgcaggtaatcttcagcaagtactgcaactccagcgacatcatggacctgttctgcatcgccaccggcctgcctcggtgagtgcgcgctgcgggctctgcccggtgacgccacgcggcctcctcgccttttcgggatggctgggaggggcgggaagaggcgctgaagggcccgaggcaccggccttctacaaggggctcttcgaaatcaatcaatgcgcagaatcccgagggaggctcagccgccctccgggcctctctgcctccacaggtgatggctgtgtccacaaggaggaaaccgtcgggctgaattaaacagaaccgccctcctaagagtgtgggtttttctgccgggcgtggtgtctcacacctgtaatcccaacactttgagaggccgaggtgggcagatcacctgaggtcaggagttcgagaccagcctggccaacatggtgaaatcttgtctctactaaaaatacaaaaattagccgggcgtggtggcgagcacctgtcatcccagctgcttgggaggctgaggcaggagaatggcttgaaccctggaggcagaggttgtagtgagctgagatcatgccattgcactccagcctgggcaacagagcgagactccgcctcaaaataaataaataaataaaaaagagtgtgggttttttcctctcacttcttcattcacttttggagaaagcggggtggttgtgtgtgtttggtccccagccccacatcaccccataggtgccttttctacccagggggcttgacccagatcaacactgggtgaaaggctgacttcagaaatgggttgaaaagaccagtgatctgccttatcgagtcctcagagtcccacaggagttaatgtcctaaatcaacagtgtgttcgagccagtgaattttctaattatcagcaaactttccaaatgtaaagggtgagcaggagtagctttggctcaaggattaactttaaagttaggacggaggtggagaagggcaattgaagtttctcacagacaggtgagaaaagggagatgaaagtacacgtctgaaagtgcagcaaatggcagttttagccgcaaaaatagcccatggtctggggcatctttgggcaccatatatgaagcaatgtgccaataaataaatatatatacacagtattccgtatagcagccctgggatttgagtatcacctctatttcacagattttaacaatttacaactgaagatcagagattaacttggtcgaggtaacacatcttgcaagaggccccaaaacatgtgaggttggaggaagactcatcctaagcatttaaaactattttgtaggagagacttgcgcagttcagacggactcccaaaggcactggaagcggaaagacaaactatgagttcgtcatctgctgatataaatgttagttcctattttaccacagttttttaaaaaaaatctcccaactcaataaagtagacttgctccaattcccattttaaagtatttcagcatctacacgcacttaggattatacgcagctgtttaatttcatttacaatcggagtctcaatgccctggggacggcctcccacccttcccatcccaccacaccttggtcaggctggtcctgggactgtcctggttgtctcagggctctggccccatgtgtacattcaagtgtacatcccagagcacactatgggcgaaaacacgggcttgggtgtgttttccaggaacacgaccatctccctgctgaccaccgacgacgccatggtctccatcgaccccaccatgcccgcgaattcagaacggtaagaggctccggccgcgctcctcggggtgtgcctggcacttctctccatgacatgggaggctttctgtgattttgtaaatgtgctactgcagaaaggtgtgaattgacagcagagatggagagcgagggtaggagccagtgtgaaggaagcttgactcgtcgtgttcccctgcagaggagctgggcacgttccaagataacaattgcagccgtggctctgcacctgcttctcaacgggaggaggcattgtacagaggggaaactgaggcccaggagggtgagccaagagctgcagagccaggccccgggatccccacattaaccccaggaaggacctcgggagattccctacagagcccctggggacatttcgtgtttacccacttagggccggtctctgtgttcataaagtgatgcctgtgggagattctaagcacagaagggccagggacaagggaggcccaggaagtcaagaggagaggccggtgaaagcctccgtgaatgtctgtgaactaggtcaagccagcggtgtatggcccaggaaggacgcggagcaggggccctcaggtcagtgacctgcccctgttcctggtgacctggggagaccccagcagcctccactgctctttgtggttgggcaaagtggaacttagatttcctcatgaggcgagggagcaggtgagctgggggcggggcgtgcgacctcaggacccctctctggcgtcctctgttcctcccagagtggggctcactgtgcctccaagggactcagtagatgcgatggtacacttgtcaatctggtcatcagggtgtcctgcccaactgacccatggccagctctgagcccacaggagaaagtgcatgtcaggcagacccttgtgtcagtgaggtcccagtgggcgtggccagcaccgtccccctcagtgaggccccccagtggacgtggccagtgctgcctccctcagtgaggtctcagtggacatggccagagccgtccccctcagtgagcgctcagtagacatggccagtgccgtcctcagcgaggtccccgtgggtgtggccagcgccatccccctcagcgaggtcctcgtgggtgtggccagcaccatcccactcagcgaggtcccagtggacatggccagcgccgcccccctcagtgaggcttcagtgggcatggccagtgccgtccccctcagcgaggtcccagtggacgtgtccagagctgtcctggtcagccgtcctccctgtcaccttgaggcctcagccgagctcctctcatctggctgtgcccgtcagtctcccctcctgccctagccaggatgcccgtctcctgccccacacagtctggctctgactcttggcttccagactccccggaaggtgcagtgctaattggctccccagagactccagtaagcatcttgtcagcctcagcaccagctccagcctggggggtctcgctcagaagcaaagtcactgagtgacctgtcctcctgacacccacaagactaaaatgatctctcagaggggacctcacagaaaccagcaccttgtccatgccagctgggtatctgagagaaactgctttgttttcctgaagtcatttgaaacagcgtgcagagacatttaaactcggcgggaaataggagaagcccaccttgacccttctaattctctggccccaggtgccttattaacaagagacagtatcagacacaccagacaaaagccctcctgagcccaaagagcccaaatgtctggaagctctctgctgagatgccaaaatgcatgcctttctgataaagagacagagacagatgaggtaccatgatatggacatggcagtggacgtggacaggggagcagtggagatggagaagatggagacacacgcagttgaggatacaggcgaagaagatggagacacacgcggatgaggatacaggcgaagaagatggagacacacgcggatgaggatacaggtgaagaagatggagacacacgcggatgaggatacaggtgaagaaggtggagacagacgcggatgaggatacagatggagaagatggaggtagacgcgggtgaggatacaggtggagaagatggaggtagacgcgggtgaggatacaggtggagaagatggaggtagacgcggatgaggatacaggtggagaagatggaggtagacgcggatgaggacacaggtggagaagatggaggtagacgcggatgaggatacaggtggagaagatggggttagacgcggatgaggacacaggtggagaagaggaagttagacgcggatgaggatatagatagatgcatagggtgtggatctaaccgggtacaggtgatgcggaaacggatctagacagcgatgtggaaatggatctagacagcgatgtggatgtgatctagataatgtggctctggacgtagaaagagcttcagatgctctatctatgatcgtgggtgtggatataggcatagacatggtgaagaggagagaatagactctcctctctcatgacaaactgatcgtggctgggggcggcacgtgctgagatgtggctgtatttgtcccccaggctggtgcctgcgcctcctgcacccccgtctcctttgtgccttcttccattccctctgccactgttaggtccaggcctcactgagctctgacctccctgcctccagcctgcctctcccacacggctgccaggttcaacctggtaagacaccttcttctccatggtggcctcccaatctgggccctgccaacttatgcctcaccaacttctccaacttacccctgtacccacgcccgcaccatgcccagcccacaggatcctgccttcccagctctgcagaaccagcttctgcttatccgctaggtgccagcccagccacctgccttaagcaccatccacagtcacccagcccatcaccatcactagcaaagtcacccagacccatcaccatcaccatccagagtcacccagcccttcactatcaccatccaaagtcaccagccccatcaccatcactatccagagtcaccagccccatcaccatcaccattcaaagtcacccaccccgataccatcaccatccaaagtcacccagacctatcaccatcatcatccagagtcaccagccccttcaccatcaccatccaaagtcaccagcccctttaccatcaccatccagagtcacccagtcccatcgccatcaccatccagattcacccagacccatcaccatctccatctaaagtcacccagacccatcaccatcactatccaaagtcacgcatcctgtcactatcaccatccaaagtcaccaagccccttcaccatcaccatccaaagtcacccagtcctatcaccatcaccatcctaagttaccagcctttcaccatcaccatcaaagtcaccagccccatcatcgtcaccatcctatccaaagtcatccagtaccaccaccatccaaaatcacccagacacatcaccatcaccatccaaagccacctagcccatcaccatcactatccaaagtcatctagcaccatcaccatccaaagtcacccagacacatcaccatcaccatccaaagttaccagccccatcaccatcatcatccagagtcacccagatccatcaccatcaccatccaaagtcactcagcccatcaccatcactatccaaagtcaccagcctcttcaccatcactatcaccaggcccttcaccatcatccgaagtcacccagacccatgaccatcaccatccaaagtcttccagacccatcatcatcaccatttgaggtcacccagacccatcaccatcaccatccaaagtcacccagcccatcaccatcactatccaaagtgaccagcccctttaccatcactatccaaagtcacccagacccatcaccatcaccacccaaagtcacccagccccttcaccatctccatccaaagtcacccaacctgtcaccatcagcacatcactggcttcctcccctcagtgtgcgcctcagtctgaagtgatctcacttacttgtttgaggttctcactgctgctggccccgctggacggtcttctctcataggaaggaaatttcaccttgctctctgctggatttccagcccctaaacgaggcggggcatgctgggtgcaggatggaatgagttggggacggagtgaaccagtccagctcgtgcgtgcctccccctctgcactgcccagagcagttttttcttctggggacgcagggcaacgtctggagacatttctggatgtcaccaggggtaagggcctgctacttgtatctgatgggtggagacccgggatgccaatggcatcctacagcgcacaggacaggcccacaacaatgacacacgtggccggagacatcagcggtgctgaggcggagcacctggtgtctgaggtctcccctgtgctctgtcgctgtcctctcaccctcccccaatcttccaacctagtagttctcagacaactgcgtcagaatccgcagggggcttggtggagcacagagctcccctcagtctctggtttgtgacggaggtgggccccgagaatctttctgcagcagaaagccaggctttctgcaggttcccagtgaggaggacgaggctggcccgggacacgccactgatgctcttctgacccaggggcttttctctcccgcttccgtccctcttccctcgccggcaggtgacgttactggccttttcttttttggccctgcctcccccttggcttctcccctcttcctctcctccactcggtgcctggtgacatgcggccatcctcagagatgtgcttcggggcccgcacgccttgctcctcgcactcttcctgcaccggagccgcggtgcgaggcctcgggaatgctcaccgtttctctcccgccccccggccgcatgctgcagccattccctcaccacatgtccaggagggagccggcatcctttgctgactttcttgctgtgactatggtgctgcgtggaaaaggggccgtgggaaggctgggcaggtggctgctcagagccccacctgacacggtgacccacggggcctggaaattcactgccccgatttccacacaggtgcctgagctcctgcagagaatgcctgagagcgagacgcatgcccgtcaatttgtgctttcaggcgtcctaagcacacacgcctgctcttatttgaaccactccctgtaagctagttccactaaagagtggctttccaccctggctgcagattgcaaccacccaggaatctttttttttttttttttgagacggagtctggctctgtcgcccaggctggagtgcagtggcgcgatctcggctcactgcaagctctgccttccgggttcacgccattctcctgcctcagcctcccgagtagctgggactacaggcgcccgccaccacgcccagctaattttttgtgtttttagtagagacgggatgttagccaggatgatcacgatctcctgacctcgtgatccacctgcctcggccccccagagtgctgcgattacaggcgtgagccaccgcgtcctactttttttttttttttttttttgagacagagtttcactcttattgcccaggctgcagtgcaatggtgtgatctcagctcactgcaacctctgcctcccaggttccagggattctcctgcctcagcctcccaagtagctgggatcacaggcatgcacgaccacacctggctaattttgtatttttagtaaagatggggtttctccatgttggtcaggctggtctcaaactcctgacctcaggtgatccgcccacctcagcctcccaaagtgctgagattacaggcgtgagccaccatgcccagcccacccaggaatcttttaaaaggtaccagttgatgcccagacccctcaattaagtccagatttttaagagattttttttttttaaagctctgcaagtgattccagcacacagtctggggactaaccgctgatataaggtctggaaaatctaagaaaccactctaccccaccctctggtgaccagaagcttatgtctaccagacccagggccttcccttgctgaaacatgctgggtaaactctttgtttcttcctagcagacagcagccctctccctctagctcagaagctacgtcagcagttggttggttggttggttggtgggttggttgggttgtgtctctctttaacttcctccacttctgaagtcacctgcagtgacttggtgtggacttggtcacctcactgtccccccagcctcaggcccaggaaccatgtctttggaggaggctctcctgctggcagctggttgcatctggcatgcttggattcctgcaggtggctggttgcacctagcttgcttggattcttcccagattcacagccatagggtgggcgtttcatgaaatctccaaattccaagggctcttgacagaccacctccatcctgatcagaaggggtgatgccggttgcacggtctcttagagcttaaaactctagcttcttctctgctcctcattccaaactaaacaaattgttgcattggattattctttcaaaatactccttgccttaatgccatcctttagattttggtggctggctcctgttgtggaccgcatctcacaggtggacttcctggtttctgcctcctgttacccctcacagttatctctcccttgagtcctgctaccttccagaaaaataggctccaaacacactttcatcccatcactcccagcatggagttctccagtggcctgttggctacaggacactctccagccccccgcattgggatgtctggccccaatccaccataatgtacttgtctccaatctgctgagctgcatgaatgcccaccccagcccagcgggcactccccttctgcaaacctccaagcacattccccctctgcacactgccaatcttcctgtccccgccccaaatccaaaggcccctcctatggctggggatccactggcagctgcctaacccttcctatgctcctggacgtttggtgcaatctggagcacgctcaagccggcatttgaaataacctggaacacgtttacatcatggaaaatatggaaaataggctgattggcttccactcccttttagagctggcaagaaaaataattgatgactaaacaacctaacgaccaacaaatataaaaagtcatagcccaaccatgatcaaataaggctccagcattcctccttggagggactctgagccatctggtgtcattttcctttccaatccgggaacattctggagatcctgacatccagctaacatgggcgttgcttcctgacaaccctaccccttccattccccagtcactactgcttcaagatgcagtggaaggagataaatcagacacctcagtagcgtgagtgaaagtggggtgtgtggtgagacacatacagaggggagagggccagaggacggcgccgtgcgacacacaccattgctccttttgttcccggtttcggccaagttgtgccgcaggtgactctccaccggctgagctctgtgcatgcagggccagtattctcggccattctggcttagagaaaagctttctatattccagaatggctccaggcctcctcctcctcctattaaatgtgttttaaaagaggtcttagagcccaggcagttagatcttagaaaaagacaaatacagtagaagctggaggcaagcttatcctttccaaagagggagtgcttcctgtgttaatttgttattgagcatgatgaagattcagctccattgagactgagccaagagttgactcattcatgggagcaacataacgggttgtgagaagccaaaggattaagcatctgggagccaagactgatcttgagtggcccagaaatgcaacccaaggatcttgggcccaagggccaggaaggtttctgcagcctcctggagcattcacagaggctccctgtccgtccacttttccctctgttgctgatgtgatggctcctgccctcagcttaccagactcctcggagaggctggcctctgaattggttgaatgggcttgaagggggctggactccatttgggtggatgagcaggcccagtgcccctgtatgaggggaagttgtcttggtaagcctgtttttgtgtcaggtccccaggacaccttcctctgagtctcttgcgtgggagaagttgctggacacgcctctctggctctgtccccgccggcactgtgtgggatccatgctgttctccctccagcccttgccccacctcctggagcccttctctgcgcctggtcactacccgccccccacctccagcattaattttctagggacaaggggcaggggaaggaggagaagaaagagtccttgctgctcctcagagaagacacaggagaagaaagtcggagaggagtggggagccagggtggcaaagccccttcctgctgcccacgcaggtcctggctttctctccacccactgcaccatttccagggctgctctcatggtgggagccggagagacactgagaagaggaaggaaggaggatccaagaggagcccagcacacccggcttctctgctgcccaccctccactctgtcctcccagcccaggcccttcctaggcaaccctggcacgggtcctcactggccacactgaggccatcagcaaagcacctggcctcttcacgccttgggctctgggtctgtaaggcagtgaggctgaggttcctgggacagctgggcactgtggacttgcccagctgagcacaggcatcaggggctagaggggccctagtcccgatgacgaccgagtgccctctccacctggggagcttggaggactttgctctgcacttagggccacgcttcaagcccagtgcctcttatgaccaagtctctggggagaaatgagccctccagtgccaaatgacccaccactaaaaggccttttgaggcagggcctctcctgagcccacgcaggcacgtggtgggagatgagagggtgtgggctcacttcttgacattctgtgtgagtgaggtcattcatagggtgaggggagaatcaaggggacagagggccctctagtccccagcacttgggctcagctggcaagtccacagtgcccggctctcccgagaacctcagcctcaccgccctacagacaaagggcccaaagtgcagggaggtcagtgccacacaggttttattttttcacattattggtgtttaaaattgtaaagattttccacgttacctgtaaccatcaaaccacatgtattgcccccagttaatcaccatgaacagcttggtgtgtatacccctccatattcactgtgtttcttcttccaggaatgagctcattctctatacatcactccgtaacttgttgtttttacctagtaaggagtcatgggcgtcccaccaggtgaatacttgcatgtttgtcttcatcttcttaacaactacctgacactgcagtgtctcagtctgtctgaacttaaacagctagacattgagttctcagagtctggaggctgaaatccaagatgagggtgtgggcaggttctgttcctggggaggcctctcttcctggcttgcatacagctgccttctggctgtgccctcatgaggcagagcaagagacagctctggtgtctttggcccttgtaaggacaccaaccccatcccatgggccccaccctcaggaactcctccaaacccaatcacctcccaaggccctacctcctaatcttacccactggggatgagggcttcattatatgaatttggggtgggggtgcctcaacattcagaccccagcaccatgggaccactaatgtggcatcctgcctgtggagagatgcacagactgacccatccagacagcacagtggagcacgctctttcaacccacctgcacctgaccacagtgggcactcaggaagaaatgggtagagcgagtgaatgaatgaatgagcaagtcaaagacatgaacacatgacatctgactgtctccctgtgtgcttgtgtttcattctgatacatccctccctaaattcatctgctgagacaaaggattttaactggtgtttctacactgctttccccaagatgtggcaacccacaccccaccagcaacacctgtgatgtctgccgccctgtgtccttgtagcacctctcttaccaggtttccaaatgttgctaaactgctgggtcaaggaatagcatctgcctggggttagcctcacttgtgtggattttttcttactcctcttggccactgactgctcctggtctatgcctgttccattggctgcactgtccttccctgcctcttggccagaggctgtcgtgtgtcagcgacagaaacgttttggctgtcgtctgcacagccagtattctctccccatcacgctgggcctcgtgatgatggggggaggggggttgacatcacagagatcccagtgcattttcgacttcatcactgtcaccatcctctcttgttcatttgggggatacagccgccatcagctcaacagagcaaaagagagggaggccacctgcatccgccaggtgctgaaatgggtccaggcagctgccagagtctgacatttccaacttgatacagcacctgtgatcggcagtagtacccatgacaacatttatttaattgaccaaacacgaacattatagaggaaggtgatcatttaaatgatatacttgaaattcatctgagtaaggaagctgagaacagtcaaagaagctaatttaaaaaataaaaataaataaaaagaaccacctaatccgctgatttctaatcatgccgagtgcttatctctcctgccaggcatacagcgagcgccttgcagagtctcacagcggcactgtcttctcttttgcagcactccgtacaaagtgagacctgtggccatcaagcaactctccggtaaggccctgctgtcgttttttaaactaaaagaaggaaaaagaaatcttgagcttgcccctgtgataaaatatatactagttaagcatttgaatctaagcatttgaaatatatatgagttacctttgaagcatttaactatatgttagttaagcatttgaatctgcatttgaagccgatacaactgcagaatctgaaaccttgtactactgtaagggctctgcctttctaaccccagggagaatagcatctgcctggggttagcctcccttgtgtggattttttcttactccttttggccactgcctgttcctggtctatggccgttccattggctgcactgtctgtccctgcccctcggccagaggccatcccaaggactttgcagttgcagggcggcatccactctggtcttcctggcccagcacctgtcctccccgctccactgtgagttgccaaggcaggcatttgtggcccctgggatgccttggggtgcctcatacagttacttgggccgctgtgttacaatcctttttctttttctttttttttttttaaaaaaaaacggagtctggtcctgtcacccagggctggaatgcagtggcacgatctcggctcactgcaacctctgcctcccaagttcaagtgattctcctgcctcaccctcccaggtagctgggattacaggcgtgcaccaccaagcctgggtaattttttttgtatttttggtagagacgggattttgccatgttagccaggctggtctcgaactcctgacctcaggtgatccacctgtcttagcctcccaaagtgctaggattacaggcgtgagccacagcacccagcctagaatgccttttccatttgatttttatcacttttatttatgtgtgatttatacatcataaaatgccatttaagtgcctattttgatgacttttgaaaaatgtgtacacccttgtaaccatcaccaaaatcaagacatttgcaccacctagaaaagctctctcttgccccctccagtgtgtctcagtccacaacggacctgctttctgacatcatccatgagatttctttttgagagtttcatatataagaaattacatggtatatgtactctttttgactcaacataatgtttttgagatccatccatgtgctgtgtgtagagacagttcatgctttgtattgctaagtggtatcccatggtgtaggttgtaccacagggcgtcttccattcactgtggatggacatttgggttgttaccagtctgggggcttttaagaataaggctgctgtgagcattaaagtacaagtattggtggaaacgtatatttttatatatttcatttcacttggctaaatacctatgatacctataaccttgccaacttttttatacagttaaacatatacttaaccgtcttccctaagagtggatataagagtctgtagagtgttccccagtctgggtttgtctgacgtttctctcacgaccagcctgggtgtggtgggttttggaaggaatacgtggggcgcatgacagccaggtaggaccacgagcttctccactgcagagttactgttgatctccttccctgctcttctttgaaagcaagtcacgaagtccagcccacccaaacacaggagagaaaaaccgaggttcgttttctctacacagatattcatttctccagcaccatttgttgaaaagatgatcttttctcccactgaattaccatgacacctttgtggaaaatcgatgggccatgtatgtgtgagtctttttctggactccagatcctgtcgtgtgaatttacatgtcttaaaacaacagcacaccatcttgactaccgtagataaatagtaggtcttgaaatcaggtactctaagttatctctggtttcttttttctttttcaaaaatgttattgcttttattttcaaataaattttagaatcagtctatgaattgcttccaaaaaaacagtctgctaggattttgactgaagttgcattaaatatacagaccaatgtgggaagaattaatatcttaagaatgttgagtcttctggttcataaatatggtctatctccccattcatttgggtttcctttaatgtttctcaataatgtgttaccattgttaatatgaagtacttaataaatactgataaatacatcactatttcatgtatttaatggtactgcaaatggacttttttttcatttcaatttccggtagtttttagtttataggaattggcttctgtatgggaccttgctaaactcatttattaggtctagtacctttttgcagatttcctgtgattctatagatgattttcttatagtgctggtcttctgacaacaaattccttctgcttttgtctgaaaaagcttttctttgctgttttgcttttttttttttcaaagagagagagagataaagtctttgtctgttgcccaggctggagtgcagtgatgcggtcatagctcacgacagccttgacctcctaggctgaagcaatcctccctcctcagcctcccaagtagctgggactataggcacacaccaccatgcccggcgaattttttaagtttttatagggacaaggtcttacagtattgcccaggctggtctcaaactcctaaactcaagtaatcctccctccctgagattacagacgtgagccaccatgcccgactgacagtgtttttatttcatcttcattttgaaagggtattttcttgccatagagaattttagtttcacagttttccagcactgtgaatatgtcttctcattgtgttttagctagtacagcttctaatgagaagtctgtgatgtcttatctttgttcctctgtgtgcaatgtgtctttttccctctggcaacttaagatgttttctttatcactggtttgcaggaatttgattatgatggccttggtgtggttttcttttggtttaacctgcttggtgttcattgatcttcttggaactttgggatcatatttttcatgaaatttggaattttttctgctctcctctgtctctctcctttcccctgggaccctaactacctgaatgatagacagcctgagagcgtcccctgactcactcacactgtttctttctttccagacctttttttctgtttgctttatttttcttagacttttccgtgacgtcttccattgcactggtcttccctcctgcagtatctagtctgctgttaatctcgttcagtgaaattttcatttcagatattgcattcttcatccctaggaattatgtttccctcctttttcgtatctcccatttttacatctcccatttatgcctcattatgtttatatttcctgtaaatgcttatacctcattataattctgtttcatgccattgtctgctggtttcctcctctctgccatatccgagtctgtctctgttgattgatttatctcctgggtatgggtcatatttttctgattctcgtgaatctagtagatcttgatggaatgctgatcacaggaatgcacgctggttcatcatctggttttgtttctcccagttaagagtgttgggctttgccttggcaagcagttaagttacttgcacatcagtttgatgcctttgagccccacctttaagctttgtgagaatggctctagagggcccttaccccagggatagctcagtcctactaagacttgatccctttggggtctcccccaaactcctggctgatcaccaaattccactctggctgtttagagtgcaaatgtttggagatgagaatgaaagcgccagggccttgaaggtcgttgcaaggatgctggcttttatgctgagtggcgtgggcagctattagaaggctttcaggagaggagtgacatcatcacatttgtgttttaaatcttgctcagggcgctgggtcgagatcacgaaagggaagtggcagcaaaggtggaggcagagaaatccaagaggaagctatttttttgggaggaggcggaggcctaggccggggtgggggccatggaggtgatgaggagcgcaggttccagcaggttctaaaggaagagacaagctttttcctaagtggaagcgggatatagagacccatccggggcttctttgacctgagcactgagcgccacggcccagggagggggttgctgcgggtgggcttggtctgctcatcagacatcaggtgcatgaggagcaggcagagtcagggcaggcggcctctcggctgtcggctcccaatggatggtgttgaagtctgggacttggtgaggccagcagggagtgagtgagcaccagcaggaggggccaggcctgagccggacggagaccgaacccatccgtgggagaaggacgctggtgacaggacaccatcgggagcagaggggaagccataaagccctggaggcaggaagaggcaaaggctggccgggtgtgggtgaggtgctgcagggctctcgcaggccagcgaagacaggcgagatggctgtgctcagagttagaagagcatcgctgggagcagaggaaagagggatttctgtgtcacctggggacccatccaggaccagtgggagatggagttgggctcattgagggaaagaggtgaatggaaggaagttggaaccagctgtcctaaggccggagctgctcctccctggaggactccggcaaaggctgctggccttgggctgtgcgggcacccagtggctgagagatcgttgccctctgcagccctcctgcaacttggatcctaggagccacaaagaggcttgaaaaataatccatcctgagaaacacaaaggctcacattaaacttcgcatcgtaaagttttgagtaaaagaacaataaggggcatttctgctaaaggtgccaggatgagaaaaagcaggaaacagtgctgcaccgccaggctctgcaccgtctctacagagggctggggttggttcaggagcattcggcccaggctgtgatctcgagaaggtggtcagggcccaggctcccgccagccctcacggcagcacgaggctggtacgagacaggtgcttcaggtgtttgttgagagctgcacacacttctgctgggctgggcaagacttccctcttcagagaggatgagcggccacacggaaggccaggctgggtgtccctccgggccagccgaggagcgctgcgcttattccgcagtgaggagtcgctggctgtccaggggagctgcattttcctagcagcgacaacccctcccacatctccatagtcacatcctggctgggctaacaccacctttccccgcctctgggtgcgtggggaccccgctctccaaataggccagtgttccaggcttttctttaggagacaaagtcggtgtcaggtagaccccccccaccccaccaaacacacacacacacacacacacacacacacacacacagctttcctgagaaatgtgtttacagaacattttttccatttggggtttgtccttaggaattcttcactctctctatggcaacaaccttccctctcccgtccatcggccttgggtcccagagccactgagccgtggcccaaggtcaggagttagctctagcgacgccgccctgagttctggcctgtaagcaaccccaggtgcccttgtgaatcaacagaccacatttccagtggcagaaaaggaaatgggagctgtttctagactagcacaaggctcagggggtggggggtgggggcagggtgcagggaggccaacgccacacagccccacacccagcctttcccaaggccctgggttcctcactgattctcagcaggtttcagtaaatgcctctaacgggcccggtggaactgtgcaatgcagaaacaccccagggttttgctgttttgctacttaaatattcaggaaatagtaaagagaagagtattatcaaaaacgtgacttttcatagaaaagggagaataggccagccctggcctgggtccacaaccccagtgtgagctgcagagacttctctggagcggtgaacagctcctgccaggaaagagcatggcacagcctcgttctccagcgtagagtagaaggaatggccccgtccacgcgaaggtctgtgttcaccaagcatcttctgtagaaaaatgctctcttcgcctgatcatgggagggaatcaaatggatagagcatttatcccttttgtgactaaaataaaggtaatagcaactacaaaaaccacgacacaggcttctcagcatctttttataacgatagtgctgattttttggaaaatccttgagcctcaatcacttttatttgatgtaagccgctcaaactcaaagagtgttgttttccagattataaaacacagatctcagctgatggcggttgacgggtgtcccccgagtgccctcggctgccaggagctggcaggggagatgcctgtgatgaggattgggtgctgtgatcacagcacgcgggaaaaggacagggcctccctcagcgtggcagatcgcgtgggtccatgggtccgtgtgatctcatgaccgtatcaaggggattgtgtctttttgaccagagcgttagggaaagcgtgctgcagtcacacgccaggacggccccccacggcccaagtcctataggagagccaggggccatcacgattttcttaggcacagcagcagttgaaccgtgctgtcacacttaacccaagtgatgacagcctcttcaactaggacagtgctgtaggggtctggttctgcttgttctcccccacattcctgcctgccctaggacccaggacctgtctctagtcacacacaccctgttcagcctctgcatctggcccccgcggagacccacaccacattctactcccctggccagagaccgagggtgactcggaggcttccagttcccagcagctttattggcgttgctgtttccatagaaggacaataaaagggggccataaggaggcgcatccgcagagtgcgtgcttgagcttctgcaagccagaggaggccggcggccggcagggtgggcaggctggctggctgtgccccacaacatgcatgtggagaggttttgggggcagccatggaaccccggagctgcccccacatgagagttcccccaggtggtgaccaaatgcatttacagtccagccgcagtccagatgcagatgcgctgtaactgtagaacacacagcaaattctgaaggcttagtatgaaaaagaatataaaaatctcagtcatttttatattgatttcatgtttcctggttgagatgtcattgatataacataaagcccaccattttaaagtgtacaacctcagccaggcatggtggctcacgcctgtaatcccagcactctgggaggctgaggcgggcagatcacctgaggtcaggagtttgagaccagactggccaacatggtgaaaccctgtctctactaaaaatacaaaaattagccgggtgtggtggtgcacatctgtaatcctagctacttggaaggctgaggcaggagaatcgcttgaacctgggggtagaggttgcagcaagccgagatcacaccactgcactctagcctgggtgacacagtgagactctatctcaaaaaaaaaaaaattgtacaacctcagtcttttttagtgtcttcattttgttgtgcaaccatcaccactatttaattccagaacatttccatcaacccaaaaagaatccctgtacctgtgagcagtcccccctccatccccttcaccccccagcccctggcaggccctgttctctgtcctgtgcattctgacctttcacataacagaatccgtggcctttccagcctggcttcttccactttgcacacggtgttgcaggctccccgcgttgtggcatatgacagctctttgttcctttatggctggatgacgttccgttgcgtggctgcgtcctgtggctgcattgtgtggctgtgtcacgtggctacgtcacgtttggttgatccgttcatcagctgatggacatttgggctgtttccacaaaggctcttgtgaatgatgctgctgcaaacgtttgtgtgcaaatttttgtatgaaagatacatggtgaaatgaggtattttgaggtacattggattaaatgagatattaaaaatttttttaaagtctagccgtcttgaaggggagggcctgagagaagtgctgaaagttcacagcagaggataccggatgctgcgggtgtgccaggctggcctgtccaggaggtccctgcagcctgggtgggaggtcccttacccactaatgggtgcctcctccaacccctgagtccccctacctgaggacttcctctgtgtgtggcatacgcggctgccccgaggtcagtcctccccagtgaaagggagctgaaggacaggtgcccagcttctttgctccacagtgggaccaatctctgacatcatcaatgcagttgctcaaagggagctcagagcgaggagtcacctgtacatcaactcaccctctgggagctctcttcccttccatgcctcaatcccccactccctcccagggcttcctgggctggcctccaaatgcaccactagcccccagctccttgtctccggtgggcttttgaggatttccaactaagaaccttagactccaagacaggtcaagccccctggcatactcatttgtcatttggatgaaatagccttaggagagctacttaaccccactgaacttccatttccctgacaaaataggaattctaatgcataccttgcatggttcttggaggataaatgaagtaatttatgcaaaatgctgagcacagtgcctgccacttggtaagcgcccagtaaatggttgttatcattgaaaatgacttagggggcatttttgaatggctaaagttatgtctctctggaattgctgaattttaatagaacaggaatgcttcctaaggtctaaaacaaaaggcggaggactggctgtgtctgccctggaagccaagttaatgctggatgtctgcgcatagacatgttgctcatgagaaataataatgctccttaataatattgtctatttcagtgcaatttcagtctagaaggctttataagcaaagccacagtcatccttacttgcatttttttgaaacaaaaagactgcagtgtataaatgaaaaataaccatttctggaatggtgtgttcagacggattccccttagagtagcctagccaacaaagacagcagcagcccttagcgtgccactgtcagagatattgatggcaaacagtaatacggaagcctgcggaatggaagtgtcctgacggcagatttgagtaaaatggagatgatgacagctgaacattgctgcacggacctcaagactgcaaacgttaggactgccctccctgctcctaggcatttgtgagaaccaggccaacccatacccacccactgctgtgtcctgcctgactgcactgaaatgcacagatcctgtgggtgcagtttgatgagttttgttttgttttttgttgtttttgtttttgaggagtttcgctcttgttgccgaggctggagtgcagtggcgcgatctcggctcactgcaacttctgcctcctgggttcaagcaattatcctgcctcagcctcccgtgtagctgagattacaggcgcatgccaccatgcccagctaattttttgtatttttagtagagacaaggtttcaccatgttggccaggctgatctcgaactcctgacctcaggtgatccacctgcctcagcctcccaaagtgctgggattacaggcatgagccactgtgcccagccacagtttgatgagttttgatagaagtgcatgtgttagatctttcaggaatcaccacccaaaccagaaataccatttgacccagcaatgacgtttatatatatacccaaaggaatataaatcattctattataaagatatatctacatgtatgttcattgtagcactattcacaatagcaaagagatagtatcaatccaaatgcccatcaatgatagattggataaagaaaatgtggtacatatacaccatggaatactatgcagccataaaaaggaacaagatcatgtcctttgcagtgacatagacagagctggaagccattatcctcagcaaattaatgcaggaacagaaaaccaaacaccacatgttctcacttataagtgggagctggacaatgagaacacatggacacagggaggggaataacacacactggggcctgttgggagggttgggggagggagagcatcaggataaatagctaatgcatgctgggcttaatacctaggtgatgggttgacaggtgcagcaaaccaccatgacacacgtttacctgtgtaacatccctgcatgtcctgcacatgtatcccagaacttaaaattaaattaaattttttaaaagtgcacgtgcatgtaaccgccaccacaatcaagacagaggacatttccatcaccctagaaaaatgtccccgtacccccttcaaggcagtcctcactgtggagtgctctgcctatttttgagtttcacggagttgaaatcatacagcacgagctctttgtgtctggactctttcactcaacatcatttttgtttgtttgtttgtgtgtgtgtgcgtttgttttttgagacagggtctcacgcctgttgcccaggctggggtgtgaggcacaatcatggctcactgcagcctcgacctcctgggctcaggtgatcctcccacctcagcctccgagtagagacatgttgcccacgctggtgtcgaactcctgggctaaagcaatccgcatcatgatgtttgtaagatccattcgtgcagttatttccttttgcactgctgagcactgcatgcctcgctcattcattcttctgtggagggacatttgggtcatttccagtttagggttcggctactagaattattgtacaagtcttattgtgggcatccttgtccatgatcttgggtccacctaggagttaaatggctggctcatatgctgtgtttgtttaacttaagacttacttgttaagtgtaagaaactgccaagctgggccgggcacagtggctcacgcctgtaatcccagcactttgggaggccgaggcgggcggatcacttgaggtcaggagttcgagaccagcctggccaacatggcaaaaccccatctctacaaaaagtgcaaaaaattagcagggtgtggtggtgtgtgcctgtagtcccagctactcaggaggctgaggcaggagaatctcttgaacctgggaggaggaggttgcagtgagcagaggttgcgccactgcactccagtctgggcgacagagcgagactccatctcaaaaaaaaaaaaaaaagaaagaaaaaaagaaactgccaagctgttctaccaagaggttgtaccattccacattcccaccagcagcatctgagtgatccagctgttccacatccctgcaacactaagcattctctgcttacattttagacattcgagtaggtgtaagagcaatcctatcttcttatagttttaatttgcatttccaagtaacttaatgatgttgaacatgttgctatgtcttattgactatttgaatgtcatattttgtgtagtgtctgttcaacaatactttgctcaggccaggtccggtggctcacgcctgtaatcctagctctttggaaggccaaggtgggtggattacctgcggtcaagagttcgagaccagcctgaccaacatggtgaaacctcctctctactaaaaatacaaaaattagctgggtgtggtggcaggtgcctgtaatcccaggtactcgagaggctgaggcaggagaatcgcttgaacccaggaggtggatgttgcagtaagctgagatcgcgccttgcactccagcctgggtgacagagcaaaagctgcatctcaaaaaaaatatgtaaaaaggattttgctcattttttaagctggcttgtattatttttgtcactggtttgtaggaaactctacataagctaggatataattcatttgtcagatatatgtggcaaacatttttcccaatttgtgatttgcctttttcgttttcttaatgaggtcatttgatgagcagaggtttttaatttggtgaattccatccaatgtaacaagtttttctgttgtggtcagtacttcttgtgtcttctctaataagttttgtttttttttttttttgagacaaggtttcttgttgcccaggctggggtgcagctgtgcgataagctcactgcaacctccgcctcccgggttcaagtgattctcctgcctcaggctcccgagtaactaggattacaggcgtttgccaccacgcctggctaatttttttgtatttttagtagagatggggtttcaccatgttggccaggctggtcttgaactcctgacctcatgatccacccacctcggcctcccaaagtgctgagccaccgcaccaggccccccaaattgctaggattacaggagtgagccaccatgcctggccctaataattttttttatcccaaggtcatggagatacattttagaagatttagagttatagctgttatgttttttcttaatttaaagaaaatttttaacaacccaatctgttgagatgttatgttttaatctgtcattcatttcaagttaatgttgtgtgtgttgtgaagtagagactgccattcattttcttccccacgctgacacccagctgttactgcaccacttgttaaaaagactccttttcccgctgaatccatggctcctttgttgaaagttaatggtatctctgtgtttgggcctctcgctgaactctgttctgcttcattgatctatttgtctatcctcacaccaacaccacactggctacgttactgtgccctggaatcaggtactctaagttctccatgtgttcttcctctgcatttgttttgactgtataggttcttttcttttccctacaaattttaggatcaacttgtcaatttcaaaaaaaaaagccatctatgactttgattactattttatttactatataatttggggagggtagtgtcttaaccatactgagtcttccaacccatgaacatgatacatccctccacttatttaggtctcatttaacttctcaaaaggttatggctttcaagataaaggtccttcatgtcttcggttaactttactccaaagtgttttctgttttctggttttattgtgaataagatttcattaattttccaattgtttgctgctagtttataaaaatataatagatttttggatgttggcgttggatcctgtgaatttgcttaattcattggttagttctagttgttgttttataggttcctataattgtccacagagacaatcatgacatctaagaataatgacagttttaattattgcattccaatttttggcttttatttcttttacttgtcttgttgtactagttgaaactgcaatacagttaaataaaagtgagagcagacgtcctcgccttgttcccaatcttagaggagatgccttcggtctctcaccattacatacgatgttagccacagatttttttgtggatgcctttcataaggttggaagtccccgtctaatgttagttttctgagagttttttgtctcatgttctttgacaaaattctttgttaacttttatcaaatgttctctctacagctactgaggtgggttgaggaggtgtcctctttttccttgttttctaatggttttgtcccataaagaggtattggattttgttccagtacctttctgcatctatgggatgagcatacatatggtttttctgctttattctattaagataatgaataatactgattgattttcaaatgttaaaaccactttgctttcctagggtaaatgcacttatatttccaggaaatgttcctaggaaatttcctggggtaaactcacttgtatttccaggaaatatttccaggaaaatacttgggaataaatgtaacaaagtatatgtaggccctctccctggtgtgtttgctttttatgtattgacttgtttttgtttttgtttttgttttgagacagtgtcgctctgtcacccaggctggagtgcagtgctgccatctcggctcactgcaacctccgcctccaggcttcaagtgattctcctgcctcagcctcccgggtagctgggattacaggtgtgcaccaccacaccagataatttttgtatttttagtagagacagggtttcaccatgttggtcagggtggtctcgaactcctgacctcaggtgatccacccgcctcagcctcccaaagtgctgggattacaggcgtgagccacagcacctggccgcttttcatgtattgctagatttgatttcctaacaattcgttaagaatgtggctgtctatgcttaaatgggatattgatttgtaattttttttcttgcagtgtctttgtcatgttttgatattggccctatagtggcctcataaaacacattgggaagtttactttcttctgtattttctgaaagattttatgtaattttggtattattttgtcctatgtccctttacacttaatgtatttgggttttttgtgtgtgtctttttaatagttaataacaatgtattttattcttgaaaatcactgagagtacattttgcattctcaccacaaaaaaaaactatgtggcataatgtgtatgttaattcacttgatttagccattctacaatgtatatatttcaaaacatcatcttgaccatgggaaatgtatctaatttttgtcaatttgttaaaactttttttttaattccaatttttttttttttgaggtggagtctcgctttgttgcccaggctggagtgcatgaccatgggaaatgtatctaatttttgtcaatttgttaaaactttttttttcattccaattttttttttttttttttttgagatggagtctcactttgtcgcccaggctggagtgcagtggtgcaatcttggctcactgcaagctccacctcccgggttcacgccattctcctgcctcagcctcccaagtagctgggactacaggcgcccaccaccgtgcctggctaacgtttgtatttttagtagagatggggtttcactgcattagccaggatggtctcgctctcctgacctcatgatccacctgccttgacctcccaaagtgctgggattacaggtgtgagccaccacgcccagccccaacttttattttacgtacagatctaaacgtatcacatgcaggtttgttatgtggtgtgtcgcacccagatggtgagcagagcccccaagtctttgttgatatggttggggttagctctcccagtctttgttcatatggttggggttggctctaccagtctttgttcatatggttggggttagctctaccagtctttattgatatggttgaggttagctctaccagtctttgtcgatatggttggggttagctctaccagtctttgttgatatggttggggttagctctaccagtctttgttgatatggttggggttagctctaccagtctttgttgattagctctcccagtctttgttgatatggttggggttagctctaccagtctttgttcatatggttggggttagctctaccagtctttgttgatatggttgaggttagctctaccagtctttgttgatatggttggggttagctctcccagtctttgttgatatggttggggttagctctaccagtctttgttcatatggttggggttagctctaccagtctttgttgatatggttgaggttagctctaccagtctttgttgatatggttggggttagctctacctgtctttgttcatatggttggggttagctctaccagcctttgttcatatggttggggttagctctaccacgttgctatttgctgtttcttgatcttgggttttgtttttctgttcctccttttctgccttctcctgtgttaattgaataaatttttgttttccattttattccttctgctgactctttagctgtctctttttgcattatttttcctcggctgttgtaagtgttacaatatgcatctttacttttttttttttttttttttacaattgatagactttgttttttagattcacggcaaaattgagtgaaaagtgtggagctcccacatgttccccccacacacagacattcagcctctgccaccgtcaacgtcctgcatcagattgtatattggttacagccgggcgcactggctcacgcctgtaatcacagcactttgagaggccaaggcaggcagatcactggaggtcaggagttcaagaccagactggccaacatggtgaaaccctgtctctactaaaaatataaaaattagccaggcgtcatggcgcacacctgtaatgccaactacttggcaggggaatcgcttgaatccggaaggcggaggttgcagtgagctgagattgcatcactgcactccagcctgggcgacagagagagactctgtctccagacaaaagaaaaaaaaaagactgtacattggttacaatcagtgaaccaacattgacatatccttatcagccaaagtctatattccacctcagaattcactctcagggctgtacattccctgggtttggacaaatatatgatgacctgtgtgtcccatcccagtctcagacagaatcggttctctcagggctgtacattccctgggtttggacaaatatatgatgacctgtgtgtcccatcccagtctcagacagaatcggttcactgccttcaaaaccccctgtgcgccacctattcatccctcccgccccaagccccagatctttttactgtctccatagtttggccttttccagaatgtcacatagttggagtcatacagaataaagcctcttcaggttttctttcacttactaatatgtctttaagattcttttatgccttttcccggcatcttagcattgaagcatattccatggtctgtatgtatcacagtttatttgcccactcacctattgaagagcatcttggttgcttccaggtttgggcagttatgaataaagctgccataaatatttgtgcacaagtttttgtgtgcacataagattttaacacatttggataaataccaagaagcacaattgctggatcttttggtaacagcatgtttagttttgtaagaagctgccaaacggtcttccaaagtgactgggccattttgcattcccagcagcaatgaacgagcattcctgccgctccacatcctccccagcttttgtgtttcagtgtcttggattttcaccactctgataggtgtattgcagtatcttcttcttgttttattttgcaattccctagtgacatatcatgataagcatcttctcatatgcctgcttgccatctgcatgtcttctttgaggtgtctgttcatatcttttggccacttttaatcatcctgaacttttcacaatctatttagaattaatactgtaccgcctcacataaaaaataaggacactgcagctatataagtctacttactcccctctcccaccacctttgagttattgtgtcatatgttttatatctgcatacattttaagccccataatacaatattataatttcctttttttttttttttttttttgagacggagtctcactctcttgcccaggctggagtgcagtagtgagatctcagctcactgcaacctccacctcctaggttcaagcgattctcctgcctcagcctcccgagtagctgggattacagatgtgtgccgccacgcccggctaattttttgtatttttagtagagacggggtttcatcatcttggtcagactggtctcgaactcctgacctcaagtgatccacccgcctcagcctcccaaagtgctgggattataggcgtgattataggccactgtgcctggcctataatttcttatttaaacagctagttgttttctgaagaaattatgaaaataaacttccagatagttttttaatagttgcctatatatttgccatttctgatgtttttatttcttctcaacttccaacttatattatatcccttcactctaaagcatttcttttttcttttaatgtttcttgcagtgcatatctgctagtaactaattctctcagcttttgctgattggaacatgccttttttttttttttttttttttgaaatgatgtcttgctctgtcgcccaggttggagtgtacaatcagttcactgcaacctccgcctcctaggttcaagcaattctcctgcctcagcctcccaagtacctgggattacaggcgcccaccaccatgcccacccaggcactccacccaggaggtggaggttgcagtgaactgagatctcactactgcactccagcctgggcaagagagtgagactccatctcaaaaaaaaaaaaatttttttgtatttttagtagagacgaggtttcaccatgttggccaggttggtctcgaactcctgacctcaggtgatccacccacctcggcctcccaaagtgctgggattacaggcgtgaaccaccgtgcccaggcaaggaacatgcctttattttgccttcattgtgaaggatgagttttcatggtgtggaattctgcattcacagtttgttttcttcaagaagcttaaagatgttgactcactttctttctggcctccattgtttctgatgagaagtcagcttaatttgatcattattcctctgtatgaagtgtgtctttcttctctggctgctttctttggggtttgtttgtttgtttgtttgttttgttttgtttttgagatgaagtttttgctctgttgcccaggctagagtgcagtggtgcgatctcggctcactgcaacctccgcctcctgattctcctgcctcagcctccaagtagctgggattgcaggtgcccgccaccacgcccaactaatttttagtagagacaggatttcaccatgttggccaggctggtctcgaactcttgacctcaggtgatccacccacctcgggctcccaaagtgctaggattacaggcgtgagccactgtgcccaggcctctggctgttttcaagctgttgatttctttcctttatctttaggtttcagcagttggactatgatgtgcttcagtctcattttcttcttatttatccttcttcatgttcattgagcttccatggactatgaatttaccttttcagcaaatttgcaaaattgtcagccattacgtgttatatgtgccattctttctcactaatgacctgtatgttagaaagtttgctgttgtctttcaagtgactgcagctttgcggttttttataatcttttttttctttgcccttcaaattgggtaatttctgttgacctgtccttgatttccctgactcttccactgactccagacttctgtaagttgatccatgaagtttttttttgtttaggatattatattttaaaattctaaaatttgcacttgactcttgttcatagatttgtctctcgagactcccctctgtttacgatttactgacgccgcttttgtttcggtgtttgcacgtacctgcaattgctgcattaaagtctcgtttgctcattttggcatctgagccggcaagcgtccagggtgtctgagggatgattttctcttggccatgggtcacattttcctatttctttgcatgtctattttttattgtagactaagattatgaataacacctaggagagacattggattttgttatcatcctctgaagagtgttaattttgctccagcagtcagttccgttactcactgatcatctgaacttcgtgcagcctggttttatgctttgttggggtagatctctagactgacccttctgtggttttagtaggaagcctgaggtatttatcaagcctctctaactcgactacatttaaactccaaactttgtctcctccacagcaggagctgaaacctctgccacactaggcccacaaacatgcgtcattcagggatccaccaaggaacagggtagtttatacagaatttgggtcccactgccatggcttcctcctttgggaactctcctttccatttccatcctctctgacaacctaaaactgtgtcatctgacgcttcaacctggaactttctgcttaagttttagccatctacattataagggcactttatagcaagaaatagaatattattccattctaggccaagtacagtggctcacacctgacatctcagcactttgggaggccgaggtgggtggatcaactgaggtcaggagtttgaaaccagcctggccaacatggtgaaatcctgtctcttctaaaaaaaattttgaaaaaattagccgggtgtggtggtgcatacctgtaatcccagctactcaggagctgaggcaggagaatcccttgaacctgggagccagaggttgcagtgagccgagatggcgccactgccctccagcctgggtgacagagtgagagtctgtctcaaaaaaaaaaaaaaaaaaaaaagaaatattccttcgttcttttataggagcatagtacttcattttgtagatgtactattgtgtatcctactgatagatacttgtgttgcttccagtcttgtttttacagcgatcagatggttcttcttaatttctcttgctacaaatgttgctgctgtgtacaacctgttaaagtccacagatggaataaaagctttggtttgcaaaaatgactcaatctttacaaacattctgtcatttgtaccataatcaattagtttattggatcaccgaattgcctgacagaatccttcctggaactagtctatggggtcatttggcatagagtcaaagcctcagacacgatgagccagagttgatttcctttggcttcacataattaaactttcccagaggattatcaggttacagtgacacacacacaggctgtcagataatggacaaagtcccagcagcgtgtacaaccagctggtggctcccaaattcaaattcccccagcggcatccgttcggttattcgtacccacaccctcccttagaagtttacccctccgccaggcgcagtgactcacgcctgtaatcccagcactttgggaggccaaggcgggcggatcacctgaggttgggagttcgagaccagcctgaccaacatggagaaaccccgtctctactaaaaatacaaaaattagccgggcatggtcacgcatgcctgtaatcccagctactcgggaggctgaggcaggagaatcgcttgaacctgggaggcggaggttgcggtgagccgagatcatgccattgcactccagcctgggcaacaagagcaaaactccatctcaataaataaataaataagttcaccccactacgggcaagaagccacacagaaagaaaaataaaataggtatctctggggttttctgaagggaaagtaagtgcagctctgtcccgtctttgcagctctaaataggaacatggtggagtagggcaggtcgggcttgacgatgtcatgacttggcctctctcagtgtcacgcagcccctgcaggttataaggaggattgagctggccaggcacagtggctcatacctgtaatcccagcactttgggaggccgaggtgggcggatcacctgaggtcgggagttcgagaccagcctggccaacgtggagaaaccccatgtctactaaaaatacaaaattagcccggcgtggtggtgcatgtctgttaacccagctgctcgggaggctgaggcaggagaattgcttgaacccgggaggcggaggttgcagtgagctgagatttcgccattgcattccagcctgggtaacaagagcgaaactccgtctcaaaaaaaaaaagaaggatagagctaacatgcatgaaccacctagaacagcacccagagcatagtaacagctccttgcagatgttacagtaccttgatctatacaacagtaaagggaaatgcatgctagctgccccagatgctgccagcttcacaggcatttttctgcctgcaaactaatcctaaggaagagaggagggcagggggagaaattgcacccagtcaaatgtaaacgatacaaaatgtgaaattcccctctctgaaaatgaaagggaaaaaactcgattcaatgcctgcccctgaggtgaacctgaaatgacaaggcagacactctctagaacttcacgtttggccaccagggtcttcggttgattttcctttcttcgtcatatctgagtggctgaaacgccagtgatctgggatagtcctttggctgctgatagacttatgcaatcccttggcaggcaggacaggccagaggaagggctcctgtgcctttaaggtcactgttaatcatgtaactttattgtgttcctgggctataaaggaaatgtcgtccttgatctgaatgtctgttttatgatgtccataaacagtgaattgccagtgactgtaccctgagtgagaacatcctcagccagttgaatagttcaagggcagttgcaggggtcaggagagagcaaaagtgggacagaagatgagtttgcttcccaggaagagagacagtgccaccccacccctcgctgacagggaagccttccagcccttcctccaaagagccttggctctcaggggttggaggttggacaagagcagaaataaaggcaccctgctcccaccccccacaatcttccggacgtctagagtgcttatctctttgggggcaagtaatgtgaattattttccctaatgcaaaaataaaaaataagagaccccttttacccttttctgaaaggatagcagaggtatttttcttttcttttttttttttgagatggaatcttgctctgtcaccaggctggagtgcagtggcacaatctcagctcactgcaacctccgactccctggttcaagtgattctcctgcctcagcctcccgagtagctgggattacaggcacgtaccaccatgcccagctaatttttttgtatttttagtagagacggagtttcaccatgttggccaggatggtcttgaacttctgacctcatgatccgcccacctcagcctccagaagtgctgagattacaggcgtgagccaccatgcccgtccagcagaggtattttttctaatacttgagaagtgtctgctaagtatgtattcaccggagggtgctcagcacctcgccctgttgctctgggttgggactaacaaggtgaaacatggctcattgcatcatattaatagcatgcaaatctaagcccagtgatgccgtgcaatggctacgatcaagggcaatagaatggatcgtgcatgagctcccaggccacacacacacgcccttgtgatgtattattccctctactcttgcaggtcggtgcttgggatgctagtgcccaagctgatgttcctaggtcacctccctcaatgcatgggtctaggggccagcatgttctattgctagggccatgtgtgcattcgtttgcctaggggagaaaagtacacattcccatcagctcaggtgcgtggaggacggaagaactgctgttgctgctagtattctcttcagcacaagataaaaaggagataggcaaatcagctggctggccaatcaaattaacttattgttacactaatttttagaatcagaattatgggtcaggctgtgctagcaatcagtgaaatcaaatttcatgtcattctgcactgggtagactcaggatttgcctgaaacaagtaaacaattcctggaagaagtgggcgaggcagaggcttgaactatccactcagaccaaggaggagtcaggcaatggcttctgggcatcgtgtggggtgggggcagcccctgccctggacacccgtgaacacggaggcagccgtgtgaacaccatgaggcagggtgtccatcctgccacccacacagctgcgtcctgcccaggaatgaggctggcagcccataggcccctccttggtccctctagaggtttgcttcattccagtacccttggttctgtcaagtgggcagggcctgggcccctctgctgcaaacccatggcccaaagcggacctgatccggcagcatctaaaaacaggacccggagaatctgctggactccaggattgccctggaacaaacctaaagtctcctatgacatgcaaacaattctgccagccccggccagcattccctgcatgtgcttatcaagtgaggaggccagcaggacttagcacccaggtgagcacacttcattgagtccaggtgtgtgcagatgagaagcagccaggagttgaggctgaagaggagcctacctaaacctgtcattacaactgattgatccttggtgtagtcaaatcttctgcctttatgaaagtcatggtatctagaggtaaatccccatcagcttggagcagcaccatgaaatccactctagcatgcagactcgggggcacttttagatattctattggttgttcttgggggacagcttcctttggagaacatgtgagttgtctgtgaatatcagcttgctctccctaggtttccatcacatggatcagcgagagttaatgctgactccccctccctcgggggcttatttgcaatctcccgatttgctcaaaaacttccaggtccagagggaccctaaagaccctgtcatgtccccctgtgaattaccagcatcccaggccattgctgggttttcttaaaactattaagacactatcaacgtgaaatgacttgaataggctttaatttttaaaattcattatacgtcctgcagcatttaggaaaaagagggaggtgtcacacataatatcaaatttggctgacacaaggtgattttgccacgaaggttgggaaggatgaacatttgcaattgaaaactgtttgttgcccccagaatccagcggtttcaggctctctgaggattccagaggtgctagagggggtaaggccacattcaggtggtgcaggtgggattcaccccttcacagcctggaggtggtgcccggagcgcaccctgtcaccccaaggatgatgacaccccagggaaggtggtggaagcaggaaggggaggtcagaggaaaactggggccctcagtgggcatccgtgatgcggaaacactaataatgccaacagcaatagcagaggcaggcagggcttacgtggccagggctgggctggtgctgtcctgagcacttgacatgcatgaaatcacagttgttttaagttctgaactcccctgggaggaaactgtggccacagcaggaattccaatgattctagggtcaggagaggaggcacccacttcctgatcagggctctgtttgtggatgcgtgggtgtggttggcctttgtgcacactggtggttttgcttctttcccccagcaaaagaatgcagattttgcattatctaaagaggcggttccgtgagcccactgtgctgagtcacatatattccatcggtgtaagtaccaccacctgggcagtgcccctggagtgttctcactgggagcgcagctttgtgtctgtacccttcctgagaatagctgacatgctggcctgggtggcgcattggccgaggtgtggctatgacagaccaggataccagcatctgccccagcactgaactgagcacaccacagaaggtgtggacagagtggcatgaaacatgacagctgcttgtgctcgaaattagatgtagccacacaaatcctgtcgtgctcaaagggttccatctccaaagtccaaaggaaaactcttccttaactgttattccattctgtctatacatttcttattttgaagcaaggataggttcacacgctgctgtaatgatgcatgcagagaaagcccactcatggcccggtttctcccagtggtgacatcttgcaaaactctagcacaatgtcacagcctggcattgaccgtgacacggtccagatccggaacatggcgtcccccacaaggatcccacctgccgctctttaatagccacgctgcttcccttccattccccactggatccctgtcccctggcaaccaagaggtctctctcttttttgtttttgtttttgttttttttttgagacagagtttcgctcttgttgcccaggctggagtgcaatggcacaatctcggctcaccccacaacctccgcctccagggttcaagcgattctcctgcctcagtctcctgagtaggtgtgattacaggcatgcaccatcatgcctggctaattttgtattttcagtacagacggggtttctccatgttggtcaggctggtctcgaactcctgacctctggtgatccacccacctcagcctcccatagtgctgggattacaggcatgatccaccatgcccggcctctggtctctatttgtatgatgttgtcaattctgtaacgttctacacatgtaatcatgcagtaggtgactttgggattggcgccttccacccagcacaaccccctggcatccatccgggttgtcgcctatatccgtggttcattcccttctttctgagtcatactccgcggtatggatggaccacggttggttcaaccattctcccttgaaaggcatctgcatcgtttgcatttgggactactacaaatacatccgccaggaacatgtggacaggcctttgtgtgaacatcagttctccgcgtacatcatctctctgccctggtgcttgcatctttagttggttttttctgtcttttgaagaacctaccagactgttttcagaatgactgtaccatttttcattcccaccagccacgagtgagtgagccgtgtttccacgggggttggcattattttgtatcccagccattttgataggtgtgcagtggtgtctcactgtggttgtaactggcatttcctaatggccgagtggctctcagcatctcttcatgggcttctttccatctgtgactttctccagtacccatctgctcatctcttgcccgctttcaagttggctggttttgttttctaccattgagttttgaccattctttatacatgctatctgcaagtctttgtcagatacgtgtcttgcaaatattttctgccacaccgtagcttgtcttgtcatcctcttaccaggatctttctctgagcgaaaattttcattttgatgaagtccagtctatccatttttctttttctggtttgtgtttttgctgtcaagtctaagaactccccaccttaccgaagaccctgaagatttctcctatcttctctctgtgttttatagtttcatgttttacatctgtggtccactttgcattgatttttatataaactgaattctaggtcaaggctctttttcttgttggcctgcggatatctaatttttccaacactactgaaacactatttccaacactattactgaatgccaccacgcctggccatatatatatatatatatatatatatatatatttttttttttttttttgtagagatggagatctctctttgttccccggctggtctcaaactcctgggctcaagcaatcctccaacctcgacctcccaaagtgctgggattacaggcatgcgccactgtgtgtggctggtattttatttataatttcagtgtctacatggtcattgctaagctttcttttctctgttgaattgcttttacatctgggtcaaaaatcagttgggcgtatttgtatggacatggtcataggccctctgtttctttccattgctctacctgtctgtctttctgccagtacctcacagtcttgattaccgaaattatgtcataagtctcaaaaataagataggctgattcctctcattttgtctgttgtttttcaaaattgtttttattcttgtgaatcctttccctatctaaatgttagaataatctctatttctacaaaaaaaaaaaaaaaaaaaaaaagtcttgctaggctttcaatgggaattgtgtaaaacttgtttacctatgtggggagaatttactatgttgagtcttccaacccattaacatggtcagtcttgccatttgtttatatcttctttgatttctttcatgaatgttttgtagttttcaacatacaacttctgcatatgttttgtcagtttgacacctaggggcatttttgagtgactgtaaatggtactggtgtttgtttgtttgtttttgagacagggtctttgtccctgaggctggagtgcagtggcatgatcgtggctcactacagcctcaacctcccaagctcaagcaatcctcccacctcagcctcctgagtagctggaaccacaggcacatgccaccacgcctggctattttttttttttttttttttttttgtagagatggagatctctctttgttccccaggctggtctcaaactcctgggctcaagcaaccctccaacctcgacctcccaaagtgctgggattacaggcatgtgccactatgtgtggctggtattttatttataatttcagtgtctacatgatcattgctagtatatacaattgtagtaaatacaattgaattttgtatgctttccaccctgcaaacttgctaaactcgcttcttagttctaggagggttgtgtttttttgttgttgttgtttgtagattcattggggttttctatgtagacaacatgtcattggcaaacaaggacagttttctttcttcctttctaatctgtttgccttttatttccttctcttgcctattgcactggctaggactcccagcactatgttaattagcagcagtgagagcagacagctttgccttgtgacagtcttagacaccaagcactgagtttttcaccattaagtacagttggctcttctgtatctgtgtgttccatatccatatatccaaccaaccgctgatcagaaatgttttaaaaacaagaaaaacaatacaaattagtaaacagtacagtatagcaactctttacataacatttacattgtattaggtattctaagtaatctagagatgatgtagcgtgtacgggaggatgtgcataggttatatgcaaatactataccatcttatataaggaatttgagcatccttggattttggcatccttgtggggagtcctggaaccaatccctcagagacaccaaggaacaactgtataatattggctgtaaggttatggttgatgcttttaatcaacttgaagaagttctcctccattcctaattttatgagagttttctcatgaacatgtgttgaattttgtcagatgttttttatgaattagttaatatgatcatgtaatttttcttctttagcctgttgattggagactacattgattggttcccaaatattgagccaaccttatatccccagaataaaccccactaaatcttgatatgcaattatttttatctattactgaattctacttgctatttcattagtgatttttgtatctatattcatgagggatgttggcatgtagttttctttttgttgtttttccttgtctgcatttggtatcagggtaataccaacttcataaaatgaatggggcccaggtgcagtggctcacacctgtaatcccagcactttgggaggccaaggcaggcagatcacttgaggccaggagttcaagaccagcctggctaacatgctaaaaccccggctctactaaaaatacaaaaaattagcctggcttagtggcgggcacctataatcccagctactcaggaggctgaggcagagaatcacttgagcccaggaggcggaggctgcagagagctgggatcataccactgcactccagcttgggggacagagtgagactcagtctcaaaaaaaaaaaaaaaaaagaatggtagtgttccctcctcttctgttttcttgaagatattgttagaatcatgttgactttttaaacatttggtagaattctctataaatgtttagaaccatcttggcctggacatttcgttttggggagtttttaaattacaaattgacttttgctataggttgtttaaattacctgtttgatattgaatgagttgtagtacctcatgcttctctaggagttggtccattttattgaagatgtcagagttatgtgtgtagaggcatttgtagtgttcccgtattatccttttgatgtctgcagggtctgtagtgatgttccctctttcattcctgatattgacagtctgtgtcttccctctaattgtttctttgtcagtcttgctagaagtttgacaatttcttattttcaaatacctagctctgttttgttgattttctgcattgtttttctgttttctgttaccgggatttctattcccctatctttgtgatttccctccttccttcctttgctatcattgtgggtttactttgctcttcttttcctgggtgctcatggtgggatcttggcttattgagttgagatttttcctctcttcaaatgaaagcccatagtgctataaatttccctctcagcattgctttagtcatgtcccacagctaagttttgtgttgtattttcatttttattgagttcaatgtctttttaattttcccttgagacttcctctttgacccttaagttatttagaagtgtgttgttaagtttccacgtgtttggagatttgtctgctatctttctgttattgatttctactttgatcctcgtgtggtcagaggacatgctctgtatagcctcagttcctttagattgggtgagatttcctgtatagcccaggatatggtcaatcttggtacatgctctgtaggtgcctgaaatgaacatagcactctgctgctgttgggtgaagtggtctgtaaatattcatcatttgatggacttctaaatttatctcaagactctgagatcatttactctcaaaggttatgtgatacgctaccttttccagacaattcctaagtgatctaaacccctgctgagttcaccaagtggcctgtaaaaccctatgatgattcttgttgatgggagccatcttcccccactagtaggtgtgggcctttcttaaggtgagggccttgagctcgcaccagttcaacctatggctgtatgaaaattttctggctgacatttttacgcttgtaccttcaagaaatataacaaaacatcatttttcttcttcttatcaagtcatagaatgctaaaggcagcgggaatctagggtgatctggtctaccctctcgtttgacaggtgaagcaatgaggtgttgcgaagttaaactgattagttttttttaattttttaaatgaaattaatatacgttaattatagaaaatgcataagaaaaaggggaaatgcataagatagagggaagcaaacatttttaaataaaatttatataaaacttataaccaaagatgactactatttttattttggagtatactctcccaatatgttttcaaaagcaggatcactctctatgactgctttaaaatcttttttttgtactttaacaacagacatgaacatttttcaaaatattatttctaatagcaaaatatcattccagatatatgtctgatgatacagttttctcatcatttatttaatgagtctccattgggtgggcgtgcaggttgtgacagttttctctgtgttaaataacactgtgatgaatatcttttgtgtacatgcatgatgatttcctagaaatgggaccctgggtcagtgcttgtgaacatttttagcttctgagccccattgccaagttggattcttgaaattttttgtttgtttgggcagctttggttttgtttttttgttttcttttgagatggagtttcgctcttgttccccaggctggagtgcaatggcacgatctcagctcaccgcaacctctgcctcccaggttcaagtgattctcctgcctcagcctcccgagtacctgggattacaggcatgcaccaccatgcctggctaattttgtattttttagtagagacggggtttctccatgttggtcaggctggtctcgaactcccgacctcaggtgatctgcctgcctcggcctcccaaagtgctgggattacaggcgtgagccactgcgcccagcgcagctttggttttatttgttttgtttatagtggagggttagacatgaaatcaacatagaagatgacgtaaacttatgactaagcctggtgtgggctctcggtgttctggggcatgagctagaggatggctggagccaggtagagaccgctcccttccttagaatgtcaccttgctgacaaggacagcgctgtgagcatccacaccttcctgtgaggtatctggcattgagcctggtcaggaaacaggaagacaagcaggttccattgagcctgggacctggaccttgtaaagccagccacccagcccagttttacaggccaggcaacaaagggagcaaccggctggacccaggcctgcctcccccgtgcagacccgccgtgagaacaccgtgttctgaattgagacgtgccttgcactcactttgtcccagtaattgcccccataaaatagacctggacactaagaggaaacttcccatatttggaaacccagtcctgcctgctttttatagctggtgtcgaggacaagagaaccacaagccgtggccagtctgctgagagaccactgagggacagacgggttgtgggcctggagcagccccggagggaaggagcatttgaaagtggacaggtagagcccaggcccagagagccccagggctgctaccaggaaggccagcgcatccctccaggtaacgggcagctcctcggccacagcctccaccccccaacacgtgggattcgggctgcaatggcctacacatcttttcctcttgtccgtgttccatctgtctttcttctttggtttgtagagagagaagaattaatccagagcgtgctggcgcaggttgcagagcagttctcaaggtacagagtcttctaaacttacaaccagccagagatgggcacatctttctctaagagcgagggcaggccccaggctctgaggctggccttggccggcaagcgtggctgtctcacctgcctggaggagctgcccgcacggtggaagccttctgtggcttctgtaactaagccagcttggatggggcccaggaaacgctcaccttagaccaaagaccatgttgagtgggtgcattagaatgtgagctcgtgaggtcgagaatgttctccaccggctcttctgggatgggagaacaagctataagaattggctccactggaaaataagcttcctcgctgagcttctgtgtagttaggagacttccttttcatcggagtcatcccaacaatcctgacctggataccgtattttccatttctcaaactgacttctctgtggcgtcttactgcccaggttaattaaaatagtgaaaagcacagacgggtgggattttttaaaaacctttgaattggccgggtgcggtggctcacgcctgtaatcccagcactttgggaggcggaggcgggcagatcacctgaggtcgggagttcaagaccagcctgaccaacatggagaaaccccgtctctacgaaaaatacaaaattagccgggcgtggtggcacatgcctgtaatcccagctacccgggaggctgaggcaggagaatcacttgaacccgggaggtggaggttgccgtgagccgagatcacgccactgcactccagcctgggcaagagtgacactctgtctcaaaaaacaaaacaaaacaaaaaaacctttgaattgtttaactgactgggttggagcctccagagagcacaacaggtcctccgaaggtgtctgtgcccatcaggggaaggtgcggggactggaccatctcaactgcatgagcagagagagggccatgtgtccaccccagagagcttgggtccactgctcaggcccgaagaagtaaatatgcccaaccagcccagaaaatacacctcatgatactttggtgattctttcctccccatgggacatgatgatttctgaaaagcaagtcctagcatgttggcacctcagaccctcaccagcccacctagaggccttgcccatgcccacagcagggactcagtaggtgtttgcttaaccggttttggctctgagaattttaagggtcatatttactctctcttttctttttcattcctagagcattcaaaatcaatgaactgaaagctgaagttgcaaatcacttggctgtcctagagaaacgcgtggaatgtgagtgacgtttctgtttcctttttgcttctctgtcctttaacctctattcaaattaaccacttggaacggggaggagttcagtgccgaaggtaaatacaaataaatgtcttttctttgtgaaatacttgaaaattacctttgatgttaacaaaggctagcacagtgactaactaagcattttatttctattttaaaagaagcacagctcatggtataaagcattctttcagccccaaagaataaaaatgaacacacgaagccttccgcacttagcccctctgagaacctctgctgagtgtcttgtctgtgtctttttgtgtgtaaatgaagacattctctgcacactgatcggcaccctgtgggtcataattttttggaatatgtctactaagttgttatctcttggtttctgatacagtctggatgtcccctccacatctcacgttgaaatgtcattcgcaatgttggaggtggggctggtgggaggtgtttgggtcaccaggcagatgcctcctaaatggcttggtgctctccttgagatagtgagttctcgcaagatctggttgtttaaaagcacgtggcatctctctaccctcctgcttctccgttgccttccaccatgattggaggcttctcgaggcctccccaagagccaagcagatgccggcaccaggcttcctgtaaagcccacagaactgggagccaatcaaacctcttttgcttataaattgcccagcctcaggtatctctttatagcaacagaagaacagcctactacagcctccaatcaccaccaaaggaaaagcagaaaaaggactagggagccaaggagtgtcgattcaagtcctgattcaatgatcacaaagctcaaattctgggaagaaaacagcttcaagtcacccaccctttttgtcctcatccataatatcaagatcaatgcttgaattccataggcctcacaattctgtgttccactcacagcttgacaagtgaactctttgtcaatgacaaggcaaaggttaatgattaacaggcactgtatttaccaacttaggaactaaataaacagaatccagacaggataccattaagagttgcagcatcaccaaaaatatctggctgattgactgaatgtcgtcgcttttctttttctttttttgagagacagagtcttgctctgttgtccaggctggagtgcaatagcacaatcttggctcaatgcaaccttcgcctcctgggttcaagtgattctcctgaaacatgatttacatagtcagatttatacttttcaaagtgtgttgacatttctaaaaatgtatgtggtcactggatcttcaagacagtttcattttccccattgtcaacgaggaagccacagagaggttaggtaacctcaagttcactcagcaaattagaaaaataaataaagctgggactggcacccagggtcctggccgggctgctgtcacggcctgctacctgcccttctggaacgagtcacttccctgcacacctggctgaagaggaccaggcactccatgaggattccttgataacgcaggttagaaagctaaagctgcaagcaacagaaactgatcgtggctgctttcaacagaaaaggagtttttccctaaaggattttgggaagcttccccagatccccaggaaggcttgggaacagggctcagaggttgtgcagcagcaacaattccccaaatcccgtgcagagctgatgctgtgcggatgcctgtgctgccgtctctgagccccagatgcggcaccagctcccctgtactcctcactctggacctaggtcccccggaggctccacaaccacttatgcagatatcaggctgcttctccatgtcactggctacaggttcaaaatctagacagagccaggccgcgcacccaaggtctagctgcaaggcaggccccacgaagggaggctgtgagtatcctgaagctgcctcacaaagcaccacagactgggaggcttaagcatcaaaaactgactctttcacagctctgcaggccagaagtcagaaatcaaggcatgagcatgactggctatttctggaggctctgaggggccctggttccatgcctgtctcctagaaccttgtggttcccagcaatccttaccgttcctgagcttggaaggctacattgctataatctctgcctgtgtctacacgtgatgacattctcccaggatgtctccatgtcaacagtctctctcagctaggtcttataaagatgcctctctttgaatttagggcccaacctaaatccaggatgggcccatctccagatccctaatggattatatctgccaaggacctttttctacataaggtcccattcacaagttccagggagtaggttgtgaacagatctttctggaggacacaattcaacccaccacagcgagtgtttgcatttccatattctgcactgggaggctggctcagctctccaccaagccccatgtcgcagggaattctccaaacttgggtaggggtttgagccaaagcatgcaaaaaaggcttgctgcagagtccccacccctctttacggacacaaaaagccacgcagtcactacggggcgagtgtgcagatgcccgcgggcagcaggtgcctcccacctctcctcctctctccagcacctgggtttttcctcagccttccccatctcctacgccccacctggaagccagtgccagctccccccatgctcttcccggaaagtgcaaacaggcaagttgaagaggccatgtcgtaactctcaaaactcttacagagaattatgtcgcccacaacaagatgaatagtaaccctgtgtgtctttgaataactgaccctggaaaataaccatcaagccagaagaaaagtgttcctattttacctgcaagtggcaggtgagtcgaagaccactgaaggaaatggcccataggaccttcccccctagcctgttctggctgcggaattctccaaaatttctcacttctcagagggaagcatcttcccataaaaccctcagtaaatgcacatagatggcctggaaaaggacaccgctcttgacccaccgagctcaggctcactgcactgaccaaaattcctggcgcttctatgggtaaaaccggttgtgactagttgtactgatttctagcaccagagacctaggactgcagaaatgggattgagggagctcacctctctaaggagtagagaaggaggaacagtctaggagttgtggagggtaagggaggggcttgggtgaggtcaggggggactctcctcagtcctcctggctgccctcctcccctggcatgcaactcacacccccaccccaggaggcagccatgtccagacaggctgtcctcctcctgaactccacctggctttgggctcatcctccccgggcacttctggctgatggctccccactctccagcggatgtgctttagcgggaggtggccaggatgctgcacctgtgctgagccccagagattctgagttccagagacactacaagggcagcagagccttaacccaaagatgcaagagcccagacattttaggaagcttggagggcagaaacggaaagtccttttgaggagagggcctgcagctgaacctctcacgcaggccactgggtaggtgcgcgcccagcttctcagaaggtcagtcccaaccctgcacggctgccagaagctagccagatggggaaggcggccaggagcctggtccgacaccccgatgcacagggcctgggccagaggcagatgctcccatctacatatgcacacacacatataaacacaaacagagaaaggtgcacatgcactcacatatacacatgtgaaatcacacaggcatgtcaggatgtcacatatacatgcacacgtgtaagcacccaggcacgtgcagatacattcatatatatgatcacatacccacacatgcgcacacacagctgcttctgctatacatgagctgctgtgagctgttttgttttgtcttgtcttgtttttgttgttgtttgagacggagttttgctctttggcccaggctagagagaagtggcgtgatcttggctcactgcaacctctgccccccgaagacaggacacttctgtctcagcctcccaagtagctgggattatagctgcccgccaccatgtccggctaatttttgtatttttagtagagatggggttccgccatgttggccaggctggtctcgaactcctgacctcaggtgatcgacccgcctcggcctcccaaagtgctgagattacaggcgtgagccattgtgcccggccaagctgttttctgcctcttgagttaaaggattcatccactagaactggccaccttaaggccatattatattgtggtggacttgtcttaaatggaatttcctgcttcttcttaaatgtataattcctctgaattgaatataaatttcttcatttctcctcattgactttcaaagctcttcttccttttgatatacaaagtttagccttgttcgagagatctgggatttcccttacgttacggattattttgtaaacagaacacccaggctcctcccctcatgtcctggctggaggtgaaacattaaaaagagattttaaagcagggccctttactcccttccttcctggtttgtggccagggcacagggcagctctgctccatccaccctttgtccctgtgctctgggcttggaccaaaacctaaacacagcgtgggccgtggcaggagctgaccggctggggcaaagtttaacacaggccatacaaacagcccagagcctggatgctagaaccaagccttgcttttctctgtcactccggaagtgtgctctacgcgggctctttagtgaggctcctggaggaagtgttgaaacacaactctattcatacatgtctttaaacagctttcactagctctgtagccaaaggactgggcctgccaggttcccggcctcttgctggagcacagtgaggctggggaaggagcacagcacagagcctcctgagcctcggctcagctctccccgacccccagctcggctctccccaccctccggctcggctctctctgacccccagctcagctcttccccacctgccaggacgatttccccaaagccagcgtctgtcagaaaatcacccttagtttttcctgcaggtggcctgtgacttgtagaagctcacaaaaatctctttcaaagcccttttttgttgctgttttgttttgttttgagacagagtctcactttaatgcagtggagtgcagtggtgtgatcttggcccactgcaacctccacctcccgggttcaagtgattctcccgcctcagcccccagagtagctggaattacaggcagcctgtgaccacgcctggctaatttttgtatttttagtggagacggggtttcattatgttggctggacaagctggtctcaaactcctgacctcaggtgatccacctgccttggcctcccaaagtgctgggattataggcatgagccactgcgcccggcctacagtccttttaagaggacagcccggggtttccagataatactagccccacacacaggcatgtcctagggtccacacctggtcagcgggaataacaggcagccgtgggctgggctcccagccccctagcagggtccagtgggccagggagcctctgctttggtttgtggtgcgtggtctgtgcccgcctgtgttcagcgtttgaaggcagaggagcgggccatgatgggcagagccgacgtccaggctccacggtagggccgtcctgctgctgtctgcagacctctcaggcttgaggccccccgccccacaggactggcccgctcctccctctggattgaggtggagcagggctggcagtgggtcgaagaggggagctgtggaatcttccccaaagcagccgggtgtcctggaaaggccagggagtgaggaggcaggacccccggggacacaggcacacacatccaccacatgctcacctctgcctcctcctgcagacctccccgccagccccgtcatttcatggcatcttgctttctcttcattgaggaatgcacttttgcaatgttgttactcactatccatctacttggccaacagcctcttcataaacttaattgccacaaattctgcatctctgggatgcaaactagtgaagctgtgctgtgtcacccaggaggcttaattttaacatcacctcaataggtagccagggaagcggatctcggtggactctgcactgtcaatacaaacgctatgcacccatcaaaaaccatgagctggcttaaaacagagccttgtatggacatgggaaaaaaattataggtttgttgcaaactcatttagcagcaaaaatgtgatctgaactgacatgaagcccttggtatttatttatcctgctcagtatgataaatagcattttcctcgggggataaaaagaaaaacgtgagctgcgacagcagccactaacatggggaagggccgtgacctcctgatgagtgaaaatagcaagttagaaaacaacaaattttatcttttaaaattaataatagatatatagatacatagacacacacaggatggatagaagctagatagatacatacatacatagatacatacatagatagatactatatagatatgtaaatagaaagataggtagaggctgggtgcagtggctcatgcctaaagtggttccccagcactttgggaggtgaaggcaggaggattgctttagcccaggagttcaagaccatcctgggcaacatggcaaaaccccatctctacaaaaaatacaaaaattagccaggtgtggcggtgcacccctttagaccctgttattcaggaggctgaagtggcaggatcacttgaacctaggaggtaaaggttgcagtgagctgtgattgttccactgcactccagcctgggtgacagggcaagcccctgtctcaaaaaaaaaaaaagaaaagaaaagaaagataggtagatacatagaatgggtggatagagagatagaacggatagaaaaataggatggataaatagaacataggtagatacataaatatgatgaatgcatagatggatgggtggatggatggatggatggatggatggatggatggatggatgaatggatacatagatgaatggatggatagatagtatataaatggatggatggatagatacacagtaggtaggtaggtagtagatagatagatagatagatagatagatagatagatagatagataaacaggatagatagatagatagatagatagatagatagatagatagataaacaggatgaatatttagaaggctgggagtgggcagaaagcctggaaggacacacattaatacaaataatattaactgagttgttttctgggcccataggatcctagacaagtttttaaatattattctttgaagtgctatttcctacacttcctacaatgataataggatattttatattcagaaaaatgacatttaagacatagtcaatggtccatggaccttggacagagggcccagctgccctgtttgcagtctacaccgcatgcccaacccttccccagatctactcactttcagaatgtgctgccttccacgtgtgaaccagactgagctcctttctgccactgatgttgaattgtccatttgctcacgtcagtgtccacgtggcaaatccacagggcatgggtgggatcctgcagtctagacaaagccaaggagcaccgctggaggccacgttgggcttcccaatccacatgcaaacccaaaatgtgttcttgggtaccttttctgagaagacagcctgtggcatgcatcagcttccttgaggggcccatgatgctggagaaaacggagacccggctccaaaggagaatgtggactcttagtggttggacaaagacgtcccgacctcagacctcaggtaccctgtgtttccccagcggcagctcatctggactcggccatcacgacagcgaccacactggctccagccacatgcacttccggaccccatgtcctctagctgttgggtagaagaggggtggagaaggtttctgtagcacagaaacacatcagcaggaccagatccaaatattgcactctccagattcttcgtccttctggcagaaagaagcagtgtcccgggaacatgcccctacttgacccctgaccctggaaacgcctcgaaacccacccgggaggctgattccagctagtctgccctgggccactgtactgggagagtttctttccggagctgcagtacttcctttggggtgggaaggagttgttacaaactagccaaaggctctgagttgcttggtttttcctttagaaaacatttgctttttatttttagcagttattcagagccaaacttcatgaaaaggggaatagagtggtatcgtgggagtatccttttgcataaaaactaaggtgtgattacaaagtaacaaagctaatcttttttatttcaattggtttatgaaccaactctaattgaaaagccgtgcaaagctgcttgcttcatggcagcttttctggggtaaacgtgcagtcagccaagggtaaatatcttgaagtttaacgctcgctcggaggcataagctccagtttgtttttggttgaaaaatagtatcctaactgttgaggtacacctttgcagtgggactctgtaactgcccaaggggttcaccctgcctgctacctaaacagagctcattcatcaagacaggggaactgcaatggagaaagagccattcacccagtgccggctgtgcgggagaccagagttttattattcctcaaatcagtctccccgagcattcggggcgcagagtttttaaggataacttagtgggtggtgggaagccagtgagccaggaatgctgattgattggtcagggaggaaatcatagggagttgaagctgtctgcttttttttttttttttttttttttttgagacagagtctcactctgtcccccaggccagagtacagtggcgtgatctcggctcactgcaacctccgcctcccgggttcaagctattctcctgcctcagcctcccgagtagctgggactacaggcactggcacaccatgcccggctaatttttgtatttttagtagagacagggtttcactatattggccaggctggtcttgaactcctgacctcgtgatctgcccacctcagcctcccaaagtgctgggattacaggcgtgagccactgtgcctggctgcagctgtcttcttgcactgagtcagttcctgactggggccagaagaccagacgagccagtttatctatctgggtggtgccagctgatccatcaactgcagggtctccaaaatatctcaagcgctgatcttaggagcaatttagggagggtcagaatctcgtagtctccagctgcgtgactcttaaactgtaatttctaatcctgtggctgttagtctcgtccccaggcaagaagcaggtctgctttgggaaagggctgttacagtctttgtctaaactataaactacaaatgaagtttctcccaaagttagttcagccaaggaatgaacacagacagcttggaggttcgaagcaagatggagcccgctaagttagatctctttcactgtctcagtcataatttggccaaggcagtttcaactccaggaatgtgatcaagtccaagttctgctgatcctcaactttgcctatttatttctcttctgttttaagtcaacactttctcctggtgaaactgctctggaaggacgttccaatgaaaagcttttcccataatgagatcgtaatccttgctgaaaacgctttgccgttcactgcattttaatgctctggcaccacatgtgcccccttttctttttgggataaaagacgcctttgtcccatgtcctcagctggtgcttaggggtatggagcaaaaagtgggtgccagagttgagattcagggagtggagagtggggaggagcttctgccttctgaaaactgcccggatggatgcggtagtgcagcggtggccacggcacatgcctgcgaggatagagtcagttgtggctgagctaagcgcggaagtgcaggcaaaacctgagtatcggcagccagggcaggtgtggggacctctgcactgaggtatattcctccctgggagccacagggagcccttagttaccagccttgagagatcctccacattcgtccgtggtaacccccttgctgtctctctctctgtcaccagtggaaggactaaaagtggtggagattgagaaatgcaagagtgacattaagaagatgagggaggagctggcggccagaagcagcaggtagggtctgcgctggggccacgggcggccgggcctggggagggctccccgtaccagttgggctggggctgtgggctttgtttgcctaaaagaaaggctggtgcagttcggtacagttcaggcttgggagagtgcagtctggaggcagccaccctgcttgcgacctgcttgtcagtggtgtgactttcttctaacaaaagagcacgcatgggccgggtgtggtggctcacgcctgtaatcccagcactttgggaggccgaggtgggaggatcacctgaggacaggagttcaataccggcttggccaacatggtgaaaccccgtctctactaaaaatacaaacggtagccaggcatggtggcacatgcctgtaaccccagctacttgggaagctgaggcgggagaatcgcttgaacccaggaggtggaggttgcagtgagccgagatcgcgccactgcactccagcctgggctcgacagagcaagactctgtctcaagaaaaaaagagcacatattggagataggggctgggaagacgatttcacagaagaagagtcctcctcctgcagatccaagccttaggagcaatgtgtccagcttggaataagttgatatccacttttaaagacagaacaagaagaggaaaagcattaggggaggagcctcctgttgcccccagggacccggttccttgtgtgatgttcccactgggttgcattccagcgagggcttcagcactggggacacagaagtcattctcctgggaacaggcatccttcacaggcgcttcggggggcccagtgagctgtgactcgtggggaaaatgccccagtctccacgatgccacctccaaagtcagttttgtgtacagcaggactctttactggagccagggtcaggacacgtgtggatgaaccacgaccaaactggggatggaaatgccggtagtagcaaagagacggcggtgatgatgagcagagcgcatgcattgaggcacttactgtgtgcgggcgctgtgcttagtgaggggcacacaggacctgctcacacctccgggctttgcctccatgcccgctggtgccagcccagacaccacaggcatatgatgtggctcatggttccccagagtgccactgcccggcctcagtgggatttaatggggactaatggactgagaaacagccctgtgcaattgcactgagttgtctcagagccacctggcatgctgacgatcattccctgattttgaaattgagggcaatctgcttattgaggaagcgtggcaagtgaaagggtctcagaggcagaaggtgaagggaaagccgacgggcctcatctggtcccctcaaagccccgggggcctggcctcggggtgggcgcagggaggaaggccgagcggaaggaagcaggccttgtctgagccacgtgagagcctgtcctacagggaccgtgccacgtgtctgtcccatgcactcatgggctcatttggagttagggatgtctcagcccaattgacttaggggaagtcaggccatagtttgtggccatggaaagttgtgagtgaacaatccatcttcgtcatccctgtgctggaggctctttaaaggacgggagacagagtctctcatttgtgagccaaggaagagctcccaagttgcacagggacggccacacagctggggtcccaaggctgggacctggcaaggctgggacccggcttggcagcctcagacacacagcaccttcacctgtggcaccgcccttggccgtgggctctacgtggcttggttcagccctctggctgtcccttgcgccccaggtgccatggctgctttggcaggagggtggtgttccagggtggtgctgcctggcagggttcccctctgcccagagccaggcggagatgggtggcctcaagctggggctgcgggtgtagcagggccagcctttccagccccaccagcagcacgaggggaagaggacaaaaactgagttctagtcttcagcctgaaaccagactccctgaacagcggcctctgggccccatatgggttggggaactccaccgccccaaggggtgtgtctggagccaggccatgcctcccgaagctgcccccagctcctcacccacaactgtgtgtccctgagcactttctggaggtgtttgtaggatgcagcctcttatcccttaaacgactgcatttaccgcccacctacagcagcaggagtgagtggtgagacagcctccggcctcacaggtcttgcctctgccgtgcctgatgggcacccgctctgtagaaagcaaggcgagtgctcggatcacacgccgctcctggcgtggtttctggtgtgcactagtcctgcaggtcaggttgaggttgcaggggggaagattatttttatcgaagttgtagtcatttcctggggctgcgtaacgaattctcataaactgggcagcttaaaacaatagaaatgtattcccacatagttctggaggccacaagtccaaaatcaaggtgccagcaggccctgccacctctgaaggccccaggggagggaccttcccggtctctcttggcctctggtggctgccggcggcattctctgcctgcttcttcacctggtgctcccatccgttctgtccaaattccccctttttgtaaggacacccatcctattggagtaggggtcaccctcctccaggatgacatccccttaactacatctgcaacagtcatgtccccaaatgaggtcaccctcagaggcagcagggttaggacttcaacatacaacttttggggggagatgtacttcagcccataacacaccacgtgggaggataacaccgatttcagagcttgcagaggaagccgccaggaactccagtgagacatcagcccccaggtgcctgtcaggcacgccgggctgtggggggcacctgggcccatctgagtaacggaggcgcatccgcacttcccccaggagtacatttttagaacccacagcgccataaaccaaagacaaggagacttcctggtgccccgtcagcttctggaggcgacgttctcggctgacagctctggcagcctcccctgtaggtgagagacaggtaaatgggactcttgcttccaaaacggaacagggtaaaaattctcaagcgttgtcgacacattgagaaaaaacaaatccagcctcctgggctctggtctcatccccagccgcgtcatgtgccccaggccggcgttgccacacatgaaaccccttcctgtttttctatgtagaaaggaactcagaatagagacactgagatattcgtgttgtcccttttgtctttgtcaacagcagagttacatcttactcatgagagccctgtagcaatgtggggaccctgggaccagtctcagttaagctggaacttccccggatgactggggagaggagctgcaaaaggcagggtgggggtggggggccttcccgagatggcagcccagccagaggccagcgttcttgcctctgggaagagaataaaggccccagacagggtggagctagctcagccccgtgccacacaaatggccagtgtgagcctgaaatgtggagctacattcagcccacatagcacaccctggtggggcctcggagccaggggtatggatccaccagaagctgccccttgggaacagcagtggcatcggggtccggcacacagcacccgggagcaggtggccgtcccctgacactcacgggctaggtttctcctgcttttccctcaaagaggacagaggtccaactgccagcttacatttagggcaggggcaggggcaggtctaccccaggggccacggccactctggcccccagcactgtgccaggcagagagcagagcatggaatatggggttcacccagagctggggagtctgcaggagcctggggtggcaactgagggctcagcgttcatcccaaacaaatggccttgcccactggcctaagccccagagaagggggatggggaccccaggaaatgaaagcaaagataagctccaaataggatgaaaagaaagagctccatgccagctgctctgtttgctgaagacgctggttcccgtggcagcggagcgcagagagaggggctgcctggccaggcagggtcagcgggccccagcagaccctcctctgctcccagctctggtatctgcaaggaaacagcgggattcgaacagtcaaactgtcttgctcggtgaagatttccataaccctcctggggaatgcaggagacttacagagacagcacatgtgcgaatgtttacacaaaacaggttaaaagcagcgaagaaatcatcatcatgccatctattttttttaactacgcagaaaacgttcgttacttctcagaaatgtgtaaatggaatttctcgtttaatggatgacaatggaaatcatttgattggtgcattttgttggttggttttgttaatactttgctgaatctgttagcgttcccccttacacatcaaactgtggtagcaactctgatgggttttgcaagcatgaaacagagggaagggctaccaaatggatctccgtggagcggtggttatcacggggaagagacggcagcatgccgagaaaataacaccgaagcctctttttccagaaaggaaatagattgattattctagttttgaaaatagcacaggctcattggaaaacctccaaactacactgatgggagctgaagggtgcacaccgatcatgacaacagccggcaatgtccccccagtttaaacctggacacgaggccttctagatgtttttctgtgcatagataccttgttttgaaaaacaactaaaacatgcgttgtgtagtctttttttttactagtggcattgtgagcaataaatagattaaattttaaccagcgtacagctcatagattttcccagaaggccacaatcaagcactctttttaaacctaccgaatgtgctctttcttcctcgtagcgtggcattttttggcacttgctttcagtacatactgtgcatagcattcttattttcccttttcatgtcaagtttcctcacttggcataatatccgtgatgatcctcctaatggcataatagtccatcatgcggaggcactgtgctggtttaaaccgcttcccgtcttgggacattcaggtggcttctagtcggttttgtgtttttgttacagcagatcacaccacggtgaatatctgtgtgcatagagctgtttgttcctgtttaattcttggcttaagataaattccccaggatagatatgtgggcttaaaggatacgaatttctatatggctcttactgggcagtattaacttgctctcccagaagaaggggctttatttacaaatcgcaggagcttctgctgcatttagctccctgagtgcccccatagcctggtgaatgtcacacaagccaggcgtgacccccacccaccatcgtccaagtacacagggagcctgttcacttccaagcaagttcacacccatagggtgtgaacccagatcggcccagccccctggtgcactctgctgcaggggcccaagagcagccagacctcctggggcagctgctcctcattcagcctctggggaccaccctgaagccagcacactgcccaaccggaaggtggctttcctctgaaacatgcctggctcactttgccctgctcctatgtgggatacctcgataccaagtgctaaacaaaaacagagtcagacagaaaactcatctgctaacattacatgtaacagggaaagttggaaacattctaaaagtccatcactggggactggattgctaacgtgtgctatggccacaccctggagaaacttggaaaatgaagctaagctctgtggagcaacttgggatgagttcatgatatgttagatgacaaagcaggttgcagcagactgactttggtgcaattccatctttgtttaaaagtacaaaggggctgggcgcagtggctcacgcctgtaatcccaacactttgggaggccaaggcaggtggatcgcttgaagtcaggagttcacgaccagcctggccaacatggtgaaaccccgtctctactaaaagtacaaaaattagtcaggtgtggcagcatgcacctgtaatcccagctactcaggaggctgaagcacgagaattgcttaaacccaggaggcagaggttgcggtgagcaaagattgcgccactgcactccagcctgggcaacagagtgagactctgtctcaaaaataaataaataaataaaaattttaaaaagtacaaaggggcggggtgcagtgactcacacctgtcatcccaatactttgggaggctgaggcagaaggatcgtttgaacctaggagttcaagaccagcctgggtaacatagcaagaccctatctctacaaaaaataaaaattaaaatattgttaaaaggtaaaagcggccacccatgtgtgtccacacttcaaaacattctggaaagatacaccaaactattagaagtgatttccagagtatgggatttagggaaataaatgggtaaagtgaggacttcggttttcatattttggtgtttttttttttactttactcttgtgttgtttagattttttagaatgtttttcttttgaaaacagcttctaaaagagaagatagccctcaacatctgacttttttttcttttttttttgagatggagtttcgctcttgttgcccagactggccaggctggcgtgcagtggcacaatctctgctcactgcaacctccgcctcctgggttcaagcgattctcctgccttagcctcccgagtagctgggactacaggcacacgccaccacgcccagctaatttttgtattattattatttttttaatagagatgaggtttcaccatgttggccaggatggtctcgatctcctgacctcatgatcatcccgcctcgacttcccaaagtgctgggattgcaggcatgagccaccacgcccagccccaacatctgactttctgtgtgttttccaagagtctagtgtgaggtcagaggtcagacaggtcatcagggattttgcttcgagtgagttgctgctgccctgactcctctcccacagcaaataagaccacacggggcttgggggttgggtttgtcgcttgcttttgctgtgctgagggcttcaccagactgaaacagcaggaccacagctcatctctgctccttctctctaggaccaactgcccctgtaagtacagttttttggataaccacaagaagttgactcctcgacgcgatgttcccacttaccccaaggtaagatgagattccggcccagaagaagctgcagctgtgtccccagccccacgcccagccctgtggccctgcggccagaccctgctgtgtgtacgttcacatcaaccgcccctcccagccctgggccgctgacggtgcgggttactttaaggcaaagtattttttctctttgacatttgtttagcaaaagtgatcccagaccataccttcccctgcaaggacataacagctccgtgctgctgtctgcccggccccgggagctgacctgggtagacagtttttacactcaaacgttactggaaagaactttaacgtttaactgaatttttaaaaatccattccattggcccttgtctctgagcaattcttagttgtcctggcaagttttgctcttttgcacaaaagtgttcttagttctaagagaagctgtgacgttggtgaagtagcaatggcatttttgaaataacgacaaaaggagggtctcgagttgccggtcacccgctcaacgccttcagctgggaagcaggcaaaatcccggcccacctgctttttttttttttttttttgagacagtgtttcactcttgttgcccaggctggagtgcaatggcacaatcttggctcactgcaacctctgcctcctgggttcaagcaattctcctacctcagcctcccaagtagggggcattacaggtgcccgtcaccatgcccagttaatttttttgtatttttttagtagagacagggtttcaccatgttggccaggctggtcttgaacttgtgacctcaggtgatccgcctgcctcggcctcccaaagtgctgagccaccgcacccggcccggcccacctgatttgtaatgtgctctcatgctaagattcagggggcacagcttccagagacagcagaggcctgggctaaacacaggtgggctctgccactgcctgcggttcaagtgatggcagagccttccacagcctccatgtaggccactggtgtccattagtccgtgattctatccacgcagttccaaacaatgtcctggatattgtcaggttctgggtggatttggggggtttttgtttttttcttttgatactgagtctcactctgtcacccaggctggagtgcaatggcatgatctcagctcactgcaacctctgcctcttgggttcaagtgattctcctgcctcagcctgagtaggtgggattacaggcacccaccgccatgcccggctaattactgtatttttagtagagacggtgtttcaccgtgttggccaggttggtcttgaactcctgacctcaggtgatccacccacctcagcatcccaaagtgctgggattacaggcgtaagccagcccagcctcatctgagatttttgaatggagactagtgcctttttccattggaaaatatgccccgcgcttctcaggatcctgtcccagggagccgtgaagcacagcctagatccaaaataaaaggtgtcagccctccagatctgtccccttacaaaaaacagaaaaacaaatatccagtaagacctaggagaagacagtgtgcaataccaaagcagtgttcttgtcttctgtatagaaccacagccttctgtccttgtgacagcttaacctaaagcctgatgtcctcagaagcaacccaggggcaccggccccatcagcaggcctgctcttctagctctcggcagaaaccaggaatgggttccagacaggagcatctcagaataacttcttaggtggtatctgaatttatgccaagtgaattttacccccacacttcactttattgccctttttttattattatttttgagatggagtctcactctgtcgcccaggctggtgtgcagtggcacgatcttggctcactgcaacctccccctcctgggttcaagcaattctcccacctcaggctcccaagtagctgggattacaggcacctgccatcatgcctggctaatttttgtatttttgtagagtcgggattccaccatgtttgccaggttggtcttgaactcctgacctcaggtgatccgctcgcctcggcttcccaaagcactgggattacaagcatgagccaccatgcccagctattgtccattttatcatcgggcttgttgaggtctaatttacatgcagtaaagttatttaggcttggagtacagtgaattttgacaaacttgtttagtcctgtgacctccaccacaagcgagatatggaacatttctgtcaccccaaaccctcccctctgctccctcaccctgcctctggcatccaccgatgggatctccacccgtagcattggccctttccagaagtatgtggcctgtgagtctgacgcaggtgccttagaaagagaacgggagaagctgggtgcggtggctcacacctgtaatcccaacacttggggaggccaaggcgggtggatcacctgaggtcaggagttcgagaccagcctggccaacatcgtgaactccccatctctactaaaattacaaaaattagccaggcatggtggcgggcgcctgcagtcccagctactcaggaggctgaggcacgagaatcacttgaacccaggaggcagaggttgccgtgagccaagatcgcaccactgcactccagcgtgggcaagagtgagactctatctcaaaaaaaaaaaaaaaaagaaagaaagaaaaagaaagagaacgggagaaagaggagaaatatctcagcatgcacatcactgtcacaggcccacggcgcctggttaacacggaactcctgtcctttctagtacctgctctctccagagaccatcgaggccctgcggaagccgacctttgacgtctggctttgggagcccaatgaggtaagtgcggggcttgcaggcaccacgtcccagggggaggcagctcaggatcttggacgccagtgggaccacccccatcgctcttcctccttcttgctttttcctcttctttttaaagactgaaaaaaaaaaacaaaacttgttttgccaggttttagttgaaactaactaacactttatagcagggcccaggagacttcacagcaaggggattctgtgagtgggggagacggctgtcaggggcagggaggctccacccagggctcctgatggcgctgggccccccgagccatctgctcatcctgcagaccctcatgcacgccggtggcagccccgtgctgcagaacacccctgccaggagcaaatctctcctcaaggaaggggctgcggtcagagtgctctgctctgagagcagtgtctgcaaaggcaaggcacaggcaaccggctgccccagataagtggacatgtgggattccgggaactgtgtcaccttctgcagcaaggcttgaggccaggaattccacactagcctgagtgatatgatttggctgtgtccccacccaaatctcaccctgaattgtcataatccccacgtgtcaagggcagggccaggtggagatcttgaatcatgggggcagttttccccatactgttctcgtgatagtgagtaagtctcacgagatctgatggttttataaatgggggattgtcttttgcctgccgccatttaagtgactttctccttctctgccattctccatgattgtgaggcctccgcagccatgtggaactgtgagtcccttaagactctttttctttataagttacccagtctcaggtatgtctttattaacagtgtgagaacagactaataagctgggcaacatagcaagacctcgtcgctacaaaaaaaaggtgttaaaattcctatttgctgaaaaatacaagaatggggaattttttgtttcatctcattggctaatagaccccctcttttcacaccccaaaaaatgaaaaagttccctcattgcagacctcggcctcagctgttttcaacgcaccaaaatctaaggacgttttcctgcttgtcagcaacacagaaaatgcacaaggctcctcagcaagctcacctgtgctctttgacaagctcggccgcagcgatgtctctgcaaagggcagaaagtgggctcttgcctcttggcacccctgaggccaggctgctgacacctggggcactgccctctcctaagtgaacctcttttcatgtgcatggtctcccagcaggagaaaaactgcagcaccagccagaaaagcaaagctccagcctccactccccagctcagttcacccaagagcagcaggcggccagtcccaggggctgcactgctgcaaacctgctcaaaacctccagccgccacgtggcaacttgctccccagctctgagagtgcaggaccggggcgcagagacgacagaagaggctttaaatatgcagaatgactgtctaggtcaacgcacaaaaggaaagggccccaggtgtgggagatgcaaggggtgagagggaaagctcagaagagacgtgttggagctgctggcctgcagcagctcccagggtccctgcacagctgctgagattgggcagagcaagtacacagcaagtagacaccgcagacagttagagcacactgactcctgctcccagcctgtgggcaaccgccgcacctcagcatcatgtagaaaaatcaccatccccaaagtcattttgacctcagcctgctgggaggaagagccaagccaggggccactgatggcaaagcacctgcgtggaaactggcactcgctgtcttttctgccaccttctaccagggaaccctttgagcacgggccactgtgactggggaggtggggcttgccccacgaagctgggggatctgtgtctccataatagaaaggccacctctctgtcctctgatcacagagtggattcacagctgctctcggggctggcaggtgggcaaggcagacagctcccggcagctggactcagcctctgggtggcatctcccacggcccgtggctcctgcccagcagatctcaagggcactccaggagaccgatgagggttccagtgcttccaagaagtatctagctgcctgtgtgtgagaatgcagagatgcccaagacaggagccttggcctctggcagatctagggatgccaggaattttggagtgtgagtggcaaagagggacaactaaagggacacacatgaaaacagcccactcggccccacaaaactgcatctggccacgcatgaggcacctggcactcagagaacgtcagggcgcctaaaagtgatcacctccctcccttccagcaggggcgcccccacttttctccgagtggtttggcccagtgtcctgcccatcacaaaccagacagaggacatgacttcaggctgctgtgtcctcccatgtgttagggcctccgagggcccagggctgtggcccgtgagcgtggcctgcctctatcctccgagggcccagggctgtggcccgtgagcgtggcctgcctctatcctccgagggcccagggctgtggcccgtgagcatggcccgcctctatcaagtgcagagctggaaggctgcaggagcctcccccgtcatctcatgagtcccccactcacgaccatgcagcccactcagaccacgacctgccgccacatgcgggaactgctggctccctcgtgcccgcccggggctgaggactgcacgtgcagccacagatgcatccggccctcctgccccacagcctctatgaaggccacataaatggcaccaagtgtctctgtctgccgatcagcatcccctcttggcttcacagcagacgcatctgcctttcaggactgccttgaacaacatctgggctggtcaggtggagagcgaggagtttccaggttgcagcccctatggtcctgagggctggcgtccaggatggtgggggtccagcagctctgggcagcgaggcccctggctgggtgatccaggtggcagctgaccagtggcctgggagccagccctcctgtcctcacgtggggccccatctccaaaagccagtgcagtgccctgcacattatccaacctacatctgtactgtctccccaaggaaaacgagtgtgtggttcacgtgctttaaggacgtttcccaggtgacattccaagctcccatctgtggccgcaagtgggggagtttccagttttccagatagattttctgccatgccagagaaccctccgcctccttcagagccatctcatcaatgcagtgatcgcaagcttcgatttacaaaaactcgcctcccttgcagcatttccaggtttcacacacagcgtaacaagtaaaaatggatttttgggcagcacgcctgtcctagtttgctgaggctgccataacaaagtaccagagactggggtggcgtcagcagcaaaagttgattcctcagttctggagctggaagtccaggatcaaggtgctgccaggttcggcttctccggaggcctcggtccctggtctgggaccttcttgctggggcctcggtccctggtgtgggaccttcttgctgggacctcggtccctggtgtgggaccttcttcctggccagcaagatggccgccttcttgctgggtcctcatgtggcctgttctctcggcacatgcatcccaggtgctcttcctcctctaatgaagacactagtcccatgggaccaaggcctcaccctgactagatggaaacttcattacctccgtaaaggccccgtctccaaatagccccactggggtcggggctttaccatgttgacctggggaagggggcagttcagttcgtaacatgcccttttgggaggagaaagtcaggcaatgagcagacacaggcaggaagccacgccgggctccagcagggatggcccagtgccctgtacaggcagcaggcagctgggctggaggtgggccctgggtggaggacacctaccaggtgtgtctaaactgcccctttcctacacatcttccttcgcactgggctcgccacccaagacctgctttttccagaaagcaaagcctactttggtcaaactctcatttttaaaaatcacttcatcttttcctccctaacttaattagctccaaagcactgagctgtattgaaatagatcaccacaatgacaatcctctttgggactgaaaacaaaatctatttcaacttgaacagggatattgatagaagacagggctccatgaaaaagggttaggaggagccgcttgctggggcaggggccgcatctgggcactgcagttaagatgttaaagtgtcttcggtcccagggggccgcagatgaacacagttcagcgtttctggatgtaaatcgtcaaagctccttcgatccccagcctcgggcaaggaaagggcctttctctctgtgatgccacctgtgctcaggtgtgcactggatggaactgtgtcctagacccctcagctgtgatattgatccgctgagattgtttttcatctgtagaaatcaataaattcctttttggtgcagtgttttgtgaacgggtgcactctctcacccggtcgctgtcctaagaattctccttgacttcggaactggccctccacgccccaggatccacctgccaggagacccccagtgtgctctcaaacccccacccatctgagtggcctggaaaggctggtctgaagacctctcttcccatgtctgccgaccaggctttgctctccagggactttctgggagggggagaacccacctcctgccaacggccctgctggcactccgaggacagcagagggaaggaagccaggggctggggagccggccacacaactgcccagtgcctatccttctcctgtgcccacagatgctgagctgcctggagcacatgtaccacgacctcgggctggtcagggacttcagcatcaaccctgtcaccctcaggaggtggctggtgagtgccaaacccgccttcggttcttcctgggcacgtggtttcatccagttccacaggaatggagggaatggatcaccagggcaccttccggatggcactgcgctccctgtgagcagaggtgacatttccccgggagttctgtgaggacactcagcctgtctctgttcctccttccaccaaaaccttctttacgcccgagctactcctgctctgataagcaaggagtagcttatcagtgagactctgccatcatcaagcaaagcagcatgtcctaaagcagcggtgtgtgggagcgtgtgtgtgtgtgtgggagcgtgtgtgtgtgtgagagtgagtatgggggtgtggatgtgagtgtgtgtgagtgtggggtgtggatgtgagcatgggggtgtctgcatgtgtttgtgagtgggtgtgtggatgtaaatgtgtgggagcgtgtgtgtgtgtgagtgtggggtgtgggtgtgagcatgggggtatctgagtttacgggtgggtgtgtgtgaatgtgtggtgggagtgtgtggggtgggagtaggagtgtggaggtgtgtctgtgtgtgtcagtgtggatgtgtgcatgtgtatatctggatgtggggtgtgtctgtgtgtgggtgtgtgtgagggtgtgtgtgcatgtgtgtatctgtggatgtgaggtgtgtgtgcatgtgtgtatctggatgtgggggtgtgtgagggtggatgtgtgcatgtgtgtgtgtggatgtggggtgtgtgagtgtgtggtgtgtgagtgggtgtgtgcatgtgggtgtctgcctgtgtgaatatgtttggcagcaggtttttttaatgaaatattgctcagaaccaaatattaaaagcctattaaaggtttcatggtgactggggacccagagctccctcttggagtctcccctccccccatcccctaactttatgccccactgtggctcctcagacacctccggggagaccccagtccttgactgcagggtgaaacccctggtgggagctctgtccccacacctgccccgggtgccgtggtgtggcccgctggacgttctcagggtccctgtgtcacctcattggtacctgtggtaaacctggaacactgttgacctctggttgggatgagggtttggcagagaatgttcaaaccagcgcacagccttctgggtggctttgggaggagaggtgggcgggcccaggcacagggtgactcggaccccctgcctcccgcagttctgcgtccacgacaactacagaaacaaccccttccacaacttccggcactgcttctgcgtggcccagatgatgtacagcatggtctggctctgcagtctccaggtgggtcctgcccgctgcacacccagacctctactctcgggggtcagacggaggcccccttccagggagcggcagccccatcccaccaagagagccacaggcgtggggtccccagccgctccgcccctcctagggacgcacccctgcccaccgttgtcagtcaccccatgggcgaggctgctcctaggattacgagagcaggtgagtccccgacctggtcacccccccaacccccacaggcaggccgatcctctcccaccatgccaggagatgccagatggctgcaggggcctttgtcccccgcttaccactcacccaattccaccccccctcaccccatcccaccctccgagtgaagagagcaaacacctacgccctgttttccaatccaggagaagttctcacaaacggatatcctgatcctaatgacagcggccatctgccacgatctggaccatcccggctacaacaacacgtatgtacaggattttctctttttttccttttaaaaggcaccctggctactggagggaacctgtcagcccaaccctcagagcagttcccagatggagctgtcaacgacggcctcccagcccccaactctgcctccactgacacagctcctggcttctggactttgcccagggccttgggtctccccggagtaggaactttcaggattatcaaaccccaggggctctttcccactcctgtgcgggcctggcttcaggctcaggtgcacggcagatccctggccccgccggcgccttctccaccccaggcagggagcaacacctgtccgcatgcagggatgggggctccacacccccctctcaggagctcgcctctccctgggcaggctcccagctggcttccgcagggaaagcacaggcaggagccagaagagagcagaagagggggagaagagggactgcagagggacaggaggtgggagtgaggtgtccctcgtggggccagggatcagaaggacagaccgttgctccactcctgcctccacaggcacagagttccgccccatgtggcggacaaggtccaggccatgggcttgggtctgtgtcctcagtggcgcagcagctctctctgttgaactgtgtgtttgtgtgatgtcatcacatgcctgagagctctgctgccatgtgtcagcgcctagtgggttccgaggtgtggctgtcagcgctcctcccggggccatcaccatgcacacccatctgttccccttttgctcatttcacactcacagtggccggcacagcacaggtcagcagaggccttgaccacagcatcccagtgaacctcagcctcgttctgcccacctgcctctggcacctggtgacgtttgataatttcacaagaggccgtgatgcctcagggcctgtcccagggagcatgccgcttcctcagaggtgtctgtctggtgggactgcaggagcatggggacgtgcagttgcaggggcagctgagcggcaggagggacctcctggccaggccagggcacaggcagctcccccagcccccacggcaccttctcctgactctacttgctccacttacatggctgggtgttgctcccccgtgcaggtacctggtgagggcgcctgagtctcccctcactctctccttgcctcccaggtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacaggtgtgtggggtgagggccctcccaccggagtgggggcacattcagggacagagcagcccccactctccattggctggaagctcccagaagctcctggccacagcagtgccctggggacccaagggaacccctccctccttcctcacctcctccagggcccagagtggagccccaaaaagagggtaccctcgccatgcgcacgtgcatcccactgacctgcacttcccagcctgtatttaattcagccttcactggctccctttgagataaatcctttgtccctcttccagcccaagaaactgaggcttagcaaaggtagggagcctgcccaaggaggggacaggccctggacagacacatctgctgcatccaacataggagagctgccccctgccccataaccccagctgctgtcacctgccacccacagcccagtcagcccccttccttttatttatttttttttcttttgagacagagtctcgctctgttgcccaggctggagtgtaatggcaggatctcggctcactgcaacctccacctcctgggttcaagcaattctcctgcctcagcctcccaaatagctgggattacaggcatgcgccaccaagccggctaattttcggtatttttaatagagacggggtttcatcatgttggccaggctggtcttgaactccagacctcaggtgatccacctgcctcgacctcccaaagtgctgggattacaggtgtgagccaccacgcccggccaccccttccattttagataagggggctttatgcctctcagggcgtgatgggaggagagtgagaggatatctgcgtgagaggaagatgacctggtccacctgccccagacaaacacctccagctcaccgaaataacgccccattccacacgggaattcctcatcaaaccctcactctctgacatttgcaggggagggaagctctcggagtaaaccctgggagaaatgtgttgggttgaatagcagcgtccttcaaacaaggtccacctcccgtgaatgtgatcttatttggaaaagggtctttgcatttgtacttgttaagatttccagataagatcagtgtggattgtctaagggggccgtaaatccaaagactagtgtccttggacgaggagacagagtagaaaacagcccagacacagaggagaaggccgcatgaagacgcagtgattggagatttgagtgatgcagccccaaactaagggacttcggggcccccaggagcaggaggagacaaggaaggaccctcccctggagtcttctttgagagcagggccctgcccacactttgatcttggttctggcttccagaactgtgagagaatgagtttgttgttttaagccgcctagtttgtggtactttgtgtggcggccccaggacactcacccagggcaccgtcttctgcggttccacaaggcagacctcagccattcgaagtctaagtggcttccttccagaggcagcaagaaagactgcctggacttcagcactgggaagatactcaccaccctccaggcgtgctgctgagcctccctttatcagagagcagcagcctcttctaccatggctttccaatttgtctacgcttccaggaagttcaaagcccagtgtaaaaaactgaagtcagtgaagcatttggggaagctccgaggaagcagcatgctccctgggacggggccctgaggcatcacggcctcttgcgaaattgtcaaatgccaccatgtgccagaggcagaggtgggcagaaccaggctgtggttcattgggatgctgtggtcaaggcctctgctggcctgtgctgtgccagccactgtgagtgtgaaatgagcaggagaacagatgggtgtgcatggtgatggccccgggaggagcgccgacagccgcacctcagaacccactcggcgctgacatacggcggcagcgctctcgggcctgtgatgacatcattgcacaaacatacacaattcaatagacaatttacagtcattattgaatcactggttcccagtacagttatctcccctttatctataggctctctggcctctcctccatgtttgtgcccctccccaccctgcaagcaggtgccctgtgtggctacgataagctgtggcaaatcttcgtctgcagtaggtcaaggagcaaccgtgaagagagaacgctgcatctgccactgctaccccagtggggagctcctccagggacaggacctggggaatcaaagcaagtgaacgccccttagtgtaggcctcgtcccactgagccatgtcggagagcatcccgcaagagaaggaggcggcacctgattggaggagcagccgctctgcacaggggatcgttctcgtgcccatccaccgtggggacacaccagcattggcctgcttcaaatgcttcactgactgcaaaatatgactctcctctgggggtaaaattagttgtcccacttttttaaaaatatattttgtcatggaagatttcaggaataactgaataaatgcttcactaataacacaattaaatgtttacaggaaaattgaataattcaagatacaagtgatccccccaaaaaaatatatatatatacagttgaaatgacctagattgatgggtttgggttttgtatctgatgcttgttgttttattttcttggaagaggaaaacatcatacctggcacagagatgtgttctgtaaatgcttgtggggtgggtgggtggatggatggatggatggatggatggatggatggatgggtggatgggtggatggacaaatggatggaagggtggatggatggatgggtggatgggtggatgaatggacagatggataaatgggtggaaggatggatggataaatggatggaagggcagatggatgggtggatgggtagatggatggaggatgaatgggtggatggatggatgaatggatgggtttttgggtgggcagatggatgtgtggacaaatggatgggtgatggatgcacatatgaatcggaataagagatacatgaaataatgtgtgcagggggctcagtacacagtaggcctccgctgaataattgttcagactatacccgtgttaacacgttgttctctcgctatttagggaatgatcacattaatcttggccactgacatggcaagacatgcagaaattatggattctttcaaagagaaaatggagaattttgactacagcaacgaggagcacatgaccctggtgagtggcttattctgcctgggtgggcagccaggcggtgggctggcgaagcaggtcatccatccagctcacactggaagccaagaagctgaaattattagtcttcttggaacaaggtgtctataaatctggttttcaaggtcatgactcttactaggaaagtccgggcagggcctccctcctgatgggtcctccttcatggtcagaggcagcattctcccattcctccatctcttttggatttgaaggagataagtgggtgaaggccgtgcatctcgctctgctttccagagaataaaaccagctctcccatgaaggcacagccccagcatggcactctgaaagcccacctatgtgggggcaactccaacacagctcccgctccccaagccagcatcccccaccaggcccacaccatagcccagcacccctccataaccaggacaaggtggccagagaaggggtagggggcctcccccatgagaaggtgcacttaggttgcccagcatctgccttttggaaaggacaggcactgggcacaccaaggcacacaaggaccagagcacgactcatgcctggaatccagcactttgggaggccacggcaggaggattgcttgagtccaaaagtttgagaccagtctgagcaatattagcaagactccatctccacaaaaaaagaaagaaaaataaaaaaatcagtgcatatctgtggtcccaactgcttgggaggcagaggtgggaggatcgctggagcccaggtccaggctgcagtgagccatggtcgttccactgcactccagcctgggcaacagagcaagggtctgtctcagataacagagagagagagaggtgcatgagaactgccctcccggccttcagagagaaagctggttttgtggagccttgtctaagcatcaggtgcacccctggcattcttactctgaaatttgattatctgtttaaaatcaatagcatcactttccacctccagagaggttgaaagatagggaactctcggctcaggctgaccttctaaccatccagtcccagtaggtagagtcattaggactcatcgctctctggagctgaggtgcagttaattcccaaagactgtgcgagaggatgggagctcccgcaggcaagggctggacagcaggcaaacctccccaggccagggccaccagaagccccttccctaagagggaaacagtcacatagagcggcttcctggcaagcaagtttcttgctcctgaaaaaccaagggaaggagggaggcgccgccttgtcctctaagatatgaggaaggcagagatggacctgcagtcaggggtgacccaggccccgccgatgccttcctcctctgaggtgggaggagaggtcagggaagagacggggaggggcaggatgccagaggatcgggtgccaggtggtcaggacaagtgaacccagctgaaggtccccactcccaccccacccccagccttacacactgcagctgtgcagaccagaggcaaagcgaggctcagagcccagggttccgtttatcccaacgacctgcaccgcggggtcagatgacaagcagcacggccaggcatcgtctcactgctacggagccccagacggggctttatgaacacgggtggaggacagaggttggggtaaggtctcgggggaaaggttctgattcaaaatgggccccaatagggaggcctctgaggatagtgcgggccagcgtgggaggtgtgaggtgcagggagtgtggccggcagggcctgggaccttgaccttccccagagacactgctgccctggccctgccctaggtctggtgtcgggacagctccactgaggccggccaggcacaggctagtcattgcctctgatctggagccggactccacagaggagtcaaagaaaggcctgaatggcttcctgggaactgatagggcagggaaaggaagggcgaccacagcaggatcccttcgaggtcctgccgaggttggaaggcaggatccaccaagcatcatgcagactccgagctgaactgagctgctcctcacctagtcacgttccccaaaccagcaggtgcagcccgcagcccgggggcatgtgcctcagctgggctttcctgtctaatcagcttcagagcctggatggcaaccaacactttggtctggaaacctggtgattccagacactcatttgtgcccggtgcaggcagggccacgggacgccagccctccacctcttgtcctatggcgacatccgggctagtttgggtggaagctgctgcattcctgggcctgccctatctcctcctgaagctcctatggcatgcccaaccctggccaagctgagacagagctacctgtcccctgggaagatgagcaatgcacccacctagggaacagcagaaaatagggggtgaccaggcacagggcagtgcttcaggggatatcacctgggctggggtggccagaaaggctggaaggaggggacccaaacaggaccttgaaggttcattctccattgagaagggagcctgtcctccctgaaggcagccaagctcagttgcatggtccagcaggtcctccgtctcttcctgcctgtaatggcaagtccagacccgagcagcagcagcaggcccgtgttctacctcctgttacctcaattccaaaatctcttctttcagctgaagatgattttgataaaatgctgtgatatctctaacgaggtccgtccaatggaagtcgcagagccttgggtggactgtttattagaggaatattttatgcaggtaagagtcttgcagagcaatcaagcctccagccactcttattagccccacttagtaagggtttgcgttaaacgagcacgcctgggtggtcccgcatattccccgggctgccgacagttcagcctccagaaagccttcagggtaagcgtacatcagaaacaaaataggttataatttgagacctgaaagacagtaacaatccagaaaagctaatactctaaaactgtcacctgtcactgctaattgagccattattacaagcagccttgtcaaacaaattgcctgaaagtcaagaagcaaggactgcagaagcaggagggggcccaggagggccgagacccagcaggtcagctcacacagatggccacggggaaggtcggggacatagaaaaccaagccagctgaaaacaaccaccaaatattaatacaacagcttgatgaaccctaggagaagtcgggaggctttctgcaggacgctgctgccgtcctgggatacatccatccaactcacctctgcctatctctcaggtcggtcttcccagctagacctgcacgcccagctctgtttagcactgaagatagggtcaccttctccttgttcttactgagacacatttgtggtgtggtttggttggttggtggttaactggcgcatcttgtctttctctgagaacagcgatctggttatggggcatttctgtctctaatgtcactgtctgctgcattccctgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaaggtgagtaactgtcaccacatgtcacacttgcttacactcagatacatgcatgcacacacaggcacacacacatatacacatatgcacacaggtacacacagacacacactcatgcacacacgtacacagatacacacagacgcacatacaggcacatacacatatacacacacgcacacagctacacacaggcacacacacaggcacacacttgtgcacacaggtacacaggcacacaaatgcacacacacggcacacacaggcacacactcgtgcacacacatgtacacaggcacacacaggcacacaaatgtgcatgcaggtacacatgcacacaaggcacgcaggtacacatgcacacaaggcacacaggcacacacaggcacacaaatgcacacacaggcacacacacacacacacatgcacacaggtacacacaggcacacaaatgcacatgcaggtacacatgcacacacaggcacacacagggacacacaggcacacataggcacacaaatgcacacacaggcacacacatacacacatgcacacaggtacacgcaggcacacacgtacagaggcacacacatgcacacacaggtatgcacatgcacgcacacaggtacacacaggcacacctgcacacctgcacatcctgagcagcctcttccccggctgtcgtggtgaccgctgtccctgttccatccagagcctgctccccacagcctggcccgtgaccccagcatctcccactctgtgctgcactccctgccttgccttgctgggccctggggggcccctcactgccctcacccatcgctgccggccttcaggaccctggaggcagcactggctgtggactctcctgtccccactctgcgtcccagttcctcacctgtggaggaacccctgagctctgtgccctcgagctgtgaagcccctgtccagctcccagtctcaccgcacccagccaccgagaccttgctccttgcacacagctcgttcctgcccagctccccccagggcctctgagctgcctgtggccccctgccaaggcccccacctcaaggcacccccagcatgtccaaaacaggcccatctcttgttccccccggggatctgggctcacagcctcacaccctccgaccttcctgggctcctacgctgcgcatccttctgctctagggcatctcttggagccaacccacccacttcccactcccaggaccctcagccgggaggctgtcagctcctttcccctgccccgtgtctttgtaagaacctcccaacctgtcccccaccctcatctcacgggcacgggggacacaggaggcaggaaggggactttctgtaggacctcatggagggtgatgagggccagagacagagccgcagtgggtggaggcagcagagccggcacgagggtgtccaggagctgggactggcccagaggtttccgcacggagcacctgacacctgtttttctccgacgtttcccattgccttaagaacgagggactctgaataaatccgtgtgtctctcccagctcttccccatggttgaggagatcatgctgcagccactttgggaatcccgagatcgctacgaggagctgaagcggatagatgacgccatgaaagaggtaaaacacactgagaagagcctgccttccttgcggcaagcaggcacgctgccctccgcactcccgactccagaagcttggacgtgccaagcagggcaccactgaaggccccgtggacaggcacacgtgtaccttccatcagaaagcctggctcagtaaaattagggaatgcgatgagggaaaccaaaactgcattcgccaagaacacgtcaggtctcagtaccttcgagggagtttactggccgtgcccttcacaagaatcacaactgtcacccacacctgtggacacccaggtgtctttgggtgtatcagccgccgttagagcatctgggacccctcagagtacagtgcctggcctggccccagggctgacttgttcagaggaggccatggggtagaaaggggccctcccctggcacggggacaaagcgaccacccacctgccagctcccgggcccagaacacacaccggcacctctcaggggccagggagcctggggctggctttaggttgctgctggatagatatcattttggaggaaggggtccaggtcacagcctcagggcccacgcagtctttctacggattccccacggctgtctgctgtcctgctgcccatggtgtggcctctgcccctcccagcctcctgcctcctccctccagcgcccccaggcagctagaacagtcttactactcctgcagggtttgacccctcctggccttggccggtgttgcctctgccacccccgctccccacagtgccactgaagcaccctccaaggcccgtcagtcagggctcccctagttactgtgcccaccaccccgtcttttctgcctgggcgctcctgaagcccatgtggcccacaatgcccttttgagcactgagccattttccaggcgtagccttgggttggtctcatctccctcgactgacggccccgtgctccccatgcccacacccgcctggagcgccatgccaggcacatggtaggcgctcagcaattgcttaggagtccactgaaaatccagaccagctgccctgacttctccagttgatgtctcctactggaaagtcacagaaaggtctctaaacctctggaaggctgagagcacttatgcagagggacagatgtagcaagaaggcttcccccactccacaaccccgcaagagagctgaaggggcttctgcctctctcgtgggccctccgagagccatagccctgatggccttgagtctctagtcctgagccctgctgcccagtaggggatagtagggttccttaaggcctctgccttcccccctgtcagcccccacaaaaaggagagacacgccaaagaggtgaaaaggccaagcccaagccgcaggctctgcacacaccaccagtccccgcggctgtggtggctgcagctgggtgagctcactgtccaggccccagatgaggcaccaagggtagcgggacagggtatgcagagctgcctctgaaaagcccatgtcaggagtgcttgggctcagaggggctggggaccacaggctttcacgttgcagcacctccaggcaacagaagctgctgggagagaggcagacactcccctgctgtctcctgctccctgacttggccttctctgtactctgttccagttacagaagaagactgacagcttgacgtctggggccaccgagaagtccagagagagaagcagagatgtgaaaaacagtgaaggtaatgcttgctctgctgaagtggcatctcagcgcatacaatgattctgacaaaggacagaaggaaagaggaaggggagaaaatctgaattttggaatacctttaaatgaatggaactttttttttttttgaaactaagtctcgctcttgttgcccaggttggagtgcgatggcacgatctcagctcactacaacctctgtctcctgagttcaagtgattctcctgcctcagccccctaagtagctgggattacaggcatgagccaccatgcctggctagtttttctatttttagtagagatggggtttcaccatgttggccaggctggtcttgaactcctgacctcaggtgatccacccacctcggcctcccaaagtgctgggattacaggtgtgagattgcgcctgaccaaatgaatggaaattttatttcttgcaactaatcattagaattaggctcttaaggctggtggctcatgcctgcaatcccagcactttgggaggccaaggtgggcggatcacttgaggtcaggagttcaagacccagcttggccaacatggtgaaaccctgtctctactaaaaatacaaaaattagccaggtgttgtggcgtgcacctgtagtcccagctacttgggaggctgaggcaggagagtcacttgaacctgggaggtggaggttgcagtgagcccacattgcgccactgccctccagcctggagaacagtgagactccatctcaaaaaaaaaaaaaaaaaaaagtgaggctcttaaagaaggggaacatgctttagttaatagaaaaacatcaataattagcatatgtatcacttataagagtaagtactttttaaaagtgcaattgaagtactgaaaacttttcacaaatcacgtgtttgctttatatggctttgagcattttcctctgtacttgttgatactagtcattcagctcacggggaatgcagagcagccgtttgttcacctcataataaggtcacactaatggccaggcacggtggctcacgcctgtaatccaagcactttgggaggccaaggcggcggatcacgaggagatcgagaccatcctggctaacacggtgaaaccccgtctctactttaaacacaaaaaattagccgggcgtggtggcgggtgcctgtagtcccagctacttgagaggctgaggcaggagaatggagtgaacccaggaggcggagattgccgtgagccaagatcgcgccactgcactccagcctgggcaacagagcgagacttcgtctcaaaaaataaaaataaataaataagccgggcgcagtggctcatgcctgtagtcccagcactttgggaggccaaggtggacggatcacaaggtcaggagatcgagaccatcctggctaacacggtgaaacccttctctactaaaaatacaaaaaaaattagccgggcgtggtggtgggtgcctgtattcccagctactcgggaggctgaggcggagcttgcagtgagccaagatcgtgccactgcactccagcctgggtgacagagcgagactctgtctcaaaaaaaatataaataaataagtaaataataaataaggtcagactccatctcaaaaaaatataaataaataaataaacaataaataaggtcacactctccatgtctaacagataattcaagagatagtgcatcaagcatgcaaggctcagggcaggacaaacgggacatggctcataagaggagctgcaacaggctttggcatccaacacacctggttttgagtccaggcttgccaattacaagccgagagatgtgcacaagtgtcccagcctctctgaacctcagagccccagtctctaagccagaggcaataataccattgttactgctgttttagtgattaaacagtcaaagtgcttgtctggtcccgatgaagtgctcagtcaatgttgccatttaatttttaagtcagttcatatttttcagtgggtcagaaaagagatcaatattgttttactttgtctaaatgtgttcagcaatatatctgatggcctctttcttttaaaatggtctgtgtgtcggccgggcacggtggttcacacctgtaatcccagaactttgggaggctgaggtgggcagatcacttgaggtcaggagttctaaaccagcctggccaacatggtgaaaccccatctctactaaaaacacaaaaattagccagctgtagtggcgtgcacctgtaatcccagctacttgggagccagaggcaggagaattgcttgaacccaggaggcggaggttgcagtgagccgagatcacgccactgcaccccaacctgggcaacagagcaagactccatctcaaaaaaaaaaaaaaaagtctgtgtataatcctgtaacgtttctgcgactgctggcacttttttttttccttcttttgtgagacggagtctcgctctgttgcccaggctggagtgcagtggtgcaatctcggctcactgcaatctccacctcccgggttcaagcaattctcctgtctcagcctcccgagtagctgggattacaggtgtgtgccaccacgcctggctaatttttctatttttagtagagacagggtttcaccatgttggtcagcctggtctcgaactcctgacctcgtgatccacccaccttggtctctcaaagtgctgggattaaaggtgtgagccaccgcgccctaattctaacaaaaacaaatcagtcatcgtttcccttcttccaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacgg

SEQ ID NO: 36779 - DNA, 15800 bp, Homo sapiens
actccggagactgagccatggggggaaagcagcgggacgaggatgacgaggcctacggtgagactggggcgaggcccgggaccctgtggagggaggggaggacgggtactttgggaatggtgtctggggctggctccagggagaggaactaaggagagtactgtgtccctgaggggagggcccgggaaccgggagccatggagggagggagtcagggtcctgggaggaggatggggcccgggggctggggctgttgctggggagcccatggggagtgaagctgggtgcctctgaagagttggggctgaggtccttgggaggaggggggtatttcaggcctggactctgggtccctaagggcagggccctaggaaacaaagccgagatggaaggtggcaggttggggccctgagcagaatagggctggatgctgggagtgtcctgtgctgcagagcctgcaaccagtgaggccagggtccctgtaaggaggaggaggttcagcctggagtctgggtctctgagggcgaaagctgcttgtggtctgccggctcccttgaggagtgaggggaccctgagtgggctggcctctgcctgccagggtctctgggagaagtggcagagggagtgggttctgctgggggtccctgtgaggagttggggctgagggtctttgtggaaagggggctggggtcctgcctaggggtctctgtgaggagctaggagcaggagctggtcttggggtactctgaggaatagggacagggcccctggggttcctgtgaagggtgaagcctgaggggagaaacagcagggagcctgtttccagaatctgcaaggaaaaggggctggggttctgaggagagagggagctggggactggcctccagatccccacgagcagtgaaggctggggactcacctgcggaggcccccctggtcttctggtctgaaggggaaggaacccctatgagggaccttctcgaggagaggcttgagtcccttagggccataggggagcaggcagtgaggactcccgagtagacttcctggagcggcttcaggtcaatcattgtccatgagccatggagggacagagtccagcgcacctggggaaagtggaccccacccgctccttcccagactcctgcccagccctcggctctccctcctcagtgcccacaaggaaccctgactgcccagccctcctcctccctgtgtgtgtactcagggaggaccaggaactcaacgtgcctgcaatctctatggctgggctcaggtgtcactctgactgctggcccagagcccggagcacactgtggccaggggactgaggtcccaccagagtgaggatgtacagggccgcttccctccccaggccctgctggggttgacacctttgtctccagtttctttccccatagccttgaaccagagggtaaggtagggcctggggcagataggggaagaggccatgacctccctgaggggctgtgggtctgtgtggtccctggggagggattagggaggaggcagggatgagaatgagggagtgagagccactgggagtcccacatcccagctaaagggagactcaggagaaccgtgccagggtagggcaggggaccaaggccatttcccagactgactgccttgagatgtgagccggaaactataaaggccttccttcccctccccatggcagcctgggtggagctcccagggagctgctgagctgctgaccaggcctggatcctacctttcctgctccccagttttcccctcctgccagtcctgccctagcccatctccctccaaacacctgaggcctgggtaggatcctggggctaggaggactcagcaggacaagatatgcagagagagactcatcctccacacctcttctcatgtccctcagggaagccagtcaaatacgacccctcctttcgaggccccatcaagaacaggtgagctctgggcactgctccgggggctggcgggggtggtgggtgcagtgtggaatccagtatttgctttgtatttgctaaaatattagtaggaaacttgtgaaaaagagaaactcctgccccagatgggtggtgccctggggggattgttgtgtctggagcaggcatcgagggcttcccagttctggggggatgttctgtttcttgacttaagtgccggcttcacaagcgagagaactcacccagctgagcccttgcgagttgtgtgcttttctgtcttttacttcagaagaaagtttacccacccagaaaaaggttttctttctttttgtgttttggagatgggggttcactgcaggctcgaactcctgtgctcaagtgatcctcctgccctagccttccgagtagctgggactacaggcatgcaccatcacaccaggctaatttctttgagatgggatctcactatgttgcccaggctggtctcaaactcctggcctcaagggattgccctgcctcagcctcccaagtagctagtattacagtcgtgagccactgtgcctggctaggttttctaaataaaatatttaaaaaaaattagccgggcagtagtggcacgcgcctgtaatcccagctactcgggaggctaaggcaggagaattgcttgaacccaggaggcagaggctgcagtgagccaagattgcaccactgcactccagtctgtgtgacagagtgagaccctgtctcaaaataaaaaagtaaaagcaataaaaaaataaaaataaagcctactgatgcccatgctgcagcatcacccaactctctaacccttaacccctccagaccataagccctacctccccaagtctccttagctcagcctcccgtttcgtttctctctcagaagctgcacagatgtcatctgctgcgtcctcttcctgctcttcattctaggttacatcgtggtggggattgtgggtgagtttccagctgctcagagccagggcagtgggtgagggacaggaacccagggagggaccattcccataactgccccactaagtccctgccctccaatgactcatctgtgcctctgtctgcagcctggttgtatggagacccccggcaagtcctctaccccaggaactctactggggcctactgtggcatgggggagaacaagtgagtacaaaggcgagaagaggagtgcaggagcgaggcgaggtagggtgggcaggagacacccccccaactcaggctccagacctgtccgtgctcttccacagcctttccctgctgtccccaccccacctcagcctccctgaatctgacaactccaggccacgttaagaaccattgctggacagttagcttcttgagtccccccagaaatgggaggcagtggagagtcgtgttaagtgtatgagttttacagttcagagattggtgtttggatccccaactggaccaagttttggttgtgtggccttggacaagttactcaagctctctgagctttgatttccttatttgaaattcaaggggaattccagaagcaatgccaacagtcctcacatacagatgtccaataaataataaaacctcaaatatttatatagcatttactatgttccaggcaggcagtaaactttacacacacaagcgcattgaaatctcatgaggtaggcactactgttttatatggagtagaactaagaccgagaacaggtgacttgctcaagatcataaagatgatatgaagttgtggagctccaagttcatgctctgagctatttgtcagctgctgcaatggtgacttactctgagagatcttctaggcatctccctacctccccagctgagctagggccaggagctgggaggtgactggtatgggccacgctgggctgggcccactgtattcttgagaagccaccctagtggtccctcccctcccccaacacctgaccaggccctgatgcacatggtccctcccctcccacagagataagccgtatctcctgtacttcaacatcttcagctgcatcctgtccagcaacatcatctcagttgctgagaacggcctacagtgccccacaccccaggtcagagcctgggacctgcctctaccccagatctcacccagggtctcaggttccagccccttagtgttctctctgcacccaggtgtgtgtgtcctcctgcccggaggacccatggactgtgggaaaaaacgagttctcacagactgttggggaagtcttctatacaaaaaacaggaacttttgtctgccaggggtaccctggaatatggtgaatattgcccctaacctcatcactgtcgcccagaagggccagggtgggcacgagagggagggggagttgggtagatcatcaccaggttggctctcctggggagtgtgggacaggctgagccccatggtggtggtgaggggacctgcttcttcatcctgctctgtgtctgtgtgtctgtcctttcactcctgccacagacggtgatcacaagcctgcaacaggaactctgccccagtttcctcctcccctctgctccaggtgagaagcacagattccttcctcagacgtcatctagtccagtgttttcattgcttgaatgaagaaatcaggcccagagagagtgaagtcacatagcttgttggtggcaaaattggaattagcatcaggtcttcattttgctctttgttatgtggccttgcagtcagaccatcagtgttttggggacctactatgtgccaggtgctggggacagaggcagggataacaactgctccctgcttcagctacattctaggtgaagagattagagttgttcacaaagagactgtatgaaaatctcatgaaaacatacatgggtgaatctacacacacatttttttttttttgacggagtcttcctctgttgcccaggctggagtgcagtggcgtgatctcggctcactgcaacccccgcctcccgggttcaagcgcttctctgcttcagcctcccgagtagctggaattacagcacatggtgcccgccaccacgcccggctaatttttatttttattttatttattaaatttatttattaaatttgtatttttagtagagacggggtttcactatcttggccaagctggtcttgaactcctaacttcgtgatccacccaccttggcctcccaaagtgctgggattacagacatgagccaccacgcccagcctgcacacatatcatttttatatatgcacagggaaaaggctagaaggatatttgttcaaatgttataagtgaacgtggctgggtggtaggatcacagttgaactttttttcttttacagtgtgctcttccttccagtagcaaatgtctttttttttttttaagagatgaagtcttgctatgttgcccaggctggtcttgaactcctcgattcaagcaatcttcccacctcagcctctcaaagtgctgggattacagacatgagccccgacacccagttgcaaatgtcatttttaatataaaacaatttttaggccaggcatggtggctcatgcttgtaatcctagcactttgggaggctgaggcaggcagatcacctgagatcaggagttcgagaccagcctggccaacatggcgaaaccctatctctactaaaaatacaaaacttagctgggcgtggtggcatgcacctcttatcccagctactcaggaggctgaggcaggagaattgcttgaacccgggtggcagaggttgcagtgagctttgcagtgagccaagatcgtgccactgtactctagccttgctgacagagcgagactccgtctcaaacaaaaattttaggccgggagcagtggctcacacctgtaatcccagcactttgggaggccgaggcgggcggatcacaaggtcaggagttcgagactagtctggccaacatggtgaaaccccgtctctactaaaaatacaaaaattagccaggtgtggtggtgggcacctgaaatcccagctactcgggaggctgaagtaggagaattgcttgagcccagaggcggagtttacggtgagccgagatggtgccactgcactccagcctgggcaacagtgagactccatctcaaaaaaaaaaaattagacaatttatagcataagatgagatatccagttatcaatttaagtacagtaaggagtatctcaagtgaatacttcaaagtcaagtagatctgaatataaattctagcactttccagccctatggtcttgacccaactatgcaacctctctgaaccttgtttcctcatctttagaatgtaaatgacagtgaggtgcagtggctcatgcctgtagtcccaactgctcaggaggctaaggcgggaggatcacttgagtcctggagttggaggttacagtgagctatgattgtgccactgcactccagcctgggcaatagagtgagaaaccctgcctctaaaaaataaataagctaggtgaggtgactcacacctgtaatcccaacactttggggggctgaggtgggaggattgcttgagcccaggagtttgaggccagcctgggcaacacagcaaaaccccatctgtacaaaaaatttaaaaattagccaagtgtggtggtgcacatctatagtcccagttgcttgggaggctaagtggggaggatcgcttgagcccagaagttcaatgttgcagtaagctatgatcatgcagctgcactctagcctgggtgacagagcaagaccttgactcaaaaataagaaaataaataaataaatagataaataaatgacaaagcaaggctgcctggcaaagttgttgcaaggatggcagtaagtggctctgtaggcacataacagttgccaaaggaggtggggataaggtcagaaggcttcctggaggaggtgagatggagctggatttgaacagggagtcatggatgggatttctggtggaaagagagccctgagagagaggcacagtaagagcaaaggtacagagtagaagggaacatgggctggatttgcacaggagagcctggaagcctggccagggagtgtggatgctgtctctggggcagagcctctggagatgtctgagtcacaaagggacccagaaccctggagtgatgaagtccaggcagtgccacggtctccctggcactccactcgggtggagggtggatggaagggtgacagggtgttctaagagttgaggccagcggagaggagggtccaaaccaaggcacgacagggaggggaggcaggggatagactgggctccacagggcagaagcccatttgtgaaatcaaaagcagcccactgagggatgcaaggcccatcacccttccctcccctaagggcactgtggactgggagggggccagagaccctccaggcagagctcctggcccccaacccagcagcccggctctcccttccagctctggggcgctgctttccatggaccaacgttactccaccggcgctcccagggatcaccaatgacaccaccatacagcaggggatcaggtaggcacctccctcccccacatcctggccacaccccttccacccacagccccatctgactctgtctccccaacagcggtcttattgacagcctcaatgcccgagacatcagtgttaagatctttgaagattttgcccagtcctggtattggattcttgtgtgagtcaccagattcccctcctcttgtgtccttgccttcttcctccctgatcctctaccccctcgcccaatgtctgaaacacaggctttggacagaggaggaggagccagagctccgaatggattccaagaccaacaggatttataagggaaagaggcctaatctggggacattgggtggtgtgtggaaaggcagggagggcctctgtaaggggaaagatttgaggggctagggctgaacctcactgtcctcaccctgcctacagtgccctgggggtggctctggtcttgagcctactgtttatcttgcttctgcgcctggtggctgggcccctggtgctggtgctgatcctgggagtgctgggcgtgctggcatacggcatctactactgctgggaggagtaccgagtgctgcgggacaagggcgcctccatctcccagctgggtttcaccaccaacctcagtgcctaccagagcgtgcaggagacctggctggccgcccgtgagtgtcctgcccacccccaagccaccagctgcccaaggaccgccctgggccatgcccggccccagccctggccctgacctaggtctgtctgccccgtcctctgcagtgatcgtgttggcggtgcttgaagccatcctgctgctgatgctcatcttcctgcggcagcggattcgtattgccatcgccctcctgaaggaggccagcaagttagggcctgcctgggagggagatggggttgaggacagcgtggacccaggagtgctaggggacctagggggtgctagagaggtggcagggagcctcagaggagaagggaggaatatagcacagtggtgaacactgctgtggctttgcttccccatctgtaaaatgggggtaacaataattcctgccttctagggttgtcttgaggattcaatgagtgcctggaatatgacataggccttctagaggggttggtgggagtggtggtggctgagtggaacggcaggaatccgggccaggaggggcagcagcttgctcccgatcaggaactgccacacacacctgccaagggatcacgcttgggggtgatcttcccttactccacccgaagctgccccaggtggcttctctgtgaccccagtttcctctaagggtcctgtgagcctgatttattcagttctgtttatccagtgagcacctacagtatgcctagccctgcaccaggccctgaggacacagatatgaaagacaatgtcactaaccctgttggtcccaccctgggggagtggggcaggccccagtgagggcagaggggtcagcccccccctttttttttttttgagacggagtctcgctctgtcgaccaggctggagtgcagtggtgcgatgtcagctcactgcaaactccgcctcccgggttcacgccattctcctgcctcagcctccggagtagctggcactacaggcgcccgccaccatgcccggctaattttttgtatttttagtagagatggggtttcaccgtgttagccagcatggtctcgatctcctgacctcgtgatccgcccgcctcagcctcccaaagtgctgggattacaggcgtgagccactgcgcccggccggggtcagccccttgagaagatggacagctggggcggtgccggttaacagctttgtctccctgcagggctgtgggacagatgatgtctaccatgttctacccactggtcacctttgtcctcctcctcatctgcattgcctactgggccatgactgctctgtatcctctgcccacgcagccagccactcttggagtcctggggggtgatggaaaacaaagcaatacttgccctgtagagtgccttggtgtcactggaagaggtgcccctttctctgggcagacacaccagcactgtgcctgaacagagttgaaagggtgcacacaggctgaatttcagccctctctgtgcagcaaacgatctgcacaagcacctaggaacaggtccctaaggagcgagtgacctgtggagacctcgtgtgatcatgctttccttgactcccctctgggtacctggctacatcggggcaaccccagtatgtgctctgggcatccaacatcagctcccccggctgtgagaaagtgccaataaatacatcatgcaaccccacggtaagaggaagcaggggacatggaggcgggactagtaggggtgaggggctgtaggggccacattcctcattgtgcagagaagactgaggccacagagggcaagaaacttgtgcaaggtcacacactcaacccccagcagagctagaagaaaccagttcccagaatacctggtactcctgttgagccatccatcatgtggggagggaaactgaggctgggagagacagccctggataccaggacttactccacccctccccaggacattgctctgacttgaggaccatcaaccacttcaccctctgagtctcagcctactcctgtttgtttgtttgtttgtttgtttgtttgtttgttttgagacagggtcttgctctgttgcccaggctggagtgcagcagtgcaatctcagctcactgcaacctccatcccccaggctcaagcaatcttcccacctcagcctcctgagcagctggaactactagcgtatgacaccacgccaggctaattttaagctttttgtagaggcaaggtcttgctgtgttacccgggctggtcttgaactcctggggttgccccgatgtagtcaggtacccaagcaatcctctggcttaacctcccaaagtactgggattataggagtgagccaccacatgcagctccattcctctgtaaaatgaggataattataatacccatccctggggtggctgagaagatgaaatgactttgggcacataaagtgcttagtacaatgcctggcacctgataagagctcaacaacaggttgaattgtattatattgttaagtcttactcccttggaacacagagccctaggtagtagccaggtgggactccctgcgggggacccgagagagaagctgcttccaaaattcccctgtgaggttccccgggagtggcgctgggctgctgggaatttactcttctcaaacctgtcatatcttcacctcgtctgagctgggaacatgagctgtgctgcaggcattagccccacccctattaaaaaggggaggtttggcaggcgcggtggctcatgcctgtaatcccagcacttaggaggccgaggtgggcagatcacctgaggtcaggagtttgagaccagcctggccaacatgacaaaaacctgtctccactaaaagtacaaaaattagccaggcatggtagcaggtgcctgtaatcccagctactcaggaggctgaggcaggagaattgcttgaactcgggaggcggaggttgcagtgagctgagatcgcgccattgcactgcagcctgggcggcgagactccgtctcaaaaaaaaaaaaaaaaggtttatttacatgtacagaggacccactatgtgccaggcactgggtatacaaagcccaaaatgatgtggttctttttctttttcttttttttttcttttttaatgaaaaaaaggctgttacacaggctggagtgcagtgatgcgatcatggctcactgaagccttgatctcccaggctcaagtgatcttctcacctcagtctcccaagtagctgggactacaaacaagtgccaccatgcccggctaatttttttttttaagagatggcgtttcactatgttgcccaggctggtctcaaacaaatgggctcaagcaatttgcctgcttcagcctccaaaagtgttgggattatacacatgagcaactgtgctgggtatgacgtgagtgttgttttcaacttgcttgtgatctagcagtaaagactgacagaaggccgcgcgcagtggctcacacctgtaatcccagcactttgggaggccgaggcaggtgaatcatgaggtccagagttcgagaccaacctggccaatatggtgacagagtgagactccatctcaaaaaaaaaaaaaagattttttgattagccaggcatggtggcacacacctgcagtcccagctacttgggaggttgaagcaggaggattgcttgaacacgggaggcagaggttgcagtgagctgagattgagccactgtactccagcctgggcaacagagcgagaccctgtgtcaaaaaaaaatttttttggttatatttgctagaaagggttgctttttaatttgtgactttttactttttattatgggaatttttaaacatatgcaaaagtagagatgatagcacagtgagttccctgtacccagattccacaaccctcaactttttgctattcttatttcatctatatcctcacctataattttttttttttttgagatggagttttgctcttgtctcccaggctggagtgcagtggcgcgatctcggcccactgcaacctctgcctcctgggttcaagcaattatcctgcctcagcctcctgaatagctgggataataggcgtctgccaccacgcccggctaattttttgtattttcagtagagatgggatttcaccatgttggccaagctagtcttgaactcctgacctcaggcgatccgcccacctcggcctcccaaagtgctgagattacaggcataagccaccgcacccgcctcataaatttttttttctggagacttttaaggcaaattctggacatcatgccatttcacctgtacatgcatcgagatggatctcaacagataagaactgtttaaaagcatagccactatatcattatcacatctcacaaaattaacaataattccttaatatcatcaaatacccagcctgttcaatttgccggaaagggttttggtagacgttgcagaggctgctctggaatgggaatgctgagtgagtgccttcccctctgattgagactgagggagctgattatgcttatgctataggcagaccaaactgagtttgagcctggagatggaactctccgacagaacttgattcccgcagtccagagaagctacttcccacctgtcaactctgggaggggcaggagctactgggaatgggacgcccaggctccatactgaggcccccgatgcctgagcctactctatccccgtctaccctcccaggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccggtaaggatggggcaggggcctggtcattgtaggcacgggggccccaggggtcctggagctgtctctgactgcataacaccctctgcagttaccacactgggtcattggcatttggagccctcatcctgacccttgtgcagatagcccgggtcatcttggagtatattgaccacaagctcagaggtgagtctggagtcggagtaggagtcaggagctggggaaggccattagggaggggcagtgaccaaacatgagccttcctcgctcccaggagtgcagaaccctgtagcccgctgcatcatgtgctgtttcaagtgctgcctctggtgtctggaaaaatttatcaagttcctaaaccgcaatgcatacatcatggtgagctacactgcaagcaaccctttgttctggtgccctttggtctagacacccccatcctggtccaggcagctcgccttggtaactctgacctttccacctccctcagatcgccatctacgggaagaatttctgtgtctcagccaaaaatgcgttcatgctactcatgcgaaacattgtcaggttaggctgctccccccccgctttgtggctccctcctctgatctcccacccaaggctggcttcgtgggtgtgctgtgctcagtcgggccctagacttagtttagtgctctgctcttgccatcttgaaacgtgaacaattttcattttgcaccagtccccacaaattacgaagccaatttcactctcagcattgccaggcctctcaccctcaacctgccctaacttctggcacagggtggtcgtcctggacaaagtcacagacctgctgctgttctttgggaagctgctggtggtcggaggcgtgggtaagggaccagaagctgtggggacagagggtaggggtgctgggcagctgaagaggtggcctcagaggtgcagcactaacccccagaattattccacaggggtcctgtccttcttttttttctccggtcgcatcccggggctgggtaaagactttaagagcccccacctcaactattactggctgcccatcatggtgagtgactcccctctctgctgctccacccccaactccccagaggaacccaataaccccaacgggtcatgtcttccagacctccatcctgggggcctatgtcatcgccagcggcttcttcagcgttttcggcatgtgtgtggacacgctcttcctctgcttccgtgagtgacacccccagccacctgtccccaaccttaaagtactgagccgttcaagcatttttttttttttttggagatttggtgcttctagaaacaatgcctttgtgagctaaacgaaccagagggagcttcttgtgacatcctgaggccaggcgtttagggaagaaggaagagagtgagcccccaggccggtaggctctccaaagaaggagcattctgatggagaggtctctgctatcttccctaagaaatctcgggtagaagttagccattagaggccaggcatggtggctcacgcctgtcatgccagcactttgggggaccgaggtgggcagatcaccctgaggtcaggagttcgagaccagcctggcccacatggtgaaacccctctctactaaaaatacaaaaaattagctgggcgcggtggcgggcgcctgtaatcccagccacttgggaggctgaagcaggagaatcgcttgaactcaggaggcggaggttgcagcgagccgagattgcgctactgcacttcagcttgggcgacagcaagactccgtctcaaaacaaagaaaaaagattaaaaaaaaaaaagagccattagagagacttcccagcaggtggctgtagcggcaggggattttcttactctacagcatgcatccattcagggtttgccagtctcctcctaagcgactgacatgcattttttccgctaattcttatcatcgctctatgcaacataatattcccgaccccacttcacaggaggaaactgagattacataacctgcccgggggtaagggtggtggtgcagcttggattccaaatcccgcaggcagcttgcctcccagtccccgatttcctggccccagggtccgctctaaccggtctctgttgcggctcagtggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactc

SEQ ID NO: 36780 - DNA, 248574 bp, Homo sapiens
gccctaagccatcagcaatccttagtataggggcacactcatgcattcctgtcaagtcatcttgtgaaaggctgcctgcttccagcttggcttggatgtgcaaccttaataaaactcactgaggtctgggagaaaatagcagatctgcagcagatagggtagaggaaagggtctagaatatgtacacgcagctgactcaggcaggctccatgctgaacggtcacacagagaggaaacaataaatctcagctactatgcaataaatatctcaagttttaacgaagaaaaacatcattgcagtgaaataaaaaattttaaaattttagaacaaagctaacaaatggctagttttctatgattcttcttcaaacgctttctttgagggggaaagagtcaaacaaacaagcagttttacctgaaataaagaactagttttagaggtcagaagaaaggagcaagttttgcgagaggcacggaaggagtgtgctggcagtacaatgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaagtaagtgattgctttcagtttctaatagcacggacctttttcctttcttgcactgcagctaacttaaagttccttaggggagcatttgtgtatttaccttttgctccaggggggcagtgtttgcaattgcaagacggctgtctgggtttggcttcctgggtaagccaaggtttgggggcttgcccaaacctatgaatgtgtgggggcaccccgtttgtgtgtctagccctggcaaattttatgacatttttggtttctcttttctaaagttcagcattaaggttctctctgtcaaaacactaccttaagaaagaaagtatgtacctcttaagcaagttggtgaaaaataaataataatgacaatattaattaataagatcaaatcgattttgcaccagaaaattttgtgccgctggggtggcaaatcatcacaaagtatttgtttttttaacctttataaaaattaacatgaagtgagagtaaatataaaatatgatatttggttggagaaattgtatatttatgtaaagggaactgttagtttcagcaagtggtagaatagtagactgatttctgttaaatatttttttcttctgtccttgagaaaaaaaattaaaaagatacattgtaatgttaactgtcggaaaggggttgctcgctcacgatgagggcatgctggctgttgaggaagacatgcacctgcagatatgggctgaacgcagcatgtagtctactatattcctgaaatacctcccttctcagggcattgtagttagagacagtacctggcgagtttaagtatccatgttatttgatgaatgttaatgttgagtatgaatgtaatctcaatttatagaaatcaaatcgaatagtttatccagttatttatctacaaaccatttaagtttttgttgaagataagcctattaaattatgaacacacttctgcaattcattctgtctttgcactctgtttaataataggcagccgagaataagtatattcaactgactatgctactagaagggaggcaatgtctcaatttgtgaaaagcttctctcccttgttaatggattcacttggtacatgtagataggtatgcaatcaggcttctttaagttagtctgttaaccgggcaatccctttaaaaagataaaagatagggaaaggacaaatgctctattttgttcctgtgtggtcacactcacttaggtcattgcctgctgaatcatgccaagtaatagttattctacttttgtccactagggactgaactaagatcactgttattttatttgacacattaactggaacttagtagttctacagtttccaaagctgatattgtaatctttctattacagactataggactgtaataggcaatcagtaggtaggcagaagaataaaaagcaaacagaactctcaggttttttacaattgtagctgaaattttatgcattactttcagtagtagtttataataggatgtttgtatttttctttggtaaaatttatttccattgtaaacaaatgattttggttgaacagcttgttattattcttcagtacaccatccgtatagtttttagtgagaattcaatcattacatattagtctggattctttgagggaacgggaaggaaaatttagtcccaagttatcctgaatgatctattctaccaaaaacgtaatgttttgtttgcttaaagcgtataatcacaatagtgattcaaacatagtaatgcatatttcttgttgctatgcaattattcagcagtgacagggtaaacacataattctgctgggcttaaatcatgcacgtgtttcatatgttaatttattttgcaaaataaatttgattcttgtttgcattgttcttggtcaatgattatgggatagctttcagattatagccaagaataactattaaaatgttctttggttacattcaccctttcaagtgtaaaaatcaagctgaatatatgctgaaaacgtccctattggtatgagtcagagcaatgtggcttgactattgtcagtttaaatttgcatatcttttgtcattgtcaatgtgattggttggaggatcaagaaaccaaaaaatgcattcagcaaagaacttgctaaaggctttcataagtttcccttaattaggagttttcttcactccaagttctaaacttcatgtgatatttttattctgataattgaaatggaaatctttttactgtaaccatttggtatgctcagtactgcaatttgtattacttctattttgattccaagtagttgccataggaagaagcaacaccctgcagaaactgaggctatcagtgtatgtaggtgaaattaatttatccatttatttggcaaaataattaatcaaagcatagtgattattatgcagctcatggcatcgctatcaggaaaggttttgaggcagaatagatgtgttatcaactctaaatgaagctatatgataattatgttaatccatcaccttccatgaagggaaacctccttcctcaacttttctggtcttgcaactgaacaggatgagaagcaaggcatgcaagggggcaaatgatttgtgggtcaccataaatactggaactgttatggcactgctttcttgatgtgatggatttaattcaaagaaatcaactttccataatcacttgtcgattaaaatgaggtaggttgatagcattattgtgacatctcagaccaggaagggtggtgtgaataatatgcctaacatcatagttttattttgtgaaacacctgggtgtgtttctggtttgatctcttctgtaatacagctctttttggaattattagcaagtcatagtaaatacctgagagtgaccagctcttagataagtaatgataaatacagctggcctctgtgtctttgtcactttcttatgatctctccctacctctctatgacagtgaaacatttagcccacatcctgtactttgtgaactattgttttctgtctcccacatctcaaaaagttcacaaagatgtacatttaaaatatttagatttaaatatgtataatgttctaagatttggggaatccttagaagatctgttttgcttttgccaaatgatgtctttttttgttaaaagtttaaataaattgagtcaataatgccttgtaacagaaaacaatagtctatttgctatacatattttacactagctaaaattgatgactattaatggaaaatatagttatgaattgccatccagaatattttaagaaatacaaagattttactggactatttagctgtttttctattgacaacattttttggttaaggatgtcccctatttgcatattgtattcttttcttcagagttaagatttgaaatgctattacccaaaacacattgatgatgacgatttttttaaacccatatattacatatatattaatccctattaatatccattagaatgtgacctccatgaggccagtgaccatgtgtgtttgtccaatgtcataacctcagttcccagaagagtatataacatatttataacagatatgcaataaatatgtgttaaatgaaaaaatgaatgcattatctattgcattctgcactttactgtctactgtcagcattttattcgaggtatacaccttacctcttcaatagattgtaagttgtcctataggcaaggactataacctatggttatttttgtcctaatactagttaaaacaatattgggtccagagtaggtggttattaattattcaaattatatttaaccagtaatctagaatctcaaaaacttctctagtcactccaattcatcttcttaattattctttaagggtcagctctgttgccagtttctccaggaaatctacccacactccacttaccctcccaggctgagttctcaaatgtcatcacagtacattgactgtatcatgttaatgctgtagttcaaagttgttgtggtggttgttttaattgtttgtttctaggcttgttttcccacctagactgtgagttcctcaagtgtagtaaatgtcgcttatccatttttatacctctgaacatgttcattaagggtctggattaattttttgttattgtaataatcagtttttaagaaatcaagtgctcaagtgtatagtggtaactataaaatagtgaaaattaagggaccttgtaactactttaagatgctaaagtctgcttaaatgttagcactaggctacttgagggtcagctagatattcctttgtacaataatgttttgtacttctataagcacaagaacttagtatttcttgttcagtacagtagggagccatttactgcatacatctgtataatatgtatatatctgtatactatatgcacatgagaacttaattataataatatgcatctgtataatatgtgcacatgagaacttaattatattaatatacatctgtataatatgtgcacatgagaacttaattctcactggtatattattgttttggtggccggtggtggctgtgcaacagtcagagagaatgctcttatgttttattttcacatttgtgggaacttcctaaatgtgtgaaatgggtacatattggccgggcgtggtggctcacacctgtaatcccagcactttgggacgccaaggcgggcagatcacctgaggtgaagagttcgagaccagcctggccaacatggcgaaaccctgtctctactaaaaatacaaaaacttagctgggcctggtggtgtgtgcctgtaatcccagctactagggaggctgaggaaggagaatggcttgaacccaggaggcggaggttgcagtgagctgatatcgcaccactgcactccagcctgaatgacagagcgggactccatctcaaaaaaaataaagtagatatttagtaagtatgattttaataatttgtcactaaacgtgaaaataagatacatgcacaatttatgcctagagattgggaaaagtaacagttgctgagaaagattaatagaaataatgatcttttaaatcgagttgtagaaatgtccccatcaacttcatttgaagaatagacctctgattttcaagccaagtaagagcccttcagaatctgtattaacttttcaacaaatagttcggtattattggttgcttgttacattttagaatcaaaagatccaaaaaaaaccctttcagacccagaagttaggcagttagtgttataacagccttttggtaaactgtctccattgagagagctcaggttttagggctatgacaagtaggtccttttctatgagtttctatgggcaattacagttcttccttacccctgactgtaccatttcacattgagctttcttttaatagcactcctctcatataaaggtattggcttaatgtaatttaaatgaataagaatgtcatttccccccttaaaatcctcctacaacttctcattacataggaataaaatctgaattcttaccaggaggtcttatatgatctgccccacacctctcactggccccatcatttactaccttcaaacgacattccagacactcaagtgacattggccttcttgttatttctccaacagacaggctcattcctgcctcagggactttacaagctgtttactcagctcagaaaattcttccccctgatctttgcatggttggctacttctcttcattcaggtcttcactcagcagtcttctcagaaagtctctgagcaccattacctaccaccttccccactttactaagagactttctaccttattatactgttttatttcttcatggtacttgctactgcataatgctgtgttacttattgtctgtcagattatttattctatctccgcctactaagaatgcaaactccattagagcagcatccttgtctatctcgttgatgcagtataccttctacctagaagagtggatgacacatggtagaaccttaataaatatttgcagaatgagcgactctctattttcatagacactatgctctatgaggtacatgatgcacctgtcttgttcactagtttttatttcttcttcttttttttttaatcatttctggtagcagattgacttttctagcacaatgcttacagcatagttggctctatttattattttttaataaatagggaaataaatgaagtccatgagcagatttggactataatcaaattgatgggtgaaatttgatgcaactatattttacatattacctttttaactacataatggcagaaattttattaatattctgagtttccatcctctctatcaagggtcaacaagcgatggcccttgggccaaatccttcctgccacctctgtttgtaaataaagctttattgaagaacaaccactttccttcctttatatgttgtccgtgcatttgtaaataaagttttattggaacagagccacactaattcatttatgtgttgtctatggctgctttcatactacaaaagcagaattgaggagttgcaacagagcctaaaatacttaatatccagcccttttgagaaaaagttagctgacccctgccctatattgcaagaggaattagtattagtattgggaccattgcaaggtagattgtaaggtttgttgtgtgggaaaaagatcgccctccaggaggcccagtaatcttcaggttcatgccagttggcagagagcctgactaagccatttcttggctgggtgtctggacatgctgtgaggtgacattttagaggcacacaaacaagggaatttcatgtcttttctttctcctgcccatcatcacaagaacagggaaatattcctaaagcagatacatatcagaaaagaaaaaaaaagcacctgaataacaatacagaccagcagcctgtggataaacaagtctgggctacaggatcttctgtgctatgtgcctgtttcatcctgttggttgtggcattagcaagaatgctgacaaaacactagagccattctattttcttagaaatggggcttcagctcagcctcttattagaaacctttcccccctgtcatttgttttaagtataaacattagaagtgctctcacttgtgcagatgatgagaggggaggagcgataagtgggtagctcagctacaaaacacagagttttatcagcccctgtgctataatttgctaattaaggaggttttgttttcattctgccacagccttgtctctgtgtggatacattagcagccttttcctgggccttgtgttcttttcttttcttctttttttttttttaataccgcaagctatattgtgtcatttgcttagatgcacaaccctaattacattctgagtcatcctcgacttttgtcccaatacaagattatctttggcggtggagttgggaaattccaaaccccctttggttttggccccatggtctgagggagggagggcatctccatgtttaaatcttcttacaatgtgtacaaaagatgtgccccctctcttatcaaagaggtttttaaagaatgacgccctccatggattatcttctctttacatttggaggctatttccatgtaggatctatacctgaatactgttatctaattcgaaataattagaagtgagagagctttagattcatttggtcttagttgtctgctcaaataatctgaattttttccttcaagcaaatgaaaaggtgattttgaacagagaaagtagctaataatttcatccagaatgcatttaggcctatgaagatcttttcttttgtcagtaagtactgaaaaatatagagtaagataactgttgttacttgtttatactatactacatgactgtgcaggtcacttattagaggtctatctaggaatgtgtttcctaagtttgtgttgaactcttgaaaaaacatgcaaattagcacaggcattgaggtgtgtctgaagtaaatcagcagctgaaatatgaataaaatgcaagtgaaaaaaatctgaatatcttaaatcactagtaatatgtacctataagcgaccaaactcactggcatcagataggtaaacttactataaatttcaacgaaatggcttatgataattttgaaggatggcatattgtaaaatttagtgacgtgtgtagctctattcattaggaaggagtatgctttattggtagtctccactttgtttctgaaggttaaataagttaaattacaatgcttgacccttcaagattattggagactttccattcccagagaaccaataaatattttaaaatcccaaattatagttcttctctaaacccttaaagatgaaagatagccccaggatttcataaaacattttaacaatgttcttgtcttcactcttgatatagagctgactagattaaagttcagtaggtttttattgtagctcaaggtttgccccacccagcaggtcttgacatccaccttattttaattgcacagatataaggggtgagaattgtaaccttattaccagtattatcagtcttcttattattttctaattctactcagtttttaaataataagaacaaaggtataaggttatagttgttctaatgcttgtagaataaatgaatgggtttattgaataagttgaatatttaataacttaaaatgtcaataataaagacaatatttttgaatcaatgaactgatgaattttaaataattcttggcaatcgaacctgattttcaaatgaattattccgcagaagtttaatatctagaaacaaatggagaggttacagaagaagtggagtgaggcctccttctaaaccctcttcccttggccctccaagagcattccgcagggcatcccatatgtccaaaggaacatagtttcaaaatagctgcaagaaaactttcaaataatcaaatattagttaggtaaagctgcccaaacctagctactggtgggcacaaagaaacattacattcgatagtttgaatttgttgccaagctgttgtaagaacatccaaatctgccttacagaaagcagtttaagggtaccaattgtaaatttcaaaaacaaatgcagattgttttagactcttaaaatactgaggcccacccatatttcacatgacacaaatttgataagataatagagtactcttggttaattagcggcaaattctataatttatctaatcctttaattatacaattgtatgatagtgtacacttatctacttttaccttaagaatgtagtatttgatgattgcctcatattgtaaaggatactattcacttcaagcagaattcattgtcaagaatagtgaaagaaaatctgaatttcaaggaggaattttgatattttcaaaattctctgatgatttgttagatctacttagctaaccttgtttttttacttctaatacatggcacttaccaagaatagaaatctcaagaactgctattttcttgtacacatgtgccagtatttttgtgttttttaagacacttgtccatgttgtaaatattaatttagtttaaactatataaaataatccatgagtccgttttcccaaatacactgaagctgtgctatatcataatgtgctgaaagaggacaatcaagtgaggcagccccatcaatttctttagctctctggagctttttctttttctttcttttttttttagcagatgaatgacgcacggccgcttaatatactgatggtgtgaaggctccaatgttaggccttatatgaatttattattaactttcttattgttttagaaatgaaagttctaatattttttctggcttccaaatggtttgcttttttcaacccccactttgctcattctgcacgttagagacttctgagattaaaagcaggaaagcagaggtggcaaggcagccctcagaccaggcaagacaaaaagattcaaagggacctcccggcctgtctctcctttttatttctcttgtctcctccattattgtttttaataaagtctcctgtgatcctccccatgctggccatggagtgggagtgctgcaaagaggatggacgacagggaaggtgaatgaacagagagaccagtgactgtccctttattgggacatgggggaggggtgacacagtgagggacgggggactatagcagtgtcaggaggactgctccatgagggatggcatgagttttgtcatgcgcttttaggatacaggcaggagtcatagagcttagcacctgcaattaacaaagggcaggaaaccagttagccagttacctaatcaaatatgcacttcagccaaggtggtctgcaaggtactaggaagatgtaagaaattcactaaaacccctgttgttgagaagcctaaacccactgaaacagacttaaaagcaaggacattgtttgtgtccactatttcctatggcaagtttaacggtagtacagcccagtgatgaagtgtgtcatgcctagagtcaaactgcttggatttgaatgctgatagcaccactgacttgctgtgtaaccttgggcaagcttcttcactgctctgtgctgcaatttcattatgggtgaaattgaggtgataatagtatctatgccatagagttattaagtgcaagcataatacacataaattactttgcataagtcctgtcacctagtaggtgttacgtaaatactacttattactaggggaagttctgggtacagtgttagttaaatattgagcactttttcaaaactgttgagaccattggaaaaactttacatgtgttaattcattgaatacctcaaaagccaatgtgaggtagatagtgttataattgcctcacgtggcaaatgaggaaactgaggcaggtacagagagtggaagtaacttgcccaggattacgcagtagttaaatttatgggccagcactcaatcccaggcagtctggctctatgacctatgctcttaaccaaatatgagattagctgcagcaacgtttgccatgtctcctcttgtcaatcctcaaaccttaagcctatttctaaaaaatttttctgtagttgtctttgtgtctaaacccttaattctttcatactaaatgtgttgcccctttctcaagttctgtttcacacagccatttgtccccatccacactctaaagctccatggttaaattgacggtggcactgtaggctctgttgctgattgaagcacaatagctgattctctcagccctcccacaggcctgttaacagaccgcagaatcccacgtctgcagtccctactgtgtaactccttagaagcaccatctcttgaagttatagagcttaattgagtctgactatttatctaaaaacttctaaaacacaaagaaaggcttacaattgctttacatggggcgaagccgcctattctaaatatcttccattcaatgtaatgacctccctcttggatttatctgtaggcaatcctgcttggaaaagtgaaagtgcattctggaacttaaaatattatttgcctgcacttccttttgtgggtcatttggagagttgtaaaaatgagaagaaaaaccttgtttccttaggcaatgacctcttatctcacttcctattttatttatcattgtccctattaatgaaaatattcctggtattttgggcccaagccaagaacactgctacttgtagacaattgtgatagttcttcctctcgttttgtctgatcttggaggcctggccactcaaaatttgggttttgagggtcactgcttcccttgctgagtatcagttgcatgagacagggaggctctaagctaccctaaattctccctgtccattcttctccatagagacccaaagaggacaaagcagggtggggacaaaatagatttcagtcattcttttcacccacctttgcatggcgaggtaaaccaaaacctattaaaacagcacaacaacaaacaactcagcgcatattcacttgcttgacctgcgctgtctattgaaagctgagcacaagcaatgtgtggtgtgcgggcattgcaggtgcccagtagatactgttgggatgtgttcatcaatcaacacacgctgtattgctcaagctgtttgggggccactgtttggtcagtgaagttgtctaaaggatacttgtgctaatgctgaataacagagacctttccccaatgtgcaggaaactattaagttatagagtacaattttcttgattttaagggtttctcacttcattgtctccatgtttgtcatcttccatctattgtgtgtgatatttatcatctctcaggagatagctgacaatacagcaaatacatattaaaggaagctgggaagtgacctctcatgtttagttgtacagcttgcattacatgagatacatgattatctactgatataacataatcacattttctgccaaagaaattgctgttgctttcggcacaaaataatttatctgcaaagagagcaatagatactggatgttctgccacatagcaagtgtgaaaatgacttttctgccagacacagtagctcatgtctgtaatccatcactttcggaggccaagactggtggattgagcccaaaagttcaagaccagcctgggcaacatggtgaaaccctgtctctaacaaaataatatacaagaattagcctggcatggtggctggcacatgcctgtagtcccagtgactctagaggctgaggtaggaggatcatttgagcccgggaggtcgaggctgcagtgagctgggatcgtggcactgcactccagtctgggtgacagagtgagactatctccaaaaacaaaaagaaaaaaataatgattttttaaaataaggtattaataaatctaccttggtaaacagtgtcatcacccaaacaaatattttaatacatagcaggtattatcaaacccactttacagataaggaaactgagggccactaaagtcaaatgatttttaagagtttacatatttactttgaggcagattgcagaatttgaacccatactctgagtggttaaatctgaagctcttcactcttcttgcctctttcacttttctttcacaaattacaacaaattctgaatggtggggagcagggaagagattcagatgaatgatgatgtcttgtaagtttttggagaatctatccatactaaataaccatctttggcaatgagaataatttaccatacatgtgtataaattgctgtaagaagcctgatgttcttagggaaaatgcttcctaggcatctttcccatcccagcacaattcttaaaaaactttcacaaatatgtcagaggcaaataattcattgctatttttacttttctttttaaataaatgagctacttagacaaattgccttagttggagttatcctgatatgagcatacaaataaagataatattttaaaacagcttatctgtatttttgttcaggaacacttcattacagtattaggttgtatttcttatatttctttcagctaaaaaacaaataaaaaataaaatatagtcaatagaggagaatcatttaacatcttcaacattaataaattgggtactatttgtaatattctggggaagagtcatcacttaaaagaccttatgccatatatgttttgaatttttttaaaagttcatcagtatgataagaatatgaaaaaagtagtcactgatctccagtctatgcttagaaaaaaagaaaagaaaattaataaacacttgtgaaggtgaaactgtcagtatctcttactgacagtcaagataaactaatgtactaaggagaccttggttcaaataaatgataaaagctgacaatagcagtggaaaactcatactcagccttcaacaaggaaagctcttaactgagaattgaatatagagagaaactaagaagtcttcctgtcaaagaggaaaaagaaatttttattttatgactgttatgtttcatatgagactaaagcttacatactttgagttcacaaatcaaacttgtgcaatttgcaaggaaaaggtcattagggaaatgaattaccctgaacataaattatctctatatagtatcctactattttgaaatgtcttccattggatctaattttgaagattatggccaaaaagatatcataaacaactaaagaattcaaataaactctataagcctattttaaagtttttttttaatgtttcaaataattcaccaaatatttggaaagctccttttctggtcagatacaaaatatcctcttgtgaaaaatgagattaatgtatgtttgttcctcctctgattactgggcatttgagaaatcaatggcgaagtggtgattttcatcagaaggacacatcattccaacccattcattcagtggaggtgttctggaatctttaaggaagatcgagtttaaaaaattatatatagtttttaaaagttagaacaaaacacacccacctcaccatatttgagtaataaagctatgtaaagacatacagttatttcttttttaatttaacaaggtagaaaaagtacaagtaataggtagagaacaggactggatggtaaatgattataatagcacttcctgtcttatatgccaccctctcatgaagagttcccctccccttgaatctggctgggccataaaagggaattgaattcccatcttgtgcactacaatactcatgccctgagctactgtgttagaagtccatataccccaaggccatggtgttgtgaagaagtcaagccacatggagaaggcatgtgtaggtgctgtggttagtgagtctccatatttgagtcacctcaactcaggctctagacatgggagcaaatgagccttcaaagctttctggtccccacccattgcactatctctagattcggaaaaggttcagaacatcatggagtagaaacaacccatccctacagttccttttctgaaatcctgactcatagagtctgacagcccaatgaacataatcaaatagttgttacaaactactaaatttggagggtaatatgacggaacttcaaaaaattcatggaagaaaataattgaaagataaaaatgaaaatgtaaactttatttcttaacataagctacatcaggttcaactcactcatataagccgtgataccagccatcttagtccatccctaaagaactgaaggtccgggaatttaatcattatcaatgcagtctttttttcattattaactgaagggaaataagtacctgatatggtttggctgtgcccccacccaaatatcatcttgaattgtagttcctataatccccacgtgttgtgggagagacctcataggaggtgaattcgattatgggggcagttttcccatgctgttctcatgagagtgggtgagttctcacgatagtgagtgagttctcacggaatctgatggttttataaggggcttcccccttcgctcgggactcattctctttcctgcagccctgtgaagagatgccttctgccaagattgtaagtttcctgaggcctccccccagacactgggaactgcgggtcagttaaacctcttttctttataaattacccagtttcgggtatttcttcatagcagcatgagattggactaatatagtaccttttacagattttcttttcttcttccttttttttttttttttttttttttgagacagagtcttgctttgttgccaggctggagtgtagtggtgtaatcttggctcactgcaacctctgcctcccaggttcaagtgatactcctgcctcagcctcccaagtagctgggactacaggagcccgccaccgcgcctggctaattttttgtatttttagtagagatgggctttcaccatgttggccaggatggtttcgatctcttgacctcgtgatccacctgcctcagcctcccaaagtgctgggattacaggcatgagccacctcacctggccccttttacagatttttaaagagtaagaaacaaaaaagtcagaaagagccaaatcaggactgtaaggtggatgcctaatgctttttcatggaaagtcttgaaaaattgcccttgtttgatgagatgaattagcacgagcattgtggttgtgaagaaggactctgctgaagtttctctggatgtttccatgctaagcattggcaaactttctcaaaacactctcataataagcagatgttatggttctttggtcctccagaaagtcaacaaataaaatgccttgaagatccaaaaaaactattgccatggcctttgcttttgactggtccactctttctttgactggaccacttccacctctcagtagccattgctttgattgtgctttatcttcaggatcatattggtgaagccatgttctatctcctgttacaattcttcaaagaaagctttaggatctcaatcccacttgtttaaattaaaatttccattgaaaactctgctcttgtctatagttgatctaggttatatggttttgtacccatgaagttgagtggaaaatttgctcaattttaatttttcagtcagatgtgtaagccaaataaattgaaatgattgtgatgttggctattgttcatgctgttagtcatcgatccccttcaattagggcataaacaaagaaaaaattctatgtgtgtggatagtctgctgctgcaggcttcatcttcaacattttcttgtcccttaaaatgagttatccatttgtaaactgctgattactttggagcattgtccccataaaatttttgtaaagcattaatgatttcaccattcttccaaccaaacttcaccatgaatttgatgtttgttcttgcttcaattttagcagaatttatgttgttttaataagggctcttttaaatagataccttattcttcttagtgcctcaaactagatcctgttcagataggttacaagttagtacaaatgtattttgggcaaacatttttaaacccatgcatagttttttcatattatgcactttccatgagctttttgaagactcccctttatattaaatcaatagcagtgactggaacagtcaccatttacttaggcatacatgcagtgcctatcactataacaggcattgaaaaacaatgtattagacctgaggtctgccttccagaagattgcattccagtaagacttatgacatggataaaaatgtcataaggtttgtttttaggcaaatttttttattgcctctgtctattctcaaaaagttaactatttcagtttcacataagtttagtaagatttaataaatataactggaagactgcatatatttttgtgctcctttgagtaaaattgttgttagtatttttatatctacagaatagtatttttaaaagcttcatagaccatccacactctgaattccacaatatcaaattgaagtgctatatagtttatgtgattcttaatgcttacattgtttgaaatttttctgatcattaaaaatcataaaaatctctgggaatttggatttttgagaatctagtcatgaagttattttataactctatgctacttaacctgtcatgtttaggctgtaagtttgaatccagatgtttctgaaagctgttactgagcatggctgactggtgatctctcaaacgtaaaatgagttagcaccatctgttcagttcccagtggtttgaaattcctgcagtaaaatctatcccagattttccccttcttaagtgatgagcatagaatctggacttgaatgaaacaggtataggaacattctttaaatatatgaggtgctttgcttattacattacatattggttgaaactttttggaaaagagcataacagtaaatacaaagaacatagctattttcaaatcttttaactcagtaatccaatttctgggaatcattcccaaggaaataatttaacagaaggaaaaagcaacatatatgaacatgctcattgcagccaccatagcaggaacacaggaaacaataggtattatttatttggtatttgtttcaataccttgcacacatgatctctaatccccaaaacaaaaaaaaaatctggaagataaacattacccacaatctttgaataaggaaatcacatacaagctcccacaagcagtaagtggcagaaccgttaagacactccaatccgggaccctctgacgaaagatcatgtcttcagtgaccccatgactgcaactgttaaaatcacgttttaaaaagagaagatgcccaccagatgttgtgtgaacaagtaggttatatacctgaataactgaaataatagctaatattttgggcacttagtatgaaccaaactctgggacagatactttaggatattattttatttcattctcacaactctatacacacatactgttattgtcctcaatttataaaagctgtatgtatgtaatagcactgagtttgtgtgtggggtgggtggaagatcactgtgcatttgtaggcatgcacataaaactattgacaaggaacatacccaaaacattcacaatgaataatttttaatggaaaaattgaagagttttaaacattttctcttttatgaagattatgtgtattgtacaatataagcattgacacttttataatcaaagcaatctttatttatttatttattttgagatggagtctcgctctgttgcccagactggagtgcagccgtgcgatctcagtttactgcaacctctgcctcccaggttgaatctattctcctgcctcagcctccccaagtagctgggactacaggcgtgcaccaccacacccagctactttttgtatttttagtagagtggggttttcccatgttagccaggctggtctcgagctcctgacctcaggtgatctgcccacttcagcctcccaaagtgctgggattacaggcatgagccaccacgcccggcagattttttttttttttgaataggtatatttagactgaggccaaataaaagaagcaggagtgatgtaaaacagatgggatcttgactccatgaaattttgaccatattaaaattttcattatttttcaaaataactgttgcagagaaaacaaatataaaaagatctttagaaatagtagcagaatcttgtagaaaaaaaaaaaacaggagaaatattttggaacagggtttttccattggtaacttcattttttactaccgaagcagctttcttcctgtaagaccagctctcaatttactttactcatgtcatggtcatttattcattttataccaatttttatttcttactttcccttgtctttactttcatgtaaagacttatgttgaaagcacccaaaacggtgaattacagagaaagaaattgggtcggggtagtccaaaatccttggctaattttattcttttttttcaaaggaagaaatacatataagaaattttgtttgagatgaacagaagtaagttataaaacagaaggaaagtgaatgagctagttttatagaatataaaatcaagattaatttctccaagacttaatgtggcaaagaaagcaggaataaatacttgagagagagattaatgaagttatgattatgtgagatgataagtatgaaattacttcacaagatcttaatatctatcccagtgcaaattatattgacagccagagcttttcaaaaatttagaaccaatcatgacattgccgtagtgaaaacacacggacccatggtatcctcagaatgaagttcaaactcttaaatctatctttataagctggccctggcttactactccagtctcatctttcacaatttctccattgttctttatgttccagccacgtctaaatgtagcagttctgttacaatatcatgatttatttctcttccttaactttgtgcaaactgtgacccaacaaattccctaactctctcccgctccatcctccatattgtagttaataaacgaatggatggagaggtgaatggacatatgactgcagggataaatgaatgagtaggtgtgataggtcaggcaattcagttttagggaatggaattttacaggtaaggtgacaaataaaatgatagaaacttactgtcaaacttttaaaggacataggcataaacagtagtagtagtgaaacaacgggtttggattctgtggttgcattatgcaagggtggataattggaagctggggtgctatggagagtggcccacacagccctgacacttccttaaagtaatacagaaataagcaagcagataaaaggatggagaagcagctagagaactagggaaaaggttgaattctgaggggaaaatcataatgaacataagtaaataaaaataaaccagaagtcttcatcaaagataatactaggattttagaactggggtcatcacaagagtgctttgctcaggcaatacgtactaaattttaaaaaagcaaatatttctgcatttgtgtcatatggagctgtttaatttcagatgactttacaaggaattcttaatattacataacatgagattgattccattctcatttttctaaatgtgaggaggaaacgacgatcctaaggtgctttcaaatttatttatttatttatttattattatactttaagttctagggtacgtgtgcacaacgtgcaggtttgttacatatgtatacacatgtgccatgttggtgtgctgcacccattaactcatcatttacattaggtatatctcctaatgctatccctccctgctcccccccaccccatgacaggccctggtgtgtgatgttccccttcctgtgcccaagtgttctcattgttcatttcccacctatgagtgagaatatgcggtgtttggttttttgtccttgcaatagtttgctgagaatgatggtttccagcttcatccatgtccttacaaaggacatgaactcatccttttttatggctgcatagtattccatggtgtatatgttccacattttcttaatccagtctatcattgatgggcatttgggttggttctaagtctttgctattgtgaatagtgccacaataaacatacatgtggatgtgtctttatagcagcatgatttataatcctttgagtatatacccagtaatgggatagctgggtcaaatggtatttctagttctagatccttgaggaattgccacactgtcttccacaatggttgaactagtttacagtaccacaaacagagtaaaattgttcttatttctccacatcctctccagcacctgttgtttactgactttttaatgatcgaattctaactggtgtgagatggtatctcattgtggtttcgatttgcatttctctgatggccagtgatggtgagcattttttcatgtgtctgttgcctgcataaatgccttcttttgagaagtgtctgttcatatccttcacccactttttgatgggattgtttgcttttttcttctcaatttgtttgagttctttgtagattctggatattaaccctttgtcagatgagtaaattgcaaaaattttctcccattctgtaggttgcctgttcactctgatggtagtttcttttgctgtgcagaagctgtttgtttaattagatcccatttgtcaattttggcttttgttgccattgcttttggtgttttagacatgaagtccttgcccatgcctatgtcctgaatggtattgcctaggttttcttctagggtttttatggttttaggtctaatggttaagtctttaatccatcttgaattaatttttgtataaggtgtaaggaaggggtcctgtttcagctttctacatatggctagccagttttcccagcaccatttattaaatagggaatgctttcccctatttcttgtttttgtcaggtttatcaaagatcagatagttgtagaaatgtggtattatttctgtgggctctgttctgttccattggcctatatctctgttttggtaccagtaccatgctgttttggttactgtagccttgtagtatagtttgaagtcaggtagcgtgatgcctccagctttgttcttttggcttaggattgtcttggccatgcaggcccttttttagttccatatgaactttaaagtacttttgtctaattctgtcaagaaagtcattggtagcttgatggggatagcattgaatctagaaattaccttgggcagtatggccattttcacaatattgattcttcctatccatgagcatggaatgttcttccatttgtttgtgtcctcttttatttcattgagcagtgggttgtagctctccttaaagaggtccttcacatcccttgtaagttgaattcctaggtattttattctctttgaagcaattgtgaatgggagttcactcatgatttggctctctgtttgtctaccattggtgtataagaatgcttgtgatttttgtacattgattttgtatcctcagactttgctgaagttgcttatcagcttaaggagattttgggctgagacaatggggttttctagatatccaatcatgtcatctgcaaacacggacaatttgacttctcttttcccaattgaataccctttatttctttctcctgcctaattgccctggccagaacttccaacactatgttggataggagtggtgagagaggtcatccctgtcttgtgccagttttcaaagggaatgcttccagtttttgtccattcagtatgatattggctgtgggtttgtcataaatagctcttgttattttgagatatgtcccatcaatacctaatttattgagcgtttttagaatgaagggctgttgaattttgtcaaaggccttttctgcatctattgaggtaatcatgtggtttttgtctttggttctgtttatatgctggattacatttattgatttgcatatgttgaaccagacttgcatcccaggatgaagcccacttgatcatggtggataagctttttgatgttgctggattcggtttgccagtattttattgaggatttttgcatcaatgttcttcagggatattcatctaaaattctctttttttgttgtgtctctgtcaggctttggtatcaggatgatgctggcgtcatgaaatgagttactttggattccctctttttctgttgtttagaatagtttcagaaggaatggtcccagctcctccttgtacctctggtagaatttggctgtaaatccatctggtcctggactttttttggttggtaggctattaattattgcctcaatttcagaacttgttattggtcaattaagtttcatttgtctcacattccattcccgttccctttgcaaatccctatgcatttgcaggttttacagcagagaatgttcaggacttgagttaaattacttactaagtctaagggtaatgagccttacattgtgacttgtgtccacttaaacagacacacttgtacagtacaatactatcgggcaggatatacactgcactgttccattagtgttacatacatatttacctaaaggcatgattttattcttttaagtctgtttgatccttcagaattgagtgaatcctactgaaaaagtaaagctctatggttccattttgaaaataaaattattaacaaattcagtgaagaataatttaagtactaagagtctgtctgagaggcattaaggtacattaagtgatatttatttgctcaccaagatgtctcatatgagctttttttttagacaacctgactctgaccttgtgttttcaattgggtcattacatgtttgcaggcatgtgaattctgtaatagcaaactgtgaaatgcttttcatcatatagcaagcggatcatgctttataaagctttttgtgacttgtataggaaaaagaaattcctgattaatattaagactgtgcatgctttggtagttctgccagtttatgataaaatgtttgaatagaaacctggttctgtgaaaacagaaattccatgtttgctgagaaagaataatggttttgttacatcaaccatgtggatatttaagcaaacacatatttatgcctagaaataaagtaggctcaatgggaaatttacattctcttaaaaacccatactcttcttgcattctcatgattttatgtcatgaagtcttattcacttaaatgaccacaacccctggagaattgaagagctcaaaccagggatatccagtactggtggtagtggagatgggggagtcatttacattctttatgatgggaaataaatggggcaaaattacaaacctccaattagccaacacttttcttctttaacaaaaagataaatcacactctgccatgcttcctgcttttgttgtatgggaaggtgttattttataagacataatgttcttatatgtatgtgtgtgtgagtgtgtgtatgtgtgagtagttttcctttcagcaagtgatggattataggtgtttattgagcaggctgctttacctgtttaacttcaaatttctgtgtctatgaaatgagaataataatggtttcctcctaaggttcctatagtggttttatgagatgagaatcacagcatgcctaataacaaagcttggtatatagaatatgtttaacaaattatagccatttcttatttttaaatatttttcttaagaacggtacccaacaaacgttaagtacctttcttagcctataaggtttgttgatagtcagatgattgctttaagattcccttcttcaaatacagtgaaaaaacctcctatgcagaagaatttaaaatagtttatgtagcttctctatcgccaaggaggtgagcataactcctcactcattaagtgtggatggctcatagtggttcttctaaagagcactgtaatggaagacagaaaaagagtaactttgcactggagaaacttgacaaacatgacctcaagccaagtaatcaaagtcaatgtcaacagagataagtcatgttgatagtatgtctgcttgccaatgttatgacaatactacagaatggcacttttattctgtgttctctttttcaaaacccataactttaatctaatcatgagaaaaatattagaaaactctcaatttagggacattatttctacaaaatacctataaagtattcctctaaaatgtttaggtcatcaaaaaagcaagaggagcctaaagagacataataagtaaatgtagtgtggtattctggatgggattatggaccaaaaaataacatcaggaaatctgaaaagtatagctattagttaataaattgaggaaataaataaataagcaaacacacaaacaaatcctatgtttgctgctctgaatttgatagacaagtatggttgtggtatgcaatggatttctacagaccttaagatgataaatcagataattctattgtaacatgaatattttctcattaaaaatctgagaatagctaagctaagcagtgcttgctccttacagtgagtcacttgaaaagtaaaaggcctgcaaaaaaatacattcaaacgtcgccaatctgaagaatgctttaaaatcatactgaaatatgtgacactttctaatgtttatgggtgacaggacagtgatatgcaggaaagtttatgatttttgtttttttagctttaagttctggggtacatgtgcagaacgtgcaggtttgttacataggtatacatgtgctatggtggttttctgcacccatctatctgtcatctacattaggtatttcttctaatgctatccctcccctagtccccccacagcctgacaggccccagtgtgtgatgttcccctccctgtgtccatgtgttctcattgttcaactccaacttacgagtgagaacatgcactgtttggttttctgcttctgtgttagtttgcacagaaagctgagaatgatggtttccagcttcatccatgtccctgcaaaggacatgagctcattctttcttatggttgcatagtattccatggtgtatatgtgccacattttctttatccagtctatcattgatgggcatttgggttggttccaggtctttgctattgcaaacagtgccacaataaacatacgtgggcatgtgtctttatagtagaatgatttataatctttgggtatctacccagtaatagaattgctgggtcaaatagtatttctgattctagatccttgaggaattgccacactgtcttccacaatggttgaactaatttacactcccaccaacagtgtaaaagtgttcctacttctccacatcctctccagcatctgttgtttcctgactttttatgattgccattctaactggtacgagatggtatctcatggtggttttgatttgcatttctctaatgaccagtgatgatgagctttttttcatatgtttgttggctggataaatgtcttcttttgagaagtgtctgttcatatcctttgcccactttttgatggggttgtttgtttttttcttgtaaatttctaaaacaccaaaagaaatggcaacaaaagccaaaattgacaaatgggatctaattaaactaaagagcttctgcacagcaaaagaaattatcatcagagtgaacaggcaacctactgaatgggagaaaagttttgcaatctatccatctgacaaagggctaatatctagaatctacaaagaaagtttatgcttgtaaaaaccagacctttgtgaacatagaaaaatgaatttgccaggtcactgaggatgcattagctataatctgatgtattctattatcctcctgcagtaatgcaaataaaaaattagtaagtttgccaacagcacatacttaacataataattacaacctctataaatgtctttgtttcaagcccttgaaactaaagtcttcaaaattgagtaagaaagcttaggatatatagaatttttctttcaaaaacatattaatttcctttgtcaatcattaaaagggctacatattgtactataacaagaaatcagaactatatcattttattgaatatttattgtaaaacaaaatattctcaaactttaaaaatattacatcagatctgtaaagcattttgttttgtgaatatggatatggttttgatgcctctattctataacagttataaggaacattttacagattgtacacagatcaattgtggaatattgtctactcattttaaacctacatagagtggttaaaggcaacactcaagcaagcctgcaaaatctgcatcacgttatctttttgtatgccttgtgaaaaggtatttttaagatgtggtatgatggtgttatccatattgtctgatgtcaattcttattgcttggtaactcatgacaaacctgttgtgtgttaggagcttatgaagtacaattttaaaagccagaaatctagcttaactttacaaaaaaagcatgtattgcagtgataaaattgcataaagtagggatggaaaaacatttgagattttggccaatttaaggcggatgtgtagtctgggtttattgctattctttcttttcaaagatgacataattaatgatatttttctccaacagtgtgagaatggttttggcatggacttttctgcaaatgctttctttgtatataacaaagcctgtcatagagctggtgcatatggcttataaaggctgtggttcataacaatttgttctccaaggttgcatttattaatttattcattcactgaatatttattgagtggtatcatgtgtaccccccaagcattgtggtaaagcactagagacaaaggtgagcacaaacaaacatcatttctaccctaatggatgtatactccagtgaggaactgaatatcaatcaagtggtcacacaaatcattttatgttaacacagcagagaagagatacacaggacaatgagaatacaaaataaaagattggatttggtcaagatataaactcttcaggtactaaaaatgtactttgcattcccttaaatgtgaaccctagatactagagactggtccttggaagtcattcatgcctgccactagcacctatgacacatggtagacactataaatatttgcaaacaaagaaaaagtactaaatgaatgagttaaatttgtattgctatagcctatatctgtctttgtgtctatataaagaaaaccctgtagttttatggtttttcctcaccaactaataagtactttgtctaggttctcccaatttcactattcttgcttcaagcatgcaactatagttactattctcttttttaccattggatttgattctcaaacaattaacaagaacaggggaggaaaactggttgtgtacacatagctcaaatataccaattggacaggtaactttctcttgtgaactctatgtgatttgatctcaatcaggaggattccctccacttacaacaggcctcctgtaatatttgaggaatttatattccagagagatgcatgttcaagagggatcttattttctattgccatactttgtataaaattttctttcagttgtggtatgaatatattttcagaaataatagatgcccattcagatttttaagtaactatactctataaccttgtggttaaaagctctgttattaatctggctattaatattatatgtagatgatataaaattgccttaaaaaataagaaatccaaatgaaatgtaaccaatcacagaagtagattaaaggatatgactacaaaggataatttgaatgactattttgattgaagagacctgtctgttcagcctaacaactggtttgatctgactttttaatttaatttaatgtatttattatttgattgatttttacttgacctaaatagtgtataatgcaaggcaacgaaagtaccccatttctcagtgtcagaatcataaccccaaatgttgaatggaaacctaaagtttacttagccccacctcccaatgagcacagaatactttatttctgtagattctgttcgtaacagttcaccttggcttgatcatgcacaacaaaggagaactgattattaggtgaggcagacaactccactctattgcagttataattctaggaaattatcttctgtatcaagttgtagattccattcatttccctctggaaagaataggtctttctctcctctacacaaatgccttcaaacatgtggtataaaagtagctttaggtaacttgctctttccgagcatcagatttctcatctgataaaagggatttaatgctgtctaacatctaggctttaggcaagagtcaaagcagacctgtttaaagtactagcacacttgagcacatagaaagtactgatttatcaatggcttgctattatatcattattgttgttgtagcactttaggatgactattttacctccttaacatttcctttttgcccagctatgcattcttttcttttttatctgttcttaattgccattgtgtggtcaattttaccttaaaccgtagagctaagctcagtatcttcaggactgaacacagatcacgtgttcctaacaatgcagaaaaccaggtctgttttgtcccaaggacattctacttcttttatttcaacctagactttattcttagtagctttatcataccactggatcataaaatcccaattaagtccccaggtttcttcaggtgaacgacttttatacctgttctttcttatccatactcttttgttttgttttattttaagctaaaggtagatctttcaatttatctatattaaattgtacgttttggtgggctcattgttcaagcccattgagaactgtaagaatcttgagcctcttttccaacagtttatatatatatatatatgaataaataaaatgttaaatcattataggtacttaatagttgtaccactatgtacaactatttatgaggtcatgtgatcttttgatagagggatttaatatgtaatgatcgataaaggtaattggggtatctatcaccttatcatttccttgtgtttggaacattctaaaccactcttttagttattttaaaattttaatcacaactttgcttatctgcacacttgacaaacctgtgttctaaatcttcagccaagcaagatgttgaatatgacatgaatgaagattagcatttcatcattgtacttatagcccaagcaagagggaaggaagtcctaacttaaggtagtactggtggagcaggagagtaagggattgaatttgtatatttctcgattataatttttttttttgagatggagcttgttgcccaggctggagtgcaatggcatagttgctgctcactgcaacctcggcctcctgggttcaagcaattctcttatctcagcctcctaagtaactgggattataggcgactgccaccacaccgagctaggttttgtatttttagtagagacggggtttcaccatattggccaggctaatctcaaactcctgacctcaggtgatccaccggcctctttctcccaaagtgctgggattgcaagagtgagccactgtgcccagcctcaattataatttttaacaaccgatgttcatgcagatgctgaaatccttggattttccttggctttacgaataattccctttccttaattatattctcactttaacctacacagagtgtatgaagtaggccaggcctgtgaagtttagggttggaatttgaggagcaatagataacactagcttttagtagggtaaaaccccactttagttggaaaaccagaaattattcttgccagccatagaatccaggttgtccatctctgtggagctggatcacagactccttgaggcctgcccttattaaaaaatcatattctctagtgcctactatgggcatttttgagatagaaagggggctctgttaataatttcaccaagacaataggataaacaggacttccaaggaaaaccttgtattcctaatttatattttgtactcagtaaatggatatttaagtaattgaattgcatcctaacattaagtggaaatttctaagtcttttatttcatcttcttccgccatacaaaaaacctcttagtccaacctctcacaatccacattacaatgcccctgatgggcattctgctcaaatgcatcaatgccaggaatggctcttcatggaaggacagtggaacggctaaccagaggagaatattagaaagccctcccagatagaagtccttcctggaacttgttcctagaactgcacctcctagcaatatgttaaattaatgttcacttggcagcttcctatttgaagatagttactctgtgggaagagttaggtaagtggtgtgatggcagaagaaccacagtggtctcttgcccaaaattgtatttgaaatgctacctgttaggattctatttagaatcaagtctctcaagagaataatatggttatctggattattcttcctagcatatggctataatcttgagggatgctatttagtactattttgcatttacttgaaaacgaagatgtatgtttaaagacagagtataagcttagacttgtcattcagtgtgtattgagcagagtagatctttggtgacttttcatgaattcagttgtactttaatatttaacattgaagtatttttcatttaaaaatgttttattgtgaaatacggcatcaatcaaagtgcatgaaaatataatatgcaatttaaagatatatgctttttaaattagtccaattcaattggttttatatttgttaatgaaaaattcactgtgattagttcttattatgacaaggtaacaacatttccagacctggaagagccaaaaagcatccctaacatttcttactaatatatgcagcagtttgccagtttgtggacttttctttaacaatgcatttgttttttaatggatattttcttaacaattagtaatttagtccataaagttctgacattaattctgaatatatttgatgcttcttagagcattctgaattcttacttctgtatatttatacatagttaaccccactgagcctgtctgaatctttccattccaactcaaatcccacttctcccacaaagaggaatgactaacagctattgctcttactctgacacactgaaatatttaactatattataactacctttttcagccacttctcttaattattttataggagaccaaatatcggctcctctggaaaaccttcttgatccccccatgtgttgggcatcctctttgttttcctgctctagttccctgtgcactgcacagtcctccaccgccaccccaccatcaacacacttaccacactgtgcttgatttcctgtctgactcttctcctgacaatagtagaatttatcgaatacttatggtactccaagttccatgtatgagcttcacttgtattcactcagttgatccttacaataaatttacgggattgtaactatcattcccatttcaaaggagaggaagttggggcactgagaattaaggaaattgtccaacgtcataaaaccctaaaattcagagagcgtgattctagaggctgagctcttgacaattaccttatgctatttttctagatccgctcctagaagtcagggataggctttgatcatagtattatcagcatctagtacaccacctagaatatagtagggacaagataaatgtgtattgaatgaatgaataaatgaatgaatacactttttttctactgatttcaagtattttcagcgagtgtaaacaaaaatagtcaagatttgaagactgaaaattacattcaaaatttgtcttattcaagctcttattttgtagttggaaaaaccatgatgcatagaggcaagtcatattcataggatcacttttgtagtttttaacccttgaccatatgccagaaaccatttcaaatactatatgtgtattatctcctctaatcctcatgtgaagtggatgctcttatcatcttcattttggagatgaggaaacaagcatgaagagattatccaatgtctcaaagctgcaggtggcaaagcaagaaaaataactgaggttggctggtttcagaatttatgttcttactcaccacactaaattggctctcacgtatgtaattattgccagatctaaactgaagcaaatgttaagtcccagaatctttcaaaaatgtctccctatatttcaaaaattataattattctaactttatcttcatctttaaacagtctggattttatagtgcattcaatatatgttttatttaatttgagatctggagtttcttgatccttgtaatgtattctacatgtctacgaaagttacctagagaaatccttatgtagcttttaaggcaattctttaatttattctagggaacttttactttttaaaaggttatatatgagtaccctaaatttgtcagcagctgtacatgggaattgattatatatataatcacattatctttaaatattggtttattcaaaaaagattaagggaatttactctgcagccataggtttctattaaaaataaaagataatggcacaatgacaaagtcactgctctacgtttactcacagactgttgtgttactgttggaaagatgttgttaatagaatgcttgttgatcctagatgaactggaatatattctaactctcaggaggacatttgggggctgcattagttttctatactacataataaattgtccagaatttagtagcttataacaacacacatttattatctgacaatttctgtggttcaggaatttgggcacaacttacgtgggtcctttgctctagagtctctcagaggccataatcaaggtgttagttaggggtggaggcctcctctgaatgtttgagtggggaaatgattgcttccaagctcactcggattcagcttcttgtgggcagttgagctgaggaccacagtttgttgccatatgggcctctccaacattcagcttacttcatcaaagcatgcatgctgaaaaggcagtgaagagtctaccagaaagatgaaagaaataccttttgaaaccatgtcatataagtgacatcccatcaactttaccagtttattgattagagtaagtcactcaatcttgtccatgcaccgggggaggggattacacagtatgtgaattttaggatcccagacaattaggactaccttagaaggctgcctcactatagggacagaaatgtcaactttcttttataagtctaagggactgagaggggaaacaggttaacttttggcactcaatttatgctttcctccctctttataacagttttgatatttttgtttgtttgtttttggattgggaagggttgattggttggttagtcggttgttttctgcttgctgtgagtttacagattgtaaaaagtaaaatctcttttaaaagtttttactttgtagtgagggttgtatacatgtataattgaatagcctcaagaaattgtttttatgggtgctggtttgtgattgatgagcccttactaccaaaagaccttccaaatctagtcacattttgttcttttatccttggagccccagcaatggaatcctgatgatcacctgtgacatgaagtatgtgtgccagcaacctcacttgtaaaggtcttatgcattcaacccctggattttaaatgtcctctctgcttgtttgctctaaaaactccctttttgaatctgtggtttttacattgtgatcctatttttttttttttgcatggctgaaccaaattgtctagttcatattgactccttcacaagaggcttgaattatgttcgtgctacccagacacaatctgtactgcttaagagatggcagtgagaagtcctcccagaaccaatttcagttttagccttcagctttggtccttgttttctctccctcttcatattttcattgccagtgtcattttcatcattaccttctaaaagcatgcacttatttttcaattaaacaatagggtttaattgaacttgattgttctaacttccaagaaaatgaactttactgtttctaacttccgagaaaatgaaactagacatagcctgaccttctgtcttccagaaggtttatatagtccaaggcaaagcactcatgtgctcattataatagcaatgaataaagctttgaccacataaatgttcttaactagtggtttgtttactaaactgacacttcctggacttctttgctgtattcttcaataagaaataatgataataatacatttattggcatgttttgaaaacaatgctatctaacattgtgtatatttcagtgtgtagagagatcgccccataccatcaatatgcatttatttacatagttattcattcattcattcatttattaaaatagaactattcaagcaaaatgtaattagcatccagaatttgttaatggtgtactttggccacagcatgtatcctatctgaatataggttaaaagtgatgggttttaaatgacaggcttggtaatattaaatccataatacagtgaagttgttaaatgatttttaatgtatttattgattctaggacattctaggacaccagtggttgtgtcattattattttaggtgacaaaatgaaaatactgccaattaaactatgatgctatcatttcttaccactttggttgtaaaaagtatcctgacttggacaaattaaaatgtgataggaccgaatcttaagctgattaatagtaagaattaagaggtataaagaaatactgagttgctttaggtatctattgtgaatacagataagtggcctacagcttcaggtttttaatagcataagtaccttttactaaaacttaacttatgttggtcctagtgtaattaattaccagagtttcccaaatttcaaaagtgaaatgctcctaagtagagaaaaccatgaaatcccaagggtctgtaggtcaagcctgaaatgatctagcccagctcaaaatttataaaaataaataagatagtgacaaatatgataatcagttttcaaatataaaatcaggtttttagttacacatatttagataaaattatctttccataaagatgtttcatatttttcgtttagctttgtgtatctgtcacactgcaatgtggctatgaggttcaagtacccttggagagtcaggcaaccagaggcaatatatggagttagcaaaggaacttcataatttttgattactccccaaatctaacaaaaggtcgaagataaattgcttagtttaattaaagagcattaacacaaattttctgcgttggactctatccagacagtatcttcttgtgaagcattatgtctgttaggatttaactgaaaatcatatctaaatgagagataactggaattggcttatttgatcataaaaattgcctgtaattgaattaaatgctctttttccttcttatccccatgtgtgtcaagcaggcagcaatttgactagcacatcatgttctctgcatatttgtgtgtgtttgttgcagaaatatttctgtagaaaacttttcattttgcagcagggatttacacagatcagagtcaaaagcagtggcagagttacaccaagatctggagttgttcattcatgcaatagcaaagcagcactcatctatacgtgcacagatgtttgagttataaatgcacaggttcaatctattttatgaaagatttatctaatttcatttttagttttatttactacatcaaaataggcagccagttgccttttcttttttaattctcccaaagacatggtctatacatacagcttctgcttaaacttctcatctctgatcccacctgtagctgatccctactccttaacagtcccctctcccccaaaaggattgggaatatatacatgctacaaaacagaatgtgcttataaatgcagaattagaagtaaatactttatacatccccacatctgggaaatgttgagcaattctacttttaggacccctggagtatttcaccagattcgtactgtgaaatgctcagacgtgtccttgtccctggaatggaagcataacccagagacatgggtgtctaaaaacaagtagtgaaatggtgatgatgctttcagcgtgttttcataggcaggtcaagtctgccaacaatcatttggagttcatgaaatttgtgacagaagtttttggcacttagtcaacaaacaaccctttgttctcttttcatttctttctaaagaaaagggcagaacattgaaaatgagtttttgagtcaatttaaattttcattcaacaccctgtgctgttcacttgatgcgtctttggatcctaccactttccctctacttcaatgacattctagaaaggcaatgaagcatatttttaaaagtctaagactatatacaaaaaataacttattttatgcaaacatgttggaccatgtaccgaagaagtctaaagcttatattggcgaatataaagtgaaaatggtcatctttgaggtctgaccacgaaaactgttgtaaacattgctagtagggcatatagggtattatgcattcctcgttcccacataatatgagttgaattctaatctacttgttttgttgttgttgttgttgttgttgttgttgttgttgttgtttgataaggagtctcactcacttgcccaggctggagtgcagtggcacgatcttggctcactgcaacctccgcctcccaggttcaagggatttccggctgacttagtagacacagggtttcaccatgttggccaggctgttctcaaactcctgacctcaagtaatctgcccgcctgggtctcccaaagtactaggattacaagcgtgagccactgtgcctggccataatctacttttcatttgttttattgactgaaaatttttcacctggttaaagtgttttaaaagctccatggagttgcggagctcttggacaagtttactccttaaatataaaatgaagccaaaagttactgaatgggatattgagtaagagagtaggagttgagggagaggacaaaaggatacagagttatacctgtcagcccttctaatgcactgagcatcacaagaaatagaaagttgcgggacgatgctcaggttgtcttaagatggcgtcacaagcattgactttgaagtttgactcttctaggtttgaatttgggctgtgacacttgctatgtgattttctgtcagttacttaaacttttggggccctagttttgtcgtatgtcatatgtaaaggaggaataatagaatttatttgatagggttattgaaatgattaaatgagataatacatgcatgcagttgacaggatacttagcacaaaggaatggttcaattaatgttagacctcctgggctcatgttcaatgtgtttaatatttatttagtggagaggaagaagctgatatttagagttcacctttctatttataacagaatgttatattgttgcatcaaacatagtataacattctgatgcatttagaatctaaaaatatatatattcacattccttagaggtaatgtcattcacactcaccaataattatctactagacatagttactaaatcttgctgaaaatattttaaattattttttctttgttttagtttagaaaatattttatactttagtatacttctactcttttgactagaagcatgtctaacccataattatgtcaaataattcagactgtcttttgacatggacaatcctaagaacttttgagaaacagatttattaatatcacaagctgaatttacaaggcagattttctattagcaggttttccaacacattgcaatagagaaatagcaactattggaatctgaaagataaataaactcattgtttactcttgtataagtcttgcatgttagaatgtgatcataaaatgcccaattaagtccagaaggccagttagcagatcactgtaattaatgtctgcaacatcagtcaaatcttgtttatcagtacatactggaatttcagctacacatggacaataattgttgtaatcccaacttggccatcagtttcagaaacttgaaactgaacagaaatcagatggccttttattttatttttttcacactcaatatgatcataatatttttttaaagaatagcttttataggaggaggaactggaacagtttgcttactaactcacttctatctgcagtgccaatgtccaagaaaatgctttcataggtatttttttcccctcttggtgtgtgtgtgtgtgtgtgtgtgtgtgtgtgtgtgtgtgtgtagtgggtatgtgtggggtgagtgtgaataatttcccaaatcagaaacttcttgggaggcatagtgagtggtttaaacttcaaaaagtgaaactaactactcgtttctggtaaagagccttatccaaatattaataatttgagttgacaaagactatgagatataaaaaattcagctgcctggtttcaggctagtggtagagctgacacgtgtgcttgtaacttcccttcagaaaagaaaagttgggattggcaaagctttatctattattgtacatttctgctaatggcactaatttggagtgtttaggttcaattttcacctcagcgaccacaaagaagcctcatgtggaaagctaagttaactgataatctttattataatttattccactgatgtttaattttcattcaatatgacagcttggttagttggttgactatctcattccttaggatacttttgttggctattactgttataatcattattaaactggttattattatttccaaatgacaggaagacattcatatgtgctaattattttgctctgccatctctacattagattattgggagcatcttacacaggagttttagatttgcatatatacctctatgtagtgacatgtatcaatgtgtaatcacctaataaatatagtctatcataaagaaaaatatgtcataaatattgtgtagaatttttattcttcatactagtagagttatgatatcagccacatagttaaattcataaaattaagagcatatgacacaactctactgtgttacaagttacaatttttgacacatcttctattggctcaaagcagaaagaaaagtcattttatcataaaaatactgctttattaatgaagtattaggaaagatagcaggaagagtgtaaggacaggaactttttggttcaaaataagttcattccttagcagatcccatttcattctttagcatgatcaagtacctaggaaagtaagatgctcaagataggtataattcgagatttacatttcattttatacatttggttctctaggttttatatttctattttaaaataatacattttacatcatatacactttgagacttgtattttagaaaaatgccactaaagtaaaaggtcacatttaacatttttatttccagaccttaagaacaatttatgaaagcaggttttgttgtacgtttcaccttcccctttgctcagtattatgtataaggatttatcttgtttgtggaaacttaaaacattttagaggattttgaagaagaaattgagctagtttgagttcagatacttaagtaaatttgtactttgagtcaatgtgacttttaatcatccatgaatgatttaaaagataagtcaaaacgcttatgaccttctctacatctcaatttttagaacaggacttttgacttgagatgctttttactcaggccttgaacccagaataccactgagcttggagtttctttttaaagagaaatatgcatgtggaatgttgttgctacagaaaagattatgcaaacatctcagctttgctcaagatgtccaagttcgcagaaaactatttgtgacttcaacagttacccagctttctgttttaacgttgaccaaatcatgtttggttgacttaaacataacaacacaaaggacatttttgagcctgtaataagttttttcaaaatttttgttcatttgaaagaaatacacaataaactttgttattaatacaatcatgttgctctctcatctgctgatgtgctgatacatataccagatctccgaggtacatttcacatggtaggcaggaaaccaatgaagatcaactttctgacttcttgtccttataaaaacatgctttttgtggcttcattccaatccccaagttgtgtattttgggtctttctgaggctgttgccatgcttgaaaatactgacaaaagagactaatgaggagggaggttcttctaccagattctttcttggagataaaagccttgattgtgatttaatccagcctcactgcctcttctattgcaaatatttttatcatgagatttaccacaggtaaggaatatttaacaacgaaaacaaaatcacaagcattacccacatgactcatgagtagagggcaggaattactataaatatctatttttttgttaataaagtctccctttgaaacattgtgcccaattcaaaacataagttggttcaacaagatacatgatgcaaaggctgttgtatttacttgactttcattcctagaatggaaggccaggattaaaccacttattcaccacattgccaggacattcagtgatagttattaaacataaaatgtaggaaaacaggatacatttgctggaaatgtaagcagagaattcaatgaaaagtttagcagatgacttgatgtacagagtttaagtcacttaatagtttaatatgtaagacaactccatctaaaattagacaaatactctcatctaattttagattttaaaccaaagaagttgctaaaattttcaaacattatttataagtaaacttacaggaaacagttgtctacatttttgagctattcacatggagatcacgaaaggctctgctaaggaatgaacttattttgaaccaaaaaggtcttgtccttacactcttcctgctatctttcctaatcatacaatctcagtaagcgggaaagagactgcaaagtaaggtagcatctgggagctatttttaggttgagtaaaaggcttctgaaggaatattttgagaaagtggccagagaggaagacatatagaagccaaaggtcagtagaagagggtggaacccatttccaaaccacttcattttacaagcccaggcaatgttttgaggaagtacaccctagacatttccacctcttagacagatctcccattgtttgttctttgccttctcaataagagcatactaaggtattttacagacccctttaacactggagtaggtatatgtatatgtgtatgtatttaaaggacagggaaataaatactactgtgagttgaagagccagaaacaaagttaggcaggtgaaatttgtctgagaaacctgacattcccatgctgatttcaagtcggcatttatgaatacttagggtttgcattacatctcagcgcattagcgggttgtttagattgctgaacaaaatatgtgatactatttgcaagtagaaaatgtactacttgctacttagtgtgtacttctagacatgtaggaagacatgtatagataacactactctaatgactaaaaaaataaagttacagatttgcatcaagttgcctctaacactaccaggtaatcaaaagtgaaggcaaactggttcaaaacttgttctaagtgacttgtttgagaactgatttgtattttaacaaataaatagaatagacagtcttgtccaatagcagcatgtcttgaaattgaataaagatagaatctaaatactgctgataacatcacaagtcaccctccctacacaactccctcttaactattgcatttttaggcttttaaggtcactcaagtacatctattaaaaaacaaagctgggattatgtaacacgccatgcactatgcttagttcttttctgaaccatttgcctgggaatgcaccacccgtgaagcaaaaaccagaaggaacatgaaaataggtaggactttaggcagcggtcttttcattcatattatatcagtagcatcagttcatcactgaaaaatgagaaaatcttggtatgctaaatgagtacaaatcaccaccacataacagagacaaccatacctattcttaacatcttttaaataaactctcccaggtatttttcttcacagatgtgtgaatttattttttaaaactatggtgactctataaatggcgtttcaagatctttttttttttaaatctcagcatatactatgtgcatctgttcatgtcaagaaatatacttcgccacctcatttaatagtcatttaaatccactttacccaatcatctactgttgagcatctagatttctaacccaattttttatgataaatagccaaacatcacattgtcctcaaaatatacataattattatttgtaaattaaaaagaaaataaaactttgatatggtttggctgtgtccccacccaaatctcttcttgaattcccatgtgttgtgggagggatccagtgggaagtaattgaatcatgggggcagggctttcccatgctgttcttgtgatagtgaataaggctcacgagatcagatggttttataagggggagtttccctgtataagtgctctctctttgcctgctgccatccatgtaagatgtgacttgctcctccttgccttccaccataattgtgaggcctccccagccatgtggaactgtaagtccattgaacctctttcttttgtaaattgtccagtctcaggtatgtctctatcagcagcatgaaaacagactaatataaacttaaaaatggtattgcaatgagcatctttgtaaatgaatattctttaattgtttttagtcagaattcttagaaatcgaatttctggaataaaaataataatacagaggtccaaataatacttcagataatctgtgccaaattaatgtatgtttatgttagcattgtgtgagaatgatcactcctcaacatacagaaacacacacacatgtgcatctttacaagcattgggcaccatcatttaaagagttcattaagcatttaacctttttggatgtaaagttatagtgaattttccccgtgcaatgtatttcaataaaggaaaataggcttatataaattatttctcaaaatttatttattaatcattttcagaatgtctagtgtgtgtttagtgaaaatcttgtgaatggagatttccatgaggaagactaagcaaaaaacaagcatttattgagcctgtactatgtgtcaaatatatttaatctcatttaatctttagaaacacctggcaaataaaaattattatctccactttggatatgagaaagctcttggagtttgggcagtttgtgcaagttgacacaagttaatgcaaattctggaaatataagtattttttaaaatttaagaaatatgtatatgaagccattttctctggctgtgattaaatatatggccatcaaaagtggggaggaacttttaatattttctcccaatttataaaatatattgattaatgtaacaataaattttagccatgcatatctattacaaacttcaaaaaaaataaaaataaaaaaataaaaataaagaaataaaagtggggagggagattatgtattggtaaataatttttacctaaatgagacgtgacttccaaaaatgtatcatggtgtgtttacaatatgaatgtgcatggtgcaataatatgaaactgggatccacagctttttggctttttggcttgatggtccatggtctctccgtaagatcctaattataaaggatatgaggatgtgtcattgctcacattttctctaatttcattttattatttagagggaaaaaatttggtacacatctctctgtatggacggtagtagaataataataatatataataaaatagtatatattgtggtagacatcgtgtcagaaggctggttgattttatctttttaagtgttaatatcctgtcttattctattcattctatacggaacttgtggctaagacacacacatacacatgtacacacgaacacacatgtaaatagtatacatacatataaacaaatataaagtataaaataaaaatttaggaattaagtaaacagaaaacaaagagaaaaacaaagatcaacatggtgaaaaacacattaatagtcctttaaaattgctgatggtgaatcaaaaattaaactaagagttctggcagtcaaataaaaaggtaagcacaatgaacataaacatttaagaatccaggagaaacacagtttccctgatactcaggtcagtgaaacatcttccttcctttttcaacaagagattactataggtgtaagatgacctccacaatggcatccctgtgataatgtgattttcgtatctgttttcccattctatgccccagttagaccttctcacaaatcattgtccaaatgatttataaaataacaagttccatgtttaagggagtcatccattttagtcactttgagaaaatgtgaagtgaataaatgtcaccatatggatatagatctgattctatagtactaaagcatttacaacactgttgacaatgaaccagaatattctattgataaaatctctccccttgtcataaattaacctcaatatctattaaagctgaactctcttagggccaatggtattctctggaagatattgaacctagtatcataaggttgaaataaaatgtgcacgtacacgtgtgtgtgtgtgtgtgtgtgtgtctgttatgtatgtattagtgtataagtgtaagtggtggaagagcagtttctctcttcatttttaacccttcctgaatctgtactttatatgcagtcactgctcaattgatgtctcctgttggtaatcatcaaaggaaacagatggtaggaaagagttaatgcaaattctggtagtatagtatttttttaatttaagaaatatatatgaagccactttctctggccgtgattaaaggtatggccattaaaagtggggagggagattatgtcttggcaaataatttttacctaaatgagaagtgacttccaaaaaaagtatcatggtgcatttacaatacgttctagtaaatatgtagaaggcagtcatacattgcctcatctgcaatataatactaactgtgatgtaatattaactgcatggggtgattgtggggtaaatcaagggaaagtaattagcagagtttcaagcacagagtaagtactcaataaatatgatttattctactattactagtattattataactttaatatctattatttcctgctctaaaatatatattatatatattcacatgcacacatgcacacacacacacacacacacacacctattcccatttgaatgttcttggcaatacccttgaaaatatttcatttgggtcaagcatttttcagaacttttttcttaaaataatattagactttactgtgtttgttttggttgattttgctttctttctgaatgctcttggcaatttcttatgtgcttgttattccgatccaaactggggaggaaaatatctcacaaaacagcacaatgtagaagaccacacagtgatttataaaggtccctctttccgcccatagagcttttaatggggaaactcatctatattgctgcgtcaagaaatcaccacctttatcacataacacagatgtaaatgaaccatataaaagcaagtaatccttaactctactacaggaagctagagcagaatttgagctttagcagatgctcagaatgtgtaactagctgtagagatgaaatgtgtttgttaacaagaagtaataccaatagtttatctatgacaatggctttaaaattactttttaaaaactcaagccttttccaacaataccgtatgtcccatatggttcctccaagtcatttttagttctcaggtcatttttagttctgtgtcagctttacttggattcaggtagaatgcttttgccatactgtgttaattttgtgcccttaatcaaaacactaattttcatattttaaagattcaaacagttatctattgcaaaattcactcttaaaaccagaattttatcatcagatatttaggtgcttctaagctttgtaagtacatacacactataacaaattgagagaaggcaagtctaacccaaagaaaattatttgatagtaagtttaatataatttattcttgattcatcatacaggacgaatatgcaaagacacacacataatgttattagatttctatgagttaatacgtataaagaatgaagacgggttctttgcacaaactaagaaatcaataaatattacaacatggcctaaactcaaaacgtgtgtgctaatgcaaggaagtcatgcaacagttgaaaacatagttattccaaggtaaggtacatctggctacaaagtttgatgaagtggtaaataaataggtctcatttatattatgtaacagagaaaatacttccttctatgcaattttgcttaagtacccatttcaagcactggtaattacctgttccatcatgtttgagcccctgaatctcaagtgaaactgttgatttgaggacctgctctcccagtaaattttcccttaatatatcagaagttttctgtgtgtgtgtgtgtgtgtgtgtgtgtgcatgtgtgtgtgtgagtgtgtgggtgctttattaataaggggtttataaagtcagtaaaaagctctgcctactatagattgaaatacatagttcattaaataggttactttatgtcataaaggcaactagaccaaaaacatcaccaaggaggggtgtctgtgttttattctttgttccactgactatctattacagcatcaagaacaatgcaggtttttaacaactgtttgatgtagggacaagtaaatgaacaggcatcactagagtaatagaacttcccctgctattgagaaaatttcccttttattttgactagacatggctaaaggaaatcacttccttccttttcttctgtgctcctcaggattcatgtagagcactgatatctcctatgtcctctgccatcactcccccaacaatgagtcagaccatgtcaattcagcctgtgaaccctctcataagaagacttataggctgattaccaaaaatctctctgtgtccaaacttggcccgtgataggcaaaattaactctttgcatatagttctggctatgtctttccttacttactaatgcacatgtttgtgcaaacttaggtaggtgggattctttttgggttctcgctatagaatgttttatctaaagacgttctttttgcattatttcaatgagagtggttttatagataatcctgatttggggtataaagagaattccttttgacctagccatacctaaaataatttacccaaatgacaaaggtcacttgctttctggtcacttcctgggttgccagtcctatcaaattccacctccagagtcctctcctgtactccctagccatcctcctcaaaaacatacaccgtaagagcagagttgggagattacccttttctgcttagcaatcctctgaaattttgctcttttactagatacttatatataaccacatagtcagctttctgtatttcaaggaagaaaataatagaaaacaaatggaaaagtgatagaggaagaaatgaattaatcgaattaatttgttctgtcaatatagcctctatttcagggacagtttcataaaaaagttgcattatgatagaagagtatctcattagttttaaggaatgtagagaaatagatttacctacaaaatactttgaacaatttagttaagaatcactgaaatgataaaatgtatttaagtaagtccttatatgtaattaccttcttattaaaacttgacattaatgagagttatggagaacataccataccacagttcattcattcagaactcatgtcctttgtctttcatgtaaataagagagtaaatcccagagattgtgtactcacacaaacagcaagtccacctctgccactaactaactgtaggacccgaagtaagccacataactcaatgaggcttcagcttctgcctaagtccaaagaagaaacagacattcaaattcataactttcagaattgtgttaaccttcaaaatcccttgctcaaatcctttgcgtaaacttactcagacacaggtagtcactggatctgcttttgtggattgtgtgtgtatgtgtgtctgtgtatgtgtcaggaatcccactgtagcattactccacactcttactctacaaagaaaccctacagaatatttcattgcctaggagcctcattggaaagccactgaactggtggccctctaaattactttcaaattctgttattcccaactgtatatgtgtcatgacctgcctgtgcagttttaagtgggctgtgagaatgtcttaccaagaaggtgacatttaactggaagaaaatgaggatgtgaacaatgcagataactaaaggaggagtggtctaaggcagagggattagcctgtgcaaacactctaaggcaagatcatttccacccattccactggccaaagaaatacatttgttcatgctcatagttaatgtggcagggatgtatagtctgtttgcttttttaagaaatactagaaattcacatggcagaaggcatgagtgcataattctgtaccatagagggaataatgagttggaaagaatctaatctgccccacaggcactttgcctttgagtggaatggggagcccttgtatggcttcaagagataacctgattccaatttcaaacatgcaatcacatctgatttctgtactgaaaatataatctaggggaaaagggcatgagcaaggagacaaggtagaagcccattacaataatgcagtgagggatcatagtggctcagaccagggtggtcgcagtagaaatagaagtggtcagatttcaaatgttttgaaggtagagtcaacaggatttcttgaggcgttggctatgagagaggaacagaaaaaggagtcttcaatctgggcaactctactagaaggagagtggccatcaactgagatggggaagactgtgtatacagaggcctgagtggaaaattggaagctgagttttcgttattttatgttagaattgcctatttggcacctgagtgagaagtcaagtatacaattgttgagtctggaatttaggagagagatgtgggttcaagagtaaaatttgagagcctcaagcatatagaagatatttaaatccatctcccatactctgcaatagccacataactggtctattaagttctattctttccatattccaatgcattttccatcctgccaacatttacgttttcaaagcaaaccctgattctattcctccctgcttagccatagctaagccatagcttaaaacacaaaatacaaatgtaatatagaggttcaaaatctggccaaaatctattaccactttatctagtaaaatcctctttatctttataggccaaattccaatgtcaactattctgttcaattttcctgatagccccaagaaaattaaactgttccttggcttttctcactcagaacttatcatatgctgcttactgtattgtccaatatggtagcagctagccacatggggctattgtccacttaaaatatggctagttcaaactaacatgtgctgcagatgtaaaatctgcatcttaatcaaatacttactacaaaaatatataaaaatctgacaaatacttttatatttctgaaatggtaatattttggatgtattgggttaaataatatacactattggccgggcgtggtggctcatgcctgtaatcccagcactctgggaagccaaggcgggcagatcatgaagtcaggagttcaaaactagcctgcttaacatggtgaaacccagtctctactaaaaatacgaaaagttaactgggcatggtggcacgtgcctgttgtcccagctactcaggaggctgaggcagaagaatcgcttgaccccgggaggcagaggtttcagtgagccgagatagcgccactgcactccagcctgggtgacagagctagacttcatctcaaaatacataaattagttaattaattaattaattaaataataaacattgttaattccacctatttattttctactttccacgtgtagcatactagaaactttaaaatcatatatgtggtttctcatctgtggcttgtaatttatttctattaaacagttctagtttaaatcatacatcccattgtgtgattacacagtgttactcgtatctatttttctgatagattctgaatttttgaaaacagaaattatgtttgatttctccttccaggacccagcaggactcttggctagatgcccgataaaagttaattggaagttcttggatttctgattgatgtctctcctcagacactgatgtgtgaacagattgcctacaatgtaaaatagaatttggaaaaaaaaagtaggaggtccataatatatatttaagaaacctaaatacttggccaaagtcatccaattttagctgaccactgaccacatataatttttgaactaaaaattataactcttgaaggaattctaggaacctaggagcatttccaagggacaaaaataatggtaagagtgtaagtttcttcttctcacttttgtattttctccctccccattgcatccaaatacaatgattttggaaataaaatttaaatttaaaatatccactaagcaatgagatgagagcaggatccgtcagaataatcaatccgatatatgttataatctagtggcaagacagtaaaatgtttcccgaagctctttgcctccaatagaaaagattctgatatgataggagatgtgatgtgattctctataggcagcatgtgcagagagaaccacagctgtagaaaatgcaaagtgagagactgcaaattagtatgtattgtcagcccccttcagggtgaagtgcggattctaatgaccattcctaggtgtctagacagaaatacccctgcagggaagaagaataacatctcaagatatgttaatttgatgtaaatctccttttgccatgctgaatttctcctttatagttcactccccgggtttttggtttgttgtttggtctctggagtgccctgcccttcagaaaatgggtagagaggtgcaatttatctcccatgaaaaattaatagctatcatctgatctagaaatcattgtcttacatgcttggtcagggtaagtgattttttcactctcatcattgtgaagtaataaaactgatgcctgaacctgtagatagtccctgttaaaactatatttaggaaaccccacataagcagagtctgtcagtctctatgtcttttgacttcataccagcttaacttaccaaattttaaagatttttctagacattattattggaaacctatacaattttgcttcaaattgcaaaatcttcatttgcatttacagagtggttttgtttcactgagaatgagggataggacctcgtgcttctagactgctgagctcatttgcatgttcagccacattcttcattggctgaccaactgacataaacagaagaaggctgatctattaccttgacatataaatgtatccttgaagagagtgtgatttgctttttcctcataaattgtgtatggcctctgtgggagagataatgatgctcagaaatcaatttaatcctaaaaacctgtcctttcccctaggtatctgagccaaaatatgatgtacttttagaactcccagtgttgctaaatatcttgctcaacacttaatagtttgaggtttaggggttttgtttggcattaagcactggtgccagtgattcaggaatgatacatccacatataacccatggacaattgagccagatgctcccagaacagaatactttctgagagcaatttagacaattttggaaggacatagactcttcttgaacacatttaatgacattgccattaagcatactaaatcataccaaatagtatgaatctgtacttaaaatctgagagaagacattaacgagaattcattttgtgtttgtctgcatggtaacttcatgttctccaataccaatgatccaatctcattttatctttttggttagagtggtatactagtatactttttttttttttttttgagacatagtttcgctcttgttgcccaggctggagtgcaatggcatgatctcagctcaccacaacctctgcctcctgtgttcaagcgattctcctgcctcagcctcctgaatagctggaattacagccatgcgccaccacacctggctaattttgtattttttttttttttttagtagagacgggatttctccatgttggtcaggctggtcttgaactcctggcctcaggtgatccgcccgcctcagcctcccaaagtgctgggattaccggcgtgagccaccgcacccggccggtatactagtctacttttaaaaatcttttattatgcccactatattattaagtatatcatgaatacttgaatcctaagaatcagaatttttgacccgagaaaatattaatgatgacttagctcaatctcctaacattagctaattaactttctcaaagacactgattcataactgagagacagaaccaggagtggaacctgggcctcctaaattccggtcacaatctttccactgcatgattttgtcttaattcaccaaaggtattcactggagaggagaaaatctgttgaggcaggtattgttcctgacctgtggggtgactaggatatcttccctgccctcagaaatcttatggccccaaaggaagacagctaagaatgcagatcttttaagttatgtagatattctgatggaagtatataaagtagaaaaggggaacacacacacaaacacaaagttatcagttacactgaaaggtaattgggacatgcttaatgaagaatgaatcttggggattttgaaagaaagactgggctgggcattctacattaggaaaagaatatttaattcttgtctctgctattaggagactgtgcaggtgttaccaaaaatataagtgcagctgaagggatgtttcttatttgctctatgcagaaaaaatatagcaccttcttacaagcagatacttagcaggctgagttactaagacttgtggaaaattaaaactttgggacagttttagcaatacttctatactgtaagatttagtttgtgtgtgcacatgtgtgtcttttgaaagcagtcattgccactttcaaagcaataaaccaaaactactatatttgagggaataggataatttaggaaggtagaagatacggagttagggtcatcctatgagaaatataaagctaacccaatagcttccattgtcttatagaaggaaatctttttagaagagaagcaacccacacttttggacaatattttaagggacttggtttgcttactcttacacttctttcttgaaaaatctgttatctagtaaggagctacacaaggcagatgtggcatttgtaaaacctttaaaataaaaatagattaaaataggaagctaagtacaacttgaaactagattagatggtaacataagaaaatgtgagtgcaacatgacctacactagtttgtatttgttggtctaaactactctttgcccaaatgtattcttttcctttttcatcttctgtcatttacattgccacagatattcaatagaagtattttgtgatgtcatactcatgatcactttattaaggaggtacgtgcatgagcatatgtgaaacatgcaaatgtttaaatacacgttcaattctccttgacttccagctaaaacatgacctctggatctacgaggtgatgggactcccccagctttttttttgagacggagtgtcactctgtcaccgaggctggagtgcgatggcgtgatcttggctcactgcaacctccacctcccgagttcaaccgattctcctgcatcaacctcctgagtagccgcgattacagatgcgcgccactacccctgcctaatttttgtattttcagtagagacagggtttcactatgttggtcaggctggtctcgaactcctgacctcgtgatctacccacctcggcctcccaaagtgctgggattacaggcatgagccatgcgcctggccaggactcccctttttaatctgcaaagacctgacttctattaggggtgtgggttagataagagccacaccaggccctgaaccacgtataatctcatttagtcatcacaaaggactcggaggttattattctcatttccaattttacacataagaaaactgaggttcaaggagattgaataaattgtttaggattaaacaacctgttagtgatgaagcagcaattcaaataaagatctgtccgactcctgagctgatgagctgattttctctctacttggcaatggggtaccacattatagaaagtcctaagtgaacaacaacaaattctgtggagaaaatccagtagagcaagagacttagtgcaattcagaaggaggaataactagggtacaagtgaactcagagggaacctggtagctttcttcgaatattgaaaagattaccaggccaaaggagttattatgattgctttgcatgatccctaggggtagaaaataaaccagtatgtatgttgaagttttaggaaaacaatattatatgagagaactttccaagaaagatgattaaggatagatagacagcacttgcttggaaggtaatcaattttctgtcggttgacttacttaattataagctgtgtaatcatttgaaagactattaccagaaacaaatcaaagccaaaactcatagcttaatgaatttgctttattctggctactgtcagttgaataaactgtgtagttaaagtatcaagataatgattgagtgattttctaaataaacaactgaaacctgaaagcattgccatggttggtttctgctagatttatttcctttcctttggttttatccaagtacataaaaggtgatttggaaagagtatctcttttctctagtttagagtgtccacattagacattttaagttaagcatatgacatggcaggatcaactttaaaaaacagaaatatcatatatcttcaaattgaagtttagaaaatattctatattacctactggttattctgacttacttctgctaaagtgaggaaatatttctaaaggtgaatatagttaaacaccatcagcctgttgtttttaaaaggacatgttaatgcttgtagaagacctttggttttccaattatggtattatacattgctttaagtcaatcatttaaagtatgcatattttaatttagcacaagtgcgaatctaaattatagtcacaaaagaattgacaatttgtaaacaaaaatgcatgctagcataggactttgaatcatcccacatttgctctcatgtatatctgcatatttgtatttactgaatgaatgaaaaaatggaaacctatttgctcaataaccttgaccatgtcatttcacccacttgggctgctacctgcctataaactaaagaaattggatcagaattttctcaagtttctcctagatctaaatgagtaagtgtgtaaaatttgatgctgtattaacccccagagggaatgtagaaactttaaaaaaatgtaattaaaatagtgaatgtttttaatcatcttctgtggtttgcaagccacattctctgagcaagtcaagatgcttgagccctcaattttatgtaccacccacctctatgcagacaatttccagaacttcctctcctgccctgacctttcatattctacccagtcacatatttctttctgtttatggaacatctttacttagatgttctgccatcacctaaatctaaacatggggaagaaaagggaattatgatccctccttagcccatctattctgctttccctgcaccatggtttccgaggcagatacccctggcatcccctccccattccaattacccaccatgtccagactaataccgagtctactgattcctactcagtgttttttcttcctctacttctgaatttcaacagtctcagcctgagccaagctcagcacacatagactcttttaagggcctcctggtgagcctgcctgcttgtattgtttccttattttcatggacactatgaagaaccacagaatacttttattcaaatccttttgagcagcaatacaaactcctttcctgagtgtaatttagcagctggtatgtgccttgaggatagtatttatttttacatgcaaatttcaaacataaatatttacttatgtaagttctgtctcatattagaacaggaattggtttagcattggaagcaggtctttttttcctttcttccttatttctacagatattcgttaaaaagtgattcatgtaaaacactctaccaagctctctgacagccataaatatagatcaaagatggctcttgtccctgtggagaacattcctacttcctaaagtaaaggaaagtaaaattggttgagtacatttaggcactgacataaggtcatgatgttaattttctcattttggctttctagaaaactttgtacaatacagttattatctccgttttacagatggggacaataaggttagaagaagttaaataacttactcccaggtctgactctgaagccctggttcttagttctatgggcctgcactggaatctgtatttactggtttctaaattaatggcatttccagattaagtctggtatgataacaacctagaaatttgctaagtgatttcctataagtctgagtgactaatatgtatctaaactttctttttttctcataagcaagtgatgttcactagcataaaaagtatattagattgtaaacactatcataagcagtagtccatattccacaatctacaggagactctatatatgtgaacatgaacaactttatgtaaaaataatatgttgtttttagatctcaaaaattcatttcattaaaaaatacattttgttcgtaaatcaaataacatatggttttatgtagcatacattcattctctcatgttaattattatatttattaatcctgccctctctaaaccctggtaaaaatatttttggatgctcatttttcaataaataagacaattattttcttctaagaccacccactacataaaatgaatttgcatctggagtggtttttgtcaacaaacttcaaaagaacatatcagataattttggtgataaccatagcctaaaatatcaggttaacatttatataaatagtaaagataagcatatggttttctcccctgatgccaatttgctgtctttgaagattgttttcataaataattacagtgtataacaaaaattcttcagtttccgtgtttagaataaaattaccacctttctactaggaacatattttgtaagaacctgatatttaaaatcttcaaaatagaaagattcaaactattttcaataagtatttagaatgtatttttatatggatgaacagtctttatcaggaaatatcactggaattatatcaaatgacaaaaagaccccctccaaagactaataaagatggaggtgacaaagaagaagaagaagaagatgatgatatcaaagaaggagaagaaggacaaagaagaggtagaaggaaaggaaagaaggaaaagaaataatcataatgctaaaggtaaactgggatttcacatgggccattattaacaaatgattctgtagtttctcatttccttatctctgcattgtgaaacaaataaaagagctttcttccttcctagacttgggtaacattgtggagggttaaggtgtttggcacctatcggatgcttagaataacaaggttcagtatggactttgaggcatgagattttctccacgccagagtgtgctagtcacgcaggtccagcagggtcacagcgcactggagggcagcatcctccagagtgccctacacaggttctgctgttcaggtaaatacaataattcagtctccaatacaaccagtcctttgcattttagaaacactgaatttcactaaagttttttttttctttttctttttcttatttttttagtccaagatgaaaagatatctgtctgtcctcttcatgccactctagcttatctgctgtcatctatgattcctgatgagttgtcacttctgtggcttgtcaactgaaagtgctcacaaagacaaagtctgcaataatgtttttagcatgtttaatagagcctggttaagtaaacatcctcaacaaaagcagcaaaagaaaggttaaaataaacagagctactgtgccaagttcataatgacttacacatttagcactctgcccatcttctaagcatggccattaaaatcaggtttgtgtacttaatataattgccttgaaaccatagctattcaaatactataggccatttacatacttcagctctctttgtcttccttctcttttctcctccagctttataaaacctggaaattgtttcacaaaacttaatttcaaggtagttagtgatacctttctctataacaggctagacctacggatttttgtcagaaaattactgattcttgtagagtcaaggagaaacgaacactttttcacattcttcaaatcaggtactctttgggagagtatgagaagtttcatatctcaaattagaaaagtagcacagtttcttaacaggccagttaaaatgacaaccaaaaatatgtatttatttaagcaatatgtaatattagaaaaatatatgcacttcggagaaagtcctggaaatgtaacctcacctcactgtccctcagtttctgacccaaccagcagttcctggtgtgaaatgtaactatattggtagatgactttaataattagagatactaataataaaattaagtagctgacatgtttgtgttcaataaatgttatctcaactgtttaaatatactagcatataattttccattttatatttcttgtaatttttcatagttatacaaataagttgttgattttcaaatatttctcccatatgtatccaggaatttatattcttatgtaaacttcagtggtttgttcttgtcccagtacgagcactttaagctaagacattccattgaagaaatggatgattgacataaaatgagcacagaatctgaggggctgtcctcacgggtcagtgttgggttctattttgtttaacaacatcattagtgagctgaaaagaggaagtaagtagcatgagaagtacatctgcagacgataaatgaagatgaacttcaaattcccaggaggagagagtataaatagatccgcagaaggttgctgaaattggtagcaaagaagagaaagaaatgcagatctaaattacaacgttccatataagcacaagagggcttgaataacgtgagacccagaaagaggaaagaactaagctaacaaatagacagtacagtttgccaagggcaccaaagcccaaaagaacataatattctggaggatgaatgcaatgtaaatttcccatttcttcctgtagcaatgaaattgaagagtgtatagtctagcatagtgttgacatgaagtcttaggattgaggcccagtgtgaatactgtgtggccttgaagaaaggacttaccttttctgattcacatgctctgcttctaaaaatgagagtattggccaggcactgtggctcatgcctctaaccccagcactttgggaggccaaggcagggggattgctagtgctcaggagttggagaccagcctgggcaacatagagagaccccatctctacaaaaaaaagttttaaaattagacaagcatggtagtgcactcctgtggtcccagcttctcgggaggctgaggtgagaggatggcttgggcccaggaggttgagactgcagtaagctgtgattaggccactgcactctagcctgggtggcacaatgggaccctgtctaatcaaccaatcaatcaatcagtaaaattgtattgtattatatacctcatagggttattttgaaggtgcaatgggtctggcactagattgtaaattctataacatcagaaattacagtatgcttacaattgtatctccagtgcctatcgtcatccccggcacatggtgggcaatgaataaaaggttttgaaagaatgctgaatcatagggctcttctgaaggctgtgtagtaaatatgagaaacaatcttgagcttttatttgtttacttccttactacctgcctcccttcttagcatgtcagctctgtaggagtaagaaaattaccttcttgttcccttgccagatccctgtgcccagaaccttgacatttagatgtggtttctcagccaacacatgacactccccggaagtttgttaaaatggtaaaattatgggcctagcaccagacctactgaattagaatctgcatttactatcctctgttaattcttgtacacattacattttgagaagcatttgtctagaaaacacctgtccgtagtaacgtctctataagctgttattagataaatgactgcaagatttactgtctcatttagcagatttaaagtccttcacacatgcacactaataatgttctttaacagcttttggggggtatgatttacctaccataaaattcactcattttaaatgtacagtccgatgacttttagttaatttacagacaagtgcagtttgcaccacaatcaaatttctgaacatttctgtcactctaaaggatcccttgtgctcatttacagtcctttctccttcccagctccaactactatgaaaatattattttaatatccacccccatcatgagggaaacggtgtatattaaaataatattattatggtgattacatagaaaatctaatttagtgattagagaatcactaaagggcaaacaagtattcctctttcattcacacttcactaaataaaagtgatttttgaatgaatttgactgcagtttaaatagtcattaactatttctaaatggatttgctcaacagctaagagtttaaacatgattcagtggggacatttaccactttcagggaaaaaccatttcaaataattattttctaaacttattgggtatacatttacaagcaaacattatcagtatatcaaaaatagaagccatgagacagtcttttcctttaatccactaattacaaatcattgccatgtaatcagggttagagctaggccagcctatatactttaacttagttaatttgctattgaagtttagtatttttttctttttttttaaagtttgtcttagctgagactgcctttcttagggcaaagtctctttaatcgttcatctcctctactgaattcaggtccttgagcttattcccctggactttctgaataggtcaatacacgatttcgttgaccccatcactctggcattatccccgacagttctgcctcccaaccccaagcgaagtatttcaaatcccccacttaaaaaccttccatgatttcaagttgtccacgcaatgatgtccaaaatccctagcatgcattgagtccagactccttttcctgtttcattcctgccactcccactttcccgcccggcctattacacatgctacacttcccactgttctcaagacttgccaagcatatcacacatctgtatcattactaaaactgttccctccctgtgggaatgttattaccttttctctctacttagatattaaaatcttatttggaccacagttcaatgcttctattgataacagctcaaatacttctccaatagtcacccctttcctcaatcaaatttgcctctttttcagttttgactcactgagtatgatattttgaaactcaaacttagtataggaaaggaaagataaggactatgatatagtgaattatatgttcctatcacctttcacagtatttggaatagtaggagcttgatgaatttataaatttgtgtgtgggtgagggaatctataacatcctgcctttgaaaattgttgcacttgtaatggcacagacatctggatgagatgtacacttccagttctccagttcatgctcatctaccctctctttgtgtgtgtatgtatcttttttacacagatatctattgaaacttttaaaccttcagttagagacaagaaaaagcatgaacagaatgaaatgtttgaaggattggtcctagaagcctggcttatgatagatgctaatatcctgtttcatccttttaaaattatggaccataatagctgaaataaattgaaagatgatatttcaatccagtaattttctagatgaggaaaatgctgcccagtgtctttatttgtattatttgcttgtccatctttcatgtcagggacaatctttttgcttttaatactttactcaatgtctctttattaataacctgattgaatagtatgtctggacatgtcctttctctgcacaggatcttgaaagccacagaactatttcataaggcaaccatggtttcctaggggaaaaacacttacctatccaatcacttgcaatagaatattccttccctgatatgtatctgctacttggtagcagtaatgaaaaagaataatctgacaccaaaggtctgaagttaacttctagctggtcttctctacccccaggtatcaattctatattttgggactcattagcacaaaatgaaaaaaacaaccagcccaatttcccctatacccacaccaaatgggcaatgatctcaactactatttaagaaagttaaatgcttaaaaagtcttttacaaaaaaaagaggggaaaaagagaattatttcacatgaatgtgaaatatgaatgtttattaatttgaggttttttttaagtcaagacatcattgcttttataaaaactctctttgtaagaacaaattataaattgcaaactggaatgaatgcctacagaaataaatgtccaaataaaaagaacgattaaaccagaagattctgcaaagaactcagatagtgagacaggacaattctctgacattgtcaagatgaccttgaatatttatttgaatgaaccagagtataatatacatatcctttgaaataaatccttgttattaacagtacttatcagatatctaatacattaagcatttatttgaaatctgaaaggtgagttaaacacctgttcattgaggactttttttttttttttttgagatggagtctcgctctgttgcccaggctggagtgcagtggctcgatctcggctcactgcaagctctgcctcccgggttcacgccattctcctgcctcagcctcccgagtagctgggactacagtcacccgccaccatgcgtggctaattttttgtatttttagcagagacagggtttcactacgttagccaggatggtctcgatctcctgacctcgtgatctgcctgccttggcctcccaaagtgctgggattacaggcgtgagccaccgtgcccagcctcactgaggaattaaaagcagatatctttttatttcctaagaaagctatatctcagaaaattctctggaaagtaaatcctattgtcttacctgactcttataacatcgttatagaaaaggaataatcccaaaataatttatttgggataaggaatatttatattttagtctataatgtctttgggggaaagtgaagtattctctttttaaaagattttacggttcagttttttttttttataattgcatgatcttgtaaatttttattttaatccctcaaatatcaattcttttgtcacacagtaaaaaagtttaattttatgatggtattaattgtgttattagagaggtaccaataattttttcttatgccaacatctatgctcaattgagttgccagagtttgctgaaatatgtatcaaatacaaatactctaatggattaaaatattgaggctggtaatattcattttaagatgtaagtttgttataaggtatttgtatgtatttctggagggatatatgcttaatgtaacttaaaccactgggtcatctgcaaagacttggtttatgaagcaatctagtctttgaatttcttgaactgtttcctcagtgcctagcatgatactttgatgataaaaaaaaaaaagacagagtagtttccctgaaaatctggtaggaaggtagatacaagcattaaggagattcttatgacagtatgttgggagaactggaattcaaaactaggagcttgagaaggcaggaaagacgtcacagagattgcagatcttgctaaggaagaaagaggttgatagtaagatgaagacattcctggaagagggcatgtggcctgtgcaaggctccgggacctggcaggacatgtaatgtgaagagaactcaggcagtctaagagagccagagtaaagatgaagtcactttagcttaagtgtgttgtgttctggatctgtcctcagttactaaacctattggaaaagtgaacacttagaaaattcctcctctgctctgtgacaacctaggtgtgtgtcatttgtaatgggcaacacgacaagtgacttccaaccaaaatctgtgtttttgcaaggtgatttattagacacagtcaattttttttatgcttacattttctaattataaaccaaaatcactgaccaatatactatatacaatgtaatgtgctaaacacacacacactgtctctctctcacacacacatgcactaccttatttaattatcagaggcaaaatagcctgttctataagaactattgttatctccattttaccaaggggagagtgaggttttgagaggttaaatgacaccaagttcagatagcaattagtacagagctgagctttgaatccaggaagtttaacttagaaactcaagaattttcacctttcaaataattgctgccttttctaagaatatgtgataccaagaggttcatcagagaactcaaggagaatagttaatcttagtgcaccaaataataacagactgtattgctgtttcatattgctgctgtaacacattgtctcaaatgtagtcaaccaaggtgtaggcaaagttggttccttttggaggccctaaagggagaatagatttctttgtctttttcggcttctagaggtcacctataaaccctgacccgctgaccactacttccctgcatcagtataacctcttgcttccaccatcacatcttttactactcctgcttttctcttataaaggactttatgattccattgggcttacctggatgatttaatctcatttgcaatttccttttaccatgtaaggtaacatagtcacaagttccaaggtttagaagggggacattatttagcctaccacacggatgcaatctagaaaaatatttgtttaaattgtaggtgagaaagagtgaataggtatgaactctgccctcaaggagctcaaagtatagttgggagtcagccatgtgaaccaaaagtgatagtaaaatgtgacaaggtgctgcaggctgcattgtgagtacttagcccgaggatggtacagaaagaaccacgcaaacattctctcatatttaaaacatcagtaaagaccatttgtcccaaactaatttttcattaatagtaaactccattttcatttagaattatattcagaattcttgtgaaattccaagaacattaaacattaccttaggagttaaaatgctttcaaggactttttttctgtatactaattagttaaaaattctaataaaaaacacacacacaaacaaaaaaagcacacattctttcagtacgtttcagaagtaagattctaaccaaaaagttgattcatatgtatgttattacttaacctgtgactttaaaaatgaaaaatcacccacatgacaaatggatttttttctctcagaaatgaaatgttacccatttattgacccaactatgtgattctttttgttacctttttattgcttttacttttatgttaatcacaataaaccatcattctgtcagagtgtcctaaaacaaaagatttgtggaagcctgcatttcaaaaataatattagtctacagaaaactccttgactctattaaaaacagtgacgatcctttgaccacactccaggaatttctctctcaccaagacaaaagcaatccaaaaactaactagttgctgggaacccagcagagtcgactttttttttttttttttttttcctcctggagctcagcaataggcttttattctttctttgagctcctattggctctggagaaaaaagacaaataattaaccctgaagtaagaagcatttcactgcagactcttcctgctgggttaacaaacatctctcagaaagcaagctccttgggagtgtcccgctcagtgtcattattgattagtgacacccattcttttagtaaagcctttggaaacttcggcttcaagggggtttgatcattaaggatgaagttttcagttgctttttgtccaaatttgttaactgaactgttaagtggtgagatggtgattggagagcctccccgggaagtccgggtttcactcgcctgcagtaaccggtctcatcttatgagtgcctcactgtgttccttcatgctttaaatgactcaacccctatttctctcaaggccctgtaagaggcaaagaatcatgtcacagcttgacattgtgacatataagcacctattaatttgagcaattggtacttagttatccttaaataacttggttatccattcccttaagcgtcttaaatataactattgattgtcgcttgtttgtttgtttttgcttttaaatcactctcagaccatgtaacatggcccgatgcatatgatttagaatagcataaccctcttgtccaaaagaattgttcctagtgtatttggaaataaactcaaattttcaaaatggatgaaaggcaatattgaatgaatcacttttctttcattttacctgagggtttaagagaagacaataataggatgaatgctttttataatacctttgggtggattgggaattttgccaatttggttagagaatgagccaagaggtcaaaataacaaatgggattcccataaaggtgaattagctactgatgctgtggctatcaacgtgtccttgcttaaaaaagcactggcaggtatctgtgattgttcttgtttagttatagcactcgaaaacacacacacacacacacacacacacaaaatgaaaaaactaccagcactactacaataataagaccaagaaaaacctaaattagaaagcaagagatcatcaaaaaacagtgtgtgggatgaccaaatgaaggagctgaagacagacccttaggaaaacctacattttctcagacacacttgaaaatagcatcattctgtttgtttctgtttggatgggtcttttaggataggatattgcactttgcaaagtctattgttgcattaaaaagtctcatgggggtcagtcttgtctcccatagggtagactctggagcttgtagctcttttgtaatctctcaagttgcccagcatgagctagacacatgggagacattatacccacacgaactgaattcatgtatactgagatgtgggtaatagatggaaacataaaaggtgaatgtcatctgggaaggaaagctatataccacatttcattatttgtagcttgcgaagaaacattctttctccttaaacatcaattccagttgctttgtggttggtaataagtggagaaaggtcacatgaaaggccatatggaaattacagtgctgccttgttcctgaaaattttcctactggataagctgcctttcaaaatatggcttcttcaatttgtaacgcagggatccctttgccttgatctactcaccaggtggacgccttcagggagcctagccttcccaaagtcctgtaatgccttgcttagtctaaggactgtcttcccaatttcagcattctgttttaggagctgtgtcttccccagaaatgacactagaaataataactcccgtttctcctcctcctcctattgagagaagatcaaatttgaagatcaatatgcacaggaacttggtcttacccaggtcttacctggggactatactgagagacagtctaaaacaatccaccattcatacagagcttcaaacctagaggaggaagaaagagaccttcccttcatgattataattattgtggaagatcttacttggacaaagggaggggagaatcaaacagaaatgttatggacaaggggagcaagaaaagtaaacaacactggacattgacctgaaagacaagcccatgtgtgtctcactctgtcctgaagagacaagagcatcttcaggagagcgtctgcaagtacagggaggaagagggacctcaacagatagctggtacagggcaggacagatgaggttcaggaaacagcatctgcttcacaaaacagacaagagctggctctgatgcatgtcttgagttggcattacagcttgacagggcaggatgtctgatagggtagtgacacttagcaatgagacagtgcaggaacgttgaaacaaaattcagccctggcccctaggcagcccctaacccccattcctccagaacacacacaaatatgtctttagctttaagagtattattaactaatgcaagctggtcctgagtacagttaacaggactcaccaagcccactatatcccaggctaagtgatgttttaaaatcagaatcaggaaaagggagtgcatggggaacagagtgtggacccatattctttttctatgttagaattcttgtgtaaattctgtgaaaagttgaatcaatttgctttgatgctaactttttaatacatacacatatatttaaatatatggagggtcatttccctctagttaaaaaaaatcctctggttttccacacaactccatccagcaccacactggtgaacttttggtgacataggtcctatattgaaaaagagtagtgtttgttattcctctcaagcttcttagtgtcttaaggatcttgctgtaaaacatcatttgttattgttgtgctccattatcctcttccctttttgagtgctatgtttattttaaggaaaaggacaaaatagtgggatttggtggagaatcttctatcccaagaatagaaggcgtatgctctacatacaaattctggaagcagggctttgaagtatcctccctcctagaagatcaaagtccaggaaagtgaatacaaggaggaagaagagtagaggggggaaggaaaaacacaaaattaaccagcatattctaggattatatggagagaggttcttcaatttgccactctgcaatcatctttttttctcatgtgtcttcatgtttaaatagataaactttcctcaaacatgcgattatttcttgacactgtaacttagtgcaaataattcactcaaccttggatcacccgcccactttctgttttagaatgctgattaatcatccagagagtgctcacccctctgagaaacctttcctggtactggggttgccctttctctctttattctcccactgtactttagacatctgtgctgctggaggcagatttatctggcagtgagtgaagcctgaccttcaggatccctcacgcgcacaggcccctttgtgtccaaggagttgctggttgttgtagaattctctgtgggaggggaagccagtttgcaactgggaagcaattctgtgtaagcatgtttgtaaagcaccagagacatgagtccccagaagtccagtaacttttatttttccttttccttcaaaataaataagcacttttatacctggtggtgcatttgtaattttgttttcattttccaagaggattaccaaatggtataagcctggggccccacaaaacctggagctgttcccgatgcttgctttggtgagcactttctgttgagagctggagaaactcaactcaagcttgttgaaaaggataccaagattgcttctgggatcagtgatggaaaccagctcttggggttggacaagagcttggaaaccatttcatattttcttttgctttggctttcttatgcaagttgtgggaaagtaactgtcttcagcctctgcttcacatctttccagatccaaaagagaagaaacttcggttgggataaccccaggatcggcctctcacaagcacaccttgagactgatgtgtcaagggatttagtttctatgactgggagccaacagagtaacatggaaaggataatggggataaaggatgtagaggagcagtgtgatgttatctagaaaagcaagataagcatgccgggaagatagccactaaattacctctattttgaattgaatttgttttcatacatgtggggctcttccataaagctatgggttttattaaaggaataacctttctaaatttctctcattatccttagtgccttctctactgtcttgcccagggttgtctgtattaagtaataagtcagcgaataaacagaaaaaaatcaagatagtaacctcccatagtagcgtatggtcaccatattgctgagcctgaattccatactagaaatcagataccaaacaatattccttcaatgtgatttttccaatgcatagaaaggaatgctttaagaatagtctttctggctgggtgcagcggctcatgcctgtaatcccagcactttgggaggctgaggtgggtggatcacaaggtcagtagtttgagaccagcctggccaagatggtgaaaccctgtctctactaaaaatacaaaaattagctgggcgtggtgacacgtgcctgtagtctcagctacccaggaggctgaggcaggagaatcacttgaacccgggaggcgaaggttgcagtgagtcgagatgatgccactgcactccagcctgggcgacaagagagaaactctgtcttgaaaaatatttttttaaaaaaagaatagtttttctaatctgtttgagatattgtgttttaatgtataacaaatatatgaattattatggcttaattttgtaaaattcctcataggattctgagaaatattatgattccaaataaaataattaatcccgtagcagtcatcataacattcatgcataaccaagaatgtacatagaatattattttactgggtggctgtgaatggctgcccaatgttttccagttgtggtttgcattgaatcctcccaatggatgtgttatgcttaggtcctgtgtggtctcaggaggggaataacatggccatcacattcaatttttttttctttgaaattgaccaaagaaggtttatatcagctaatctgattactaaagaaacatcctgttagttacccttctcggaacagtggagttatcaattttgcattcgtgttacagttgaggatccctgagtacagtgtcttcttagttcaaaattagatgtgtttgaagatcaccaaccaaaatttgatgaactcctgaaattattttatcaccagagtcaagtttaaccattttatttttttctgactcttaaatggatttgaatttccaattgtctgcttggcctccaaaatgacttgattcagatttagcattttgaagccaactaagattgtacatagccattatttggttgtgttgtccaatgcagaatttttttttttaacttaataagaggaaaaggggtcaggcacagtggctcactcctgtaattccagcactttgagaagctgaggtgggcggatcacttgaggccaggagtttgagaccagtctagccaacatggtgaaaccctgtctctactaaaaatacaaaaattagcccgatgtggtggtgcacacctgtaatcctagctactcgggaggctgaggcaggagaattgcttgaacccaggaggcaaagatttcagtgagccaacattgtgccactgcactccagcctgggtgacagagcaagactctgtctcagaaaaaaaaaaaaaaaaaaaaaaaaaaaaagaaaggaaaaggaaaaggtacctgaaatcatttcctctaactctaacaactaacaactagattagaactaaggtacagtgaaagaatgattacagatatgttattagaaactcacacccttttcgagtactgtgtgctaggtaatgttacatgtatgtcttaggtcaaattccctgggaaacagactctgagacagagagagatttgtgcagacagttttagtggcagggagtgaggaggagtcggggggtgttctcagagggaggaaagcaggactaggcaaagggaaatgttaaactatgatgcagttccaacagaccacttagctaatcccacaagacgctgcggagctggaatggcctttcgggggcccaggtctttgtatctccacatccatccagctgtctgatgtggaaggggcataatcctgagcaagtcaactccccttagctaagggcaatctgcagagaaggtacagctataagtcctcagcagtcagcactccctgcacctggtgcaaccatgcgggcacacttcagtattcattattgacgctttatctcatttagtcagtattgtgctagtaaatgtttaataactggatctaagtaggggggaagagaaagtaggcttgatttatagtctgtcagttttcatggtgtaaatactcctaccatggccaaattcaggttaccagcttgattttagtgaatgcagagttgtgaagagatgtgcacatacagctcttaaaggtatgagcggactccagcacatcagcactttaatcttcattaagccattggtaaaaataatattaatcccttttgtgaaatgggagatcatacaagaagtacattgctcaattcttctttatatacaacctgaaatcaccaggtaactgcaaatttctctgcgaaaatgtttactatagagtttttcacgtatcatttagacctgcttgcacaaattcagttttcttccaatatgtatatttgagtaaaaccattattattattatttttaggtaacatctaaacactaatttgggcagttaatggaccgatttgtttgggttaagtaaaaagtttaaatgagactgaatgctaaggaaactctagatgtaaaattagttcaggcctttttgtgttgttggtgtgataattagaggtgtctgaatgtttgagactaaaagcaaatttacaaatgtgggcgattatgttaaaaactttgatgagatgcaactggaagacactctggagccacgaaccaagatttccaaagcctgaccaaggaaacaagattagtatcagttgtgctctgaatttagccatggtaagtatcatgggtcccagaaatgtatttattcttttgtaaaaggtgtttttgtgaaagttattctgtgaacactatgggacaactgcaatgtggcatgagagaacttgaggtttatggacagagaggttcagattggaattataactgcatgtcactgggcacatgctcagactctctgatccctggttttctcatcagaaccgtgatacctctttcccaggttgccgacaagtttaaatggggaatcagattgcttgccatgtaactgcataatacattgtagcagttcctgtaattagtgtaggaagctgagaatttggaactgaatatggagttttcagtagactaaggtaacgattttatgtttctcgaaattacccttaaaattggaatgaagtattctcatttgtagtagattttagtaaattttagaggtatggatgggctttcttactctctatagaatgactgaaagaatgtgttctaaaaggtgtttaacatgaaactcattaaaattctatagcagtggttcacaaatggaacacaaacaatgaatagaagtcattacaaataataatgtcccagagaaaaatcagatggctgcgacgaaatacatgaattatcatgcttatggacaatgttagaaaactcactgttttctatgcaaaaactcaaattataataaaatgataagcctatcacttctctcttgctttactgaaactaacttccttcctatctaaaataatgcacacgaagcattgtgttccctgtgaaaccccaagctgcagataaactccattcactggagatcttattaagcaaacaattcaaagagcggctttgctttcacaccggacctgatattgacagatgctaaccttaccagcaagactcctcttttgtatacttgtgatggggaaggttttcttttcctttcctagctcaggggaggatagatagagacaccgaagtcgaatttctcttataaaacatagctttgggatacttgtaagtggtacagaaaaagtgagactttactgtctttttctttctttccttgttttggctggtatcttgagtcatactttatagcttcacaaaaggccactggacatttttattaggcttgaagagaaatgtttttgactttcttttactggcagatttccatgcaaactgtgactaatactacttccattgcaatttgatgagaaaagacaagacaatttttcactcacaatgagaaatgctaacagctattggaaaaatgaaggttatacattttaccttttgatgaatttttaaagttttccgtgcaaaatagaaaatgttagtaatatgtaaaatcgttttcactctaccaatataaaataaaatattgtcatacatttctacaaaaactgatgagatagaaatgccagaatttatggatatatgtttttaaattccaaatagaagaattattctggtagaataaagaattaaaccagtggagaataatttttgcataaatttcaatttatgtattaattaacaaatataaatgttagcaggagtattagtgaataaatataattttcatatgaaatcatttcttttgatgattagcagggtagggaattcatatatatctatatgtttttatatagacaggcatacttttagagctaaaaaaacaggatgatacaaactattatttttaatcttacaaagttcttatgtgttttatgaaattagaggacacttctaaactcaatatcttgtgattcatcctccatggaccatatatgaatgctgacctaaataacagattgataacaaaagttttggccaattctcattttctccagggttgataaggagagtattatatatatgagaggatatgagacctgaggctgttcttctccgtctgattgggaagatgtacaactttaacgacttgttctatcaaatttatgatggaaaagtaaagtaaatagaggagagacaactaacaattaacctataatgtttgccttcgatacacacaatcatagtattaaattctactgatttctttcaggaataaagcaaacagcaatttttttgttgtttttttcctaagaactgataggctttgtcacgtatggtacacgactaccttggccaaggattagaaacactttttacattgaactgggggaggcttgaagcacaggttcactcctttagctgtttatcagaggcattatttccaatactggcagtagcactggaagtccttcattttgcacctataaataataatagatacaaatagttttcaggttgcaagtcagataaaaagtaattgcttattaattaaatttgtaggagtcataggcaattatcaatgaacaaaatcaattatagaaatcctaaaagcttctgtaaaagcttcatggtatctgagtcaaagaaaccctagttgaaatcctggcttctgccctaatcctctctaaacctaagattcctctttatctgtaaaatgggcacatattaactaatgagatgtttgcggagattaaattaagtcacgaatgtaaagcatttagcgtagtggttgacatcaaatagcagtgcaatatgagatctatttataatagcaatttaaaagcattaaaaccctacgaaattagtcaaacctagatatctgatcattttaactcacaagacaagctttgagataacccaaagctttggctgggttgaagtttgtcctgttgggtcgatttgcatgttaactccctgtctctctctccttgtctctgtaggggaggaaaattttcctcaactctcccggggtccctggctggatctgaaaataaaactgacaaagacagattaacggagaaaagcatacaaatttacttaataagctttatttaataagtgacatggggactttcagaaatgaagacccaaagaaacaagtaagcacatatttttatgcttaggttgatgaagagtggaaagtcatggaaaaatgtgattggaggacaaaagggtatgatctaatggtaacaaactggggggacctagcaaaacctgtttatgcagattcatcctggcatttatagctttgaggataaggatgttcctttccttccctctgggtacagaatgggcacctctggaatgaaagttttatgacctacttcagagaaagggtcagagagaattcttttaaagcctgcttcaggggagaagggcaagagaaggtcagagaaaccttcttgcttctgctgtttcctcaaatggctagaagctgtgttttgaaccctatcaaaataggagtttcactgagtcctgaaccccatcatctccctgtctctgaatcctccccactgtctttcttcatctgtgtgcatgacaggctgaagggggatcatgaccgattttagacctagaaaatatactattgatacatgtacacatatcagtttgttcttggctttaggatactggtttaactttctgtatcagaagagaagtaaaagatatgtatttgcgttttgcacaaataactaaatacatcaaataattccagaggctgggattttttcccctgattttgagagagtacttatcctagacagttttgcaactttgaatagaaacaaatctctattagttctgggaagttgaaggaagagctggagcccaccatggctggccccaactgggattccattatatgagcaaaatggaagcttctatgttggatccaaagtttttatttttcatgagccagatttttatcacccttttactcctttgtcatttacaaataaactgctacttacatatatcttcaaaagccattattcttttttatctcccattgttcattactggattttccagatagttttgacatatatcagcaaatattgcacttcatctttacaattttctacaaatatctaaagaagcatggaaattgccaatcccaattagctgcatgtctcatcatatcggttgttttattcccagccgatacaaaattcagttgaatgtcacggaatactaagcaacttggtatcatcacaaacgagagaacacagacactcatgtgcccatttttttctcaacttttttcaacagattttgttgatggtgtccaaagaaaggcagctgtaatgcttttggcttgcaaagcttatatcgtactcagctaaatacagttgtcatggaaaatggtaaaatggtgacgggggtttatctagagaagataaagtaaattactgttttccacccaatttaatacaataattttcactgcatatgttgtcttctctggcataaaaaaagtctaaactttctctacgttagaaacaaatatctggtttatatatatctcatgtaaaaaggaaaaagtgtgtcatgatgctttagtctcttgaagaggctgtgaaattttaatttctagtgcatgatctgaggtcacaacatgttaccagaagataaacatctaaatgccaatttgcagagacagaacaattctatttaccttactaggtgtatttgtaatttttacaagactatgagggaaaccctgtcccccgaggccctcatttcacactgtagacttacatgattttaagatgtcaatgttgttcaatgttgcaaatgccttacgtttaagtatctcaggattgaaacaaactgactaaaattcacagccacagaagatttctgtcccatctcctaacttcttgctttttgttgaagagagaaagtaatatgcccttcagatatttcctggccagaattcattcccacagatgaatttgtagctctctccaatgagataagccccatttaactggtcctagggtggtcataatctatttgggggaaaggtaacatttaaatgtagacagatgctaaattattcccaggaatgaaaataacgggggatgaaaaaaaatggctctgcagaggtttttgattgaagaagacttaagttagaatgaaagtttggaagtcatccttccaaagagaaggaatttggcaaatgctaatgttgcccttttctcacttgtctcagagttccagataatagttaggatgttcctggggctgtagcatgtgataacaatggcaatagcccctaactggccttcccatccattctacctgacatcatgatatcagatcattctctcaagggtacaatgactcctccctcttagcaagaatctataatggcaacctatgatattatgatatgatatatatgtcacatacatataggtttttatccatggtttctggcttataactcccatgtccctttttatttctcctgaaggccatagacactaaaaatatactctaatcttctctgtctttgagctggccatacagaaattctctccaggcacggtggctcatacctgtaatcctcacactttgggaggttgaggtgggcggatcacgaggtcaggaatttgaggccatcctggccaacatggtgaaaccctgtcgctactaaaaatacaaaaattagccaagatggtggcgcatacctatagtcctagctactggggaacctgaggcgggagaattgcttgaaccagggaggcagaggtggcagtgagccaagaccacaccactgcactccaggacagagtgagagtctgtctcaaaaaaaaaaaaaaaaagattatctgacccaccttgtctgtaggtcataagacccctatttcagaaggtgttctgccccatgctctggaggaaggaatgctgcatagagaggccaagaagaacttcaacagataggtcttgctgggttcccctctcagtctattagtattagattataccctttttgtccaatcacacttctacatggttgtccatgcttcaatcctgcctgtccaatgaggtttccataaaaggccaaagaggacagggtacggagaacttctggacagctgaactcagggaagcctacaggaaggtgaacaagaacttatatatgtgcctggacagtggggcatcccaacaccccagaggaaaggctcctgcacttgggacccttccagacctcattctatgtatcgctgcatctggctgcttatttgtgttctttaaaatgtcctttatgataaaccagaaaatataagtagatggttccctgaattttatgagctgctctagcaaattaattgaacctacagagggaatcatgggaactccaacttgaagccagttggtgagaagttccagaggccctaacttgcgattggtgtctgcagtggaagggggcagttttgtgggactgagcacttgatggtgtctccaggtggacagtgtcaggtttgaactagaagacacccagctgatttcccctgcagaattgattgattgattgcttggtatatgggggaaaatgttttctatgttgattgctgtagtttgacagcagagaaaagagagtttgtggggtttttttttcccttcagattatcccatgattataaattaagtaaacttctccactcccctataatggacaatatggcaacgaaccatctgtctgccctttcttcactttacttctggtcttacttttatagctccgttataattactttgcaagggggagccctccatgactacctagtatatactggatatagggaaaggttggcttcaaagcatagaagggatttgatgtgctaaaataggctggattattgatgccacataacatgcgagcagacaaatttctttttattgtttgtccagaaggggctaagttgtgaccttttactggatcacctttaccttatcagtgatatactctattgcttccattgagaaagattttaaatttctggttaaagcaaagcatgggtattttcagacttaaattacatcatgtaacaggatataagagatacttgatatctatttgagtgaggttttaatgggtaaagtaaaccttttctggcaatgggggaataccttaataaactcacacacttggtttgacatacagagctctatgatgggaaacttgagtatggtctttgaaaggtttcaggttcattttataaagttatcaatggtttccacttagggtagaatgtcactaaaagaatcttagttgactcaaaatacaagcctagataatggtcaaagttattgggttctttcattccagatcattcaaaatcaagtcttgctcaacagttttgctctatgagaaaatccttccacttagacataaccccttctgtatgccatgttcacaaatactttaccatataatcatggtgaccagaatcactgacaagcaactaattttagcactactcctttttacaagatatctttaaatcgtgttggttttgaatgatgcaacccacattccttgatcagagcagagtaaactaaatttgacaaccacctacctagttcagcaaccactcagaattaaaattccagcaagaagtgtattttaggcctgcattctgtaattatctgttttgtgtgttcaaagccattttttaatactaatattgtaaccagtttgacaaaattcaaagagtggcagctctgtggaaagtgatgtcatacttttccctttcttcaaacctcttcttataaccagtggctattcatagattcctctccctttagcagacaaatgagatgtccaaataatttaaagatttacattcattttgtagaggtattatacttcatttagaagtactcagatgggcacttggaagtgggaagtgctatactaggtctcaaaggttgatgttagttcagacaatcttaacaagttgcctggtttggatgaggttactggtttcctatccccatacttgctttctctgaattatcaccctcatttttttcttacctgggctgatggctaccttgtaagaagaaaatagaacacaaaaaattacattttccaatcccttttacagacaggtaaggtaatgtcactaaattcttttcttttaaactgaaaaataataagtgtatatatttatagggtataatgtgatgtttctgtacatgtgtacatcatggaatgaccaaagcagatgaattaacataggcatcacctcaaataatcattattcctttgtattgagaacatttaaaatcttcttttgactattttgaaatatacaatacataataatgcattgtagctagcctacttttaaatctctggatcaatgtggactgccagaagctgtgcacttggattcccttgtttgggggcccacttactccttcccatcctgatcccaaagaactgctatccttgagcattctcccttcagtgtatatttagggttcctagcagaacgattaatgctgttcaaggtatcataaaccctatacccatggatcaagggccctctgcaatcatgaacagatgaagattttcaggtactgcaatctcaacttgaccttcatttttcctgaatttatttcaccaccaccaaacccacttttcttcctatgtttcctttcccaataactggtgagcattcaccacatctagccaaccactcattcttaccatcttacctacaacatatctctaaattccatcctccttctgcaagactaactgccctgccatcatattacaaattattttctttcccgctctaatgtggctcaccaagtcatggtcactgatcttgtctttatttaacatgttgatatttttccatcatgaattttaaaaaattatttttgttttaaaaatatttcattaaaatattttaaaattaatatttccatataaattttataatattaatttaatatttcaacattaaatattttaataaatagtaattcattaaattaatgcatattaatttaaataataccaaatattttaatatttattattttaatttaatgtaatatttaatatgtaatagttcactaaatcttatttatcttggttactgagggttttttggttaaattttgagcctgaggcaagtacctcactcacttcactacagtcccaacagtattccctcatacctccattttttggctttattgttttccattttacctgagtcaggagcaaaatagctacagaagattcgaggcaggaaggctggggagcagagggagcaggtctgccttccagcctgaagctgttccaaggggaccaggaagaagagttaacacgaagtcaaatttaatgtgttcataattacccgggattggccactcaattttttgattgagaatatatttgcaacttaaagtgatcataggctaaattacttaagagtaaattgaatagtcatatgcctgacactgtttcacccagggctgagtaaacttatcccttttgataaaataaaaatgacagaaaaatacttatgttcttagttacatcataagccagactagttttgtaatacatattggccacatctttttagttgatttttacctgtcttttcccacctgtttgttcactgctttctctttaacctgaagcactccctggcacatcataggaacttaatattttagtatccatttgtttattcattcaacaaatattcatggaagcctactatgagccatccacatttccatctgctagaaatagagagtgaaccaggcaggcaaataccaaagagcccttccttgactcttaggcaaagtgaggtaataattccatggcacccagcaacacaacactcatcatattttttgtaatgatctctttcaagtgtatatttcactggttcaatgaaggcaggggatgtattcatcttgctcatcaccatgactctatcacctagtggcctggaatatgggatatactcaatgcggatttaaataaatgaccacatttctcaatatttcctctgtgatgacttaactaatttcttttgaatgtatacatgtatacatatgttcaatgtatatatgtgtacatatactatcagaatcagtctgtttttgtttttttttcctgaggaattgtcttgtgagtgctgttgattgcctaccctgaatccattatccctttatttatttctaatggatccctgattttgttcaggaattcactcttccctatgaagcccatgattcaagagaaactgactcttcctctatcgccagggacttgattggttcaattagtcctaatgaaagtgtttctattcttagcaatgtttggcttcagtatggacatgcaatttaggtcacttttaactgagatgttttccaggggcttctgcgaaaatctccccttgtttgcctagagagcctttctcctacagtagcggttctcaatcttgggctattttgcaatatctggagacatttgtgattgtcacatttgggggatgctacttacatctagtgagtcaaggccaagatgatgcagctaagcatcctacaatgcaaaatacatccttcaaagaaaaactaattattcagcccaaataagaatcaagaatgtacaagctgagaaaccctgatctaacatgaaggagaaagcatgtagctctttctgttggctccttccaccatacaaccacagaaaaactagctttaggataaagctcaacactgcagattatagaagaaagagagaaagattgtagattcttgataacttctccaaatgcatagttggatcaaatatttttgaagctgaccttggctgtggactcccagtgatctgagccaatatgtctcctatttgctgtgtcagtttgagctagattatttttaaatagccattaaaagcattctatgtaaactgatatatatttctttattaaataataggaatccagttactgatttcattttactttggttttcaacaagttaaaagctaatttatagtccaatctgaataactataattttttctatctgcatatctgcattcaaattttttacatagtcttttatcttcgttctatttatgtgtatttttgctctgaatttattttgtacatattcttataagtctttttatcaatttcattgaatgatgtaggtgagataaagtgccttatacctcataggaaactaaagatatatttgtggaattaagaataaaggtgtaccaaacaaacaatgtttatttaaatattaatacaacttatatttagctggtctttgaaaattgtacaataccagctgaaataatttggagtcaacatgggaggcaaaataccatttgtaagctagtgtttgcagagattgaaatctataagtttagtgctctttctctttcatcacttgcatatctagccattctctccttggacaaaaacaaaaatagcagaattatgtgaattttcttacacattttttaaaacatctttaaatatttgttaaaaaggtcaatcaaagcctcaggattttgagtttttatcctatgattttgttcaaatccacagaaaccagtgttatttagctcatgatatctttaaaataagaatggttgtagagacctacaaaaaattaaaataggaattacttggcacaaacagttatgtaacattttatgaagctcaagagcttaataatactaagtaagagacaaatggtaactgggcaaagtttttgagaaatataactgcaaattactgaaatctcatttaaaaaagctaagatttcactttgttaatgggtaatagttaaatattttatgctgaccatatatttgcgcttgcaggagaaactaccacattgtccatttgtttgttaagtcacatgttctggtattttagtcataatctgaaagttacttttatatataattaatgaaacatgagagggtttgagttgatttaatctattttttcagtctccctttcctagtgatttcagaggtcagaaataacctagcttttcagacaagacagtttcctctaccaaaacaattagtgtctagctgcagaacgaaggaaatagaggtttagaaaacacaagtttttgatgctcataggtcacctgcggactgtaggggtaaaagggagccttttagcatgttggcctgtgtagaagaaagcagcacttgggaggaagggcattccagagccttaggacctgacctagggactttctagttcttagaagatcagtcctaaaatctgccaattgcagtgggacactagctggggaggaaactatggggttagagcgttaaaaggtttcttggcagggtgagtattagacccttgaagttgaaggtaacagtttcaaatggtgtcaggagccactgatttgtgaactttgtccttgcttgtgcttgacccctctgacctttgtccaggctggcctgcacaagtgtgtaagcagctgccagtggagtgtgatttgaagggcatcaagaggcccacttggccctgattatttccccctgggtctggcataactttcctattacttagcacagcatctggctcaataaatcttggatggttggatggatggatggatggatggatggatggatggatggatggatggattcatcacatatatttattacatgccaggtattatacaaaatgcacaggacccacaaataaacacaatcattatgttcctacttttcatgaggcccactgtctagttaaacagaaaagaaggtaaaataaatacaagaattctaagtgagggttccgaaactttagaaagaaataaagtgctaaagataatggacttcagaaaagtcttcaaaaaaaaaaggcatttttcatatgaaaatgaccataattaaaatgcaaatatatgttcaggaaaaaatattataatctcattggccctgacttggtgtttagagagtctgtctatgaaaaggtaaaagtagagcagtaagaaaattagggacttttgatggggagaaaacttctcaaggaagggataactgagagcccagactgctgttcaagctgaactgatttgagcagagatgaacagactagaacagagccactgagcctgggtcctggggactgtgggacctggagcgaggctgtccagaaccaactggcctgagtcccattggtgaacctgacagaatgttgcgctctgggaatccaagctcaacagacaagctgcagtaagaaagtctgattgtgaaaaatgctaagaactctgtgcaagagtgatattttcttgatggaaatgtgacactattatattaatcagagatgacagaattgactttggggccactggtttagtaacagttagaaggaaagcctggggctattttaaataaacaattcctttgcatcagataagaatatttcttgccacatctgaagccatttgatttttcatctatcagttgcctttggattaatcagagaggagttgcatgcataataatagaaataagctttgtctatgatcatttttactttagctttccaaatttgaggaggatctactgatagtagaatatttgctgaatgaatgaatgagcaaatgaaggcataaatgttggagtataatttattattctgctgcctgtaatactttttaagtgatagtgtctcatgtcctcattcacctgacactgtgattgtgggaaaacagaaaataatcttacctcaaattactggtttttatataaagtgctgtagttttattttgatatgtgattagccaagcctctaaagcctcattgtgtgttcttgaagcacataagcagagactgatctataaaacatgaaagttcagctttgggggtaagccttaaactaaatctgcactgcttgcttgtgtctactccaaaattccaaagataagagttcctttatttgccatccattatcactatttaaacatctttcattgctgaagttgtacttctcaaggagttggatgggttgactttgaacagtagcagttcataaagacagcagagccctcaccctcccaaccctatctcctactttgtttttctactttcagcacgaagactctttttagtatcagacggaggaacacatttttctctctaaaatacatcaagggaaatgaagggaagcaaaacctcaaaagcaatcttttcaaacttataaaattttcctctacaaatcatgatttctgctttctaacaataaccaaagagccttcttgaacatcaaatagctcttgcaaaatgacatttacaaaatatcccatgtacacaaactagaaacatatggataaaatagcaaacatttagaagttagtgaattaaatggaaaaacacctctgaaagcacattttatattgttattgtaataccacaatgttactaatgctggataaaccctgagaacagctggattttgactatatctaattgggcctgacccaaatcatttttatttttttgtaagaaaatagcatttctgtacattactcttattttcagtgctgagttctggactatatgccagtgcttaccaaattcgctttctccatatgtgtgaataaataaaagagaggctgcagcccactgctgagttttcataataatggaggaacaatggtctttgaaagttacagataatccccagtcctcattgtggtcatctctttctgtccaatctttctctggaacaactagcaagatgcaaaattgactgatgatcttctcccttcccctgcttgaccctgcatacacaccgcctctcgtagaagtgccaaggagcagtgaaatgaccaaaaggcagggagtaggagggagaggaaagaaaaacaaaccaagtgatcaaccccaaatgactgagtgttggctgttttctattatttactcctttgagctttctcagatgtgtttttctgagaagactttcatgttgtcttttctttcctctctgatagttaaccaccaatttccctgcaatgggctaagggtgcagagcccttgaatgaggtccaggtaggctgccagattctcaagacactaaagcacaacatttccatccccattcttttgaaaacaggcttttaaattgtgcatgaagccatgtcaatgatgaacaaaaatgaaagtcacaaagtagtgagtgaaaattcaaaagcagttcatccatcctcggtatttacatacagctttaaatatgtagatttttttgaattatgcattttggtattctatcattttataaagggctgccagcaatttacaaaaaaaaaaacatggtctacattgagttctgttttgatctgccctctccatcagagtgtttttaaatgcttgtatcatgaattaaacatagaacaatctcattcatttaaataaaatccgcctactgagggccatatgcatggtttgggtcaaatctgtggaagcgtcattgtggagaagaatgccctctggccatgtcttttctgtttcaattgtccaaggtctaagaatgaacaccaaagaggaaggaacacatcaatctgagtcaccaacacttcaaagatggtctttctcaaaagaccaatacactgcaggctttcatcacatataaactgacttaaggaatttcctaaaggaggtagactttatgtagaattgcttttttttttttttgaggatttaatggtagaaggacttctttgtaaatataaaaataattatttaacattcatgatgatgacttacgtagtaacaattttattccaatcattatgctaagtgctttacataatttattttaaaaaccatataagatagttatgatcattattcttcatgtgtattattataaacgacaaaaagggagcacagaaaagtatttgctgacgctcacaacacatcaggatttgaatttccttatcttactccacaacataatatgagactcgaaagactacatacttatattttattcaggtactttaaactttctcagagatcctactaattgatgtagtttgattctgggatcctcaaaagggaattttatataattttagctattgatggtcatttctaataacttgaaaatatcactctagagtatatattacacatatatataacaagatttctaaatctaggccaatttttttaaaatacttatttttaatgcctattgtcatgcatttttgcttgttaaatctgtaccttgtgtgtatgtcagatttattaaagagataaatgttaaaaaatgaaagaaaccgaagacagatgttactgtctttactatgtaaagagctttcatgaatcaacatgaaagtgtatagcaactgaatataaaaagacaaagaacatgatgaagaaatttaatggggaataaatacaaatggttagactcaaacacatatgataaaatctttcatatcaattttaactataagaatgccaattacatattatattttaattattaatgaaaaagattaaaaactattttaattcctattatttcaaggacatagaagtatgaacactctcaaacatcactggtgagagtagaaattatttaaacataaacacccaaacacacagtttaaaatatgagttgaagttgtaagacttcaaaatgtttatactctttgagccaataatttgatttacagtagatgaagaaaattgagaggaatatcaaattttacttacaaggatatttattacagttttattttaaataaaaaatttaaataatttataagttcaacacaaaataaagacctggctaacacatttatgacatagtcataggatagcaatagtgtgaagactaattacaagttgaatatctcttatccagaatacttgggaccaggagcgtttcagatttctgattttttctgattttggaatatttgcatatatataatcatacaccttgggaatgggacccaaatctaaacacaaaatccatttatgttttatatacaccttataaacagagcctgaagggtaattttataaaacattttaaataatgttcttccttaaacaatgttttgatcacattttggctgtgatttgtcacatgaggtcagatgtggaatttttcatttgtggcatcatatcagcactcaaaaattttcagattttgaagcatttcagatttgggatttttaggttagggatgttcaacttgcaatataaaaacataatatagtacatttatttgcaatataccattaaggagaaaaagaatattaaaaatatagagtacgatctcaatttataaacaaatacctcctatatagctctacatataataaagctacatcacatattaaaaatccacattatatgcatacatatataattgcatataatagaatgagaaaaaactgtaatatcaattatttaaatgtggtataattgtaggtgattttttctttattcttgatatgtactggcatttaaaaaatttactacaattaatatatattttttatagatgaatatgtctgatataacatggaatcatcaacccatggtgttctcaagaaataatagcccaatataaatgcaaggtactgctattagcataaatgtttacttgagtaaatttatgaaagaagttcaatgtcactactattcacagaaatatgaattaaaacaatcacaatgatttccctccacgtttgctgaagttctgtgctgctgaagatagaaagaacagtcctcttcaaacactgctgcctggagtgtgtaattggtacagtctttttggagagcagtgtgtcattatctaccaaaattttaaatgaacacaccttgaaaattagcaatttcacagctaggacagattctacaaacacatctacccaagtgaataaaattgatgtacaaaatgttcattgcagtatcttttataatagcaaagtactggggacaatctaaatgtccatcaaaagaagaatgtttaaacagatttagcagctgctaaaaaatagttgagagagatctacatgtaatggcttagagagatgtccaatacatatgatctttaaaaaaggacatggcacaaccatttgtatagtatgattcaactgaggtttaaaaaaatctgaatatatagaaaatatcttaagaaataaatcttaaatttaacagtggttatctctttggagggacacgaaccaaggatctttggaggcaatgaaacagggatttcgggttgaacttttattcttctatggtgtttgaaatttttgcagtgagaagtatttatgtataccatagaattagaatgatttaaaatgatcagtgactcaagaaaactgttagccatttgttttaaccaaacactaaaatattggcagatatcatcaggctagttgaaactgtgaattactctctacaaaataagagtatttttgttctcttttaaaatattttaatttttgtggccggcacgaagctgatcttggcaagagtggaaggcattctcacaggaggagaaatccatagagcaatatatccaatatattaagttgcaacagccctttatttaaggcttttggtggtatcatcatctcttaacaaaacatttttatttttccaattttaaaattctccagtggccattttgcttgatttctttcttgtctttcatttcttcatgacagtaatgcaaaacaaattttgataaaaatatcttgttcattttttcactactcaactctctgctttcaagcagagccaaggaacattgatattttgatataaaataatttttccctttgaattaaattgtttttcaaaatggaaaggatccctatttttaaaatagtacaagcatcttatgctaatttaaaaataacagatagtatgtaaaaatgcaatgaaactaaaatatccctctaatcctatcacaaagagacaggtgttagcattttggtgtatatattttgtgtgcatcagttttcctataacttgattttttttcatgtgatactccctttacccttatcatcattgatgatatcagcataagattctactatacggatatttcatttttagacaccaaaatttctgccaggcccaactgattgccagtgtaattagcctctccctctttcttgttggcaaatcttgcctcccataatagaggccgaataacagttattcacgttctcagttttctttgcagctaaggtgtaggtatgagtccccaaactggctaatcatcgcaaataacaaagttccaggaacaggctttcctccttgatgaaaaatagacatgcttggagaaactgcccttcttcttgtctttgtgtaagatgtgatgcccggagctacaggagctgtcttgtgaccatgaggaatgaaacctaagaaaaaaactatgtcaatcataacagagttttaacaataaaagattctggatctttaatgacatttctgaactactgaacacactctagaagctccctttcagaaattcctatgggctgaaaaacaactattggttgatccactttaatcaagttattctcacctgtatccaaaagcaattcaactgatatatggttatttccaatttttcatcctctcaaacaaaactgaaatgttcattactaaatgtactaaatgtacaacgttatcaatttctccaaatgttttcctgaaataaattcttagtagtgtaattcctggctcaaagattagaataactttaaatataaattattttaagaacatcataaccagaatttatgattttattttttattcttatatttctttattgtggcagtggtttagagattaaggatcatggactaaagaggtatatgctacccatcaattaggtttctgcccactcttactacttggtctgcttaaggcagtgacttaacttgtcacttctttagttggctcatctgtaaaatgggtataaaaatatccacttcattgtgtttctgtgaggcttaaacaagttaacagctgtaaaattaatagaactctctagtgctagcatgggagcaggtgctctttcttcctctgtgtaccctcccatgctatcttagtaactgatatgtattagttgctaaatacacatttatctaataagtgaagaaatgaataataagtctgagatctttatctggacaaatattttgtcgtatttaagggtctctaggatccactcggtttgcctttgcatctgttatttatctttttgctgcaaccacaaattgggctggaatataatattacagtgatgagtcagtgtggactttcaacacagaagatctcaacctgaaacatccttaggattggcagtgcgttaaaaaatgagtttgttctactcaaataccaatttgttctttaaaaatcaacatagcatgcaagcattggatcttcagaagtgatgagtttttatagttttttagtcccattcttcagccaatgaagcaatttgctctttatcaccccagacattaatcacccaatgtgctgattgaatttttccatcattatttttaaatcctggaggtggcgaggatggaagcaaaattagggacccattgtctgactattattttatccaacataataagcatgaaggcaaaaaaaggacatcacatttccaagatattgtagttttgagcactgatcgtgaattcctttttaaaatttttagatctttacacactgatttttttagagaaatagaatccataaaatgagcattgagagacatctaaaaacatcacacatcttatatccatataaacatatatgtttgttgcagtgttatgtgtacattcaaatctgaattccgcaaggaatttcatcatattattaagagcaaataaaataatcctgcatcaaaggacagttgaacttaatggaagttttatgtgaagttcaactatcttactctttggctaatgcctatcaatcaacccactcattgccctcagttatgcattaaccttttgaggatttaaaagcaggtcacttcagatctttagtgtattatctcatctctctgatctactcaacagcataaaggctaccaaaatgaaatgactattccaacctgtagaaacagctaagattgttacagtggttctttgattaactcacattttagtggtcctgtgagagtattttatttggaggaaaaaacagagaaaagaagttgtatctgaatgttacactttaaaaaaatataattaatgacaagaagcggaaatgaaatagtccacagtttttttttttcttgtttagtgacagaagatcacttgctattaatggattacccaaaatgaagtgctaaacggtagaaaaatggtgtatgaataagaagtactgacaataaagactgttttgaatattttatgtggttcttggttgtcaaaaagcaaagtctatggactcaaaacgctatgccagtcagcaagctagaaagctgattgtaggagcaccaggaacacatttccaaaagtaacgttttaacagcaggattaaaggttagaaagtggaattttgtgtcaaaagcaatcatttgtggggtgtgtgcggggtggaggtgttgcattcatgtgtttttgaagaagataagccgataagccatttcctagcatgatctagtgtaaatctttacatttcaagttactttaaaaagaaatatctgctgggcacggtggctcacgcttgtaatcccagcactttgggaggccgaggtggacggatcacctgaggtcaggagttggagactagcctgaccaatatggtgaaaacccgtctttactaaaaatacagaaattagccaggtgtagtggcaggcccctgtagtcccagctacccaggaggctgagacaggagaattgcatgaacctgggaggtggaggctgcagtgtgccgagatcacgacaatgcactccagcttgggcaatggagtgagactccgtctcaaaaaaaaaaaaaaaagaaagaaatgtgaagtgcaggagtgttttaatactgctgcctgctgaggaagcagtgattggactcctcctgtttttcctagttgacaattattgtttccaatggacagtgacgcttgatgcctactgctgtgaaaaaactttcattcatgtgtccatcacctgtttatacaggacctactatgtggaaggcattgttctaggcattcagactatagcagggaataaactgaactaaacatcttgttgttatggaacgttgtccagaaaaagtactattgaattcatccactttgttgtgagatcaagatgtgttcgttttactcgttcttttggggatggagacttaacttaccaaatgtactttgaaatgtatttgtgtagacaatttgaaaggagctgggtctcctctttcctgacatgacttcccacaaatggaggctagaagatcactgtcctacctcagaaaaagagtttggaacagaattggtttgtatttaataaatacctacatgttaagaaaaagtcccactctccttttgatggtgtgcatgtggctctattgtgtttctagttaagatggggtctagagggagagaaacctagcgctctaatttatactttcatgctgaactctcctgtaatgcgggccagttgtgtcgcaacatctcaactaccctgatgttttctaagccctttctacccaacaagtgtggcacctggctccttcagttcagtgagattggcatctcaaggcaattgtggtgtttgcgggtgtgactgaccactgtgttgactcttccgagtcacatcactgtgccatgtgaattatcaggattcatgttcttttaatggagtggaaagggtttgaggctgaaaccctggggcattcctgggagagggttggaatcaggagccgggctcagccactatcctatgacaggcccatacccttcctttgtgcaaaggatcttgaaaggcctttactgtttcttctctgtgagaccgtgaatcacctatattttaaatgatgcgtttttaatgggtcaaaattaagagactgacataaacaattttgggagagaagtgtgtatctcttcatactaattaatgtccagagcagaaaatagtttttgatagtacaatgaaaattacaagcctttattctgataacttttttacttaacatgttataacattcttggaaccaagtcctgttttcagagaaagtttctttaaaatgccaaccatctccaagcctatcacagtccttgacttatgtcactgactctagaaaagactgttgttgatgatggagaaggtataggtcagaaagaaggtcagaaaacatgaagagaagcttctggaataggagatgaagtgaggacttcaggcctaaagttgaccccctcttctcctgtgcaaatattgacccctagtaatacccaccgattgtgacactattaccaatagaagtaatattagaataccagtgaaagttggatattctggaatacgaatggaggttccgaaaagtgtgggtttttaaatttgtttgcttggtttaaacacatttctaatttcttttatattttacctgaacttcttacaccctaatttggctaagtactacagccactgaaatagctccaaaagaatctttctcatgattttcctagaacatctagagctatggaatactgaaaatgtcccagtgtcttctgaggctcccattcctagagaaatagcgattactctttctctgaaaggtaatctttccttgttttaccattccaccctgtaaaagcagacttgaaaaacataataagaaatgatgttggtttttgtaatagcacatgaatgtattcttagctttctctggagattaaaactttaaaaagctaggtaccactctgtccagaacagttttaggtttgctttgagaccagagcaaggattatatgacccatcagcagaacttccatacttgtgagtactgcaaaaagtacaaaatatttgattcacagagtgttttcacacttagcaaaaaaaaaaaaaaaaatagaaaagaaaaaaattaacatttatatttaaattttaaaagaattttaaaacttataaatgatttgcctttacaaccaagcaaatctttgagtaaagtcctcatgcttttcttgaaataatagggcttaaaatggatttttaacatttaaatttaaattgcatttttcaaattgacttgccagaaattttcacacacaaaagcagaagaaaaccaaaatgtacctatcacccactaacaaaaactattctaaaacttacaattttcaatggaatcaaagtcctgacataaaataagaacaaaatttgtaaaaactgtttctactcttttgggcatattgactgtgggttattcaggtagctgcatgcttaaaatacatacaaatcatccagagatacttaacacttctatccctcccataataccctcagagttattgtcagcacctgggagcaagccagttcaggagaatctgtctgcatcatgatacagggcaaagattcagccaaaccctgataatctggtaataattcaatttagttttgtttcaactttggtatttgaatcataggaaaccaaagtccttccgtgtatgaacaagtaggttttttagggcatttgatgaggttttgctcagaaggaaatgttttaagtgaaaaaatgggactccactagttggatttctatgtggccattgagagctaataatatgacctcaacagaccccagtgcaagattataggactgaaaaggggtaagaaaaatggaagcaaatgggaaaatgtttccagtatgaagagttgacttgctggttctgagacccaaatggttcttttgaccaccttccccggtctccccagtccctacttaaggttagaagaaagcagagctgccaacttggatatagcttccatgatttggaagctgtaaaagaagtgatccttgaaaaccatttcaacaacaaagttctgttcatgaaacagctggtatttttgtgagttatcacagacttgtgacttatataaggatggaaattaaacacacacacacacacacacaagcaacatttttgaggggaaaaaatcccctcatgttaccctaagaaaagggaaatatttgtatgagtcaaaagcatctggctttgttttattggagcctaacattttccagttcttaccattttcatattgcttgccctagggctttcaggtatccttggcacattggccttggggacattttcagaaggagaaagacatgagaaacaaataaatacatatatgcatatttcctctaggaatgatggttttgtagtagtcttgtgctaacttaaaaagcaaagtaatgacatgttccttctacgggtaactcatgtcattactgaagaaattgaaagcaagtgacaaaaattaccaattgggccattaaatagtcatttaaggtacagcagctctatagttactaaggacaggtctatagttccctgcccagcatccctttcttctttctgctctcaacatttgttcacatcccttactgaacatcctcactactagatagaaaggagagttgctgaagtgccggtcaacagcttctacctacttttagtcaatctcataaaatagtaggaaataaaactgtaagtattggctgtttttagtcagtgttttaaaagaagggccgggtgcagtggctcacacctataatcctagcactttagggggtcgtggtgggaggatcccttgaggccaggagttcaagaccagcctgggctacatagcaagaccctgtctttacaaaacgtacagaaaaattagccaggcatggtgacactggcctgtagacccagctacttgggaggctgaagcatgaagatcctttaagtccaagagtttgaggctgcagtgagttttggtcatggtgtgcactctagcctgggtgactaagtgaaaccctctctcaaaaaaaaaaaaaaaaaaaaaagagagaaaagaaaagaaaaagaaaaaaggctaactaaaaaggacgggttttagttatgtttgattttaatgtccttacatatctctatttttcccatttctaaagataattttggtttacctattataataattttgtgattattttgggtttgagaatctggacttaaatgcctattggtgttttaagtcaatatctacaagggccaaaatgcacagatgaatgaaaagtaatttggctaattggataggataaatagccatactgaagatagacaaatgcctgccttgaatttcccagcatgatgtttagtcaatctctaattttcttgtcatgttaccaaagtagacaagagccttagctactagttgataaggtcatcaagttatcattatatattagctctatcactatcaaaagaataaacagatcatggtctctccatcaaatagtaactactgagacaagcttttctctttaccattcaggttctgaagcactttgtatcccagtaatcacttttcctaatatcataacaggacataagtgtcttttctaatgttgttgaattagagtactcactaaagaatgaggaggaaaaatgccttgataatctccttgagaccaattcttttatccccagtgtctagctctgggcattcaatgatgaagaagtacatcctatctttttcttggaaattctaactgttttcctgctcctgagaactaatgattttatgtctttgaatggtataactgacaaagttaaagtgaaatctatgttatgcttcaaagaaacacatacataaataattctccatattttaaacttatttcctaacatatagaagtgacaacatatcttagttgtagatattacaaaatatccttatttacagttcaggccaaagtgaaatattacagaggggtatttatatttgccattttttgttagacttccataaatcaatgaaaactcataaagatgtttaccgtcatctttaattggcaaagatacagtgagaaatcattcagaagtagaatcatgaaacttgtggattatatatggcctagtgtaatacactgaaaattcttaacaaaaatatggaaacatggaagtaaatgcatataaatgttaccaacacatagaaataatactcaaggtgatataaatacctcgacttgatccttacatagtctatactcacatgtagcacatgcaaatataaaatatatgttttaaaaaccatagaaatggaagaaatcatagaggtcatggagtccagtcctatcccccagcatgaaatatcttaactacattctcggtaagagtttgtaagtactcaatgaagacatggtgaataaatgaaaaacagataaaagcctctagattcacattggacatttctaggaatcctcttcagaaggcagctcactctattttggacagttccaacatgcagagtgctcttttctatattaccttatggcatttattataatatcatctagatattcttcaatctatagatagagagctactgctttttaaaaaaaataactggatcactatgtcaaacttaattatccttagggtttttaagaggaaaaaaatccataaggaagctctaggaagagctacatatttttatgagttattaatgttccacgttgctttaatatgctgttatccagtccaaataatgagtacaaaaattaatgtaatccaatataaatataaatataaatacagaaaggaaatcttaacaaaatcatcctgaagactgaatggtttgggcaataaaaatcacatagatttattctgcacttcaggatatgtggataaatagcgttagtgacaatctgctaatccaagatggctcctatcatgttacctccagatagcctacattttcacaagtgagaaaaagcaggcgctttgtcatgatatctcttaagcttagtctccttccctccccccagctccttattctgactctgaaaactaactcctctgggataaactctgataacattaaatctgtaggtaccatcagggctatttcaatagatcactgtgctgaacctcctggccttctgtctggaactgagactggcgctggctttctgcaaaaatgctcattaatcttttcttgcctcttacctctggtctctgagagacagcctagtttcttgcttgtatattctagtaagagtcaactagaagagttttccctaaaatgcattgatcaaaactagagaaagtgggaatgacaacactgtagctccatggttctgccaaccataactaaacaatctcagtttcttcaagtggaaaattgcttcttagattctcctgaggatcagctctccagctctaacccctagctttaggaaaataccggtatctttcacagtcccaagaatgcttgcgggcactgtaataaaatctataaacctgtatcatttcctcaggatgaatgggctctaaaaatctttgcagaggtaaaacaggtcaaatgtggattacttccaaagactgaaagtcaaaatgcattagtggcaggagtccctatatattttcacttacgattctgcttttgttttgtcttagcaggttaaagccaagtcaagacggttgctccatctattgcaggaagtaggtcaggttcatcccccatttttttgtttgtttgtttgtttgttttgagatggagtctcgtccagccgcccaggctggagtgcagtggtgcaatctcagttcactgcaaacaccgtctcccaggttcaagtgattctctcgtctcagcctcccaagtagctgggactgcaggtgcctgccaccacgcctggctaatttttgtatttttagtagaggcggggtttcaccacactggtcaggctggtctcgaactcctgacctcaggtgatccactggcctccacctcccaaagtgctaggattacaggcgtgagccgctgcacccaacccatccccctaattttttttaaaaagatcatatttcacattcacttttaaaatttttttaaatttgtatgtattgagatataattagcatacaatataactcacatttttaggtagactgtttgatgagctccaacaaatgtaatgtcatgtaattactaccaaaattaagatatagacatttccatcatccaaaaagtaccctccaaatcttttgcagtcagtcccctctccccctctcaagcccaggggaaccactgatctatatttgttctctatagtcttgcctttttcagaatgttcacactcagatgttttttaaaaaataatgcttataataaatagttacagcttaaaaagttaagaagttagcatgcactgatgggaaaaaaatcatgaaaaagtaacatgattggtgtgaaaattgtatagtttctgagttgaacaccaacttttttactctacagaatgcataacttgttcaaatagtcactattacccattgttagactccagtcaattaaaaagatggaatctgctgccataatcaaaacaatatagtttggcttcagattagacaaagagatccatggaatgaaacagagagaccagaaatagatccgcacacatatgggaacttcatatatggcaaaggtggcgtttcaattcagtaataaaaagattatttaccaagtgaacagtttggcaaaaacaactcttcttctggaatgaataaaattacattataccacatatgaaactaattccacatagattaaaattttgaatacaaaaaatcccattaaaatattctaaaataatttgtgagaagaacaggagtagagttaatattcctaaggaaagtgggagactcagaagccacatatatccaatatagatatatttgcatggcaaaaatgacataaacaaagtaaaaaataaagatagatttgtgttaatggcttaatatttttcatatacaaaaattgcctgcaaactgatgagaaaaattaatcaaatggcaagaacatcatgatctcagtaaatctgtaaccccaatggatgataataagcaggagctcatccttattattagtcaaaatagaaattaaaatgacaataaaatataatttttttcttctaccagatcgacaaaactttagataagtaacagctagtgcttttgagcatatgggaaaagacatattctaatacactggaatgggtgcaaatttatttcattattgtgaaaagaaatttgtcgggattgcaatatgacacataacttcggaaatctatcctactggaataaaaatgccagtattcatataattatatacaagattatcctcaaggatattttaaaacaaattaatacacaaatatttatatgtataaacataaagaaagttatgggatttcgcataccaggatatcaggctgttagctcaaaggtttcagaatggaggagattattatttttaaaaatacaactttgaatgattacagctattacagtcatgcaccacataacaacatttccatcagtgaggaaccatatataccctggtggtcacataagattataatagaggtgaaaaactattgcctagtgatattgtagctgtggtaatatcatagggcaatgcattacattttctgtgtttagatacacaaattcacaccactatgttacaattgcctaccatattcagtgtactaacatgtggttacaggttactgaacaagtttgtagcctaggttcagtggactataccatacagcctaggtgtatactaggctatcccatctatgattctgtaagtacactctgtgatggttttttgtctgtttgtttgttttgagacaaagtcttactgtgtcgcccaggctggtgtgcactggcatgatctcaggtcactccaacctcagcctctcgggttcaagcgattctcctgcctcagcctctcaagtagctggggttaaaggcacctgccaccacgcctggctaatttttgtattgtcagtatagacggggtttcaccatgttggccaggctggtctcaaactcctgacctcaggttatctgcctccttcagcccccagaagtgctgggattacaagtgtgaaccactgctcctggcccaacacatgaatgtataataaacacatatatgttttgaaattaacaaaatataaatgggaaaataaaaagactaagccaggattccaggtggcctggggccggagacaaaaaaatgactgtcacattttcggagaaacttgctctcccatacccagaagattcagccccacattatgatgggaaccagagatgtgaaaatatacatcttagggccacagatttcttctgggtttggacatctacatttgtgagttaaagtaagtctttagtagtaattaatttttaaattaaaacttttttcattgcaatagtacctagtaactggtatgccaatttaaatctacaacctttaaaaatgtttaatgatagcaaatattacacattgggactctgagtcacaaggctcagagttttaataatggagttatttaataatggagttctgtccctccgttttaataatgaagggataagtagcagaggcagcagaccatggattctgaagccagacttcctagattcagaacctagcctggcctctcactagatctgtgatcttgagcaagtcactgaatctttctgtgactcagttcctctctctgaaaaatgggtataatggtagtgcttacctcaaagagttgttctaagaattacgtgagttattatttgtaaaatattttaaataatgccaggtaaacagaaatctcctatttatgtgtttattaaatacatgaatagtaaaaccctccttctattttctgatcatcctgtaccattttctaagcaattctttgaggattcattctggatcctcttgaaactacagagtgtctgatgatttaatcccacgtatgattttggttaccacctttgaacaatacaatatcaactatttcattagcttcagaacgtcactttgtaacactcatctcagtatctgtactcagcacaagacaagcttcagagtattcagctcaatattttaaaccagactgaactgaatggtcagagtctcacagtcacaatgaattacgtcctgctttccaatcataaacaagtgcatatttttgtttattacaaggccagtattaggttccaatgtgctcagtttcataaacttcaagtttatacttgcaggcccctttctaatagtcacatacatattagaaatgtggactgatattggaaataagttttctgagtattagattaaaaataaggaactaggaattattgaagagtgaatgatgtgttaaaaattattatgggtaattcaccttttgttgtatttggccagttaacctgaaagggaatgcagttattgagtttagatttacaggctttgaaattcataatttaccagacattttggaaaggaagtaggaacaataaaatgccaattttgtgctctcaaagagcttactgcagcatgatttttttttttttttaggaagaaaccttatggttcaatatttctggaatgtaagaatgaagaatgtacagagggatggtacagcacccttgccacattgcctgggtcaaaaatatttttagatggagggagtagccacaactattttctaaaacgctgttgtttgaatttactctgtgctatacatatatatgtccctaaatatccctaattatattttatatgtttctaaagagctacaaacctactcttttgcacagaggtttactttggcagtatataattgtttttgttatatgttatcctctgtttggccttactgtaagctgaaacagacaaaagatgttcaggaaaatcaagccaattctcaaatctggagatgtgaagagcccccagtggaacatgtgcaatggaactaacagagactaagaatcttctttaatttgctattcctgtcaaggtcctgtcacattcattattgtgaagtgtaattgccttacataccaaatttactcctcccgtccccctgcagaattatccttctcttcatttcccaggctaatctaactttggataaccgcactcccacatgttatgcatggcagacctagatctaactcaaagaaaaccaaggactattgctgggcagtcagacatagcacgtagtccttgccatgatcagaacaaacccaagagataggaagaaaacatgttgtcctcattttttacagaaataaaaggctgcaattaacagtgctaggtagtagcaaagtcatgattagaacccagctttccaggctcagtaaatttttattttcatatcactacatttgtgctttagaaagtcatattagtactgggtcatcatggctataaaggatgtagaattgaaatattgggtccatttgctccatctgaatcctcagagactatcttaactgtgtgaataaatgtatttccactgtgtatgcagccatatagccatagatcttcaaattaaataaacaatatgtcaggctcctttgaacaaaagtgtacaataatgatttttgaaactgcccttctggtaatactttactatttcatatcaaagaaattaaaggagtaacttctagtgttaatttgatccatacattgcagaaagagtttttagcagcaggaaaataacacaggaaatgctccatactcttcagccaatcaattcggctctgccactaatctctgccaggatacagaatgttactgtctcaatctctttacagattcacgggtgtgcgttgaaaattctgcaataaagcaggtccactctagagactatgctatgcaaagtccataaaagtggtgtacaggaacggtataatcaggcggtttggggtattttttcaaatgacaacgagctaagatgttttgagaaggatggctcagaataagcttctgtttacaaaatggaacctgactcctttcaggtatattgatcattgactaggatattttgttttatttatttatttatttatttttattaaaaaataatttggaaatggggtcttgctctctcacctaaactggagcgcagtggtgcaatcatagctcactatgacctaaaattcttgggctcaagtgatcctcccacctcagcctctgaagtagctaggaccgtaggtacatgccaccatgtccagctaattctttttaagtttttgtagagacagggtcttgctatgttgcccggtctcagatatactgtataatattttgtttcaggaactttatccaaagctgttgagaccaccgtttgttactcataattatgatttgtatgcaattcatgttactaaaaactaagttgtgaaaatatgaattagtttcttcataaaaaaattttcatctcattataaattgagcaaacttgagaaacaattaatatagattactggcaattattgtctaacttattcatactcttaaataggtcgaccaaaacccagaaatatataacagattcccaaaatattctttaagacactgaaaatttagaaaggagttgggattcagacattttacttatttacttcaaagaaatttatttttaaagttgtggggaaaagtaaagaacagcatcaatagttcctcctataatacaaaatttaatcttaaaaaaaaacctaggtagagattatagtattgcttggaatgaagtctttaaatagcatgcacagccagaatctgaattctttcaacatttcctaccatttttttctctgtcaaagcttttttcggtttatccttgctcaagattgtgaataatcaatgttagtgtcaattattcacaatcttgagcaaaaataaatagtacgatcgtactatagtatgattcgtgctatcgtactatttattactattacaaatagtctattgtaccattggtaatattataattctcccaaatgatcaacaagtataaactgttatttcagtttaagaattatttgcttgaaagttttgctgcccagggattttgcagtgcacacagaaaggtacttgctagcattttggccttttatgtcaataatgctttaacaataggcacaaaagaggaagaattcatgtgaagaagttagcaactcctattttgtttcaatacagcagggatctgaactcaaacaaaggaatctgaacttggagaatatcttcaggtcatttcatcaacgttgctcatacttggcacctttgatccttagtatcttcctttctctgtcttctaccactttgtttaaggtttgctttaaaaattatcccttctgtggagcctttcccgactacttagggtgttttacttttgttttcacagtgctgtgcacacatttcagttatgggtttttatagtttacctgtctatttagcccactaaactaagaattattaaaggaatatcatttatttttgtaacctagcattagcacagtagctggcacatagtttgtgtctaataacttgtttttaataaattaatacactctcaaaaataatacaattatatcacgttaccatagattactcagtttttactgtatattaattccaaaagagaataccctgtagtctgtcagagaaaggcactctgcaaattgtattaactagttactgacttcgagactgtgttagtgtataataatagctaacatttgctaagactttatatatgctaggcactataatgaatgctctatatgtattgatcctcttccaaatcttaggtataattatcattcgtacaattaataccacacttgaagttaagtgtttgagtaagattcaactccaggcaagctgactccagagtcatcgttcttaatcattaaggttggcttatttctaacctatgtgatttaaggttggcttatctctaacaaatacaccattgaaacaccacctattggatgctcaactcaagggctaccagcagtttgtgaagtactttaaattttaaggcagcctctcttcttttttctcttgctgtgtacttgtaaataaatgtgttttttctttccaattttattttatattcaaggtgtacaacatgcaggtttgttacatgggtaaattgcatgttgcaggggtttgctatacagataattttgtcatccagctaactagcataatacctgagagctagtttttcaattctcactcctcctaccctccatcctcaaatgggccctcttgtctattgttcccttctttttgtccacatgtactcagtgtttagcccatttaacagtaagaacatgtagtgtttgcttttctgttcctgcatcaactaacctaggataatggcttccagctccatccatgttgttgcagaggccaggatctgatttttttttaatatctgtgtagtattctatggtgtataagtaccatattttctttattcagtccaccgttaaagctaattcaccggatcaagtaggctttattcctgggacacaggttggtttaacatatgcaaatcaataattgtgattcagtacagcaacagaactgaaaacaaaaacctcatgatcatttcaatagatgcagaaaaggcttttgatacaatacaacatggcttcatgctaaaaaccatcaacaagctaggcatcgaaggtacataccttaaaatattaaaagccatctatgacaaacccacagcaacatcgtactgaacaggcaaaagctggaagcattccccatgagaactgaaatgaaacaaggatgttcaccttcaccatccctattcagcatagtaccagaagtcctagccagagcaatcaggcaaggaaaaaaaataaaaggcatgctaacaggaagaaaggaagttaaactatctttctttgcagatgatatgatactacacctagaaaaccccataatctctgcccaaaggatcttagatctgataaacaacttcagcaaagtttcaggatacaaaatcaatgtacaaaaatcaatagcatttgtatataccaataacatccaagctgagagccaaatcaagaatgcggtcctattcacagtagccacaaaatgaattaaatacctagaatacagctaaccaggaaggtgaaagatctctacaacaagaattacaaaacactgctgaaagaaatcagagatgacacacacaagtagaaaaacattccatgttcatggataagaaatttcaatactgttaaaatggccatactacaaaaagcaatttaccgatgcaaggctattcttatcaaactaccaaggacatttttcatggaactggaaaacaaacaaacaaacaaacgacattccaaaactcaattggaaccaagaaagagcttgaatggccaaagctatcctaagcaaaataacaaagctggtgatttcacactactggacttcaaactatactgcaaggctacagtaactaaaatagcatggtactgttacaaaaacagacagaccaatcaaacaggttagagaacccagaaattaagccacacacctacaaccatctgatctttgacaaaaccaacaaaaacaagcaaggggaaaatgacaccccattcaataaatgttgctgaggtaactggctagccatatgtagaagattgaaactagacccccacctttcaccttatacaaaaatcaactcaagattaaggatttaactgtaaaacttaaaactagaaaaccctagaagaaaatctaagaaataccactctggacattggtctgggcaaagacttcatgaggaagactccaaaagcatttttgctgtttgttaccctttttcctcttataagtccccaataaaatactacaaaacactgaaacttacgtttactaaagaaagattgcttgtcgctaccaaaggatgaaaaaagttacctacagaacagttctatgcacttactgatcaagaaatatcagtgttataagtaaaaacatagaacttctcatatagcaaagtctattttttttttgtaattaacacagataatacatatacatgtaatatccttcctgattatgaagaacttttatatgcaatgtctgtgtaggttcctgaaagttagatgttatttttcctttttaaaatagaatattattgagaatcagaaaagtgacttagaggttcttaatcctgtatgtatatttagagtcacctgagtatcttaacaaatcaacaaaaccatgccaaccttggcattttttaagcactccccagacaactctaatgagaggtaagtgagaaccactgagtcaaacgaatcattcaagacttgcaagctgaaccttaaatcctggaccttagactccacaggttttggatgaccatgtccacctcttcaaatacaaacccttttgggtgtctttttaagggattattgacacccttaattatgttaccacatgtgcaatggaagattgcttatttttaagagtaagtttagatgaataatatcagctacaggtgcctaatgtgtctccttctgaaaatttcattagattacagaaaggtgaggtactatagggaggtctgtgggaaatataacaatctctgtgggctccaaaatctctatcagctcctgaaaagctttccaactaaacaatagaacaatatgcttgcagggctaatgtcccttgaggagaattctggccctcctttctgaaagtttgtaatctttcaacctttcatatataaaatctggagtttcccctgatagtctaacagtttctcccaaagttttgatgttggaatgtctcttctaggtacctgttcaggctgaaaaattttcaagatttctatgggtttttaaaaaggtgttgtgtgtcggtaagtgcctgcctctaaagtaattcagacctagacaggcggtataattaacaccttcacactcaacaaccaccaggacttgaagtatgacttgctgccacaaatgttactgctgtgataaacctggaattcggtgcaagaagaacaagtcctgttgtgagtaagctcagttacagctgttctctgacacagctatgtttgctcagtttgtaaggctggacttttgctttggctatggctttggcattgaggttctccccagcaatttcagtttcaggtgtacatccagccctttcttggagctctgctttgaatcactttctttttggctgagacccacacaaccattgattgagatgaagtccaaaggagccatttctctgtggtcactaaaaatacaagctgcttcatactgatctgaaggaagccacattagaaaatcttggtggtgcactgtggtcagacagaaagggatctggagctcagttctgctgagcagtaattggtttctgtacagtgtagacttgatcctgtaagtttccagatgacatggacagatgtgaggaggtaagtacaataaggagaaataaagatagcatttcagcaaataccagtgcctgcttcaatgtattagcttggttacatctatttttaagatataaccaaccactcattgtctgtttttcatttatcgttgttcagattgaaatatacagatgcacaggcaaattcataagttgtattttagtgtagaagaaaggagcttgaactaggaataatgcatctattcccaacttggccattcctgcttggctttcacaaatcattccacctcatttactccaaaactttcggggtttgggtagagaatttctaagttgtctcctagttccaagtatattgatgggagactggcataggcttacaagagccaattatgcacatttttttttcccagctctgtgtttagtgacatcagttggtagcttgaagtctactgtgtgggaagtatttatgccatggaaaatgggaaatgctataaatagggactttttttttctttttcaaagacaaaatttatcagcacagcactgttggatatctgcaataccctggtgctatggagcacatacatagtaactgggaatttgctatagtgcccgacttgtagaaaagcacagcagacctctctgtgacaaatatgggatttacacacactgcagctcgacttggatactctgctattgtatgtgatgtatctaaaatattctgcatttttgtaatctactttgttgaaagaaaagaataaaaatgtaatagggaaggggaagttttataaatgctgtgtcaaaatttctttttaaatttttctcatatttctccagatttatgacctattaatatatttcttccattactctttaataattaagttctcttattctatctgaaatattaaattggtgcagaagtaattgtgggttttgccattaaaagtagcaggtgacctattgtttgggttaattcagaatatagaggcaggaagaaataacggagtcaataatttagagtaaaaattcctgatataaatcaagcccattcatcttgccaagactcctgcatgtctttcctctatgtcttacaaaatgttcttgaccactcacatatagaggaagaataggcaaagagcaggaaaaagctatggaccaggcaaagaagcagcatttactctgatcagccaacaaaccttagctaagttgaaaaattaataccctgtagggcttgcttttcttttggaaaactatgtttccatctccaattcctgtcatgcccactgtcccagtatacagttgtcataacgatcctttctgacatggaaaattgttccagtttgcttttggaaatgtgattcaatcttgctagcagggattcccttgaaagatccttgacccattctcaggatgctctcagtttgccagaaacaagcaacagagtgaatggagtttcacaaagatggaattcaggagtcttcatgagtataattcctcttcagggctgccctcacactgctgccaagacccagcatggtgcctccacgagggcacctactcttctctttcaaagatatccaattactcaggctccaagctatgaagcaggggttcagtgagcatgaagtggttcttgggaccctctggagaagcaaacattgacaggtaatgtcatagctgcctgtcactattcaatagggttaatctctgggcaagttcccggcacacacagtgttgcttttaagtcctgctgatttggattcaagtttttcccctttgagcattttgcctgaaatttctgtttgacttggaactccacaactaccaaattaagtgaaatgagcatgataaaaaagttcattgaaatttaccacagccatttgaagaaacttccaataaaaccagaaagagagccaatggccatccacccagcaacataaaacaaagagctgcccactaggagatggagttaaaacactaaagaaatcagtaacaggaagaattgaacttttctacagtctccacttatctaaacttcaggccttcccaagaattagcaaaatccatctggagtacccaacaagcttctcaacagagatgaccttgcttttactttgcaaatgcaaagcattaagcaagcacacacaggcaaacaaaacccctataaacaaacacaggtaagagagtggtggggtcctttaaggttctctgtcctacacagccatcactaaagtaagacgttgtcttttgttctctgtggctctgccctacttgagtagcaaagatacatggataagtggggatgatatgcagtagaaaagattttcccctcagaaagcaataggtccattttttggagacacatttccagttttgataaaatgagaaagtattggcatgctattggttgaaacaataatattcttaataaagaaaactacagttcatagatggtgaactcacactggctatatcacctataaaaactaaccaattgctttaagaaataaattttttttaaagtgtaaggtcagggaaaaaaaaatccaaacagtcaaaatggcatctagcttctaatgtgtatgcatagtatatgtattttgtcactatatatacatatatatacgtatatatagtcagatgtgtttttgtgcaggacacacacacacacacacacacacacacaaacatcctgcacatgataaacgctcaataaacattcgatgtcaaataactagttgattgattatatcatgtagcctttaactgctgccttgtgaatagaatcaaagactgaatagtccattaccacacaggtaatggcacatgtgtgtaataaactttagatattggcattccttctctattctacttaatttattgtgttaacattttcctagtaatttttcctctatttgtatttttattcttccttaaaccacatttccagaccaggctatcccggggctgtagtatctgatgatgaagcagatttgttaaatttttgcaaacaatattcatagttataacatgtgtgcgcgctttcttagatttttgtgtggaagttctttcatcattttttaccagtatccctttgggatatctcaagaccccaacatctggttagtggtttcttggaaaggcatactttttcaatacataatgttctttttcttaaaataacaataacaatctaatttgcacgcttttagtagcttaaaaagttgaataaattcactttttcttaataactgtcatcttccctcttgccatacttcagtgcacctgctctgaaataccataaagctataggttaaaaatatgtacacaaataatttgggaagtaaatatgcaaaataaggcaataattggataacacaataaaaactaaagccatgatcccgtttgtgtgggagaggtagaatgggtacaggtttagtgtcaatatctttactttaaaccacaatcattttctgtttgatgtcttttttttttaacctcctctgagactcagtttcttcatctataaaattggcggactgctacatcaggcttttcataaatatcatttatttacttaaacaaacagtgctgtaatgcttgctctatctcaggcagtgttctaaccactttcaaaattgtaatttatttaattgtcaaggcagccttatggagtaagtacttccagttccactaaggaaacaagacacttagacgtgatgactttctcctagaaggccttcagctagtggcctaccaagggagggagcaattgaggtggtctactctaggtgcaggtgatgaatgtctgccttttaaggagataatttaaagacagtaacaaaaccaactaatagttggtctgcatttattatcaggccctgacaattctaagcagttttcatgaaaaaatatatctcccctcagggtggatgactcccatccctcatccctaaatatccattgctctgaatatttttaacattgtttatatataaaataatagaaacagagtttgtaaaacttttgaaaatttagaaaaatatgaatagactgtaggactaaaaatagtcttgaagcagttatatataatagagtatatatatatatatgtatgtgtatatatatatatatttgttcattttcacactgttacaaagatactacctaagactgagtaatttataaacaaaagaggtttaattgactcacatttccacatggctggggaggcctcgggaaacttacaatcatggtggaaggtgaaggggaagccaatgcaccttcttcacaaggccacagttaggagaagtgccaagggaagggggaagagcccgttataaaaccatcagatctcgcaagaactcactatcatgagaacagcatgggggaaaccaccccatgatccaatcacctcccaacaggtcccaacccccaaacatggggattacagttcagattacaatttgagatgagatttcagtggggacatagagccaagccgtaacagtgtacatagagtatagttaggtatatatggtgtgtgtataaacataaacatatacacacattatacatatatacaactgtatttaggtacataataccttctttctcttaggataattaacatatcagtggcatctgcattttgcctttatactatacacagatgctcactggagatttgagagttggtaatatttctaaatgcacctttctcactacttgcttcttttttgaaaaatgtgaatagacattttcagaggcagttgcagattaaaatatatggttcctaaagtaacaataatcataatgacaacaacaaagtataaaagagcactcccttcaccatttttaaaccaaaaaattcaagtgtgtctaaaccctatgaaggctgatttaattgagtagtgaatctatctgaattctgcttcaaatgctgtatggaaaagtcatattttacagtgcatattatacagattggctatttcaattagaagtacagtgggtgatttttcaactattcgcttggctctgctgctaagtcatttggatatcttaagctgcagtgtatgccagtgcaatggagtcaattttgacaactgatatgtttttttttcatgacaatattgaagtttattttgggtggtaaatttaaccaagatattagaggagatttacaaatattaatctttgggccatcttttcttctattcaatgcactcatctgtttttacgttcttgacaagattgtgtaattgaaagctttggactttgagccagggattttcaggttcaaattttatctacactgcttacttgtgatgtaacattggctttaacctccttttctggaaataggtgagacaacgcttacatcacaaggtaggctctgaagcttaaatggattaactctacatcaagtgtagtttcttcccttgtatcttcctctcttcttccacttctccaaacatcaaaatactttaaaatagtcccaaagagtagcaatctgtacatttctccttcagtgagattactatctttagaaagtccctaggtaaggtttggtgatggattaaatgtcagtatgaacaggtgaatgaggtctggcttgcccagcacacatggcagatttatccagacaggattatgacttggagtgtgtacgtttcctgctatgcatatgccaatgtcacgaggcatctggggaggaaattcggcctgttcattgttgaacaaagcaccaaaaaatgtccagtatgtttattatatagttattttagaataaaggaaaagcaaaactatatttcaacattaaaaaatgttgatgtatacttagaattttttgtgtgtgccaaaagaaatagaacgttcccttgcaaaagtgtgtattgaagtgaaatgaaacaaatggccctttatttatttatgtaaggctagacattgggtatattgcatcatttaagcttcatccttacacttcattacctactaaaaatgggccctgcttgtaagtatttgtgtaatcagtgatgagctgtgatttgagatggaatggtgcagaccaagcattagaagaaaaaaaaatgtacttgatcttttgggacactaagagaatatttgcttcaaaattggaaatttcctaaactctaagttcaaaaatcatagaaatactctgtttcccagacacactgaaccacaaattacatgttgatagcttagaaataatgtttccaataataataatagatatgtaaaaattttggaatttagtgagaaccgaaagtcagacttgaaggcctatatcctcagattttcttatttttcagtgggataaaattcaaattgcctttagccaacattaaatagctgccacagtttggctaggccttaccgtatctctcaccactttccaaagctctgctatggctggagtagaatatgcactgctccctcctcctgaaccaaccaaccaaacaaacagaaaacccacaaaaaaacaaaaacaaacaaacaagtgtgcattttctgtcttctatccctttgtaagatctgttctttctaatagcaattcctttcttcctcctccctgaacactaatcaggtttgagtttaatttttacctttcccataaacaatttcccctcccctctaaattgcagcaatctctcctggaaaagaactcagggttccccatacttccatattgaaattatttcttaaaattttgctgcacgttaccacatacatggatcctatcatttcaaccacatggcgagcaacttgtggcaagagttatgaatttaaaattttgcaatgttctcaacttgattacatgtggaaacataggcacagaatgttaggcatggaacaagagggacattataatgctgtgctctacttcttaaggttaaatgtcatgacatgatagtttagagaagttacatactcatgaagtgcttcctaaagaagggaaatgtttggaaaaaaggaatagggataaaaatctgtaagaacagaaatagtacctgaataaagaaagcaagaggtctcttcccataggccctttcctggttcaatctcaagaatagtaaaatatacaaatccaattgggtcatattctagaacaatgattgaccatatagcctggaagacaggggcaagctgctttaaaactgcacactcaggaacacggccctttctctgggcctcccctgtgctcttatcagggcagcttctcagtgtttctcatgcttcctatttccatgtggcctgagcagtgaggtccaagtcttgttgctggtactttcctctctgcttcattccattctttccttgaggtgcccaatcccacccttacccttggtggcagtcctaaaccaatatggagcctggctaacgtccctcgtccactcttcttgccttcactcatgtgtgctcaatacacatatcaggtctgtctcctgtggttgggaggaggatggtaaaatactaatatttgaatgttagtttcagtggaggattggctggccttcttacacttcagcactaggctttatacttcagcaaaatttgagagctctgtattgaaatttggtacaaaatcccaattaataataatgtagaatttagctttcttttgaccattgtcccctggcttaatatttccacagggtacctcaagggaacaaggccattgctggacaaaagaaggatttaagcatttcttttttaaaaaaatactaactgccatatttgttaagggttttcaacaaccttatttctataactggcaatttctgttcttatttatgctaaattttatcataaataattagatttatcctgatagtttttttcgtttgtttgtttgtttgtttgtttgagatggagtctcactctgtcaccaggctggagtgcagtggcatgatctcggctcactgcaagctccgcctcctgggttcaagcgaatctcctgcctcagcttcctgagtagctgggactgtaggcgcgtgccaccacgcccagctgatttttgtatttttagtagagacagggtttcaccatgttggccaggctggtctgaatctcctgacctcgtgatccgccctcctcggcctcccaaagtgctgagattacaggcgtgagccaccgcgcctggccagatttaagcatttcttatctccctagctaaataccatctgataccatccagatttccaccagaatttttatcagtgaagagtaggtttctccattcccttctggggactgagggtgggatcaggtcagtctgggaaatgcaagtcaattctttggccaatagccatgtgctccctttttgtcagatagattgttctaagagagacagactgcttttagaccattagacagaaggcaatttgcgaccagacagaaatagtccagaagtgtccaccagtagcccatataatgcttttgagagaattagaaaaccgcccagtcctacaacaggcattggagtttagtgagctcaaagtgaattggatttcgtcccccacttacacccttggctggctgccttgggcaggacagaatctgcaagactctgtgatgacctcctgccagaatatacagtgcatgtgaacatgttagtttaatttgtttttcttcttttaaggtatatttcctcatgagaactgccattgtgtaaaatacaattaaatgtaaatattatactttctaatcttataataatttcctgataaagatatctgataaactagtctatagcattatattacagtctattgcagttggctcttctggtctcctgttttcttacgactgctatatttgatcatacttttaagatggaaataacctgggctttatccattcaataaaaaaaggttggcaagccctttttatgagtaaatggaaagggttttgcaaggcagcatatataaaaaagaaacattaatcctaacccttcactctcttaaatgggaattaaggtcaatattcttagagcagcaaattgaagtggtgctaagttcagaaattctttggaaagggaaccaaacagctgactttcactggagaaagaagcatttcacgagttgagtgctagcataggcagtatctttccaagactcttcttcttaactaagtcatttcttctaagagaataatgagaggtcatttaaaaagatcattatgttcatctacttaattctctgtttttaataagtctttctacttcattataagacacaataagtcagatttttcctgaaagcccaggttgtacctgaagggaaagtgaggcacttagaaaaatatggtaaatctttcagttcatcagacttgctaaggcattaaagaatatattcaagagagcccctagaaagaaaaacttccatcatcgtagaacttatctcacttctttcttcaggctcaagtggtaaatagtatctttttggagaggaaatgtctctgtgaatgatccctcatggactacatcatttcactccttcaatccacctctcattccttcttccaacatgacagatatactcaaacccaacagcactgcatttgctatccagtttccagagtggtcaattgtatcattttcatgtttcagcatattttaaaattcaacctctgaatcttaaataagatgctgtgacttagaaacccattggtaaaaagacagtgttccttcaaaatttgtatgttttcttcagatctcctccaaatacactctctaattcaaaaaaaaaaaaatctattttgtacttgactaaaaatagtgttgaagttaatgaccacttaagagagtaggtaattgagatactgaaaagttaggaaatggagaaggatttacactttgtcaaagaggtcatttttagcaccttatcacagcaacagcataaactccttgtaaatttagttctgacagcattgggattatcacttttctgtctgagataaacttgcatgtagtcaccatttgtataaatgtctcaaatgttttagcatgacaataaggtaaatcacattttaattgcaggtaatagttttcaaagtacttcacaataatttcgtgttgttagccccatgttaaagaggaggagactgaggcagagaaattgagccttacctttaggtcatgtgaatacctggcgtagactctagtcacgctcacgtcttctgcttggtggctttaggtacatataacgtatataacacaaaaatccagaggaaaatgtaatgtcggtgagctactaaccaagaggaaagtatcttttgttgtttcctcctcactggagaacagatggtcatagacctgcattctaatcgttactgtgtcactgcatttctgtgagactttctttctctgggccatggtctttaaggagcagacatttcgagaaacagcagccgtgatcatttcagctctaacattgtgtttctgtttctgttttgaaaatatggccaaatcttagttatctgataagttaaataatagagttaaacatgaaactaatagtttcaatctctgccttttattagaatacaggataagaattagacaaatgcatttggttctattacatggattgtaattttagaggcaccaggagaatggtcatctcctaaataaccccacatttcccgacatttttttcttatatccctttattaaatacacacacatacttgctcaaaatggtagcaattatttatatcagtagttctcagctgggcatgattttgccaccaatggacatttggcaatatttgaagacagttttacttgttacagctgggaggcactactggtatctagtaaactgaggctctgctacatataacacatggatttcctcacacaaacatgcacacacaatgaaacatcaccttgccctaagtgtcaatagttttgaagttgaaaatttctatttaaatctataaataactgaacaacactcctaatatcatacaacacatttttttttctagtaatttcacttttggtccatatgacataggtatgatacatatattttcaatgataaaatcatcacctcagcttataaggctccctgagatccaaaaggtcagaatttaattgagcaaacagcatcttttagaaaattaaaacagccagaagagcaataagttggaaaccattcattcatgcctttatgtgaattaaggtaatgagaagttattgtggggaaaggcagtcctgggtaaatgccatagaagaggggtttaggcaggtggaagacagcataagaatgcccggcaccacaggcctgctggtgggtgcctgtaaacccagctactagggaggttgaggctggagaatcacttgaacctgggaggtggaggttgcagtgagccaagattgtgccactgtactccagcctgggcaacaggactagactctgtccaaaaaaaaaaaaaaaaaaaaaagaatgctcagcaccaagagagaggggattgaagaaggattatggtgcccaattttgccaactttcaaatttagtctaactagcctccaccacaaaccacaaagagtagcagaacacatatgtaagcttcagtgttcttcttttttctggttcaacttccaatgagatgtgattttcaaaatagctgaggactggggagaacaagagtgaaaagagatgctgacaaattcacagattgactgacaaattattttattggctgcttgggattagtagtctcaatgatttagaaattgcatcagtagactctagtccacactgtgtagtttgatttgaaagcctaaaagtaaacactttgatcctactacactgattatttagtttatttctctttttccttttccttttccagccttaaagttaccatgtaacacatacataaaaaccctattgagatggcatctcgccaggttcaagctgtaactgtttgcatcgattatctgttggttgcctaacaaattataccaaaatttagtacaggcctaccttgttttatttcacttcactttatagcattttacagatattgctttttttttttttaaacaaatcaaaggtttgtggcaaccctgtgtcgagcaagtctattgacaccattttttcaatgccatatgctcactttgtgtctctgtgtcacattttggtaattctcattatatttagaactttcccattatcattttatctgttatggttatttgtgattagtgattattttcctcttttttttcttttcattgtccttccttccctccttccttccttcttttcttccttcctttcttcttcctcttttttttttttttttttttttgacagagtcttgctctgtcacccaggctggagtgcagtggcgtgatctcagctcactgcaacctctacctcctgggttcaagtgattcccttgcctcagcctcctgagtagctgggatcacaggcacacgcccaccatgcccggctaatttttttatttttagtagagaccatgttgggcaggctggtttcaccatgttggtcaggatggtcttgaactcctgacctcatgatctgcacaccttggcctcccaaggtgttaggattataggcctgagccactgaccctgactctttctttctttctttctttctttctttctttctttctttctttctttctttctttctttctttctttttctttctttcctttctctttccttccttccttctttctttcttctttccttttctttctttcttctttccttctctttctttttctctctctctctttcttccttcttccttcctttctcctttctttctttctttctttctttttttctttctttctttcttctttctctctttctttctttctctttctctctctctctttttgacagggtcttgctctgttgcccaggctggaacacaatagcatgatcatggctctctgagccttgactttcccatggctcaatcaatcttcccacctcagcctcctgagtggctgggactgcagatgcgtgccaccacacccagcaaattttatgtttttgtggagacagagtctctctatattgcccaggctgatcttcaactcctgggctcaagcaaacctcccaccttggtctcccaagtagctgggaggctgctgcacttggcacatcagtgatctttgagatcattgagattgctattgtaaccgttttggagtgccatgaaccacactcaaatgagtaggagaacttcatcgataagtggtatgtgtgttctgacttctccactcatgggccatttcctcatctctctccctctcaatgggcctccctattctcaaagacacaaaaatattgaaattaggtcaatgaataaccctacagtggcctctgagtgttcaagtaaaaggaagaattgtacatctctagcattaaagcaaaatctagaaataattaagcatagtgaagaaggcatgtcagaaaccaagacaggctgagagctaggcttcttgcaacaagcagttagccaagttctgaatgcaaaagaaaagttcttgaaggaaattaaaatactattccagtgaatacacaaatgttaagaaaacaaaataggcttattactaatatgaagaaagttttagtagtttggatagactatcaaaccagccacgacattaccttaagccaaaacctagtccagagcaaggcgtaactctcttcaattctatgaaggctgagagaggtgagagagctgcagaagaaaagtttgcatctagcagaggttgtggctcatgaggtttaaggaaagaagccattttcataacataaaagggcaaggtgaggcagcaagtgccgatgtagaaactgcatcaagttatccagaagatctagataaaatcactgatgatagtggctatactaagcaacagatttttaatgtaggtgaaacaactttatattgaggaagatgctttctaggacttgtgtaactagacagcaaaagtcaatgcctggcttcaaagcttcaaaagacaggttgactctcttgtaagggggataacgcagctggtaactttaagttgaagacaatacttatttactaactcaaaaatcctagggtccttaagaattattcttaagaaataagtataaggaatatacttataaataagtataaggaatatacttataaataagtataaggaatatacttataaataagtataaggaatatacttataaataagtataaggaatatacttataaataagtataaggaatatacttataaataagtataaggaatatacttataaataagtataaggaatatacttataaataagtataaggaatatacttataaataagtataaggaatatacttataaataagtataaggaatatacttataaataagtataaggaatatacttataaataagtataaggaatatacttataaataagtataaggaatatacttataaataagtataaggaatatacttataaataagtataaggaatatacttataaataagtataaggaatatacttataaataagtataaggaatactcatttactaactcaaaaatcctagggtccttaagaattattctacatctactctgcctgtgctctagaaatggaaccaaacagcgtgaatgacagcacatctgtttacagcatggcatgatgaatattttaagcccacttttgagacttactgctcaaacaaaaagattatttttaaagtattactgttcattgacaatgcacctggtgacccaggagctctgatggagatgcacaagaatattaatattgtttttatacctgctaacacaatatccatcctgtaacccatggatgaaggagtaattttgacttactggtcttattaaagaaatacattttagaaggctaaagctgccatagacaatgattcctcagatggatctgggcaaagtaaattgaaaaccttctggaaaggattcactattctagaagccagtaagaacattagtgattcatgggagaaggtcaaaatatccaaattaacacaagtttggaagaagttgatgccaaccctcatggatgattttaaggggttcaagacttcagttgaggaagcaactgcagatgtggtggaaatagcaagagaattagaattagaagtggagcttgaagttgtgactgaactgctgcaatctcctgataaaccttaaatagatgaggagttgcttcttatggaaagtggtttctttacatggaatctactcttggtcaacaaccatgaacattgttgaaatgacaacagaggatttagaatattacataaacttctttaacaaagtattgacagggtttcagaggattgagtcccattttgaaaaagttctactgtggttacaatactaccaaacagtataactttccccagagtgagtgatcaaagagagacagagagagacagagagcatgctttagataaatctttagtgaaaggaacagtcaattgatatggataacttcactgttttatttttaaaaattgtcacagccactccaacctttagcaatcatcaccccaccctgatcagtcagcagtcatcaacatcaagacaaaaccctccaccagcaaaaagattaggattcactgaagtctcagttgatcttcaccattttttaaccataaagcatttttaaattaaatatgtaccttgttttttaggcataatgctatttcacacttaatagaccacagtatagtgtaaacccaacttttttatgcactgagaaaccaaaaagattgtatgagttgctttattgcactatttgctttattgtggtggtctggaaccaaacccataatgtctccaaagtattcatgtagcttaaaatagcaaatatttatcatctcatatagtttgtgagatttcgggatctggggatggcttagcctgggtgattctggttcagggactgcaatctctgaagacctgactggggctgcagggtctattcccccgttgttgttggaaggcctcagtttctcaccatgtgggtctctccaccataaggtttcttacagtatgactttccccagaatgagtgatcagagagacagagcccgagagacagagccagagagacagaatgcaaatagaacctgtagtgccatttacaatgcaatatttgaagtggcatagcatctattctgccatattctattgatcacacagatcaactctgatataatgcaggaggggactatgccagggtataactaccatgaggtagggatcgctggaccatcttagaagctgatcaccatattgatgttgtctttagattcaataatcagtttgagttcatccaattgaagtgtttataagtaacaatacgcagttaagtttcacaactgttaacttaaaaataatgacaacaagctttctggataaaaaacagtgagcccatgttctaaggacaactgtgttgagtttattgtacatatatacaatgatcttaaaaaaacacagcaaacgtatttcaggttttgccagttatatttttttaattgtacagagatacttttgtgctaatttaaccagaattctgtttagtctgccctgaagtagcaacttttggctttttggtggtgtaatatgataagaattagaaagtatttgaatgagtaggaattagaaaagactgacttctaatctctgctctcccatttcctgtctgcacaagcagagctaaattctaatctcagatgctttgtccatgaagtagatttagtaaaactcatctctgatggttggtttgaggactaaatgctatgatgtgagcaaactatttagcacattactgggcatatagtgataacataataaataatattttgagcatcaatttccaattcagtgttttgtaactgaacattatgaccacagtaagttgagaaaattaaaaatggattgagtcaagcctttttgtacaaatgaaataaaattaaacattgtaaaaatatcagagggtcagagacctgggttctagtgtttactgtgtaattggatttagtattttttaatgaaacttttatttctatttgtgtatacaggcaaaatcgtgtgtgtgtgtgtgtgtgtgtgtgtgtgtgtgttgtatttgtttcttgtcctaattaaaactgcacttcttactgtgggtcacagtcaagaaaatgagaaaaccactactttaacctgacttagttatgtttatgtttttttcctgagaagaaccaatcttattctcttctagtgattgcatctatctgaatgttttggaaggcagagtattttaatgtctctttgttggagagcctcttcctgtttacaatcccattgaaagacgaaatcccaatgctcatggaatcatgacctttccatgttagaccagtagacatgccccagatgaggatacagcttattgcttcatgcccaataccatggtggttgcagatgcattaatggtgagagtcacaggaaactcagaaatctcagtggacttactcattgggaattattttatatagcaagcaagcatccacaaggacgtttttagttataagattaaataaagaagtgctaagcccctgaggtttatgaaattctaaacatcaatctgtcttaataaggcactacttctcatgggggagagcaccatttgaggctgcccattgtcaagtatgctgagtttccggtagtgaaccatatgaataaatgtgctttgtatttattctaatgtcatatttgccttgtcttaccattgcattgatagtatcatcagtaacttgaaatgcttcagcttatcagtctatttatcaatttatcaggaagttttaataaaaaccttaaatgcttgcaatattgttactttctgggcccttgtgtactacataaggtgatgaatatttttataatatgaataattctatgcttcattccttgaagtcagatgttcaggtagttgtgttaactataatgtttagaatgtctttttttttcccccttctgcaatcttcctccaatccttgctccctacacctcttacctgcacagttcttttctgaaagacatctaggaactgcgttcactgcagtctctcactttattaattgctggcctagcactttgtggtctattcatcattgaaatcataattacaggtttttctggattaaaattgctcaaggagaaaattccctttgaagttttgaaacaactagcacgtgttatacaagatgtttctttatatgcaaatgtcagatacttacactttggtgtagttagattgggagaagcagtttgaaaatccattagaagaatggattctctggtgtgagtgcatttacagttatcaatgagaagacaatcaacagctaatattaaccatcgggctgggcacagtggctcacgcctgtaatctcagcactttgggaggccaaggcaggtggctggcttgaggtctggagtttgagaccagcctgaccaacatggcaaaaccctggttctactgaaaatataaaaattagctgggcatcgtggcgcacacctgtaatcccagctactagggaggctgaggcaggagacttgcttgaacctgggagatggaggttacagtcagtcgagatttcaccactgcacttcagcctgggtgacagagtgaggcgctgtctcaaaaaatcgtagtaataataatattaaccattgtattatttcataaacctcagggatttagcatttctttatttaatcatataactaaaaacatccttgtggatgcttgcttgctatataaaaaattccaaaagagtaagtccactggtggccttaaggctggaaaaattagtaaatatatatagtaaatggctttctgacattacattaaaatgcaataggatattattacctatagactttatggccagcctgtagtatatagatgtactgaaatagtgttaaaaggaaagatacttagatttgcgtaactgtagtattagtcagtcagcaagtgtcagtcaggggactatatttttatagctacagttaatgaaatagtttcattcttgacaaaactgctttgatgtagatattattatatttacagatgaggaagttgaggcttagagtagttaagtggcttgttcatagtcacagtgttaataagtattaggaagctaggcctctgtaacaaatttctattattattattttttttactgtccaatgccatctgtcacatccatgcccactgaggcagtttaatcccattcttcccatttgaagcttgttattttatttttcaatttaggtatatttatgatttttcttatttaatcctcaaacaatactatgatacagatgcattattcttcgctttttctagatgcagaagctaaagcacagagagggaaagcaacttgctcaaagtcacacagctagccagttgccagcttagagctaacagagtccaaaacttattattctttctcaaacactgcttctcatgtgctgcttctcacgtaaatataaatcagaacttggaaaaagcaataatatggtggctagtattagctgttcattgtcttcttattgataactgtatatgcagttacaccagagaattcacacttctaatagattctcaaactgcttcttccaacctacccacatcgaagtataagtatctgacatttacatggcaccttacatctgaccaagcattttgacatgtattatttcatttgatcattacaagaaacttttgagatgtttaggacaggtacaattagcctgatggctttactgatgagaaatatttatctcacagaagtaaaagaccttggagttcatatggctgacaagtgggagaaaaaaaaaaaaaaaaagcactcaggttccctgctgacacattctgggagctctccatagcaccatgttaaaaatagctcttcatgccgcaacattctacctgcctgtgggaattcaccaagacatttcccccagtttggaagaagtcatgtagattgcaaagattctctatttttgatatgagaaattcttacaactgggaagataggcatggtgtggattagcccaatcctagacaagctgggtaagcctcatgtaactgtatgtcttctgggaaattacttataatctctgactcttccttttttacagaaaaaaaatggtgagaattatgaaaaagcaaatgtataatttcttttctataatggtggttttccagtaaactcattagactttttaatataacacatctcatattaaacacatctctgtgacatgagaacccttggctttaagaagtcaagaatgcaaaaggcctcaatgagatcctagaatctatcaggtttgggcttcatggtttcctggagataatgatgatgatacaattttaatattaaagctatgaattatgagaacagccagccctgggtgggaatgcacatcaggacagaaaaaaaggctgatgaagtatgtatttctccaagacatgtttgtactaagtaattctgaatttactaagaagtccttgaaactgtatttcttctctatgagaatatggaataaaagtgtcatgtattttataaactttgagtatattttttacaatcttgtagagaatatttccactttaacagctactaattataatgatatctgtttatatacttgtttttctcacttgccagggactaagcaagaactgcatctttttcatatttatgtattcatggcacgttgcctgttagcataggacacatataaaacttactgagtaaatgctcattgaaatgtgtttatataagaaagtatgtgaaaatgtataatacatatgcacatctacatatgtgtatgtatctgtgtgtctttgctaatatttatttatttattttgagacggaatctcgctcttgacatccaggccagagtgcagtggcgcgatctcagctcattgatctgcctccagagttcaagtgattctcctgcctcagccttctgagtagctgtgattacaggcgtctgccaccacacctggctaagttttgtatttttagtagagacagggtttcaccatgttggccaggctggtcttgaactcctgacctcaggtgatctgcctgtcttggccttccaaaatgctgggattacaggtatgagccactgcgccagcctgtctttgctgacatttaaactaccattccgtgttcttatacatacttaataagatatggcattttcaaggggaaacatgaactgtctattaccccatcccatatatatattctatattgatatataatatatacatatattctatattgatatataatatatacatatattctatattgatatataatatatacatatattctatattgatatataatatatacatatattctatattgatatataatatatacatatattctatagatatagatatagatacacagatacatatgtatgtatatattctatatttatagatagatctatatatattctatatatattccaatttaagattctatacaaatatatatatatctgcaaattttctttaagcataactttgctttcaacaaccaaaacatttttgagataaaattattccagctcaggaggttcaatttacagtacaacatgttttagtttagtaaagaagaaaacactatttcccaaagaaaaatggcttgtttgaatattgattggattttgttagtaaactttaaaaaaaatcataatattagagctcattctatgagaatatgctctaatattatgtgcatataataatgttagaatccatatttgcttgatatttgtgcttatttgaaggaattatggtgtaatgaacaggagaacaaacatgatactaatccatatgcacgtgaagatgatgtctctgttttggttgagtaaatgaaagaaaatgctaatgcttttcagcaaagataattaatgtggccataaatagcatgtcactatggacctgaggaaagaataagtcaacttgtcatataaaattattatgtttcttatttatgctgggcttacaaagtcctcaaatgtcttgccacatgttgattcaatcattctttcagtatttctaagcgtgagagtggtgagggggacttttcattgtatttttaaaaggacaacaagtatatgaagacttttttactgcctgacggtgatcatcaaatgttaggtgccttcatttcccgcttaatgatggcaactcaaatgccattaggatctgggcaactgaccttaatagctaaaagggccagaagttttatatccaagagaggtatgggctgtggataactagagattacatactcttgttaaaggcttgaaaccatattttaaaaataatgtgctagtcaaacaaaacactttggctgtttgaacttgggcagcaaagggcctgtttgtaattcttgccctaaccaagaacatggggctgaataaagcggaaagagagtgacccgggcatcaaagagacttgagtctgaatatcgactgcaatatttgggctctgtagtcctgatcatgttactgaacttctcatcacttctgccacctcattggtctgagatggtaaccatacctatttcaaagggctgctgtgagaaataattaaaggaagaacctcaagaccttacctcattggctgatccacaagaagtattcaaaaaacaaagacgattgttacaggctttgcacacagcactttccccttggtaaagacctacttgcggctgttttggctcttttgtttatttcttcttatttgtttgttttcttgacttcttatgaaaccagagaattaggggtggcaggtagggagtaagactagacgaggaaaactggctgagccagtggggaatgtctatggagggcagcagagttttccagaatttctccaaccaggccaccactaaactttgccagatgtttgtaagtttcctactaagaatgaatgcattccaagcacatttctttctttctctagttctttattttatttctgggtataaaattgaattctcattttctaaagaaaggagaaaaccaaccaaaccatttcaagaagaaaataaaattcacctgtattcccgtcagccagagatcgtcactattaacagttcagtgtttcttttctttttcaaatgcatacaaatttgtgtctgaatatacttaccataattgagaacatgctaaatatatcattttgtgtactgtgtattatgctgaacagaaatggtttttgtttgtttgtaagccatggaaagctagtatactgaagccactttgcactttaaaatcaagactatcttgtctattcaatggaatgctgctaggaagttgggggagctgtctttataattgtggtaatggttattttaaactcaatgtagtaatttatgtttgagaataactatagaatcaatttttagttctggtaacatgtttcctttctttctcaaccccctaattgctctctctgggaaataactatttgccaaatataaaaattattcattcagattcttgagatatagtatttaaataggggaagattcattacacagctttccttcacatccttagagaagagaccctgggggctttgtgagagtctgagaaacaatttgttccttcttgtgtctgagctagaactcagggtaacaggaatctgaaagacattgtactcctctcttcggagtaagtcaggcgttgggatatgagaatgttttattagcagttagaattactaagtctaactcagtcctgtaattacagtaaaacaatactgttaatatatctaagtctcaaaaacataatattgatttaaaaataagagaatgaagaaatcatgcaataaggtaacatttttgtacatcatgaaagtgtaccagacagtatattattttgaatataaacctatggagaaaaagcccacatcaacttcagaataaaggttatattctgattgtgggaccttgattttatatgtagtaatttatttcttactaaaaatgaaaacatccaaaataaatatgtcaaagtgtgatgtctgttaagtaggtatggcagctttctggtctctattatccacatttcatgatcataagaacccaggatttagactttccaataaattagcccaggcttctttcagttaatgaatatataaagtatccagttctcccagcttgttggggatggggactaaatcaggaggaacaccgggaggtgatctacagctgccaaaactagattaatgagtctttaaaactgacttttacaaaattcctctggcaatatgtgtagtcacaagagcaggtatttttgcagttactcatgcttcgtttcattctcttgtggtgtatggttaattctcagagaagccagttcattgtaatgctaatttggtctctcatccaatagcacttgggatgtaacaagcatcaccagggcaccaaaatggcctttgtgaaagatgaaacaatgcccactgtctctagtcctttgatcaaagggagaaaaaaaaaaatagggattttattgcatttataagatgtcagcaatcattattcctttcttatgctttgaatgactttttctgtcctaataattcttccagtacttggaccaagggtaatttaaataagaactactcaacaaatattattcagaaaaaaattagttggacctcacacataatgctttggaatgtttattatacaatgacattgacagttttatgcctgtacaaacttactatatgttccattgagtaatctcatattgtgggagaaaacacacgcatacacatatatatgcacacacttttatcatttattttactttatttaagcagatgaaagaaaattaattttaaaaacccataaacaagatatttcagaagagaaagacaaccaacaaagcaacttcattgtaagcaagaaaagatgtagcataaatgaaaaggtaataacagcctaaaaagtcagagtgttgaacagtgaaggattttattgaaagagatttgattttaagtgttaataccttccaatttcatacaaaataccagagtaaaatgatgacaattttctacctagtcatggtattcctgaaaaatcgacaaatcccttaattgttaaggctttcaaacttctgttcttgagtatcttatatcatctgctgggtatttaaatttcatgatctgtcctgtaatgtttcattgaatgcagaagatttcttttaaaagatcatcattataagctatgtgtttgcatcgctgccatttgtcagaggagaagtaagtgtggtttgcagaaaatgtttcttagaagaattatctggtggagagccttttaccccatcaatccccccaatctactagctgctggggtggtctgtagttcaaatgtcaaatctttctctttttaagtgaaacagaatgtattttgtgtagcatgcagggggttaaattgcatttcagataagcaagaaactaaaaagcattacagtaaagggagacatgtttgcaattttgtttgaaacagtatcttgtttagttaaaaaaagatcccttttattgttataaaaacaatgcataccaagttgctttttaattcttccattcttctgtcatctaagtataattttagaatttgggaaaaagatttctgtgttgttaggcagaatactggagctgtccatgacagattaatgggcattttctgaagtgattaaattttacatcaaatacacctcattcaaaggtgagtgatgcgttggctattttaaatggatctttaagaaaataaactgcaatgaaatgaacataactacaaagcatgaatgtagaactggacacatgtaggttgggaatagggaaatatatgtgtgtacaagagcataattgtgcaaatgtatttgtgtgtatgtttgtatatacgtacatacaacatatgttcttatatatgttattaaatgggtaaatcttatgcttactatgtctgaaaatatggtaaagtgcacagaaattatctgtctttgccttctacctgaatcccatattaaaactctgatgctgtgcccttgccgcatgtgtgtggtatggcattaatggtatgctgttgcttctgactgatttatttcttgatttcccaagaagcacatttcaggaggtaagcaggagagtcatcttgcctaagcaagcacagctccttgcatgctctcaaagtcttcccagagtcctttcttatcccctagccctcaatttttccaggctgtattttttcagatataagctctaactctgttgcctaggctggaatgcagtgtcattgccataaggctatttttttttatattaaaggagacaaaagaaatgtatgccctcccttctatattcctttgggactgcctctggaaagacttattagattctctcgttgagaggatttgttcctttctttattctacccatcaggcaggcaggaaggcaagcaggacattgataccttcagtccagcatttgtagcatgcttatgttataagcagtctcaatgaacagcattaagttttacttcttttgcttttatgtatgaagcaatgattaagacatggttagttttcaatgtgtttcatggattttacttgatttaaacaatgactcatagtcgagatgtttgggaatagcaaagtagaaagacatagtaagacaagatgggtttatgtggtccacaaagtgaggatatttgttttcagagctatgtacatcattaatgctggttcctttgccattcaaaaggggatcattgataattgctaatatgatatttcttacttagagaaacaaatggaactaagctaagctcacaatgggagactcagtattttcatacacaaattcatttatgcattaaattatttatcaaaatggtattgagaccccactatgtgccaggcagtgaaaggaagtggtaccaagttgaaccaggtagtgcttgtgcttaaggaacttatactgggatggtgagcaaagctattatgaaaaacagaggcacagtgtgctccagaagtagaaaggaagggtggtgaataaggctattatgaaaaacagaggtacaggtgctctagaaatagaaaagaagggtattacagagagaagattgatgagaggcttcctagaggaggaaaagcttgaactgagttttgaaaaataggacctagcccaagaaaagggagaataaatgtgaaaagaagcattccagttggagcaaagtcatatgcaaagacatgagtcaaaaagagtgtttgcttagtgaaatgaaaatactgtggtcatttggtatgtctggagcataaagtacatgtagggtgggagggtcggggtccagattgttaagaatcatctatgacgaatacagtgttgtgacattatctgcaggtagtagaagctactgaaagagtttgaacagtgacatgacaaagccaaatctgtgctttagattgatcccactggctatggcatggatgatggattggaggaggcaagtctggagtcaggagaccagttatggggccattaacaaatccagaagaaaactgatgagagtctgaccttagtcagtgactgtgagaataaagtgatattggtagggagagagggaagcgggagagggatggacctaggcagccttcaagagacagcagagggcgaggcacagtggctcacgcctataatcccagcactttgagaggctcaggtgggtagatcacctgaggtcaggacttcgagaccagcctggccaacatggcaaaaccctgtctctactaaaaaaacaaaaattagctaggcgtggtggcatgtgcctggatacttgggaggccgaggcaggaaaccacttgaacccgagaggcgaaggttgcagcgagctgagattgccccactgcactccagcctgggtgacagagactccctctcaaaaaaaaaaaaaaaagcaacaccatctggtgtggatttaatgtagaaaaagaaggaaaagactaatcaaggtgattctctgtggcttggatgaacagataggtggtaatggtgccgttcactgtgataaaaattaaagacagaaagccaagtcgtgttggagaaagacaaggaatatatttgggacagaatggtgcctggggattaagcgattcagagattctagctctttatcttaaaacagatgtgcctgctatggagacatgatccagtccagggctttgctattgtttctagtatcattgtttctttactgccattaaggatatgtatgttatattttatagatatatacattcagatttcaattttctataataaattaatattcaaaccttatagactcttgtactttataaaggaagttttaaatcaaggagtttgagagcttcatgagtcattagaaatgatcgaatccagccctttatttcatagatgaagaacttaaacccaaagtgtttaagtgatttctccaaattcatggagtatatcaatgatagtacctggattaaaatccagatatcctgactcctggctgaatgtgctttctatatgccatgtgccttttaaaaaaaggtaaaggaaaaaattaagcagacgtgcaaatatgcttgaggttccatgactctgacattttactagtgtgagaaggtaggtgtagaagagaggtgccaggttagtaaaatgtgttttggcacaggagacattcgcttatgcaaagagagaatgactttcctgggtcctggcccaactctaggggcaatgtaaatgactttggcaactttcagcagccacaagaatgtggtcccacaagaatcattaccaaaaaaagcaatggcaggagaatttgttcctatgggattttctgggttgcccttgatagcttctatatatgcctcagtgggatgttgctactattcctttggaggctgagtaacaaacatccactcacattattagtatcagtatctgagagcatctccctatcaagcagaaagaatatttacagaaagaaacatagtcagaggcagaccccattcaccaattctattgaaatgactcattcacgtgtttctatttcctgctagactcaactctttgtacctgtagcatttggcaccaggcttagtacacagcacacacttaccacatatatgctaagactaaactgaactgacacagggggtgataagcctgaactaattttagaatttggttctgttttttgccatgtgtgaggtgatgcatctgaagaaaaaaaatcaaggggttgctgaggctcaatgaccagggggcagctgatgggtatcaatggtaggaagcaagaacagagtccagcaaagaaagtcaagacccctgaaatggatggagcatgagttggcgaaaggggagatccaaatcaggaatcagcaaaggcaaagcaagtagcaggaaccagggaattgggaaagaaatgtggggtgggtctaaggtaccgacagccattgttgttggctcagcctagtgatgtgagcctgggtttcccacacacagaggggccatgacctgacatctgacattgattagctgtttcaccttgctttctataacctctctgaacctcagtcaccacatctataaaacaagatccttggagctcataatatttaatgtctctttcagctctcttgtactaatggttttctttcttccataaatagtaaatattctttcagatatcaaaatgagaaatgggatccatggcatgtatatccacacagaaaccattttaaatgttagctaaatagatctattgtctaaaaagacaattatatttctccatttcataaaagaaatagtatattgggagatctaataatagaaatccctgaaaataatatatttggcttcagctgtctttttttttaataaggccataaacctagatatagttgcattttaaatattgccattgatttatggaacaatgagattagataaaaccatcaacatttaaggcattttttgcattgttttacctttttattgctttcccatatttacccttttgctttatttcatggttgttttgtcataactgagtaatgccatatgcaccaacatccaatgaaggtccatttaatctgcaccatattttaagtgaacaatgcctttgtcaatttttatagggtttaaaatgttactttcttaagaattacatggagaaattgtattatttgtgctttaagatatgctctggtttaagagaccccttgaagtggtttcttcaagtgaaatgatacagaatgcatttcacatacaagacatgtcataatctcacacagattttggttctcatgaaactgaagcccgcaagggttttgagagtctagtaaaagctctcccaaaattctctctcatgatggagaatgatagcatcagttctcccctggtcattgggcaaaagacaggggcatgtgatttatgatagaactacaaatggctgattatattaccttcttaaaaatatgttttctttgcctacttaatactaagacttttcatacagttgactggatatttgccttctcaccatgggtaacatttcctaagatattacagccatcaatcaatatgcaaatgtataaattaaaaaatggtcaatctttgaacaagtttcacctcatcatttctgtagctttcatttttacatattttgtgcatgaatattgtatgttatcagaatttgtttttaacattggtaacaatatgcttgtgtttgatgagtgacattccttcagaatggagcacaagctactggtcaatctagcctcaaagcaacataccagctctgccaaaaacccactgtatgatcttagacagtttacttaacttccctgagcctctgtttagacatcagtgaaataaggaaaataatacttacagtacctggattgttctaaagattcaatgaactgcgtatttgtaaaagctggtacatatctagcctttgtagaggctttgtgtattattgttattccctttgttgtattttacaatggttggcaagaaaatagaatgagcagacaaaataaacttatgttactaagaaaaaaaggtaagaactaatgagaggactttaatgattccattctattaaaagtactggcaaataaactttccacatacctggccctagggcttctcatcccacctcaaattaacttggtctccactatagtgaaaccaagtgaaagtaatccccctctagtgatgcatgtttttctcaaaggaataaatattataaatattataatatattgtgtatgttataatatattataataatgaatatgcaatagctgactaaaattgaaattatcagtcaactaatcatccagccaaccagtccaataacagaacacttcccgcaactctgaggctagtagaacatcagaagatagagttgagatttttctttgatgtctggcttttctttgatttctatgaagtcactgaaggcctcggatttctaactataaaatggaatcagttctctccttgcaagtttggtataaggatgaagtcagacaatgtgtacaaaagctatgcaaatattaaatcacttaacaaatgcaacttttttttgcttgaaagtaatcatttattgtttgtcatttcatttcaaatcacattctcttcctagcattttggtcaataacttataaaactctggcatggcagtatagtcaaataattttattattcaggttgagagactcctacattataactcattagctcttgtggtcagcaacttctaggcttaaaattcacatcttagatgtttataaaatattgaaccttgaggtggctgtcattttctgtaaacatattttaaaaccagtagggaatatatgaagacaatcaaatttgttacaaatcttttctgaacctggctgctatggcacatcaagatggatttcacagttatacatctacagaggaatgtttagagataagatgaaagcagtcctccttattaatcacacattgtatatttgacttctgcctcctgctccagcctttaaatcaactacatctggttcttgctacttaagtgtggcattagattttgcattaaaaggcagttactcctggagaaagcagccccatttgattaaaaaataattaactagagctatattcatgctactcatcatagcagcctaaatgagcattttagtgtaggttggagacttactttatatctacaacagggtcagcagaactgagaggcactttatggttgtgatgaatgctagcatgaaatagttattttgctttgctggtgttaacttttataattaaaaaaagcacaatagtacagaatggtcaacagctgatacaaagacactgaaccttgatgtagccacctatgctgagggtgtcctccctgtgaagactagggtacatgattgttattacacctggagcaaatcaaactctgggaacagactactgctaaccaactgcataagaaattgatgtacaattatcaagcagatcttgtattggagctcactgattagtgaactctctcaggaggaaaatttgcatagaaagacagatttcttgataagcagggaatctgatatttcaaagtaaatttgatggtttaaatgagtattactcaatgacattgctgtcatttaggaaacatggtaagaagtttgcaccagaatataaactagagcatcactttcttcaatgagaaagttttgcatgtgtgtttgtatatatatacatcaagtgaatgaactaaacagtgtgcttagtgacctagataatttacatcctggtgcaaactcctcatttcatggctgactgttcacaagcaggtctcatacaggcagttgttctatggaccacactttgagatgcactgattctttacctgaataagaattacactgggaagctttataaaatatacagtttcccagtacatgcccttaaagatttctggtgtgttttacctccatctgcattttaaaattctccccatgtagttttgatgaacactcaagctttaagagctatataataaaatgcatagcataacaaatcagtgctaggctaaataggttagaggttaacaacatgggttttggagctgtgggttgaatccttgtttgttcttgagcaagttgtttgggggtttctgagcctcaatagtctcatctataaagcagctataacatatataattgtgaagtttaagtgtgattataaaaggaaaacacgtagctctgtgcctgttgcatagtaggcaatgataactgtcagctataaatgatagctattatctttataatggagacttatctgtaattttttaagaaacttacactcatgtataacctcaaattccctggaaaagtaaggaatattctcttaacgttttcctccctgaaatttcttctgctaaacattgatcaaaagtaacaatccaaaatcttggttgtaagtgttaaaaatctaaatcaatgtgattgaaggggaaaaaaggttggctgctcaatgggagactgttagatcatgcaacttacaactgaatgtccaagggtggaactagctaaaaatatagctaggtccaggtgctcaaaaggaatcacctgactctgtgtctatctatgcatccaagtgtctatgtatgtacatagatctatctatctatctatctatctatctatctatctatctatctaatctccttatctaacatctgtctgagtcagcttcatttttgggctgactctggttttgtggtggcaaaatcgggcatcaactgtattgggcatatgtcaccagcttattaaccacagaggaaaacaaagttattttataaatgagtttgataaaatttgagaactgaggctaatggccttgcttgtgatgtctttccattcttgaacaattcacacctatgaagcaggagcagaacattctggcttgacaagttagaacctgtactcatttgtgatgctaggctgggacaactctacctgaagcatttgttccgaagggcaaaacgataacttcccaaaagaaagttaaagaatgctattaggaaaaagggaacataggatgtggaatccaaaatgacaaatttttattactctgtcctaccctctttttctctacctgcctcttgttgtttaaatatgttagttcaattggaataaagtcaagatttggcctacaggccttacattttgataattttcagagatttattataatatattttgtatttgttttataataaacttttataggttgaatttttttccctcctatgtctaatttgggggaaaaatgaatgaaggggaattatcttatattggccaagaatgaatttagaatgtattaataataataagagtttgattgaaaaccatttttgttagcatgggacagatttgttcttgataaatagaaataagcaagggatgatgttagcaagtgagctgccaaagctttacaaaggggaatttacatttagactatatttattacatgataataattttactatggattatgaaatagtggatgtattatggttcactaaatcagtaaaaatcacatagctgttaatgatttggaacccggcttgtgaagcacgacttgtcatagctatcaagtggttgaaagtgttggtatgagagttaaggacttcagtgctcaagtccaagtctggctgattttgtggtgtgtggccttggacctgatttctctgggatgcaatttccctatatgtgtagtagagtaataaaatgtagtcaccacacagtggtggaggaattaaatgcactgacagggaggtgcaggtttccttgtatttttcaaacaatgcatatgttcagctttattttcccaggtacctaataggaccccttgcagtaagtcacttaatgattctccatggtccctatggcaccatttattttagcactatactgttctctaagatggcaccataaaggactaaatattacccaaagcaagaggagtaaatactgctatatgggttgtactttcagtacctatttttgagcttgcaaaggagcatggagaatgattacagctagctctcaggctttgcagctcatttcatatatcattgcctatattttaatattcctttaaaggtttttgttttggacatcatccttcctcccactcctcatcccatttccccaaagcagtgtgatattttatttatcgttacaaaaatggaagcaggaggctgaatttttctgagataagtggtcagtatggtgtaacggaaaaatcagagcaccaagaattagatttaaattagtatgtgaatttggctgcattcttgctggtcaaccttgggtttatcactggcctctctgattctattttttcatctataaaataaacaaaacaataaagctgactgtgatacatctttgctataaaggctaaatggataatgtcaacaatgggaaagtgtgatccaagtgcaaattgtcattatgattgtgatgattataaatatatgtatcagtatattaggaatttgttgacaactggattcctgtgtgctctgctcccatttctccaactcccagagatgtagaggatccccgccagatggctgatttgccagcggtgtcttgttttgttattgtaaatattacatgcccgaactgggaggccttgcttataatgtaatatgttttgttctttatctcttgcagcttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtacaccccagggccagagtccacagactcaacaaggaaaaattttttttttctttagctttctccataaacacagagcacatttcagcactgtgattagggaaacatacatttttgtttattggtaataacaacaatgactgcctgacatgctatgcgtgttttttttgatctaatgagggttggtatatttagctttgcatatgtttgccaaaacagagctagcaaaggacctcatcaatgtttaaattcaaataagcactgcagctaccaactgtgatatgatatgtgtcaaacaaagtaaccatttgagtcagattggtgtctttgttgtgcatttttgacctgttttgttttgtctctggtaatgctgcagccataagggcacctgcagacggtttgtgcattcagcagatagaaaggacaatctcaaatgaagttatgaggaatatgtgtgtatatacatatatctacctattagggccaatgatgtacttatttgagtaccaacgagtaaaaactagggatatcctttgatcaccattgtcacaaacaccccatcatagtttactggcaaatagcaaatatcatttttgatgactatcattttgatgactgtcatttttaattgtctcttggttcccttttagccatgaaaatcattattccagttaccattctgaaacccaagggatgattctatcccaatgtagttgatttctgacatgaaagctgaaatatatatgttcaaaaataaggtgcaacatgatttctattttctttcatttgcgatactggcatcacaggtagattggtatttaaagaaaaatagcaatgatgactgatacagataaaacctatataacataacttcccgtgcacacatggtttttatgaaaatcacttagagcagatagatagatcttttagctagaaatcactagcttgagtgatttctcacattcatgcagctagtttataaaatctgggattcaaactctggggtactcatttcttttctatctcccttgattagtaacactaataattaactaattgaataagaacttaagtattgattacattggggcagtgattcacattagctttggaaaatactttttgctgcccatcaacatcagatgaacatgggagatggacggaactacatattgtccctgaaaattacaagactttatctaatcattcattgtcacagtaagtttgataatatatgcacattggtttcttgtggtataaataatgtgactgtattatttattttattttattagaacagaatgctcaccctctcctacaaaatactctcacatgttcaaaaacaaatacacaatatatcctacttaattgcatatttgaaatttgtataagtttctattacaataacttttctggaacacatggcagagtcttgtttaatttttttatcccctaaaacactgtgtcttgggttgttttttaatctctgtctacctagcagttggagttgtgggaaaaaaaaatgtcccattgttagcacgttaatctccaaactgttaagatgcgtgctatgtaaggtattgagagataaattgttctgcatccttaaggccagaagatgtgtactttattgaaaatggtacagaaaattcaatgaaaaagaataactactccttatacgaagcagccaaaacttactatcaaagaccaatgaaagtttattagatacagtgagaacaattttaagatagctgaaacccagaaaacatttcaaaaatcacaaatccatcacaagtagcaatgagagggaagtagaaaaggatgacaatggctcaaattatgccctaccttaagaagtgacgcctatgtgtttttttcactttcattttcatgtcttccaattgcttatgctatttgtagctgtgatgcttcgaacctgttatatgtaaatgtataccctcgtgctacttatttgaactattgcaacaggacatgttctgcttagacataatcactcaagtgaactcaaatcctgattcagagccaagtttacaaaagtaatcctgaattattccttaacctccatacactctattcatttataataagcatttataaaaccagtagatccttctgtgctatccaggcatgctctcatggttttcctcctatattcatctaacttggcttcacagtggtaagtgttgcttttcctaaaactgacttcaggtcctcagtttatttcaggaactcatgacaatgtctttccaatatattttaatgcactagctttcacatgatgatgttatgaaataattaacttattgctttctaatcttctgctgaccttctagatttatgacttaacaaaatgcagaaagccacaggttcatgccaatggcattttaagatcctcttgtgctcaaaaaagtgtcatgatcaggaaagataccagtaatgaccacatctgaataactctgctggccatggtggcaagaatcagaaaccaccaccatgccttttccttcccccttagtctggcttgcagtgtttttctcactctgttatcagtttgtaccaatatctcttggccttcaagttcctctttccaagagtacaatatgaaggggtttgtaggaggaattattcatgtcacttcctatagtgtcattctatttctcacttctttctcaggcaaatttggtttttggggaaactaacagacaaacaaattgccttaaaatttgcctctaataatccatgcttgcctcagttctaagtaattttacatatattggctatttaataataataatgaattctataaggtagatgatataccatcctatgtttatttccttatcttttattattatgttttgagatagggtctcactctgtcacccaggctggagtgcagtggctgatcagggctcactgcagcctcaaccttctggtctcaggtgatcctcccactccagcctcatgagcagctgggactacaggtgtgtgccaccatgctcagctaacttccttattttttgtagagaccaggtcttgctatgttgcccaggctggtctcgacctcctaggttgaagcaattcacctgccttggcctcccaaagtgcttggattacagacatgagcaaccactcctgcctttgggtacttccttgatgtaagatgttttaataggtcctattagaatgcaacaaataaagcagtctttaccttcatgagtttgagttaatgtggcaaaatgcttctaagtcatttctttcttaactttcagtcaaattaatgatctgtggagcccttcctcatggccttaaagatgtacctttccaatctcctacttgcggaagtataattgaccagtgctcaccaatggctgtgctctgaaatccattgctgtgttggtccagagaccacaatttccagcagtcacttccactcattgtggcagggatatgtaggcctgctcctgggagctgtagaagtccactgacacatgactttggctaggggctcttcatcagccttgctggaactgttgcacggctgccttgagggataagacttccacccaactcttcttccttccctctcctctttcctgtaattagaccatcccggtctgaagcctctccaaacctcctctggcttcctcccaatttttcctcgtgggcatttcccctaatatatttcctgcatgtttaatcccatttaatcatcttttcagacatcacaaatgattacatctgccgtttggacctcaatagcactcattagaaatataaggcaagccaggtagagtggcccgcacctaaaatctcagcactttagggaagagccaggtggaaaaatgacttgagcccaggagtttgacaccagcctgggcaaaatagcaagatcctatctctacaaaaaaaaaaaaaaaagccaggcatggtaatgcgtgcctgtagcctagttactcacggagctaaggctggaggatcccttgaacctaggaagttcaaggttacaatgagctgtgatcacaccactgcactccagcatggttgacagagcaagaccctatctttaaatatatatatatatacacttgtgtgtgtgtgtgtgtgtgtgtgtgtgtgtgtgtgtgtgtgtgtgtgtattaggcagttcaggaacagtttgttcaatgagcatgaatcttttaactgaaatgatgaaacaaactctttagtgggtcatctaaggaaaatatcctgtaattagttttcttacaaggtttaggaaaattgtttgataagccactaggatagggctcagcagcctatggcccacaggtcaaatttgaccagccatcttgttttgtagataaagttttattggacacagctgcactcattcatttatatgttgtctatggctgctatttcactaaaatggtggagctaaattgttacacaagagaccatttggcccaccaagcctaagatgtttactgtctgggcctttacagaaaaatctgaccaactcctgcactaggatataaattcctaagaagcagggatgtttctgtcttgttcttgttcactgctctatcgacaggatttagaacaggactggtgcataggctctcaataaatacttgtgaaataattacattgactaagttttagtcccttaatctctgcaggtttcagcccaatgtcaccaagcctgagggcaatatgctgaggcttgtgtgttgattgtaataggtacccacaaatagctgatgggtcagaagaggactttgaacagaagcagtctactgcaaagatgtctgacccaactaagaacactgagtgaatgtttttttgggtttttttgtttgtttgtttttcttttccgtactctgagaagcataagaaatttggactccttccttactcgtgatgctaatttagggggcaggggcagggagagagagttggatgccatcagctgcaacaagcagagcacctcatggcgacttgaaagaagccattttggtagcagttgttagtgactagagggtgtcactaaccagagggaagctgcttatttacagctactcgataagcctgtgggaaacaacccagactccggagatagactctctgggttgcattctgactctactgagcattagctgtattgggagagttatttctacccacagttctctgtctgtaatataagtcttatctctattaaattctgtaaccaaatgaagtggttattatattataaatataatatagggttatattattatgttataatatatacatatataatgagggtattaccattataaataaaatatatttatatataaataaatagagaatattatgtaatagttatataatattaattatatattacatcacaactaagatgaacaataattccataagattatctaatttctacattcatattttctcatttttccactaaaacttttataggagttttgtttttcaagatttaatagtccatttaaatttggagcagtcttctactttttttccctgatattgacattcttaagaaactgggctgttttgtcaatcatttcacgttctgcatttgtctgaatatttctttattatgacctttagtttacccttcaatcccctatggtttctgtaaactggaagttgagtctaaagactggtttaggttgaatggaatattgtggcagaggtgttctgtggaattactggtcacttcctattggatctcttcaggagacacatatgccagattgccactcccttagttatgctgttctttaacttggttagggttataacctccatatcactgcatctcgatagttcatttttccctaggaaattaacagataacctgtagggtaatacttggtcacattgtccattattaaccaagtaaattacttcaatcattttgcaaaatgctgattttctaactctctcattccctctgcatgtatcaaccttaattcttctgttagaattaattgccaaggcatcatattttatgttacaaatttttctttggaaaaaaaaataaagcaaaaggaaacataaccctaaaaacagggcctatttcaaagttaatgagtcgttgaaagagatttttggccaggcacgctggctcacacctgttatcccagcacgttaggaggctgaggtgggcagattgcttgaacccaggagtttgagaccagcctgggcaacatggcagagccctgtctttacaaaaaaaaaaaaaatacaaacaattgctgggcacacctcaccggagcccaagaggctgcagtgactgtggtcatgccactgcattccagcctgggtgacagagtgagactctgtctctaaaaaaaagagattttctttctacctcaatctctgacttttagcattaatattaatttaaaggatcagaggcactcttgaaaatattaaagggagctgggtgaaattttccagctcactttctcttggaaactaataattttcatttttaaatgtttacttttttaaaaaaaagaactaaaattttgtagcccgtaaatcctcaatttcaggttttatgtctctcttactcttaggtatattttggaaaatttattctttgaaattgttccttgaggggcatgtttcacatacgctttactccttttccttcttcttatttaaaaattttctttttttttccccaaagatgtgcttttggaatgtgtttaggctaagaaggaaatgtcttttgtcattttaatggaacacttcaactattgctaagcagcgaattccatagtcgcatggcaagaaagtggtcaatttatcatagtttgctatgcaattctcttggttgcccgcttcagacctagtttaatacatcagtggagagagttgaaataaagcagcaatggggtcaaggtgatggggaaagaagaggagggattggcatttgtgctctaaactgccctgatctttagatcggcatttagcctggacttctgatattggactccttccttctcctatattcagatgctgctctagatttagactgtcatcactgacctctaacttgatattcatgtcggccctgttaccctttctgtgaccatgactcaagcctgaaagacagctcactgtccattgcccagaatgtcatctaactcagctatgagcgctgcagtgtcctaggcccccagggggtctggaggcttagaggactccagatgagccttcctgcctctgtgcagctgacattctaggaggggcagaaagacagcaaatgagtgaatagatatgatagttttcaatagtgataattctgtaaagaaaattaaataaggtgatgtgatggagggtgaggaaggtattactataaagaaggtggccagaaagggactctctaagatgatgagaagaaatcagccatgcatctaggaaggggtgggcatgccaagcagaggaaactgcaagtgcaaatcttccaagattggaatgaatttggctagtcaatgtggcagaaagaagactgtgtagttggagcataataaacaagaagtgaacagggttctgatcacgtgggtcttttcagaccaggctgagggctttggaattcattctaattgcaaagggaagccattagcatgttgcaaaggagatggcatgatctgatttatgtgttcaaaaagatccctctggatgctgtgtgacaaatagacttgaggtagggcaagtaggagaaggaagacaaactgggaactgtagtggtctccagactgagatatgggcagctttgttttcaattttaaatggttccattttgttctcaatggacatggaggagaatacttactgtcttttggaaattaaaatttttggtgtctgagaatgtcaggaactgtgatcagagagtacggcgaataagaaagaaaatagatttcatttaactgcatatgatatgcttgatttagtgagacaatgtacctcataagcaaatactgagtatccataaacaaatattgagtgttgtctctgtgccaagctttgttctaaatgtcaccaaaacatacaagtgtttcattccctatttcattattttataaattgtcactcaataaacaaatacaaatcttacttggacaataatatgtttaatagttgaaagttatatcttgtgcatctccaatatttatattctctaccatttatccccactgagctactccaaactctaccttcaaattgtttgttttgaaatgaaataatacagaatagaaaaaatgttttttaaaacgctgaaaccctttacaaacatgaatatgattagtagtagtacattttagacgggctttcagatccttactaatgactgtataaatgagtcatagcagtttaaacttttttagagtataaatgctccatctcaccattctctgccccatcccctcctcaccctcctgttccaccccttgcggggctaggactgtagggtgaggcaagtgagaccacatcagaccaaatcatacatgtgcagaatcagatcctgtctttatttttaaatgatattctgttaaatgtggatttcttgaattaattgtaaaattttaaaaatgttacattaaaatattacttaccttgattactgagatttctggcacccctttaagttttgcaactgaggcatttgcctctctcacctcagcctagttcctgccttgctcccttcaaatacatcccctactcctgcaaattcctgtagcccaagtccagcccagggtctattggtgtattttgttttttattttattttattttttgagatagggtctcactctgtcacccaggctgtagtgcagtggcataattatggctcactgcaaactctgcctgccaggcccaagtgattctccttccttagcctcctgagtagctgggactacaggcacaaaccaccatgcccagttaatttttgtatgtttttgtagagatggggttttgccgtgttacccaggctggccttgaactcctgagctcaagcaagccacctgctacagcctcccaaagggttgggattacaggtgtgagccaccacacctggccctgttggtatatgttgagtagactttctgtgtgcatctgatgtaatcctagatttagagacgctgcagaaaaggaggacggctctaatggcatcatttgtagaggaactttacattgatattgacctggcagaagtatttccaggtccttttaaataagcagttttaggaaagatgtggtagttaaaaaatgtttcaaataatgtgaggagcttttaaaattaatttatcttctttctttgttttatacctcccttaaggagtaaagagagggaaggacaagaaagagtcaggaacagggcattgacacaatttgaaggcatctgctaggactggagtgtgcattctttgcctggagaatgataggtttaggtgcacagctcacagactcatgtcataataaggcccagctggacacatgggtcattgtgattcaagatgaattgagccttcacagtttctagaggaccaccagagtagtaatagtggtgttgaaaggatgagaacaatctgtctctcatacaatctgggttctgggtcatttcatttcctcagattggtttgactcaccgtctccttaattttctttgcaaagcagcagaatcagaataaaactacctgagtttgaaaccccactcttcccttggttcctgtgtgaacttgggcttctgtctgaagctcagttttctcatttgtaaagtgatgataacaatttctcctttgataggtggtcatgatatccggaaaggctagcattacctagtgtgataggcgttctataaatgtgtgataatgagtctttctaaactatgtcaagagaattttgcacatttctaattgttttttgccaggtgatccaccaaggcaggtatcttttacatgcctattagttattcttaattattcacaatatctaagaccttgtacttaatactaacgtgcacttacagatattggagataaaatatatgaagcaactagcacaggagaatatcctagggttttaggacacagaagtcctaaaacacaatatgtttgttcaattgcaatttcaatctcaaaccaaaataatatctgaaaggcatgtaaaacattagttggtagaatataagtagaatgtaaaccttttttttttttttttttttttttgagacagagtcttactctgtcgcccaggctggagtgcagtggcgcgatcccggctcactgcaagctccgcctcccgggttcacgccattctcctgcgtcagcctcccgagtagctgggactacaggcgcccgctaccacgcccggctaagtttttgtatttttagtagagacggggtttcaccatgtttgccaggatggtctcgatctcttgacctcgtgatccacccgccttggcctcccaaagtgctgggattacaggcgtgagccactgcgcccggcggtaaaccatttgttaaattattcttgaaaaaatatttaacgacaaaataaaacttaaaaaagttctttgattcgtgactgaagtttgaaatattttcatcttttatcttaaggtactaaatcaaacttctcgacttgagatacagctgctggagaattcattatccacctacaagctagagaagcaacttcttcaacagacaaatgaaatcttgaagatccatgaaaaaaacaggtgaggattgctttattccaaaaatgtttctgtgtgtacttatttatatccttcacctctctgccaactcttaaacaaataaggttgaggtggtttacaaaaatgaaatatagagccaaattaatattaatataaaaataaaggagagcttaaggtaaattcagctagtatgtcaggaataaattaatattgttgctgatactcttgaaatatttgctttatataacttttagcattaatttctctaatggtagtagttcaaatctcaccatatctacaaaaatttgattctatgactaaataaagtgacataaaatattgacatttttcagcagaatgaaaacctataacaacagagaatagagcctcttaaattcctactcaaaccccaattcttaggcttttacaaagctacagcgtttttgaattcagaaatatagcactagagagaaggaaaatgtatattttttctagaaaataatttacctataaagctgatcaagggtttggttttttagttgtcatttacagccatttactttggacatagtaaatttctttggttagctttatagatgtcatcacaccatcttgttttataaattatgaatcatttcagttgattgaattggaacttagacatcttgaatgctgggacaatgaaagagtgtattattttgaagtcattaacattgatgatgaacaattcaaaacactgacttccttaggacaagtttcttgcattacattgatttttcttcggggtatctagataacttgaagaaggttcagttcctatgcataatattgaggtgaagaccatggtattgatagaaactggttaaatgccattgaattggtggcactagagttccctttatattccacaccaggaaggcacctaagaggactgctagttctgttctttacaagtgagggaacagagactcagtggaaggcagtgacctgtccaaggtcacacaacttgctagtggccgaaattggaatgtaatttaggtgtcaggatctttccactataacacatggcctcttcatattatctacaaactaaaagaatttcccaacttcatgctaaaagtagagcataatgcaacaattacaattaaacttctgcatgaaaaatacaaacctggctgttggtttagaatctgaaaggggtcactcatgctgtatgacttgtatttctaagtgttacatttatttatccttgtactgtgacatggggttagctgtataactacaaataaacttgacaggacttgacccttattgcatgattaaatgttctagaactaacaatcctgttgaaatataccatttattctcctgcaatttcacagtaaccagacctatacatgtatgtaataggtatgcttcaaccaccccttaatctagggtcacccctttatggtttaattttgtcaccaaaagtgaaccacatttacagtcatatttcaagatgctatttgtgaaggctttgcccaggaatcatggataagtaaaacgatgacaattttcccttatttttctgagtcgtcgtttggttttataattatacaatagcacgtttattatagcataaggacaaaaaaaaacacacaggaaaattaaaaaccacagctttatcatacagaaagagctgcatattttgctgcattttatatataaatatcattttcacaaaaagttctgtcataccttacacacagtctggaagtctgacttctttggagatagatgtcattttacattaataaaatattctctaatattcttaataactgcatatttcattttactggtataacctaaggtggtttgaatccatctctcagtagttatgttaccacctgatttatttctgaaagagttgccagcatgaatttacattctttagtttttccctactgatctgcatattatatctttgtctgtatctgacccttgagctgtcatgataccataacataaactgggaggcctgaaaagtctcctccctaactgcaaaacaaatgccatccttatgcaccacttgtactcaggtactctgtctctttctcttttcttccctccttctcatatttatccatccttccttccttccttccttccttccttccttccttccttccctccctccctccctccctccctcctttctttctttcttttctttctttctttttctttctttctttctttctttctctttatttcttaaaaatgtatcctttctaccttaattctggatcatttcagattttcttgtcttcccatcatgatttttatgcagcatctggtatcatttcctactatagaattctcactatgaaatattatattttaaaggcaaactgctttaaagttgttctctctgctctatcagtaaaagtgagttagggtgcaagctctcaaaagagctccactctgggtcaggtagaaggggcttccatgcacttcagtatctcaaaggaatctgacttctgatcccaaacatatttgtgccttctgctgatgaactttcccctctcattaaattctaatttcaacagaaaactcaggttttcttacacgtgtaaatcacatcatttattgctaatgttaattttttcaggattatagcaatttccttttctagtaatataggtatttcactacaaattcagagatttgggttttaattggaaattcatttctgtgctcacacagacaaaaacctgcatgcatcttacacttccattccacatctctttctttttcgacagtggacccctcaagtatggcattatctcacatgtggttctggggtatttttctatcaatttctatgcctcctggtattgctgtatctctatagttatctgtctatcttcttgtctaagggcctaatgtgtgtgatggagtattggcagaacatctgttcttaaattagacatagtcttccataaacaacttaaaaaaaagagaagtgtttttctttatacaaataaaaaatacccatttgtgatacatagcatactttccctattctgtttattgttattgtttattttcatatgtgcaatggaattaggggagctctgccaggcaatttatattgcaacaaagaaatgtgctcctcctatttaagtggagagaggttcaaagtcaagcatgaagctgtttatgttttaaaaaaatagtttatcgattaccactggttattccttatatgaatcttaatcctccaaatgcaacaagaagctatttctacattaaggcatctctgaaatgcagcaacaacatgcctttagttggtcaggtctggtttggatcagctaatacactttgcaggggggattatctaaattaagctttgtttcctccccaaggaatgtcaggggttgtgtctgggtgtgggacttaccaggtttgagtaagatggggcttcagccgccaagtcagtgagctggcccttaggaaggtccaccactgctttggcaaaatgaggaggaatattttatggttaggattatactacacaaacatgctgagaggtcctgctgatttacatcctgacaaattaaatgcatcacttgtaggattggaaatggatttttggcctcatgagattcacttctctatcccctacatggccagaagcacaaagcagaaacaggattagcaacgtttgctctgctgtttgttttcctaacagtccagagggagtcactctaaaaagcttccagtttgctctctttaggcaatatgtttttcttttgttggatgctacccgaaacttaaaacctggttttgtttcttacctcaaagaaacaacacttgggagtaaggaatctgtaactcaaccatataattggaattacacaaccaagaacctaagtaaatgggaaacattaatattttaccttgcccacaaagggagtgagatgaacacaaagtaggacacaaaatgtaaactttcactagtttcctccagtatgtttcctactgctttctaaaacaatggaatagaggtgtacaggaaatgatgtcctaatgcagtttccttcagttgaaccaaatatgtgactgggtctgttagtcgaaaggtttggtcaactggccagttttcccagcacccgcccatctctgacttaaccccaactttttgcaaggcggaagcaaagccaggctaaagaatattccagaaggagcccttctgtctcaccagggtatacaggaagggaaatcaaaaccccatgtatacaaagacggagcacacgggctttcttgattgtgctgagtatgcagagtgaagattaaggaagtcttcagtaagaccgttcagagtgaactgaaacgagacatgtgatggccattcctacatagtttgagcaatactagctgccgcatagctactagtacaaggtaaacatctgtgccaggtgctttaacttactatttccaatcctccaaccaatcctgcaaagtatgtattattatttctattttacacttaaaaaaagccctgaggctcacagaaatcaagtaagttgcttatgaccaaacagctaaggatatggcaaaattagagttcaagttcatggtgattctctgccttaattattataaaaatatttttgcaatgtgatgaggcctcaagtataattgatgtagttgtcaagttattctcttaaaacaaacaaatattcatttgaagaaaggggtagaccagttgtttttggcctgtcactatataggtcattatttagtccttctaatattagagcagaagatataaactatttattttaccttgggaattcactgaacttatttgacatgctcatctatcttctagctggagttatgggaagttattaagttaattaattttaagtgattgaaacatgtgcaacttcaagataccaaattatgccttactaattattgcaataaaatacagtattgatatttaatgcttaatatgcctaaagaaatgaaaaatgaaatcatagtcttttaaattaaagctatctttcatttgataaattatttacaaaatgctaaagtaacttgctaacttctaacattaaactaggctgaattatattagttgtttataacaaggataaaaaaggtgactttttgaatttatattattctagtctttttcttgtaaatagaacacctacatactagaatgttaccttttttccctgttaatttttaaaataatatttaatagcatatagcattttcctttttttaaattataataaccgtagtatcttggcatgaaatacaattctgatcaaattggaaatctaaggctcatcttaattcttctctttccctaatcccccacaactcaccagtcactgttgatgctatcaattccatcttctaaatatttttctaatccgtcccatcctttccattcccactgactatgtcttaggtcaagctgccatgaattcttgtctaggccactgcagtgacctctgggtttaagctatgtgccactccagtccttatccagaagctgtgccaaagtcttctttctaaaatgcaagtcagactattttcctctattaattccctctcaaccaaatgacaattctctataactgatagaagagagttcaagttctttagcacacaatacagtccatgatcactataatcttacttttgcagacttacttccaataatcttattttttagaggatacacgctaatagttaagagcatgagctctgaggccagactgcctggtttcacttttccttgattcctgggataatcgactaagtcacatattatttgtgtgactttgtgcaacttacatagactctatgtgttttggtttcctaatttgtaacataacaatgacaataattgtactgtatgaagttaagatgaagattgagttaatgtgtgtaaatcactgagaacagtgcctgacatgagcagcagtgtttaatcatgttagttgttagtatgacactgaacacatgatgttatttcagacatatttgatgtttgcctgacattccttattcaactcacaaatttctgttcatccttggaaactcattgcatgtgtcagcttctctaacagtccgtctctggctctaccagatagatttgctcattatgacctatgtgatagccctgtacctgtttcctccccataatttcacttatctgatcacattataatatatgtatgtttctgtgtgtgcatgtttatttatctatatccatactattaggctgtgaccttctaggacacagagaatgtgttttattttcattgtcttcctgctcccgggcacaattttctacacataagcatatttagtattaaatgcattttgaatgctaaatgaataaggaactgggaaatgtcccaatagctctaacccaacaaatgccatttatccatacgacacacagagactcacacacacacaaagactcacacacacacacaactaataaaaatacttatagtggaaaaaacaaatcatattgtttacattaaatactgtaaatccatttatcgttttcaacatgaataaaatagagatcgtgtttacaccactattctgcattgtcaaaagcccattgcatggcactcaatgttactattgtatactctgaggttcactaattcagcccacctttaaaatttctggatagcatttgcacaggccattctagacctatgactgtttcctccatttctatgataaataaaaacaagtaagacaaacttgttgtatatacatgtatattaaattatatacatgcatatacagttgtaagtcaaatttcccctaattccacacccctacaccataccacctgctagcagagaatcatcattaagagattaaattcagtgcttactcttccagatgttttctctaaacatactaacatatgtgtatatatagagtgtgcatatttatgtgtgtgtttacacagatgtacactcatatataattgcacacatgcacaagtacttgtttatatgatatgtgcatatatgtgtagattattttatcattggggttttttctactatttatttcataataatttgtcatacatatattacacatataaccataaacagatatacctcattcattttcaagaatgagtagcaatctatttttatagatgcactataatttataacctattataagtattatttatgttaatagatatataatttatcaaaactataattagtgatgtgataatttaaattttttatagatattcacaagttatcttcacattttaccttctccctaagagtacctgggctttcaaatttcccaaaactttgctagccatctaattaatctcggcttcttcagaagttaagttgtgcatgtttttgtgtgtattaaccatttgcatttcttctgtgactagatttctttttctgtgactacatactagcctatttacgtatgtttaacattttttctactatattgtttatccttttttaaattaactcatatgagctctttaatggatattaaaactttgtaatatatgttacaaaattttctctagtttattatttattgtccaacttattttttaatagaaacattacatctctgtgttatgaaatgtatcaatctttttttttcttagttgctggtttttataatacatttagcttattcttctttaccccaaactttacatttatttgccaatatttacttatagtatctatgcttctactccaaatttgaatttccaaacaaatatgatttcagactttgagaggaaatttattgcattccaattagacacgtaaagtataaatttaacctgaactaaatctgtgtgtatttaaatggggagaaaaattactctttacaaacccatatttgcaacacatgttgacaccatacatgttgaaaatagtggaaaatattggaacatctgtaaatagattcagacagataaaaatgaggtttctatattttcaacatcttcctccttgtttgaagggctatatttatactcatagagcttaggcaactgtcaccactgtgaattcattggctgctatgttaagaactctattgtgggaaacaatttgaaagggatatccttttctgtgaaagcttcaagatatgttcaatgatttgaaatatttccaataagatgttggagaaggcagtgtaaaacaggggtatggagaagtctaccagaaacttcaaataggacttgctgtacactcatttagaaccttttactaaagttcgaggcacagattattttgtttattttattcattaaagtgcacctctgcctcaaatagaagctaagtgccagaattctatgcatgtctcttctcaaagtgtttccagaaagacgggaaacaggaagtcctaagactcctgtgagaaactctctccttggatttctagctcaatttgtatagatttaggtgcatggtttcataaagtgttgttccatggaaccctaatcctaaaagaagcatcttaataaaaactgtttgtttaatataggcctccctaaatcttaacaatgaaactcttattttgcttcaaagaacatactgaatatgctctaggaaacagtgcactggtgttcagtaaccatccaggttttgtgtttaaaatgcaaacctaagctaaacatgtagctgagactgtcatcagggaaaatctgactactttgactatctaactttaggacactggggctgcagtgttgtccttcatatcaacctctctatataaagatccccatgctagctgaggtggccactcccaacggacctggataacgaaaatagtaaagaatcaatgaaaggcttcagggacaaaatgaaatatgagcagtatattaacaatataattaaaattaacacataaatttaatggaagaggtattaagacagggtagtatttaagaaaattctagtccagatgttaaaaatcgacttgacaaagtaattctgtttttatacgtgggaaagataaacaggttcaaatattgtgaaggataagctcccagaacaactaaatggagagcagcaaatattaaggatatgtgaaggcagtgccttggttcctggtataacatgatgaataaaaggaataggaagagattatagtgtgttaagtcaaagagatgagactataggatgttcattgacacagcagtgggatgtcttgagtagatttccagtctaacaacttagaagacatggctttttattcctggttctgacacttaatatctgcatgattttgaagaaaacatttgattcttacctatccatgagggtctgtaacatctgctcattctatgttactatattgctttaagaatcaaaggagataaaggtttcaaattgctatataactataatggtgtgttacaagaataagataataagtagagatggtatatggagttttctggcaagtgaggtttgcattgaaaccattttggaagtaatgacaaggaagggctgacttccaaagtagatactagccaataaatgggaggaatcaaagagaagagagcagtcttttggaagccaaatatgaagagaagatgaaaaaaggggatgagtgtagtcaaaagaaatggaagggtcaagaagagatcagtcttgcctgaagaagtctaaaaagttgtcattaatatgaaaaatgtccctaataaataaagttggtagataattactgaagtacaaatgttattaagggcgctccaagtgaagaaatgtgatgagaaaatgatgagaagagataattaactggtaagacttgccattagagaaacaatgtaacatgtttccaatttgcttgtagttgttatgcatattacttgggtttccaaatcctgtggaatgtctgtgctgtagagtagccttcttagttccatggacagtctctttttcacattacatgcactgtctattctaagatgacaaactatatgggtatcttttgatacctgctagtaagggagcattaaaggttgtctgatgaattatgaaaattaatgttctgtctaacgtgctaatgtgcgttatattatatattatacatattatgtattccttttactcagaaaagcagatcttttccacaagccagtgtccagaattgtttcctttagtaccaggacttctttgatctactttccattctcagctctttccaagttatcctgaaaaacaaaacaaatcaaacaagcccaccttctttactgacatctcagatagcagctatctctgcgcatatgtccgcttgaacaaggaatacatcaaaaataaacagaaaaacactgatgcaaaaatttaaaaaaaaagtattatgtctgaaacagaagtttcttttagcttctgcattttcatttgaggtttttattctctaaaaataaaccctagagtaagaatagtgtcattttatattttacagaattattggcacttagcaactaataaatacaaattataactatagcatgatattttccaaaccagaatgttacctactgattaggaaaactgaaaggccagtgcccatcttatttcaagtacaaaatggtaattcagaatttttatccagtattatatgactataacgttcaaattttgatatctacatgcttgccagtttaataggtaatgctaagttttctcactagtagactataacgcctatgaatttaaaaggcaattttcttataagttaacaactctaaattatgggcatcttgcctctgatcattaccccaggactagcaagaaaagtaaataaaaagtaaacagagaataagctaagacactggtcgtggttaattctcagatctaaaggccaaaaattaatgggcacagagaagatctcctttgacgcctaccccagtaggtgggatgaaacttttaaccaataaagatagtgaagaagttttttgtttttgtttgtgttttaccacgaacttctccaacaaaaagttactggcaaagaaaaataacatggtaaaagaagatgaatcatacctaccccttacagatgttgtttttcatcttacactgcttaccttgcctaagtttttcatttccaaaagaatttttaaaaaataagtgatcatcacagtttccctatattactgtacccaagctctatctaaattgggtttactttatgatcggtgcagggcagggctcctttctctcttggtattggtagaatgaaagcaattcaaaacagaaatgggacttctactgcagaagtcacacagtttctgctaatgggtctcaatgagaaactttcttatgtgaatgtgtgcacactactaaaggtattataaattagtagagtcttagcagcctcaggtatttttcaggcttgacttcacaggcagctttcctgccatattcttcgagtacaagtttgttggcaaagatttggaatgcccaggagtagttctggccacacttctttttcctcttcctcttcttctaaacaatggaaatgtattctctgaatattctggaggctgaaagtcccagatcaaggatcaaggtgcctgcagggctaggctctctccgaaggccctagggaagactcggttccaggcctctctcctacctgccagtagttccttggcttgaggcagcagtgctccaatctttacacaaccttttccctgtgtgcacatctgatctgtctctcaacattttccctttttataaggacaccaatcatagtggattagaagctcatcctcctccaggatgacctcatcttaactaattacatctgcaacgaatctgtttctaaataaggccacattcttgacttcctggaggttgggacttcacacacacacacacacacacatatatatatacatatatatacatatatacacacacacacatatatatatatacatattttttttttttggctggggggcaagcatgggcaggccataattgaactcgtaacaaccacttaaaacagtacctgacactggccgggcacagtggctcatgcctgtaatcccagcactttgggaggccgaggcgggcagatcacaaggtcaggagatcgagaccatcctggccaacacggcaaaaccccatctctactaaaaatacaaaaaattagctgggcatggtggcaggcgcctgtagtcccaactactcgggaggctgaggcaggagaatggcgtgaacccaggaggcggaacttgcagtgagtagagattgagccaagatcacgccactgtgctccagcctgggcgacagagcaagactctgtcttaaaacaaacaaacaacaacaacaaaaagcaaaacaaaaaaacagtacctgacacatagcaaccatgtcataaatgagaggtatcatgactagtatgattgacatcatcatcaccatctaccatgctgatccatccacaaggtttctggcatctaccaggatggcacagcttctgccacatggacttctctcgattccctcacagtcttttatgccatttaagccttggacccacacttcttaatctgtgtaaaagacaatcagatgttacactttgtcccccagtacctggtgttggaagatttggctcttcaaacatgctctattttataatttaagtattgaatctaaaacactccctagtgtcccctttttgaaaggaatgattcagtgctgtatttctccaaggtaaattaagtgcccattctggtatgtggcattttaataacaccttgtaaactaaggacgggttgaaccttctgaaaacagaactgagaaaaccgagtaagcctttccccggaggaaaactagtatattagacactccataaaatgttaatgctttttatttccagtcagttggtaggctccaaaaatgcttctgctttctctatcatttttaatgtgcaatatacaaggggaatatcctataaagagctcagggagaaggaagggcctcagttaaagatttcaacactctgagcaaagcatcccaactcctttcagaagaccataccatcagccaaagggagtcttccttttgttaccatttatacagtgacttgggaacttgtagtgtcattaagcctcatcctgaagcttgagttgagaaataaaggaagctagtggttatgatacaggaccagttatcaaaaatcacaagaattcattgtgactttagatagatcacttttggctcctgtggtttctgtgtcaatatagttttctttttgtatgtgtgtgtgattgagaatgtatattgctgttttttcttttttcacctaacatattttgagcattttctaatatccttaaaatgattaaaaatattttcaacagtttcaaaataagagatttttttctttcttaatgtcattgtacataaacctttgtgtttctgattatttcatatttttctctttatttctgattttgcagatggtcaatatactattcttgatcccacagaactatcgtgaaatttagtcaatgttaacgttttgaaaaccccaaataaatgaagcaaagtgaataaaaagtagtttctacgtgttgtttgtttttttcctgaactattctgtttcctcttaggcccatttctttagtgaaagttatactataacttctttagagtgtagctatttgggtgtaagttagctaccttggatataagatacacccaaggaaaccaagaaactaaatcatagttaaaagcaaacattactctgacaatatctggtttacttattttttatttgacatgttatatgtgtaactcctattctgaagaatacatattcttaagtctctcacttaaaaatatttttacagtgaaatgtaaaatttctcatcttaaataaattcaggaaccaattgaattataagggtttttttgtataacattttttcaaatctaagttttattttcacttccttgtagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaaggtggtaagaatgtcttcctcactttggtattgttaatattttatttcctttgatcaagtaaatactcaatatagctttctacagtgcattgattgctgtgtaaaaaatagcagaagaactttatggttagaatcatttatgaagttatgttgataattttctcatgtttctacctggagaatgtattcataagcctaaatttgtgaatccacaatgtctttctgaaagagctttctaatttcttctttctttgtcttttaaccttagataaaatctgtgatactgtcgtgaataaataattggtattatggtgttagacacttaactatatataggacagagatgagccaatgttaaaaattagttcatagtgctgggagagtttcaggaggatttccatttttaaatgaatatttattatttccttttaaagggaatggggtaggaaattgtgggttgcagagaaacggagacagactatttgaaacaagtattatgagtgaggcaggattattgttattaaaaatgtttattaagatcacttgtgcttagtcctgtgcaggatagatttaatcagggtatttaagttcattaattctggggtatctttgtgacagtggagatacaaatttttgatatcactagaatgtctggagtcattgaacctttgggaatatctacaaccctgtatttctttagaaggcatacatctgtctatccatccatccacctaacaattattgaatgaatgcctctgcttgcacctgtttccttcaagcagaacctctagtgagcctcagtagagctcttcaaagtttggaacttgaagtcatcttctgtatttctctaatcagcctttctctgaatgaagatggaattgtaaatggtgatgagtgaaagagaataccacttacatctgcaagttgttgttattaagctgtggcttatgtgaccattcatgaagtggttcagtgagcatatgcaatgtacacatggggaggctcctttaatttaaaagtggatttgagctatgtgacaaatttgttcaatttcatgctttcatctatagttatgaatagggaagataactccatattaagtgattttgttttaaagacatttcatatttctctattacactccattacctcgagttatatctcctttagatagtctaaacaagcctttaatatgctttgtaaagtaatattttttaaacagtgagttcccagagctccatttgggtgtgctcagtaatgtggttgggaagggaaaagcctgctaatcagtcagactctgccaaaatcttgagttagagtccactggaaggaaagcatggtagtattttgccagagaattttaatagaactcatgagtatttaacgattaagtattaatacaagttatatctattctcatattgagctgaatacattttgggaaagattgaaaacacatttttcttatcatcctaagacttaaagcacatggagtggaatagtggtttttatttcatgattttagggatgtcaagccctagtgattctcacagagctcatatgtctgcgtacttatcataatttaacttcttttctgagtatttgcctaataaatgtgtctttaagcttttagaggaagaggatgtgactttagaagtaaacattctggctaggtttcaactttgggcgcaatatcagggaagcaaacatctgttcaatttaagaaacatttttgaaaaatgaggatagccatgatagatggtacccttcatagccattcaggaagtgaaaaaagtaactgtgtctgttctatgatgtagtatatccaaaaatagtaataataatcatagaaactgaatttgtctaaatattccaggcctctagatatcttttctttttaatgacaaaactctgaaatgaatcttgatttaactacaggatttgccatcttaatttaaggtgattgcctaattttccaataggttctctgctgtcatgaccatagattttatttgcttcttgttaatctcttttttctttaatcttactgttaagcgttctaactaaatatttagttacttttagaactcataagagacacaaaagtggaaagtggctctcataaggtttttatgaagattttcattgtctgcatatctttattttcactggagccttagtcgttggctatggtgaatttaaaattttaaatggctaatagcataatactagattgaatatcagttattaaaatgaacttttattcaaattctaaaacacatgggtaaagcctttctttgttttatgaccaaaatttatatatcatataaatttattatttattgaaggattatatgtaaatattttacttataaatttatatatatgcaaatatttcaaaataagcataccagaataaacgcatcaaatattctaaaatgtacattttaaagctcaaatataggtattctacaagatcttaaaaaacacgagctgtgtcgtcatccaaaaagccaaacattttaattgaccctaaaaggtcttctggtttcaatctgacccactaatctgtggagacagcctgaatataatactgcaaggccagactaaaaaaatgttaatgagcttcccctgtcattggcaaccagtttaaccttaaggaagctgtctcatcatgtataaagtcaggagaattctgtctatttcaccacaatagggaaagaattacattagatgctcaatatacaagcgaagatcccattgctgaagacacagttgattcattaaactttagtttcttctttctccttcgatggacaagattcagttaagtacattcattatgtgctttataagcaaaacttcctctgcagaaaatgtttaaatacaatgccccggagtgtttgagtgttgacagtcatccaggcagcttttttggcctccattttctgatctctaaaatgggatcataatatctacccggtaggtatgtagtacaccataaatatatacaacttttgtcaattatgtagttcaaaattgccaaaaaagtggattgtaaatgttctgaccacaaagaaatgacgagtatgtgaggtaatggatatgttaattagcttgatcattctgcagtgtatacatgtaccaaaacatcacgttttactccaaaaatatatacagttattatttgtcattaaaaaattcaaatttaaaaaagaaatagagggcctagaataaatacatacataaacaagtaaatgaattaatttcttaaatgttgaaatattaaaagaggttagtataaaacgcatagcttctgtgttaagtcatagtcaacattaaaataatcgtaattatctttattttagtgccttctaaaatgcctataatgcattaaagttatatgataaagaattcctaggaagtgttggctagacatgtactttttttcccaaacatttgtttgatccagaaactgtaaatctatctttgcattcagagagtgcttttgtttagtttcacagcactttttctactaacacatctgatgttgtgagatacttttaagaaggacaactaataaacacattatctgaaataattcaccaaactttcctcttcttattcctaatagacaataatggtgtcttaggcaaatagtcaattcaaactgaattgcatccactttgtaaggcttctgagtaacacatttatttttgcctaaccttcatctgcaaacattgggccacatttattcttagaaacattatccactaaagaaatattgccctcagtgttatcacaatgtcaaagctcagcctattgcttcatgtttttggcaattcaaaattaccaaaattaaatatttgctggaattaagtaatttacattaataaggcatacaaacaaggtttggaatctttcaggggagagtaatcagttactgtgactattaaaaaaccactagttggccaggcgcggtggctcatgcctgtaatcccagaactttgggaggccaaagtgggtggatcacttgaggtcagaagttcaagaccagcttggccaatatggtgaaaccccatctctactaaaaatacagaaattagctgggcatggtggcacatgcctgtaatcccagctactcaggaggctgaggcaggagaattgcttgaacccaggaggcgaaggttgcagtgagctgagatcacgccactgcactccagcctgggcaacagagtaagactctgtctcaaaaaaaaaaaaaataaaaataaaaataaattcactggttatctatgtacactggtgattaaaatgtcatctcatgttgagcatacacgtggcaaatatataattgggaatttaattactaacagcatgtaaaaaaaggaaggaaggaaaaaagaaaagaaaaagtttttaaaaaaagtatttagactgtattataaacttacatagtctgattgtctcacactgctcaaatcagctcgaagctcatttctgctgtagcaggatgtggttcataaatttatccattcattcaaaacagttctgcagcaactgttctgttctggggaaatgatatttattcatttttatttaacaaatatttggtaagtttctataatgtgccaaatattgctcagactactgggaagaagaaaagatgtatttcattctgtggctttaaggaacctagggtttgataggagagaaaaaagtaaacaattatttttcagaattatttgctagaagtgagcctagggtgcctggacccgagcaaagctcacagagaaatattaaaatcatggcaggaacagaaggataagggcagaatccagcatctctagagttttcttggggattttactgaatccttattatgattctagtttgcttaggctttccacgtgttagcccttacaacagcaacatgagggagttaccatgtctagcataattttataacctctacagagaatttgagaatttgcccaaagttacaaagctggaaatcattgatctaggattaaaatataagcaagcttgttctagtgggaagatgatagttaagtctaaaaaatgaagaaagtgaaggacacaccagagagtacaaacggcatgtttattttccagaagtcatgggagcgggctgtagcctaagtcttaaaatgaatttagagagaggatctctgagggagaccaaaaaggccacattttttctataaaatcaatgagcagtcattgtcaatatatgatgataatggtgatatttgtgttttacaaaaatctccccagtgacaatgtaggaaaaatatactgtaaagctgagaagcctggagtaggggaccagatgggtgcttttaccgttattataatatcagcaaatacttgacacaagccagtcttctgagacctttgcatatattagtttatttaattctggtaacaacactgtatgataggttctattaccaactctatatgaaaggtaagctaagcacagagaggtgaataatgcttaaatatcacactactagcaagtgagcaagctgagatttgaacccagagtcttgttctgaatactgtacattacacgctgcaccatattggacagggaaggtagagttgatgatttttgtcagaatttcaaagtgatctctaggaaagaaatagtaaggtccatattaaacaggggtaaatggaaaagtaagtggaagaaatttgtaaaaatagaaaaattagaatcagcaagaaataatgacttcctagaagtctaatctaataccaattgcacatttctaggttaaacaactgagggagcatagatcacattctttaaaaccagcaacatgggagatgaaatagattggaagggaaaaaatagtgagttttagtttgggatattttgactgagttgcctgtgggacagagtctggcaggcagataaatcggattctagaaggagaacaatgatttgtcctcagaggagacaagaggtaaaatcatagaaagtgcatataaagcaatggctcttattcatgtaggggtcacagatccatcaggaaaccagatgcaaacggctatttttcctttccacttaccccaaccccaaaatgcaaggatataagcacacatttgtgtacaatttgagagcatttacataccaaagttatgagtgcattgtatgaaaaaatgacagtgtaaaatcaaagacagaaaaatttgaaggtttttaagggacaggttaaaaaaaagagaccgaaagaaaaatatagacagtgtgaaaaacagtagtaagcagtgttttgggaaggtttaaaaaaaaaggacagttatgaaggatgttcttttcagtggcaagtaagcatgacagtcaagtttttaaaaagaaccttctgtatgcagaggtttggtatgctacatggctcagttgcatatctcagagactaaaatgagtgagaggaagttaacagaaatcattatatacctgcattcaagaaacttgaatgtgaaaggacagataacaactttaagtagggaggcacacggagtagaggaaacttaaaaataagtactgagagacaagaacatgtttatatacttaattctctcataagaagttcaaatttcaactcataggagcttctcatgaagttcatttttaagaatcatttcacattatcacagagacataatggctgatactacaaatgtttaagtgaccactatttgagctaaagtgcctttcccagaagctgattgcagtggtatggaacatttgatcattattatgggtcctctagtcttcttaaagggggaaatgaggcatttgctttcttctcagtgctgaggagtcatttggcttgattctcagaataattctaccatctgaaaggaatttacctcccatgttgtgtctgttgagtttatgaagtttatatcattctgtaagggatgagatagtttgaactgcaagtcccttgagttaagaatgactctaaaaacatcacaagtgatgggaggaaattaaaactttttgaatgtcagtcatataaacattgataaaaatggaatatatcagtttcgttgactgggtaaaatacttggtttttcatttactacttgtagtgcacaatttaagattaggtagaaagagaaagaaaaatacaggaagtcatctgctgaacactgcagtgagtacttgtttccatttaatgagggaaatgctttatcttgacagaaaattatatgtcaaacatttacaatttccttaaaatgaaccacactatctagcacttcctttcataaaacccagtggcttaaggcaaaattgactgtttatttttggaaatggtatatttctcctttttgatggagcgtgttatctgccttttagaatagtcataatttctgtaaaaaaaattgtgaatagtggatagccaaattaatgataacaaaataaaaaataacatagtccttgacctctcccatgaactatttctaaaccccatctttcggaggagatttgaaattttgtggttaattctcttttggaattggagtttttaacttcagaaacaagatgaactatctgaaaagggatatctcctggttccagctgggcttggaagttacaggggtaaaaggccacaaaaagagtgtttccttgatgttccaatattaccatgagcaaactccatccttcttcccttatgctttcatagcctggttggctaaagcgaaggagcacagatagtttgaatagactttcaattaagtcatttcctggtctcatccacactcaagtcaaattcaacagatattttctaaaccagggacaaaacagaacagtagacattagtcacggataagatatggcactttacactgaaccaaatgacacctataattactctgagagacagtaagaaaaaatgttttattaacagcattaaatatgtatgcatcatatcaactatagagtgaagacctcatgaaattttttatactgtaagaagggagaaaaagaaggtaaaatctggggaatgttgcaactgtacacttagctttaaatgtgtataaacaaatatttatttttagcataagattttctaaaagtcaattgcaaagaatctttaaaactagtaacattttggccagtcgtggtggctcacgcctgtagtcccagcactttgggaggccgaggcaggtggatcacgaggtcaggagatcgagaccatcctggctaacacagtgaaatcccatctctactaaaaatacaaaaaaaaaattagccaggagtggtggtgggcgcctgtagtcccaactactcgggaggctgaggcaggagaatggcagaaacctgggaggtggagcttgcagtgagttgagattgcgccgctgcactccagcctgggcgacagagcaagactctgtctcaaaaaaaaaaaaaaaaaaaaaaaaaaaacaactagtaacatttttagcttcctataggaactcataatttattatcaaccaaaggatatcaacatgaaaactaactttaagtacactggaatctcatgcttgtgctagtttgggtgttcacattctgagtggggttatgtctgctaaggagtcatattaatatgcagcctacaaagaattactcatctttttaatggatttatgaataagtcagattatcaaatgtaatatcaaatgtcagacctcttttaacttgtgtatttattatatgtttgcatgtatcttaattatcttaattatttttaggtgtgaacgttccattttcacaagtgggatgacgtcctttagaatagtgagtttgaactttgggtataattttaagtggaaatttggttctaaagggagattttgccagttgtttaggcctcatggacacacagacacgcacaaacctaatcttaatcataattaattatccaacctatctctctagagctaggaattatagattgagatggtttctctccagtatctgggagcaggtgtataccatcgagagggcaggcatggtggtttagaaggagcaggaatcatgacatctctgttctagtcccagctctgctgtcagattgcttaacatagaagtatggcacaccttagagtttgcctggtatcctacacaaacctacatactttatgactcatatcaagcattccaactttgtctcttggttttgtgtcactcctaataaccggtgaagccctgtattcagaggagaagcccatgtagagccagggctggtagtcaagtactgttctttaagtatatcacaccacaagagtaagaatcaaggtgacgtacttgtggtgacagtcaggacttatttacttaaaacttcaaagtggaattttgtgtatgtgtcagttttcaaaaacatctggcaactgctttctatgtttacagcattgcccaaggactttcattccatttttaatggctgttgctgaaataaattatatttgtctgctcatagcagagcacaaaagatgccccttaagctttcccacatgtatgggaaatcttttgtacaaaaccaatatattttagccaggctgaaaaaaagtatatgggaaattaacacacacgaaacacctgaaatgtctttgtgaataaaatgagctcctgaacaaatggcaagggccgtgcagcattcgtaactgcccaacagggtgcccaaagggaaaacaaagaaattaattttatgtaaaatgaaagattacttgattaaacaaagatggtgtgtatttccagttgtaccttttagtcaagtatttttccccattctttttttttttttttttttgaaacggagtctcgctctgtcgcccaggctggagtgcagtggtgcgatctctgctcactgcaagctccgcctcccaggttcactccattctcctgcctcagcctcccgagtagctgggactacaggcgcccgccaccacgcccacctaattttttgtatttttagtagagacggggtttcaccattttagccaggatggtctccatctcctgaccttgtgatccgcccgcctcggacttccagagtgctgggattacaggcgtgagccaccgcacccagctttttccccattcttgattactttaggtagtaataggcattgaatatacgttgttatacacatgagattcgtttcacattggaagataattgcaaaatttatttgaacatggtaatcaaactacagtacaaatatgtagaattgatatttaattattcttccactttaaaacagactttaaattagagctacacttatgacataggatgctttgcatctctacataaatgtaagagtttgtatgtcttatgtatatcgtagtattattgaaaatttgtatatctgcaattatatatcatgggcaatatattcttcagataattaaaatgtatccctttagtaaaattttatgaaaatttttaaatgtgatgaaaaattacctgcattttttatcctctcctttctttttttggaagagaaaattgaataaaattatggctttttttctaataatttaatccgttattatccatatgaattaattttcatcataataccgtgatgcctctggaaaagtatatagcatgccccctttatattgttcagtgcccaaattcttatcatttcttagttttgcctactttttaaaattttctgtcttttcctcacacacatacacacgtactttcaatgatccaattccttgtctccatgcctgatactagaagatgaacacagacacacacacacatactttcaatgatccaatttcttgtctccatgcctgatactagaagatgaacacacacacactcacacacactcacatacatacacacagtcacacacatacacacacactcacatacacactcatacacacacacatacatacacacacacacactcacactaacacatacacacacacacatattcccactctcactaccccgccagcctatcctctctgtctttgaagcttctagcaaatagtccgtaggctgggagaccaactaccaggcttatgagaataatacctaaaattaataggggtaaatcctgagtcagtgtgactttaagggtatgaacatgataaaatccaatatggctgctttgggacctctcacttatcctctgttagctcttgacattgtgggctgtcacggcttcacttttctgctgagggttttcatctcagacaattctactgcctgtggctctctgctatcctcatgtcaacatattctttgttcttatcattgctgcctcctctctcttttcccatacaacctgcttccatgagatgaggctgtaccctttcagacttatggcttatactgaataactcaggaccttgggtgtgctcttgtcagcagagataagtattgctggggattctgtgacagatgactcactgaagttctatttgggtttcactttactcaaaggccagtaagaagtagttaagattttcagctttatagtcagagagttctactacttacaagttttggtgaagttagtagcatttctgagcttcaacttcccatgtaaagcaatatattgataaatactcctcataagaaatttataaggattgaacaaaatgaagcatgtaaaacatacttggcacacaaaattcagagtttaccacatagtaagtgttcaattaatgctagttgattttattatgatcatgattattatagttccataaaaaatggtagttaagattttatagattatctataaaattacatataaataatttaaatgagagcaaagaagttcttttttaaaaatgtttaattaaaataataattcactagataaatgatgttcaagtgttcccttattccagggttagagggactttgagaaaagaagtagttgttttaaataaaaaagtacacttttagttaatcaaagacttcaaattaagagtatttaagaatagaatgtatgtgtttgttatactgtctcacacacatacacacatgcacacacacatataaccatattcaattgccatttttgtaggttaaaaacagtcatgctgagatatcagcccacagatatttaggtttgtatgcatatgctttctacaagaaaaaaataccaacctcaacattttccatttataagcatacagcttgtatgtatttgtgtagctatatatatttgtatatctgtttataaagtcattggtaaatatccctcacccctatacctacccataaaatattgaaacttggactgcctggaaatcttttaattcttccacacccttgaaatgcaagacattaccttcttccacttttaaagattcttttgaataaattaggattccagagagtgtcttcaaaatgttttctctatgaaatgcccacacacctggctgaaaagcacaaaatctaatccatcaattgtttgcttgtttgcaccttgtcagatgtgctgttttcttcctttatatgctcagttaatttcagtgacctgttgtgttgaaatcacaggttcagggtcaatttctagtgctatgatcttcctaataatgatgtctcaaggactatccttgaacaaataacctgatccacatgtattctgatgttcggtaaatactggaaatacatgaaccattagccatatttaaggtttaaaatgaacgattgaagaactgatttctttatagcaactcatcagaaaatgggtaagagaaagggctttggctttttacactgtctctggtagcaaggctaattgccttctgtgttctcggctagtgttgctgaggctaataattaccaattccacattccaggaagttttttcttgagggttcatctgaattgaagtgaccctctgccttagatttcatggtcctcccctgaagtcagtctggtggtggatgcaccatctagatttaaattggttgggtaaaggaagggaagatcaggataaagtcaacagctgctagcatcagggtctcaggttgcttattgactgaatgttggctggtgaaagacagacatgcacctgtttgtgtctctattctatccctttagatgacaaagatttggttgtatagataaggctaaatgaaaagaatgaataatgattccttcctaggactttctagatttatttgctgatattggtgtgggcaaagtctttgaactagcataccaggctcttaaatttaggtcagataagcttttctatatgttatattctttcaactgttatctcttctaggtagccttcctggtgtccacctggcagaaggagtatattcttgcatgttcccaatgtgcttgatacatacctctaagataacaattgtctgcattctctctctttggtgctgtatttaaactggtgacattatagccttacaagttattgccagctatcttgtgaccaggttgattgccaagaataagtgggtcaagaaaaagactaagaaaccaatttctggtcacattgtttgaaaccttaccatgacttacttaaagtactacattggattctttagttacatgatccaataaattatctttttgcttaagccaccttgaattgagttttgtcctatcataaaagttactaatcatgggtatagcgttcatggaagatctttttcgcatcaggctgtgatcacatgacaggcaggcttgggctttcttatgtctgtatctccattgcctaggagaagtcttaaaaatagcaaatgtccatcaatatttgttgaaataataatataggatgattgaactaagagaggataagaagcagagggacaaatggaaaagccatactctaattgtcttattagaaaaaaattaacactttaattaatttttaactgataaaaactggagaaggatagtgggactaataagggaaagagcaaacacctggtttggaaggaaagattatggaacattaaacaaatgaaagttggtgtagcaggaaggactgcccaacaggcaagtagatatatgaatctgaaggtaaagagagaggcaaatactcagtgttaaaaagtgcctgtgtatattagaaatcttttgtgccgcagttggaagccatgatagatagtttgcaaaatgaacagatatataagaaatagagatccaagaatggaaacttagtgaacatctatatggtaggtgatgagaggaaaataaaccgataaaagaggaaagagaaaaaacaattggagaagttgaaagggactaggagaggtcaacaaaaaacgcgaggggaaagataggcaaagacaacttctatagggtagaggaagggagtggaggagacatatcaaatggctttgatcttcagagtaaaccataaaggtcatttataaagagtgagagaagataagatgtagttttttaaaacagtagaaagatttgcaatacactctacaggaaatgtcgtaggaagtttattacaaatgactcagtgtttgcagtctacaagggggttgagaaagtgaatgaatgcccatctgggggttgggatttacctatgcaaaggtgagtggatgaaaggacaatgggtggagagaccagggatgccaaatggaccattattaaattcctgactctgggatcgaggctaagaagaaagaaaagggaggctcggaaagcagtgataggaatggcagggatctaaattctcaatgagagggaagatgaactcatcagaaattaaagaataagaaaggaaaaataagaatatctggtcaaagaaagaattttagacataaagatcaaccttttaactcgtgcttcaaatcagttcattattacaaaaagtgtaaaccactttgagagatagatacagccctctttcaggtctccggaaggttccccctgacatctgttcggtgatgcttcttttactcttccatcaaatcttagtccagacttttttttttaatttttaatttttgaagagacatggtctcactgtactgcccaggttggtcttgaactcctggcctcaagggatcctcctgcctctacctcccaaaacactggtattacagggtgagccactgctcttggccccatcaagtctattgtatctatctgtctcgtgtcatttactaaatattcctccaatttctatcttctatctaactgaagctcaagacctcctaaaaatcttatcactggtgctgacacttgcaatgttcaggaaattcaaatgttattgtctctctaggttttagaatgtttcctaggtgtccagttttataatatctatgcatgacattggacttcagaactctgcagtacttaacaaagaaacgagtcatgcaaaaagtcatgagattgaaacttctataaccaacatgttgacatataaatcgtttataatttcatctgaaataatctttaaatcttaactatttaggtaaagcttaaaatacacagcaagatgagattgcctgttttggggttttcttaaatgtaaacaatggtataatctgatttattcaatgaatgaaaccagccaattagccaaatttgaccaggagaggctaattcaatgtgatcctaaatataactagtcaactataactgctatgttttaattagaaggtggaagacagcagcatccaccaccccctagactggccttccacattctgctagtgtctcttccataagaaggagtaacaggataatattgctgttaacagtgttgtcattaccataacaactaccattcttgagtacttattatgcttcactgtctttgcactgtgttaggtaattcatacacccatctcagaggtatttataactacctcactttatagattaaggacaaaaaaaactctaaaggtcaatctacccttatcaaagggaccttattcaaaccgtagtatataataaaaataccaaaggtaagctgtggatgaaacttttacaatgattttcaatgccttgctactctaaagtgtagcctaaattaactttcaggcatatgcttgctagttggtaagtaattaaaaacaatcaatctaatctttctggaaagaatgacttttttgaaagaatataagtatctcaatttttcaaacataccaaattaaatttcaagaaaatacaatatctatttcagatatgttaccataacaacaaaaaatccataatataaccataatactaggtgtaccttttgatggtagaattctcaaaccattttcccaagtatagaatttgtattcatggttttgacaacaaatttatactgttagttttcacaaaaataagttaatacccaactttttccttttttctcggttactaaaaatgtgtgtgaaatagcttcctcttcccacacatagccacttcaccaacatcttcctgaagtggaaagaaaaagcaaaaatgggaggagagatggcagacaagagtgaagggaatgtgttctccatacataactaaaaaagggagggcaggatgtggtatatacaagagaagcattttctccatagataaatgactttctctctctcaaaagagaaaaatgggtttaccgttgggttcctgctgaccacatcttcctgtgttttttgtcctctcaagtgatcataaattttagttggtatttcttcacatctctttttctgggcatctgatttgcttattttcaactttccaacagaataaaggatccagtaggtgggatttaaaatttttttttgttttagaaaaatagcagtccgtaaagttagaataaacgaataccagtaaactacgtcaatgcttttgaaatggatacctttatataatccattgacatcctcagtgtcattaaagatggcttttgagtaagcatttatatatgcatctttaaattgctatttgcatacattctgtgcagtacttcttcactatcatatgaatctgtagccctttaattagttgatttattttgtgttgacatggcaattgtgatggtggtatttagatgtaattattagtatgattcattaaaaccattagtgcagacttgagctacatagaaaatcataatgttattaaatgctttagtactatttttctgctgtggcaacatatctgacataaatatttcattttcttgaaatataatttaatattttttaaaaatctgagtaatttatattgaaatagtaattatttccataaagattagactgctcaatacctataagttagtaaacattaggcaactaaaggccagtatttagtatgaaaccagtattaagttaggccaggattttagatttttagatcatttaaaattaatgtaaaagttctgattcatagtttgcctttgttatttttattataaaagactattataactcaatgtgtttgaatgcagatatttattgataggaaactttaagggcaagataacaaaatagtcttaatcttaatttctagaaaaaggttaaataaaaccaattactaaaataatacataatagaaaatactaaatcataaatactttataaatataacacatatatctttagctaagaactattaaatgtgggtcattttgcatttttatttcatttgtaagaagttaataatggataaagctcagtaaataaaataaggttttcctcagtagagacagtctctaactattaatagattttctgtcttcacttgacttctagtgtttactgtgactctttcacctgtataatttaatttcaaagtcttatttgtttgttcttttatttgtgtatcatctgcctgatgatttaactttagggcattaaagaaagaacaaagtaaagtttggtttcattttcattgtaggtagttaagttgggtcataaactcttttctacttcccaaatctaattattgttaagagttgttgattctttttgttttgctttgttttgttggtaaaattttctagaagctcttcaatataaagtcacagaaaaacagtacttccattgttttagtgttttaaacttccatattgcatttttatgtttgaatttatcttcatgtcttcctgctccaaaaagtgtgttagcactttttttagactttcctgtgaaatgtaggtaagaacgttttagagattttgcaggaaacttgacgtaattgctaccaattgaagatattacatgcccaggtcatttgttccttaagttgatgttttggaaaggatacatagaaaaaaaagaattaagaaattaagtaaaatataagcattcagttaaaaatggctctacagctttttccttcagttttttttttttaattttgtaagctacctcaaaatctagtattgtctttatgattgactttttactatgtgcgatattgacatttgtgtggaggaaatgaagacatgcttagctattattggagtcagtttggctactaatggtactgatattcacatattgcaatctttttttttttttttgcagttttactaaagggaggaaaaagagaggaagagaaaccatttagagactgtgcagatgtatatcaagctggttttaataaaagtggaatctacactatttatattaataatatgccagaacccaaaaaggtaaaaccagaagtgtttgtttacaagatgtaagccagatcccagttgaattgctggataatcagattgatttgtgagcttgttaaactggaaatatatatagagatgcctgaacttttttctcccagagatactctgtttcccaggtccataaaggatgaaaaccctattgtacagaaatccccaatccacacaccttttctttcacacaaaattttgcatttattccctggtgtccctaggatgtccccttgctcatacatgtttgccttgtacagattacatgttgaggtcatgtctaccgtgagtctatgggaaagagaagccatcttccaaagacccaacaatccagagaacacacattatccaaagccaaatactgtgaggagagggaggggtagatatagctatttgcaagttattgctcctgttaggataggagaaacatttcctatcttacttcataatcttgaaagaatttgctttccatatttacataaaagagtgggttggaggatcggattcatcagtatgttgaacaggacccaaggtaaactttggagtaagcaaacattatcttcctgctgtaacatctcttttgtatactgtcttccaccatttattcattaaatcatccatctatgccttcattcaatactgttaagtggatatcatgcatttgttaggaacatgaatatagagcaaacagtttctagtgtaatgatgaagatagacaattatgcagatagttataaaatgctgtcaataagtatagtgatagaaatggtctgtgtaaagcagggtatatgggaagttttgaggtgagacagctgaagagagtgagattaggcaagaaccttgctcttcagtgtctgtgagttttaactggaagcccagggtcccaagaggaccgcatgcccttacaggataaaacaactgtcctcccctcatgcccccacctaaattacttgtctcttatccccatttcctctggggcctgtgcaatgctcttggaatcttctctgattccctcaggcaactttacatgactttctcactaccagagttctaaaaggcagagattgtgccttttatctttgatttcctggaacctagcatagtttctggcacatagtaggtctcaatagatatgtgctggaataaatgagtaagtgacctgctgatggcaatatcaacacttccatgcagtgcatagtaaatcagtctaacttacttagtcttcctgattgttagtctcctttgataggcaaaggaaatgaatcctggagcccagtttgccagatgccacttaattggcaacccaggaagtctggactatagtccaggtctgatacaattctattttcccttttaccactgtcctctgtctctcttgatttccgtaatgaatagttgtttatgttagctctaaatggtttctttttcccctttgctgggacaaaattttcttcttgaaagatacctttgatgttgtctataagggggtaaaatgtaggagtggagtgggcacaggagggaggacaggcaggaggcactcttctgtactttgctacctcagccatctaccagagaagtgtggttttgctgtttttcatgtttgatttctgtgcaagattacattgaatcccatggcttaaagaagcaaacaaatgaaaaattgaaatacaatggcaagtctgggaatgaggagatgaagataacttattctaaggaagatatcctaaaatcacacttaagcttaaattcaattcacacacacacacacatcataaacacacaccatacacacagcagatgaagtatgtgagaatttgatctggagtaggaggtggagttaaaacatttgctttatcatttacctacagtactactcaagacctgaaagaacctctaaattattgtcagttccactagagcttataatctgactataaaaataaaattaactaaaaatactaagcgaacttccatttagactcatagtgattctgtgatataaatgaatcgaaaaataattcccaaagttttcagatcaagaatattcacaattttagaatttttttgacttcatcatcagtactaccatgtggtctgtgggaaggggtgcagtacaaatacagctttagtcattctatggactttagttcatatataaccacaactacactctagtttgaaacattatgagatgcaaatggtgcacaggctatttgcagaaccactgcgcctggtaatgtgaagaaaaagatcccacctcaattcataatcctgaataggtttgcttttcatgcttacataaaatagaatgttggagaatccaatttactccttccatggctggctcctgggttggtttcatcaggaaagcaagattcaagcttacgcttctacaaaatggtggattttaaatatgatggagtttttgggttttcttaaataaataaaacttagaatattatattcacaaatgtcaagtacctactgaattaacttctgatatttaggctaagaaaaaataataatctgaacaggttagcagtaacatacccatacgtacccataaggagcaaattttatcactgctgaatggccaccatggcttttcagagagaagaaggagaagttccaatattacctggtcaggactattgttagatttagatttagttttattgaaatactagcagagtgtggtgagaaggggagataactgagctgaagagagaaagacctggccttcttctggacttagatgttcattctcttgttttattatttccctattataatcatagattctcttacaagtagtaacattgttctataataaagatgggtatttcagactgacatacatacacatttttgcaggtaaaaaatttagtgtttaatcccttagtataattgcatagcatagcactggtaagaacaaatattgtgtgaatttcctcaaaagtaatttacaagctgattaacaaaatagctcaaatgtattgagcatttacagtttgccagtcttcttctaagcatatatatctctatatatagatagatatagatctctatatatagatgtatactatactatactatatatatactatatatagatatatagagatatatatagatctctatagatatagatacctatatctagatataactatatatatagttatatctagatataactacatatctagatatctagatatatagttatatctagatatctagatataactagtatatagtatatatacagtatatctagatataactacatatctagatatatagtatatctagatataactacatatctagatatatagtatatctagatataactacatatctaaatatatagtatatctagatataactacatatctagatatatagtatatctagatataactacatatctagatatatagtatatctagatataactacatatctagatatatagtatatctagatataactatatatatagtatatatagtatagtatagtatgtatctaaatatactatataactatatgtctatatatagatatttatatctatatatagagatctatatatagatatataatatacctatatatctgctgtctatatctatatatgctatatatatctatatatgctatgtatatctaaatatctatatatatgcttagtgtatatatatgcttagtacatatatatgcttagtatatatatgcttagtatatatatatgcttagtgtatatatatatgcttagtatatatatgtatgtttatatatatatatatatatatatatatatacactccttcatttactcttttcaacaaccctatgagatagagactcccattatccctactttagaaagttaacctgccccatacaaattcttagcaaatattgaatattgactttgaaacaaaggaatctaattctaggatacacccttttaatcagaggattaagcaggatcattatttatgttaacgataattgaaattgtatcatttataattttaaatatgaacctgttgccccatggggtggtaaacacatggtgtgacatgtgagctacacaggcaagggtttatttttagaaaattaggtaagttgattcatgttctcattataacccacctcattctcaccttcctataatctcagttttttccatcttgaaataaattgtcagcattctctcaatcctataaaaagtgctagcaaaattcatcgttaagactttcacccttccatgtagactgtacattgtaaacaggaagtttggtgctacccctgggtaggcttagccaaagcattgctcattataatgtttccagaagttttggcaagggtaagaatctcaaggcaacctacacaaaaaccgaagcatcaaatatgcatggtatggacgaaaaaataaactagggttattaaaggaaagtgacaaaccaatgagcagaaattattcatcttgtagtcagtgtgtgagttgcaagtataacaggattgtagtacagtaattttttcgattgacattgttccatgccaaaaaaaaatgtctttgaaagttagagaaatgttatcttttcaaatgtggaagccaaagacggttttctaggactatttaacttttcaagcagaaagaaaattagatttaggtcatttctgtatttactttttgcttttatgttattaatggcttgtgtttatttttctttctgaattcccttcaatgtatagtagtaggaaacaagactttccctttcattttatgtttccaaaaccaaatgcctagtttcatccaaaaaacaaaccatttaatcattactctgcttattgtaaaatattaaaaatttgattctgaactcgtaattcccctaattcttggaaaagtactgtaacaaatgggttaagcccttttcatttatggtatggaaaaataattaacattcacaagtctaatcattccaacttctatggaacataaaagtataaaaactatgtgaatcaaatttccccgttttgtttgggtttaagcctccgtattatgttaaaaggtgtttaatgcttgaaagctttgaccttgcctgggataggagccagttcagtcatttcttggatagagttaagcccaagtcatatgatcaataaatgcaataggcatagttaatgtagcagggtcttgtccacaggaaggacactgccagatagcacagaccacacaatactggcaaatgaacttttcaagtctttcatgtctcaaatctttctaaaacctaccatctatttttttaaatttccttcatctgttaagcataggcttttatttttttttctgactaaaaataataggcttttgttttgtctttgctagagtgagtccaacctcttaaatatagatatatgtatgcgtgtgtgtgtgtatatatatatatatatgcatacataatacatatagaaaggtggcatgctcaaagattagtgatgccaatattataataactagagcctagaaatcataattataaagataatttattgaacttctacatgttttggttttgtatattttctattatttataataaattataaaatttgtatgcaatgttatataactatagtatattaaatttaaatattatatacatattaaatattacattatatacatagagtgtataatgcgtagcataaacatatattatgtcatcagtaatacatgtaagagatgggagtagtgtcaatgcctattaagtgccaaatgctgttctaaaaattctatatgcattaactcatcaaattctcagaaaatatctaagaggtacatacagagagcagaggtggattttaaattcaggcaatgtagcactcaagttggcgctattaaccaaggtgtcattcagctccattgtgcctatataacacaaagagcagctgttatcattgatgttattaagtctgcataagaattgggaagcatatgttcaaccctttaacctctctgtccctcagcttccaacttagtaatctgcctgggtaatttatatttcccaatggtttttcctctaggtctttatttaagaagcattctcagcacatctgaacatttacaagtcactggattcctctgtttagaaggaaagttgtctttttcaaaaatttccgagtgatttaaaagctaagatgcctctgtttagaaggaaagttgtctttttcaaaaatttgtgagtgacttaaaaactaagtgcatagagttttaataatctaggtaacagtaatttaaaaactgtacaatatagtttcctctctgcactctacatttataaatgtagtgattcttttccctgagtatgtaagtggactttacagctttgcaaacacaacttggcaaactttcaggcaatcagtgtccattaggaaataaaaatttgaataaaaacattcattctggattaacaagtcagggcacgataaaatttaattgagaaactagtgatattagctgcttctagaaaaatgtttccttgatattttcacttcccttttttctcatttgaatttcactggtaaagctccactttgaccacttctcttgaatcaccacctatgccctcttgaaactatgccatctgattttattcccacaggaatctgcattctctctcaccaaggtcactaaaggcttcttcattcaaattgaagttatattttcttaatcattttttatcttgacttttctgaaacctttgatgatcacctccccaactctaaatccatctttcttagcattccattaatcaaattttcctattttatctctcctgttccatctctatttgtttatcaaatattcattcagtacccgctacaggctaagcacacctctaggtactggggacagcagtcaattgaaagaaatccctgcccacctaaagtttcctgatgtattctgtccttctcaggtgttcaccaaagcccgttctttgacccttctcactccctgccacacacatctgtttccacctttttctttacttatttaagtaattgcatttgtcttcatgctattaacaaatgcttttaagcagattattcccaataattttcaattaggtagacataggattcaattctgaatccagttcaaatcaattttaaatcccagatccagagcttattgttgagtataatcactggtaagttactgaactactctaaacctcagtattttttcatctgtaaaatggagatgatcatcatacctacatcctactaggactatcatgagaataaattagaaaatgcatgtaaggtgtttatattatttggtccttaacaagcatgtcattgttaatagcaattcctttctttcttccttatgctcttatccatatttttatccttggtctagatcatctcgaagtgctcgataaactttttctttggatatctgtgctacctcaaaggctaaggtgtccaaaactacgatcattttctttgctagcctttgaggtatccaaaactatgatcattttctttgctcgtgttttctttcttaaatttctcatttagattattgtctccatgattcttcaggctattagagctgaaaattgtgaactctgtctccttaattctatgggatcagtcactattgaaacttggagatgtttgagtacctgacccatattttatttataataatacccccagttgtaagtgaaaactgatgcccaagaatggttgttgagtaaatcaaaaaataaatgaataaatgaagtagaattacggaaaataaaagtgtagctcgaggttatgttgactgagagcaggtgcagaaattaaaggaatagtggtggtggggactactgggacaggaatcaacatttcaaatgtacaatcttggaggtgagtcaattcctagggttaatgaagacatactgtatgtgtggctgttgtcaaagtagggcgagagccttgggaggagagttgtcctatttcatatgcccacaagtaggcatgtatatcttggacccttccactctgaggaagtacatggacaattcgctctttgaatgacatttcttgccactgcttttataccctttttgctacttgtgttccaaatgcaatgcctcagggaaaacacttgaggttttttctttaatcagggcttagctctgtgtcctcatagcctgcttgctgctgttgcatcatatcccacctttagccaagcttcaacatgctttagtattcagttgttgaggaaatagtgtttcccatagtccccgttgaataatcaagctgccacattcatgctacatcaattacagtgattgctctccgacgataatcccattacagatatgtttctcttcttgggtagaccctgggggaaatgagtcaatttctaaataaataccattgtattttgaataattaaaatatgcataagtctttgaaagatttgtataaattttccacatgggaaagaagttattgtcacagtcagaagagatacaatatgtcatgttctcctgttattgttcgtgactaaaatacaagcaaataatatattctacatatgctatgccacaaatgttgcctctaatgaaatattgactcaaggatatctactgtaacatgtacatatataagaattgataggcaatgaaatatgtgatagttaaagacattatattttaaaaattttttattcttattgtactcccatttcaatcaatttaaagttttaaaattctgagtcatgtgttttggcaatcaaatggtctgtaactttggaaatttggtagcatttccaaaactttgaacatactcaaatgcttattttcatttaaaacaaagattttttaaaatgttgtatagtctgagacaaagacttaattttcagctgactaaaatttgtgcatgtaatttattcatcattgatggaatttaatcagaaataactcaaatatgaatcagaggaagaaataaccaataatatatctaaattaacattgttcaatatagtaatttcggtttttgtaatctgcagacctgttcgccttattcctattttgaaacatgtaggatatatgttttttaaagtagaagtattttttacttgactttgttttccatttgtcaggtgttttgcaatatggatgtcaatgggggaggttggactgtaatacaacatcgtgaagatggaagtctagatttccaaagaggctggaaggaatataaaatggtaagatgcaagaatttatggtgctttttggtgttttatcttgaagttatcttctccatactatatgatgaatcttggtatttttaggtggttttgagttatttttgacataaaatgatacattagtattattttcattagacacaaaacactcataaatcactttcagtaaatgatttccacgtgtgcgtcagaaagaaaaacgtattactgaaattatttggtgaactgttgtgtattgtctgtatttgttcctagttgcatgagggtgggggaagctagaactcagaccttcgttggatacgtgagcctgaccaagggagctgtgcagggttgcaggttgtggaacaggatgggtaatagcaatggcctcacccacataactggctaattgttgctggctgttgactggaagcttctccatgtgacctttccatgtggctaagctaagcttctttcagtaaagtgatccagggttatcagacttcttacgtagcacttgtcatcctccaaagacaaagcaggagctttcagccttttttagttttattagacccagaaatgaaacagtgttacttccattgcattctgttggttatggttggtcaaaaggaaagtccagatttaaggcacgaggagtacacaaaggtatgaactgtgagccatggctcactggggtctgcaaaataacagcaggcatcatcatcatcatcatcatcatcatcatcatcatcatcacagttcttctcttttttaatgctcaatatgtctgccctatatgtaatttcttatcaatttttaatatcagccctattaactaacactatgcccattttaaaaggaaacagagatgagcaagggttgaaataatccaaaatccagtaatcacatagtcggtgcctacaatattaactattaaaatctgctgacagaatgtaaaggcatagtaatgcaggagaatctatatttatggattctcattcttttgcagctgaaacctctagataattcttgtcttgactttttgacaaattttctctcaccaggtagagagaaagaaatgctatactagcctcagttctgtcttgatattcttgcagacaatttgtaaaaactatggttgatttgcatcagagtttgcccattaataggctcatagttggtcaaatgacagtaaataaggggttttaataaatgaatggaggtttctagtggtgtcactgcatctacatttttatcagatactcagtcgaacagtctgaaagcacgtttaaaaagtttggacttacacaaagttggaatcctgatgtctttgttatttcataaactcaagatggaaaggtaggctgaagccagcaagatataattccacagagatgattgtagaatatttcacctagataaaaaatacctaaattaactctgagaaaacagggtaagggtgacaaattgccttaaggacttagtatttgaaagagaggtttatttggttctaagctcattttgaattaacaaagattaatgtactcagtgtacattactagtagtttagggggtcacataaaatgcagaactcactggtgtctgccatgttctggttacatcaaaaacatagtttcaattctagaggttttcaaacaagtgaacttatcctaggggttataagcaggatgggaggaatttagaaattacatctgtaacaggtaaacacctggagaaaaaaagaattaggcataaacctgatagctattttagttaactggatggaggtaggtgatagtagagcctgcttctcaaaatgtggtccagggaccagcagtattagcatcctctggaaactgaatggaaacacgaatctcaagctctggaccagatttactgaattagaatgtgcatttgaacactgcctgagaggggagtgcaataatgaatggagtaatattccaagaaggcaaaatttgaccaagtatgaacaaaactctctaatgattaatcccaacatcaaatagactgcctattaagtggcaagcccccccccccccccatcttcagtggaaatagaaagtatatcattatcttttgggattggtatggagaattggaatgctaggtcagatttgaaggcctcttcctacctaggtgattctaaaaatatatgagggataaaagattatctatattcaaaaacaaaaagactttgaattatgtttatattaacagttataggccaggcacggtagctcaagcctgtaatcccagcactttgggaggccgaggtgggtggatcactaggtcaggagatcgagaccatcttggccaatatggtgaaaccccgtctctactaaaacaacaaaaaattagccgggtgtggtggcacgtgcctgtaatcccagctacttgggaggctgaggcaggggaatcgcttgaacctgggaggcagaggttgcagtgagctgagatcacgccactgcactccagcctagcgaccgagaaagactctgtctaaaaacaaaacaaaacaaaacacaattatagtcttcactctgccatttacaagaggagagattttcgacagatcacctaacctgcaccttagctttctaactagttaaaataggacaatgataatacttcacctgcctcacagtgatgtttcaaggattagaagtaatgtaagtaaagcactttggcacactgaattttcagtgaacagtagttatttttattatccaagatgaaaacatcaaagcaaaaatttcacttaactatgccaaaaatactgttttgcaaaccatctgaattcatgattattttcaccactaaaatgtgatgtgaagaagtcatctgaaaatcagactgtagatagagactcaggctaatctgaaatacattattattaaaattaatgataacagaaaaataaatataaagttgtcatcatggtgactttccaaaatggtgaattcttaactgtaaacatctgctgccttggcaagctaggcatgttaagtaagagatactgacttgttaagtatggaatcaattcatgtcttgtaagtatttaccaaatatatccatttctaagcaattcttttttcattattggaacaaaactgaaattctttaatcatcatgttttatggagtttacccctcctcccttttttaaaataagaaaggctatcatgctttattcaaacttgaaacatttatcagatgaatgtcaattttgcatgatcaaaaaatgagataagctccaacattttgaaatattctggctaaaaatgaggctgaatttttttaattgaaaatattcatcatatgttacaagatggttaaaacacatggtagacagtgtttcggttctttctctagagtttttctttcacctaaagacaaaataacatgactccaccaggaatggatatagactccttatgccagttcttatcaatcacacctacttctatttcctgcatccaaagaactgcctgctcacttcttcagctaagggtgtacatccttcgggataacaagaacttggcatgccccaactcttctccagtctttaccaatctactattatatatactaggatgctacatttcttccttgggcaatgagtgcagaaatcaagttttctctctctttcctttctgcctttcctctctccttccttcccttcatagtgattgatatctatgggctgcctcttgcttcataagatttccatcacatgtaattacaaatatatactatatattatcattatttttaaacctctgtcaatatgaaaggtttaccactttttggattctcggcattggctttaagcctacaagtatcttacctaagcttagctgtcacttaaccttcctcatgaggagattcagcaaaatctggtttatggatttgtaaagatgtttgtctgaaaggaaagtctggagtaggctttttaatgaggcacttagggaagatattagctccttcaagtcataaggataccctttagtggcctccagcagtaacacttatcagcagtactttcacatataaaacgcaatgaggctaggagttccagatagtacccaaaatggcctaattttatactgttgtaggcaatgactaatgtcctggaggcaaacttgctttattttgagaacaattacccccataaacagagcttcctatccactcaaaaatttcagtgtgagcaccattccttctgggagttctttgtttctggaaagaagttgagagcacattttcagctatattttaacatcttcacattaaaaagagaaaaatgcatatgaaattaaaaattttgaaatacaaaatttgtttcagtctttcttgagttgcacgtctcagcatttagaggagatgcacaatttaactgcatatgaaagtgccctgaaagccacagcgctgtcttatctgttttttattttttaaataatttgtgtgaaaaaagatgcaacccatggaatacatgggctgtgtctggtttcaattttacttcatctataaaaagtcaacgcttcctgagagcattatcagacaaaacaaataaagtatcagagacaattattttattaacttggaaaagcacaaaccaaaattgaacatttctgcaggttttggcaaaaactaacaaatgttgatctttcctttgcatgtgtttttgagtaatatgtgccttttaaggccaattttaagtcagcattagttcagattaaatttcagtgtctttttatccttttattagagcgttagagaagaaataaaatcaattaacaatgtatctgagttactgaatcaaaacctttcaggtgattgtgtttgacatcattaaacatcatttttacaaaagtacatggcatagtatccttagattttattcatgaaaaagaggaaattgtattgtaattgtttactcattcgttgctgctttttcaatatcagcacagaatttcatatatactttcatttttatttttatggaagttacaggctattgggggtaaaataaagacctgtggtaaactgttatgtgccataatgtgtaagcctattttggagcatatgcattggttgactctgtcttttaggcatgaatatgaatttttgaaggacagtcccagacatgtaatcaaaatttgcctccctatagggacctcagtatgaagatgagattttactcctgcattttccctgtataccactcaaataatttgatttaattaatatgttctttttagtttgcacttggaatatctattccacatcatatttatatggatctctaccttcagttcatagcagacttacatgtgcaaccttttacatgtatagctctccctctgagtccaccccagacatactgaatcagaatcttcacgggggacctaaccatctgtatttttttaaaacccccacagctgtttctgatatgcattcctggttgaaagcaattattacaaatattaacttattagcatggtataataccttaaaaattacctcttgtgtagctcctaaaactcgtgagatatggaaagagagggcttgaaagagatagcactaagggagagtcgaaggaaacagatacttaagtacttggaagcaaaggtaagaataagaaagtagtctgtgctttcattagtactatagtttagtcccaattgaaatcagttggttgtaatttcttatttaataattaactttttggattaaaatgacaatactcatttgtataaaccaactctcaatttagtaaaatattacattagtcctctgagagccttttaaataattatttcagtatccctttattaatttttgggctaatacaagacccaagattattctttttccttttcttatacaaagtagaaaggaacttgtttccccacatatgactcacagtctcatggaagagaagcaactaaccagaaaattactgtgtattatgacatatattttaactataacaacagctagatttttaagtgttttctgtctatcagtgctcagttaagtgcttcggttatattatcaattttattctcaaaaccttgtatatgaaaatgatgtctgtaatccctgttttgcagacagagaaactgaggctcagaaacaaagtcgatatttctacagcaaatatgtggcagttcaaggctttaatctggagccagagataaggggtagaggttatttcatccaagccaagcctttgtcctacatatcagatctgtggtcatgcctggtaaactatccaaaagacagtttactaatgtgggaacacaattccccttctttcacgtatttttcatctttataatgaaacagttgtttctggatcactgcacttggctattagaaggtttcctccctatattgcagccattttgattcattgtactcaaaccttttgctctcatactagagcatgcttggacagttttttgggaaggagctcgaaataaatgttagtttctaaatgcaaattatactgcgttctttttagtcacttcttcctgaaagacaaaaatgcaaactgtttaggaagggatatttatttccatttagagggaagtacaggcctgcatgtggagacagggatggaggctgtcctaggaatgaggctaatgcttgtccatttctaaggctcacccaggatcactgcgtgtttccctggggaagttggagagttttatccacacagcgctttcaacagcatggaaatatgtgacccaaaacttaacacttcatcattcccagcctctttattcacattgagtataagtgttgaatcccttttcaatgactgcacagaaaagggaatcatcaagtggcaagagggagagttttgacatgtctgagctgcaaaaaaatgcaaggaaaatcccagtggtcttctttttcttcccaggggctgttgtaattgataaagtgctaattctttgactttcagcctcctgtaactttctgttttgtttatgctttggagaaggtaagctttgctcttctccttagtaggtagcattggctgccataaaaatgtgtaaaattcttagcacaccagaaattgctctaatatttcctgccactgtgaaacttttacaaagtgtgacttgagcatcttaggaacagagaagtaaagagccaatggagtactaacttcagtggtcttatagctttactgtgagctatgggtggatggtcttcagaagagtatatactcaatgcaatctggaccaagcatattcagcctatcaaaaaacttagttaaattggggaataactttaaaagtgtacacatatgttaattttaactttaaatataacagtatacatcacatacccattaataaaaaaaaataaaacgagggccaaagcctggaattctgtgtcatcagttctttcctaaaactttcccatagtagaatgcatccaatctctagtttcagttttttaaaaatagaacagtacatgaagacacatgcaaggcaatatgttaaaaattctttaaatttttaaaatttttcccagtcttttagagttccaacaattcgtaattttaaaaaaagttttactaatttgcttttattgagcaaatccggatatttataaaaaattaaaactctcttttcccactaatatttaacttatttgcataacattttataaatattgcaataactgaactggcataaatgggtttggtaccaaacacctttgaactttggtaagtaactcagttggcagaggaggtagtgcgcaagtgacccagttgggcactttaagaaacatttcaccaagactcaactgtactgtctacaacaagaattgtgctttaaggttacttttccatgtgttattgtaaaatgctgtaatattttgttttccttcctccttacctccatttctctctccctttcttgcttctttcctctatcctttcctttctacctttttctttgaatttcaaaacaaccctattggaatgctcagtgcatgtcagctcttcactggtttttggaaattcacaaatacaacacagtttctatcatcagggagctcacaacatggccagtgaaacaaatatgtagatcaagaattacattgaacttcaagcactgccaatgagtattttctgaggcaattgtgaatactccaaatctagaatgccagcaagtttctaggggttctttcttttcctatcactaacatctccaacattaagcgctggctttcttttgggaccacttttttctccctacaaagaaactattttgaatacttaacaaccttgacttcccccaaagagaacaataaagtcatgttgacattcagaagccaagcagtcagctaggttcactcaggagcacttacaaatcagccttctgcctcaaaattccaatgccagtgcagctttgtaaataattacagtcatggatttacagggttgcttattaatatttaaaaataagaaagttaaagctccaaaagtcatggttctagtaatctattagtttggtgcaaaagtaattatggtttttaccattgaaagtaatggcaaaaactgcaattacttttgcaccaacctaaatatgaagttattgttgaaacataattgcatttgtgaataataatagtaaaaataatattgttaaataacttgtctaatatcactctcatagtgttcattgaaaaatctttaaactctattcaaaatattttgttaactagtaatttagaaacattttcaaaagcaaaccttgaattgagaattgttttccagttaaacctattaactagatttattttatacaaaatgtctcatccacacagatttgaataacagaggttttattgtactaagtaagaattagacagaagctttgatgaagagacacagaattattgaaatgtcaatcactggagaaaaagtgtaaaatgtaaaaaacaaaaacctttactttttaataatttttaattattatttagaaaatagttaaatgctgaacatgaaaagaattcctctctaaagtaacaactgcatctctatattgtttcccagggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggtaagtcatgctacagtgtagtgttcgactaccttttacctagccacttaataattgtagtgggaaaatatgaaaaaaagaaatgaaaatcatccttcaaaatgaaaattcttttttttttgtctagacctattacaaagaggtacaaaaaagcctgtaaagactttttcaaagatttaaatttcagttttcgtaggttgactatctttgatattggcttaaattttagggaatggtgaatgaagtcaagcatactgttgttctgtggttatcatgcagttgcagtgaattcatatatataaaactgataagtttcatactcaaactcattggcttaaataatctctttattctaaaaaaagattttctggttctactttttttgatgacctttcttgaattagcatttttcaaatgatcttgaagatgacaaaagtaaaatttttttatgtttgaatgatttacataaaagagaagatgaggcatgatttagagggttttcttggtaaatctaaaaagcaaaaataaattgtaataatggcatcaatatacataatacatgattgcagatgtaaaaatagataaactatacacttaatgatacatgtttccaattatcctttttcaatgagaagctcgtctactagggaaaaataaacacacaaaaatatggctaaggaaataatgtgatgtggtggattcattgcacgaacacttattgtgttacttctgtgttcctggaattctactgggcgctggtcttacagacgtcaaagtcaagctttgttactaactaggtcactaaaaactggctggcattccttgggaacagggaagatattttagttactcttctactgctactcattaatgcaattcttgatgcctagcaggtctttaattgtgtgtgcctcagtttcattcttagtaaattagagttgtaatgatttttaactctcaatattgtgactgctctacctctgtcttgaaaatatgattgtatgaattaaagggtgggcacattgcttcaagtaattgcaacaatagcaacccaacccttgcgtgtgttttgtttcaacctgtgtggttatctcatagttcaactgtttctgctgcttatttgtcttttcaagacaaaccttttttttttaattttttaaaagtttgaattctgcatattttcataggcacaactcatttcattttaatggattatgtatggggttggatccttggagacataataatcattttctcgacaaatagtaatgatgtcaccacaacagagaatgagaaatagatctaaaagagttgatagtctcatggtgggggtggaggggaagcgagggtgtacttaatggcagctcaagaaaccaaagaagagacatttataaaatgcaatggagtgtaagaagaaatgtttccaaggaggtcaatattttgaaagttttataacaagaaaaccactgttaaacatcagggatactcttatgtaaatgttttgacctgaaacttgaaactatatgaaacttggctaatgtcagacagcctgacaataggactagcaaataattagtctagtcttttcctaggctcctgaagaatttgctttggttcctttccaaaatgtctctcagtttttcataggtggctgcatgtgtgtgtgtgtgtgtgcatacacatgcatatgcatgtgtgtcaggcttggagggtgttgcgggacagagtgttggggcagggttaggaggattgttggcatctgtggtgcacttcggagtgtatgatgtgtatgccattctgccatctgcatgaggaaggagtactcacctcctcttagagtgccccactgcccttttgagcatttctcatttctttgacatctgtgtgattttgtattctcaccacacagtagggatctatgatcaaaaagtaagtcttccctgctagggtgatgcatacactctgatatccccatttttctttcttgatagaactgtgaaccttgagaatcaaaattataaagccagaagaaatgtaacaatttaatttcaaacctctggttttatgggaaggaaagctgaggctcatatatatatatatatatatatatatatatatatatatatatggttcatatatgtaatatatatataatataatatatgatatataatatatatgaactcttcaagcctcacacacatgcatatgcatgtgtacacacgcacacacacacacacacatacacacatatatatacatatgagcctcatatatataattttgcccaaaaagggagaaagacttaaataagggatgtctaactcctgcctcattcaatgtggtttctgttctgtcatgctgctgacatgaagttagtggttctggcctctttcctgcagggacctaacagaaagtagatgtgcagtcatcattttctcatgcaattcaagtatacgattcacgttgacatgaaatgggaaatgagaactcattaaaacataatgcttactctggtgaaagattcattaaagtaaacacactataagatggtgttattcgctttttcaaagaaaaatggaacagaagcctgaaaacagaagctaagcccttgcaacttttctccctgcctgtatcatcacgtatgcccagtactgcttctctaggcccattaatgcctcccgtggcctgcagttagaactcacattgtccatcactgcctcatgtgctttttgtccattcatgtctcgtccctctgaattggcgtgtgtctttgtgatcaattgtttcaagtattaatactaagatttgcacagtattccataacctatgaaatgatttttaacactacaagcatataaacctcttttggaggtaggtattattagacacattgtttttttgagacggagtctcactcttatcgcccaggctggagtgcaatggcgcgatctcggctcactgcaacctccgcctcaccggttcaagcaattctcccgcctcagcctctctagtagctgggactacaggtgcctgccaccatgcctggctaattttttgtatttttagtagagacggagtttcaccgtgttagccaggatggactcgatctcctgatctcgtgatccgcacgcctcagcctcccaaagtgctgggattacaggagtgagccactgctctgggcctagacacatttaaaaaataagaaaactgaggttttggtcagttgacttggtcaaattcaactaaattccgactgaaatataaaactatgaaattcatactaggtttttgttttatattttttgttttctataacttttctcaaaaattaaattaaattaaattaaattcagaattgtttgaggttttattttctaaaacatattctatcatggaaattttgtttgaaaattcttgtaacaggtgtggtcctaatgtttaaacctaactgtggtgttgttttttaaaaaaacatttatcatgctcttgacatattaattaaaagaaagtgttgtgaatggatagatgagcttataaatgtgcatgtattacacatatttttcttttatcctctaaggaaactccaaataattttctcagatagaaaataaaatctgtagaacccaagagaatataaataagaaaaaataataatgtaagagtgtcatgataagcatagcatatgaactaacatgtatcaatgtgaaattatttaatacttcctctagagaggtagtattatccagatcctcatcatctaacacccaggcaattatagaaccttcctgcctctttagtcttcatactctcatatatatcttccatgctgttgttgagatgatttttctaacagacaacttggtctttccctccttcatatatttcaacagtgttcaaatatctgcaggtaaaagtctaccactaagactcttcgtgacctggccactacctaattatgcacctattgctgccatacactctccctaactttacctacctggatacccttctcattaacggttatgttctggtaactatttgcgattgccctaaatcctccatgcctttgtttatgctatattcttactcactcaacacataaacttaactttgtcacatggatacatcttaaatctttaagattctctcttattccaagtcttccctgatacctactgtggtagatgtaacgtgtcaacccattgcctccttcaatactaaagcgcttctttcttccacttccgggaaatgttgactgacaggttgcagctgaagtcccctttccaggcactgtttgtagttaaagaaaaattagccgggcgtggtagcacatgcctataatcccagctgctcgggacgctgagacaagagaatcacttgaaccccggaggtggaggttgtagtgagccgagattgcgccattacactccagtcagggcgacaagagtgaaacgccatctcaaaaaaaaaaataaaaaaagaaagaaagtaacatcacccaagattacttcttgcaagatacattgtatctaatgactggtcaatataagaatatgaagaccctcttgccccaatttggggcaattctgaagagcccctcagaatccaaaattccacttcagattagttgaagtcttcaccatgacagcatgtgagccctgaatctccctttgctgagttctgcatgcttcactctgccacggatcctgggacctctcccttctcaacctccctacactgatttcccagagaaatgcatcaccctcattcttaggccaatttggatactctgtgctcccattgacccgtagcactctggataactatccaggatccaaatcctgttataagtcattaatgagtgactgttaactatctttaacttgtgctctctctctcccccccccttcctttgagtgtgtgtgtgtgtgtacacgtgtgtgtgtatgtgtgtgtgttctaagcttttaaagtgtagaacccattttggaaaaattcaagatatgtaactaatttagccaaattactgactaagctagctatatttgaggcacacatactatacaccagatgtcttgttttcacaagagaaaactgaggcatagtactttgcacaaggtcacaggcactgataacgatgagtaggagtccgatttgaaatttggtcttataactacccaccatatgggcatcctcaaataaagaagttcatcagttaatttctagaattaaataaacccaaaacacatactctaagatatagtatatgtttattctaaccctacttctctctttaataatttgaatgcctttggacacattacctatctttccagttctcaattttctattcttacaagttaaagtatttgtaaagcaccttgtagctcaaaaattttctacaatagaactacctttacctgtgcatcactatttttattacctttcaattctttgataaaaaattaaatttgatctctctaataaacacttgagagtttattatcagtttaaaaaaacaaatacacaaccaccactgcaacaataaatgctttaaaaatattttaataatagcagatttattgtagggttgaggagatgctatgtccactggaaggagctctggagtcggaatcaggatgtggaggctgagaagaaatctggctctaccacctgggaaactggcatggttgtatttgtcagtgttcagtcaggggagcagagccatgatgagtcttacggaaataaggttaaaacatatgcttgaaatttggcatggcagacaagccagagcttgtgaaaatctaagaaaccaaacacgtgtagccaccaaagtggaaccacaaaagggaagatctacagaaatttgttgccttgctgtagttccattaaatgaggttgtgcagtcaagcatcttgtggtgggtctggagctgttgccagcatcaggaagacaagctgggtgctaagtgaagaaatacacaatgtagaaactgtcaggcatctctgcccctggacttcaccatatctgatgacgttctcagagtcaggccactgcttcactttcgccttccaaatctcacacaaaattctcttttagccaaccccagcttagaaccttacaatgaaggggattcagggaaatggagtacccagattaaccaagttgatattacttttatgcctcagttttcttatctttcagtgggaataatatcctcgaatcaaaaagagtgtacatatataccttgtatttggtaaacttaaatatcatgctaatacgaaagctgtttagagactgggtacagtggttcacacctgtaattccaccacttagggaggccaaagtgggaggactgcttgaggtcaggagtttgacatcagcctgggcaacatagcgagaactttgtctctattaaaaattaaaaaaacaaacattcacttggcgtggtgttgcacacccattgtcccagctacttaggaggctgaggcagaaggattgcttgagcccaggaggttgaggttgcagtgagctgtgattgcactgctgcattcaagcctggctgacaaaacatgaccctgtctttaaaaaaaaaaaaaagaaaagaaaagagcaaacagactttttaaattaaatttttatcatgcccaagaaatatattattgagtcaataaacaatttttaattatatattctatatcgaaatcaccactattgtctccaacaatgtccttggctggttgatagttgtttatttacttggattcaggatcccatccagcttcactcattgcatttgcagtcatgtctcttgagtcgccttttacctgaaacagtctaccactcatctatcaattacatttttcaagactttgggtcagcttttcccagaacagctctttctgggcttatctgactatttctttctgattagattcagattaaagctttcttgagaagaatactaaataaatgatattgtctatttcccattctatcacatccaaaggcacaaaagattaatttgttccattattgattgggctaagcttaatcacttgttaaggttttgtttttggttttttaatggaatacctattctctccaaaattcttacaaaggatcataatgtatgaaacacgtaaagctgatctattttgaaatggttgtgggaaggtagtataatatttcctcttgctattatctcaaacattagtacagcacagtttaaaaaccattgtgttatattattataaataaaaaagtagaatttaccagttggaaataaatttcactgtactatttttaaatgttaaaagaaaactatataaaaatttttctgccttaatattaaaaggacacaattttagtgaacatattccattataaagtcattttgcaggtaattattttcagatcttgggaacagtttgttccttacagttcattattttgttgtcttttatgctattaacttaattagtaaatcctctgtcacagatggtatcatgagcctctcttttaagcaatagaaaattagtattagttaagtccgaatgataatgtttaacattttttaatgcacatcttgtcattataatcttactacataatttataatgcacattttgtggatatttatattttattgactttatattatttattgaggataaatgacatcattagattagaactgactgttgatgtctatcataagccttgttctggaaaagattccacatgaagagatgaacagaattttaaaccaaaattgtgaagaaaacaacctgaaaataatttggtcattaaatatctttttgcgcaagtttgtttttggccaagatcttcattgggaagtagtttgatgtaatttgtaaaacactgtatcgggaatccagagacatgaactctagacttggatttgcagttacttttctgaatgaccttggacaatttgcttcacttttctaagtctcagatcctcagaagtaaaatgaggaggtaaggctgaagttctttccagttccccaatccattttttttttttaaatcattaaagtactcccatgccgtgtatgtatttcaaggacaaaacaaattcatgtggattgaaaagaattctctcgagcctcccatgtaaatttaagccctgcatttttgtagatattgcaaaacttgtttcattttttttttctttcagtgaaatgtttcttatttctctgatcctctgggctacatagtcctggatggaaccagtagcaaatatgttgaaatactaagaggaaagttatttttttacagcagttctggactgatcaaggtatgaaaaaatatgtaggaaatctcctggcagtttctacttccctcaattcctaacataggttttcaaactcaaggttttaaagagtcttatttgtgttttcaaataatttctccaacttggaaggtgcattacttttatttagactgtgatttttgttgtggttacttcctaaaacagagaagttgttttaatcatcaaaatttatattttaatccccttgactgagatgaaatactgaagacaaaaaaggcttcctgggtcttcagaggcacggatgagcacattcttacagtcactttgcaccttctttaggtcttttaagtgttgggaaaatctcttcacttaaaaatgcagttgaatgtcagtctctagagtcttggatatttttcaagctgatgaaaacaaatgcctgcatgctgttaggtctaaggattcccagaggattcctgtcacagaatgggtaatgctaagactcagaccactgctgtcctagaaacttacaggttggcaaaagttgccagaaccagctagcaagcactgcctccaataaattatctaaggtgatgtcctgtgatccactgctctaggttcccctactgctgttcactatcaaaaagatgatggctccatgaaatatttgttatgcatccatcatgtgctatcctaggataaaatgtccacagagatttcagtacagtcatgtatacgtgtgttcatgcaggtgcatacccatatgtgatggatatggagtggggtcggatggttgcagacagccaaacaggcaattacaatgccacgaacacagtcagttcacttacaatcacaaatgtgctgtgactaaagagggctaaccagttttggaaggttgagaaagcttccaaatagtggcctaaagtgacataaatgtggcaaattggtattagttggggaatagttcagagatgggggtagaagagggattagctcagaagtgagactcagcacgtcttgctaggaaactacaagtggttaactgttgcttaagcttagagcgtaagggggtaataatgagcaatcatgatgctaagagaaaggagaaccgctgcttgtggcagacttgggacaggtaagcagccatggcctctgggggcaatattgctctgatacggccttttctcacatcaattttttcacactcaatattttgattactctgtttggtaaatatgagcaacaacaatatgcaagctactgtggatgaaacaaaaccccacagaactcaacctctatttttcaagattttattcactttgcctaattggattttcttgatcctttaagtcttagctcagtccatagagctcttcgtccttgattgggttaggagccccttccatgtcctcccactgtgctctgggcatgtctttatcagagtacacatcacactgggttgtaattgctgttccctattattagactgtaatctctaggaggacaggaacctcttcacaatgcttggcacatgtctcgaaaaaaaagcatttcttaataggtatataaaagacatattgacaaggtttttttgtgcattcaacacaggtgatttttttgtgcgaatccacacagctgactaatacatggcaattcttgatctagataccagaaattcaaagagcaacaagtcaaaaatcctgcctccaaaggtttatggtataaaatgacagttgccactaagatttctaataaagtatcatgtccttaagttccctggattgttgttgcttaaataagatttattttctagaactattaaactctagcttcttttatctttatctcttttatctttaactgcaaatgatatgcaagaatttctatattgcttgttggcaagtaaataaaaaaattaataaaattgtcccacagcatacattgttcatttctcttaactggctacagttttgcttttacctacataactttactaaaattactctcttaaaagttattatagttcttttgaaatcagagtctgccttcattgctttatccagccagccaaccaccatacacttaccgtgttactattattttcctggcactatgccagttgttttatttcttgaatgtgcatataggtaactagggtgcctgtttaaagtacagatttctgagtcgcacctaaagagattcttatcctgggttaagacctagagctctcagtcctatcaagtgcaccaaagtgatgctgatgcagaaataacactttggttacaccaaacagacacaccataccttctcttgtggggctaatagtttaggagaaggaaacaaaacatggaatagttgactcaaaagttttagctgaagtgatttagcatgtctgtttgatttttcttttgttttgttttttgatcaaggaaccatagatctttttttttttttttaatgatgaagccaaggactttttccctagaatgatgaagaaacacaaaattttgtataaatttatgtgtaattcacctttacactcacagtccctgggaaagaacccttggaattaggctatcattggttacttaaaaaaaaatagtggtcaattctactggagttgggaatggatagggttcattggaggagattaaatgggactgggaaaggcttcatagaggaaatccttagagatgtgtgaaatgagtaagcgctcatgaggcaagtatggtagttaatggcaggaggaaggacttgagatcccagccagaggagcaatgtggacacacatgcagagatgagagacagtctgccttatttagaggacagcaagtatttagaggacatcttgtatgcagggctttactgtgctacatataacagagggctagaatccatgacaaagattttcgactctagcttatactgattgtggagacaaataagcacactgatgactttggtcatcagaagaatctgctaatgcatgctggaggcttatttgcagaccttatagcaatacaatgtccaagtacaacaagggaaagtattttctctttgcaagaaacctcagacaatgcatctcaatggttttcaacattttgcttaccctctcctctctctatctaccccaagggaatgctggaaagaaagtttcttattgctctttaaacacaaataaaaaatgagaacaaatctacctcccgagaatttgtttagactgaaaaatcaccaatttcaatcacaagttttacaaggtcctgacttaatttttggtaacaaagcaaaacccataaactctctgagatggccattggcctggtcttttaggcaccacaagagggtcagaccagagagtcactcactggaagctgactctatcagtcacacatgatgccaaggaaatccaaatatgtttaagggactgtttgtgttttaaacaggggtcttggtgtcacgtgattcattttggcactcagttttttttttttttatgtattcttaaaaaagggaaggaatactggaataactatttatcttattttgaactaaaaacataatcactgagcatgtatttctgaaatttgggaaatatttcattgtcacagatctcatatatatacatacatatataatatatattatatatgtatatgatgtacagaatagagagcactctgtcagcactattgaaaggcacacaacaataacagtacgtgggtttgctattttctttggaggaaaaatttatcatgagttttgagcatatgcaagcttcatgtctatcactgcaaaacactaagaactgtattttaccagagttttgaaacaaaaattactgctaacactgttcctaatgtcaagagcttgggaagacctggaaggttgataagctcattttatctaaattctacaagatattaatgtttgtaagtgaaggggagacattaaaaatgtatattatcaaaaacttacatggaaatccagagtacaatttatacaggtgttatacaagctaatatctaaaacaatcatatgagaatcagagattaagtgaaactcaattttctaaagatttttcatcatttggggtgaggttttctgtagctttggaaatttatcttccttaatcatagcacagattcccaggaccattactatctcaaacatttttcatattttttcacacttttgtgtacatcttccattacacatattccaaaatgaatagcatatctacctcaggacatctgtagcttctgaaacaaataagataatgtcttccttcttaacataatggtaaaattattatgcacaaattctggtgattcccaattatccagttccctgttaaaacaaatgacaccaattgtggaaggtttaatgagaaaaagaaagctttcagcaagtagtcatgagaattaaaggctaggttggcatggatgatttttccaggaattttttttttttttttttttaccagtatcaattatgagtaaagaaaggaaaaccaaacaaatatatattggattcattcaacaaaatattatatgatggcaagaaaattgtagggttctcaaaagtctgaaattttaatttattaaaagataaacattttaattgaaggatatttattcagaccatctagagtcaaattaacatagatcttaactacatagtcagtcagcaaagcaactctttggtttcttgtccttcatgtttagtactctgcttcctctatagaaaataagaaaaacttccaaaggatatggggcctcatgggtttgagaaaattgatccttttcatctttaatttctctggcttgttgcctccatgcctgtcctcatgagctgtatctctatgtcattgtttttatcactctcagaacacttacatatgtctatcaaggtcatatgtttatacctgtgtaatttagccttagtcattcccgtaattcatgcctattgaactactgtatattttatggttattgcttaaggaagtttgattactttaatttttttgcaaatagtcaagtacttactttattttgcatgcagcagtctttttaagggctttccgggtatcacctcatttaatcttcacaaaatattggcaggacatagaggtattttacagatgaggcaactgaggatcagaaagaataagagctagattgcaaacccaaacaggtacactacaaactctgtgatgtcatgctgtctttccagacacaagtggtcatgacacagccttaatttgcagaagccaatggcttatttatttctccatttcgtgtgtgtggaggaggaggaaaaaaggaagagttttggttaatggctttatagagggttatttctttcattcgtacttattttgtaccaaattacctgtatctgcttgatctgtatatttttaaaatgtttttagatatctataagtctttatcacagccttaattcttgattagtcacactttacattatcaattcttttagtcttcctactcacatcctcttttctttggaaacttctttcaaacatttcttttctggattatagattattgtcatataactgaatgtctttaatatattcactcactttttcgtaagtgtattaactttgcttcatatatttttctagcattttctcacatattcattgataggctattgcaaataagtaaagaattctgttcatgtatggacaatagagttatagaatatatctccaggatgtgaaaaagtcagtgctaacatacatgctctgacatccctcttggctaatggtgcccagttctttcagtggaaagggggtaggattggagaggttgaatatggcagagacagcccagaagcagcaactagaaatcatagccacatcaggaaactcttgtcagattgagccattgctaccagcctctgaaagagaaccatgaaggtcattttgaatttcttagtaattgtgagaaagataaactagttccatatggtggcagggagagaactcagagccaaaataaaaatctgctcagcttgtcagtacctacgaccttaaagttcagatatctgcgagtctgtctactgtttaaaagggttgaggccaaacttcaatttgtcatacaaacaactcccactgccttggatcatgaaagagacacttggccacctgagtatggtgaagatgcaaaaatgtgaagagagtgagtctcttaagtagagaaaattagtaagaaactgggttcatgagattgggctgcccattttaaagaaaagaaagttctagaatctcttggatgatatataggaatattttgaagcctgttcttccataatagaactcactgttgtcctatattcattaagaaatgtgatgatttagtctttataattactgaaatttctaaaagtgattgaaaaggagtaacttttatcaaagatgactagagaataatgactaatttcaatggacatcagttttcccatgatatgctaattgaaaaaataaaaatgctgacattctttatagtcatccgtcgaagggactcatttttttttctttattaggagaaaatacatggatgagaataaatgccataattctatgtcgtggctgctttttggtcacatcaaattagattctctggagttttttgttttgttttgtttttcacagcttccttatgtctgtccctaatgtttttttctggaggaacattttgtttttatcttctaacatatcgtctttcatacaggccatgtctacactggctgaacacaagaaataaataaccaggattcccatgctgttattttgggagatgtattctaactaatgtttcacacttccaattcactgtcacggtagtcaggtgcaaagccatcctgtatattgatttttctttgataaactgaaagtctatttggaacaattattagcttcatagagaaagccacagatgatagttaattacacataaggactagatattagccagaaccagtgttaaaaagaatcatccaaatgttctgtttgagcctcaactcaaagaagttttttttttttaaatctaattacagaaatacttggcactaatgagtgactggtccttaatttacctgtatcaaataactagctgtggtcgttggctttgggccaaaaattgggactctgagctaggtaaagagctgctaagaaagaatgagcccctgaactgtgcaggagaccttctctggactgcatagtttctcccagagtccttctgggattccacagaagtacagttgtcctcatgtgcaaagtttttaaaatattgtttagaagaaatgatttttatgacatttcatctttatctcccagtgcaagagactgtgtgtctcttccttagaagagcataagccgctcctctgtgacatgctaaggatataaacatggggggatgaatactacttcatgtaaattacaagtgctactaagtatccaacagtgaaacattcattattcctcaatatatcagtcccttctacttgtacatcatttcaaccaatatatgtcactgtttacattgcacatcttgagacttctctctacttctgctttatgttttaatgcttaatctgggcaggaccttaaggaattatgttcacaccttattagaatatttcttttttaaaaaataattttagctgaaacactaaccttaagcatatttttattttgaatttgctttcaaattgttttcagttggctattcatacaatacaaataaattgttcaataaaatgtaaggaataataggaattaagacatggcctttttttcctttattctatctgcataatgccttgctcatgtttttatattctggagtctctgagaaaataagaacaaaaacaaaactggaaagataagaaggatgtgagagactgtatctatgtacacacacacacacacacacacacacacacacacaaccctacatgtgtattttttaattatttgagttggatgggcaatgaagtgggtacccaggtaggtatgttgagtacctaactaaatgagatgtaaaagctatacttctgaaatgtagaccaagtatattttgatattagagttatttatatttgagtttgcttttgcttgctaccttgagcttaccaaaaattaatcagttagtaaacccatcatccatctagtcaatgaacattgaggcctttctctatctcagagactgttcaagatttcaagattctgatgattcaaagatgagtaagacatagtctatgcctcaaggagctcacagtttattatgggaaacagaaaagtgaaaagacaattaaaatacagcaagtaagtgtcatcatgaagatgctgatttgatgctctttgaggttatacttggaacaaatcttaaaggatggataggagttcagcagctgttcaaacctggagagtaccttctaggaagaggggatggtacttgcaaatgtatggagaaataagagtgttgcttagagggaataagtgagtgggtaaggctggagcactatgtgtacgtgcagaaaataacaagatatgggagggttagggtgggtgagacatgggaaaaagtagacagtaaaggactagacttcaaaggccttgcaaatcacagtaaaaaatttggactttatctttgaattttggaggaacaaccgagcaactttaaccagaatagaggaatgatgagatgcatgtttttgaatgagctgcatggacttcatggggaaggggaagaagaagtgaaactcaaggcagggagactagttgtaagtcttctttgataatccagagaagaactgccaagactagaaactgacctccaagtcttaaatagatctggaaagatgtctctttactgatagcctaacatagcattgataacattcatacggggaaaggtcaggaaagaaatgtggattatattgtaatcctaatacctatacctatatacctatacctataccagcacacatatagagagatacctgaaggcagccttagtcttgtgactattgatgatatattcatacaatattttccaaatgattttagagaaaaaaatgtaatgatatgaaaaagtggtcacaaatttgtatttgaaaataatctcatacagaaacatgtaaagtataattctatttctatttgtattttcacatggagagaggttgtttttgaaggatacctctaaagagggagatgaaatggggctgtgggcagaagctttacttatagtgttcaaaaattttataagaatgtgttcagatacgtatatatttaaaaataaataatattttatatttagaggggagaaacaagtaaaatactaaaaattgttaatatgaaaagagtagttatactcagtgatgagatttgggttgatttttatttcttctttttgcttttcttctcaaatttataatcatgcatttgtattgccttgattacacaaataaataattataaattatgagacttagattgtaaatcttatgtgaaagggtaaaagtataaactatgtattcaagcacatagcagtctcttatttaaaatcaaacatttgtgctgaattccctgcaaagacactatagaaaatcattacatcctggaaagtctgtctttattagtgagcttaaagctactgcggagaaaatggcattgacttaccgtaaaaaggaaggccattacaaatcacagagaaacaaaaaatcagagttaaaattgccattgctcattcaagagcgcctatgggctaaactctcccaggcccagtagagcagatttcacgctaggagagacgtagctacttaattttggaatcattcacttattctctcaattctgattctgtcttcaccaaacaagtaactttctgattataatttggctttctgtgtgaaattctctctaagaagaccatgagactgggtccccaccatattcctacttggactgcaaatggaggcctgacaaaagtctcttgttagttttgccaatgtgtgtctatctttgggaggctgaggacctccaaagaagtgattgaattgaaagttctcaccagctctggaaggtggcgaattcacccaggtaacatgtcccagaactccctttggtgatctgtcatcttactttctcctggtgaaacccacctccacgtgggctggctgcagcctcaaatgtgaattggcactttaaaaaattctacaattttgcatcaccagttacttgtagtctgcctctcagagttttaaaatacaagcttgtatgtgataattcaacattagaagattatttgtactactgtgaaccagaagttccattaattattgaaaccaacaaaaactgactgaggtttacttgtatactttgctctggctcaaaatctctgcagaatatttgtaaaatattgcacaaacatccaataatattgttttttgctaaaaataatatcaaataccacaaacagtaggatatatacatatacctagatgaaaacacaagttaaaatatatctccaaatattaattgatctttattattctatttcataataatgtaatgttttgctcagagccagcctaggttttaggagtgtctcactcatacagagatgtgaatcacccattaactatactgtgggtggacaggattcataaataagacccaggcatacaggtggtgacctatatgaatttgaaggggatattactacatgattctgatgaaaacattgtgctggtatggagaagcagtgttaggtagagttagagagagaggggctagagtcttagccagagaacaccttgagcttcaagctgtcgatacgacaacttcagtttagctactctaagccctatggagccactgaaggacgtgagcaagtttacattagttctaagcactacgttgcccagaaggatatgaaagcagcttgtacgatcagtaggaaatgagcagacatcagacaggtcactacatttgacaactattgtgatttgcccactagttctcggattctaggacaatacttgtcaaaatgttctctttggacagtctgcaaagagaaatctgagatgctagttgaaaacaaacattcctggggttagtaaataggccttttaaacaaaagatcagatgatttgttatatgcacatccattagagggccactgatctaggttaatgcaagttttatataagaaatgtttctagatagtaagagaggttcttcgaagaatgccatattaaacagatgggattttgaatttaattttagggatacctctagaatacaagtccctcaaaagcacagatttttgttttcttttcttatatatcttaagtgcctagatcaataactggtatgtagtttgtgctcagcaaatatttgtccagggaatgcataatgattcaaagcttgagttttagactcataccagctaaattccagcttacatagcttccctaaaccttagtatacaaattggggatattaatgtctggatcacagatttaatataaaaatttaatcaaataaacactggaaatcatttaacatagtgcctggcacagaggaaatccccaatcaatgaaacttcctccttttattgctattaataatgtttagtacatctgcactattagatattaatggattaagggagtgacatgctgaattgacattgtaaaaagcgtttatgtttagaggttaatacctgtattaatacaataaacccaagtttttatgttttctggatcctgcagtatcagagaaccacatgagtttgagcatgcataatgaaataaactttttccttcctttgttcttttggttcagatagcttgggtctcctagaggtttgttggaagggctgagttcaaagaaagaagaaaatgatgaaaaaggcaaacattcaacaagctggtcttctgggttctgttattctgtcgaatggcttatctttcttttttttctttttgacttcaggttgtatttaaaaggtcacactgggacagcaggaaaacagagcagcctgatcttacacggtgctgatttcagcactaaagatgctgataatgacaactgtatgtgcaaatgtgccctcatgttaacaggaggtaagtcctatggggccattctctaagctatgtttcattggtttggggcttaaggtttcttatctatgagaaaggagtatgatcttatggtcaggaaacttaagagcaagtccctagagatcattttgttctgcccacgaatttaccctgcgttcttgtgtaagacattgctagcatatttagaggtttgcgtcctcccccaacatcaagagtgaaaatgtgctaagcttggttctgaatacatttttcagtctcttaagtcccagatattctactttctaaattagtatcttgatatccttagtaaaatgaacaatagtttgggaactcagcatatacagcaattacttcttataaaatacttcgcaattatgtagtaagttaattgatcattttgttgaaatgagataagaaaaataaagaggtgtagttaaaccaaaggtaacacagttcagaccagctataccagagttttgcattacataatattaatcattgcaagatattttagctagtataggagataccattaaatagtatcatatcatagagtaagaaagttaatccttttgtacattttaaatatttttccagccttctgatagccccacagagaaattctcaatttggtgctctcatttctgtaatacttcttcagtgatgtaatgcatcacttaccaatgatgcttcttggcaaaacaaacaaacaacaaaaaacaacaacaataacaacaacaaaaaacccttatccatagtctcagagccttggttaagcaatggcacatacctaaaattaaataatgttagtttgttttaattttatgagttttttatctacttccttttttttttttttttttttttttgaaactgagttttgctcttcttgcctaggctggagtgcagtggtgctgtctcggctcactgcagcctccacctcctgggttcaagcgattctcctgcctcagcctcccgagtagttgggattacaggtgcccaccaccacgcccggctaatttttctatttttagtaaagacggggtttcaccatgttggccaggctggtcttgaactccggacctcaagtgatccgcccaccttgctctcccaaagtgctgggattagaggcatgagccaccatggcacctggctatatctaacttctgttacagcaaatgatgctgatttcctctttaaatgaatgatataaacttgcattttagaatgcattcacaatattctgtatttaacaaatagtagatttaaagaaaaaattgttacatattaataagagttataaatggatatggcaaaactgtgaagttgatacatgactgtctgaagtttgggaaacactaagataaaacccaatggcaaatgatatcactcaagaatgttataggctctggcaggaaaggagttgacaacaaacaaaattgtaagagaaattcctatttcagtgtttctcctctcacagttttagtgctgcttctctcttactgtaataatcactaccaccttcaattgttctgatatactttctgtcttattctgttacaaaacatgatttcatattagcaaggaaaaaattgttcaaatctaatattttcctttcccaacactacgttactaccattattaaaacatattacgtgtttctgcacatgttgtactatcttacttgaactccagatccactctgtgagatagcagggagagaaactcatctctatgttgtacatgaggaaaatgaatgacagctagcatttgccatttcatcccaaacatctagcacagctgactgtgacacatagaaacttattagaaaatgtagtacctgaattagtgaagtagtagtgtacatgaatgagcatagtacatgaattaccatcttttaactcttgaaataactttcaaattttaaaaccaaataaataaatcattaggttgatgttatcttcatccacgaatagagcttggtagagtataggtgaaagttttggatgatgatgattatcatttttttgagaccaagtctcactctgttgcccaggctggagtgcaatggcgcaatctaggctcactgtaacctccgcctccctggttcaagtgattatcttgcctcagcctcctgagtagctgggactacaggtgcgtgccaccatgcctggctaatttttgtatttttagtagagacagggtttcaccatgtcaaccaggctggtctcgaagccctgacctcaggtcatccacccacctcagcctcccaaagtgctgggattacaggcatgagccaccacacccagctggtttgggataaatcttttgtcttcctccctatccccaacccctctattactattatcaccaaatcacagcccattgaccccatccatgccacctatgttgatatcttttcaatatgataccagccccaatattatcaaaactaacctattatgattctgcctctatcatattctatcatattctttctttctttctttttttttttttagatggagtcttgctctgtcacccaggctggagtgcagtgacacgatcttggctcactgcaagctccacttccagggttcttgccattctcctgcctcagcctcccaagttgctgggactgcaggcacctgccaccacgcccggctaattttttgtatttttactagagacagggtttcactgtgttagccaggatggtctgaatctcctgacctcatgatccgaccgcctcggcctcccaaagtgctgggattacaggtgtgagccaccgtgcccggcttcatgttcttttccttaatctttgaactatccttttggcatcatatttaacatcatcaaatattaaaaagtctcctatatgtaattttatgactcctccctcagccctcacccccaaaactagttgctacaaatctaatatttttttttaaatggtacacacaaggtaggtcttgagctttttcctgatagaaaatttttatttttattacttccctgatctcataaatgaaattgtcagcaactttatacaaagacaaagggactttgatttttcagtttcctgcacattttaatattgaaatatgctttattttctccatgtctattttcaaagatattttttcttaccaaataaatacaatacatgaaaaaaccaacagtaaaatctttcaaatgtgtccttagaagagtattccaatatgttcatatttctgtcataataatgaaaatatggagtgaagcaaagagaagaatgtacatcttggttttcaatgagaaaacttcactgctcagatttatgattttatttctgctttaaatgattgaacttcgtcatgttctttcatccataattattcttggacccaattcttactcaccaataaacacatatgtttgggagagaatatttccacttattgcttgggctggaatagtctaagtaaatgtgtttttgtaataaacgccattaccttatcaaatgtccctttgaaagaatccaggtcttgcaaagctatttattatggaaagctaaaatgtggaatttagatagctaagaactggagaacataaggatgaatgtcattgacagtccaggtaactggagtattgcctggaacttaggtcctacttagttactccccaccactactacttattctctgtcaaaatttcccttagagccattttcctcatctaatgatttttcctttccttttttttctttttaaacttagtatttgagcctgttgcctatttaaaataccctctcttaagcagtgagacttcatactctttggagctagtaactcatagctctttgtcatcatcaattaaagctttgttttatcttgtttatttatatatttttcctttgtttcttctaaaagggattaagagtaaaataagatttattgcccactaactatcctagttttcttcaagtacatagaggaattctagctggagaatctggtatcattacccttatcggtaaaagactgaatggcaggaaataggcttaactgaaagcagaaggtatttcagctagacccaaggtaggacttgatctttgttcttcatttcctaacttccttatttcttggctttcttctatcagtttaagggggttaattactattaaacaaatgagcaagacaggctagagcataagtttcattaaaaatttaaaagaaatagttttatctactatttaacattaagaaaatgaaaatgaaatctcattcaatgcatactttttgtatagatttattgtatatggagataaatatgtgaaaaattctgattccaaaattaagacagtgacaaatttttgttactagattgtcacattcaaaacaaacttaccttcagctaaaaaaaaatctttgatactaaattaggagttttcaaagtctgcatttctgaaagtttgcttaagctacagttaactaaaattattaatgttataattaaagaattatttctaaaaatctttcataaactgtaattattaaaggttgccaacaacaaaaacaaatatgttaccgttttacattccttactttagtttcagtataatttccatatttagtacataatataaaggctatgtaaaaatgtgacctaactttctgtagaaagaatctattgaagtagaaactctcatttcttttcccaatgcataaaccatgtcaactggtagacaagactttctaaagctaacgaaggatatttttcagttcagtccttaaataggggataaagccatacacgtaaatttcttagtacatctagaactttccagatgctaacagcagacagttgacaaacgctcactttgcctactatataatcttaaagaagacaaagaaaatgatagaagctagcagttttttcaactggtgtatgaccttgaagtgacaagatctttgggaaaatataattgtcttagcatttttgggaacccaagaaagacctgctaagcatgatcagataactaaaattctctgtttcaaggtaaaaatattgagagaaaagaagatccatatgactaatgtaagattgactatagaaatctacattgcactacttttatttcaacccaatttctatatttagtacataaaacgtaagcctattctacacaaatgtaagttctgtgaatgcagggattttatgctgtccactactgtatccccagtggctgccatagtgtgtggcagatagcatatgttcaataaatattggtttagtgagtaaatgttagcagagactctgaaaggacattgcaaaattacaaattattctggtgaaaatacataaatgaatgttagtataaacgtgattcttgcatgaacttatatttaaaatgcctaatacatacatgtatttatatgcaccagcatggaacaaagagatgactatcaaagactgaaactaacttaagaataaccaaaccccaaaagactgaactgcagaattataaaaatttgagtgttaggttcctgactgtcaaataaatttgagcttcctaaaatgcaaagtttaagattacattcctattttctcgggcaaagtttcatttcttagaaaaagagcaaagagtatcagaaaatgtcttttataagtttggaaaaaggtgaatcagaaccgatagtcctctcgtgcaaggctacaaccaaagcttaataattgacagtggatgagaaataaccaattaattttgtattgtactcagtaataatatttaaaaacttattgagctctttctaatggatacgtttatattattctaaatgatttatatttaataacatatatgaagcttccaaaaactcttggaaatacagactacaataatacttttggcaagaactgagatacagaaaagttagataatttgccataggtcacagaattttgtcagaagtagaatttaaatgcaggtactcaacctccagaggcctttgttctatctactctttctactgcctccattaaaagggatgacattcaaagagaatgacagagctctattgtaccgtttgcagcatctttttgcaagcatttcctcatttaaacatggttaaaagcaaaatgaagtatgagggagaagagaggaggtaaaagaatacctagaagttttaagtgaatttgatattcctagccaggataaacaacttttcatctttagaacaaaaagaagagaaaggaaaagaaagaaagaagaaaggaaagaaaggaaagaaagaaagagagagagagagagagagaaagaaagaacagtcaaaaacaaacaaacaaacaaacaaacaaaaaagaaacaaaaacaagtccttggcctgaagaggatatattaagagatgacagaaggaatggacttctagcaaggttctttgcctcctgcatgcaagacccatgcagctgcttcttgaggcttgctttgcgtagggccaactttgtccacataaactcaccaagagattttttccattatgatcccattgatggcaccaatcaatttagtttaaactcattcttagttagtgatgaaagatgaaaatcttaatttctgtgcaagctgttttgcatactgctgattagaatgcatgcattgaaaacgaacaaaagaaatctacaaaaacaaatataccttttcattttgctgtacattttaccacagaaaagaagtgttgagaggtgttttgtttagaatcagaagaatttaagagttagatttcctgatgttcaaataaagttgaacttcctgagtacaaagttgagaatcaaattcctattttctgggcaaagtttcatctattagcgataaaatgtgaattttctgcttcaaagataaaagacacaaatgattttaaaaggcctgggatagttattactaaactaaattttaatgagttaagtgtaaatgaattggaaacatgaatctcagatttcttattaaaatatacatgaggttacaggttatgaagaaaaatgcttcgaaagtacatctcagcagttgccaaccttaagacatttgaggctgagcgcggtggctcacgcctgtaatctcagcactttgggaggccgaggtgattcgatcacctgaggtcaggagttcgagaccagcctggccaacatggcaaaaccccacctctactaaaaaaaatacaaaaattagccaggcgtggtagcggatgcctgtagtcctagctactcaggaggctgaggcaggagaatggcttgaacccgagaggcggaggttgcggtgagccaagattgtgccactgcactccagcctgggtgacagagtgagactccatctcaaaaaaaacaaaacaaaacaaaaaaaaaaacagaacaaaacaaaacaaaaaaacatttgagacattttatcagttgtcccaatagcagagggtaacttttttttcaatcctttgcttgcatcattgagttctttcaggcttgaagtgccttccctaaatgaattgctctaggatatttcttatttgttattcccaagcataaacaaaatacaaagtcagtgttttcccaggattgcacagaatatataattcagctattcagaatcttatcagagaggaactgtaaactcaggcatactcttctgtatattcatagaacatcttcatcccatgcagatttaccatatgtactgagtatctatgatcacctgtaaatacaaggaatgcatatgagtaatgaggagtctgctatacttttgcctgcattgaaaaaatgctttaaaccacatattttcaggatttgtgtttaaaagacttggccatgcttaatttttaaaaataaaggtagaaagtggacaaactgtttgaaatatttgatacgaacaaattatttagtttgttttaatgtatatatcaaagaaaacagagaatccttgcctacacagaagtaattacttcttctaccttgaagttaggatattttataataaaactgaaattgtcatgagaaataattgctcttttatttcattttcttccatcttaattcatcatctttattatcagttgctctgagatagatcacagaattcatggcccactagtcttaagataaagagttaattgaacatttcaaactccttgatttgtcatgaaatcaaaatgaaacatttaaaaaaattaggaacttaaatgccaagtttttataacatgaacattgtacagttgtacttatttgggtctaattattttcatatttctctaataaaccccactaagcaaataagaaaatatgttggcactgatgaccttgtctttattattaaattactgtgatgctccacaaggtcttgtctcttttttttctggcctaaacattctgccccattttctagataacttacagctggcactttagtaggattttacaggctgtaatagtgcattatcttatttgattcttataactgtgctgtgaaaatggttggttagctcttagaatctatgtattatgaatgtgaccttaagcagttccttaaactctgtgagcattagtatctttattatggtacttgccacatcacttaaggctgtttgggggataaaatgagaaaatgcatataaataccttcatatgaacgattcaataaatatcaaatactattggtactattgtgtaggatctcttggttatttattgatgaagtaagcatgaaaagtctgggtcttctaacttctgctccggcgctctccaggcttcccattgcccaaaagaaaatgtctaaaggtgtaataaaaacctttatgttttccctcctgtttattttttagccctatattctccaaccctttaacccactggcactccagccaagccaacctgctggcagacactctcccctggtcttccagagtacagactatatagaagctctttctgtccagtgaactcatacccatctttcaggacccagagcagctgttgaatgagtgagctttgtggtccctcagacagttagcacctactgcctctgtgtttccatcaaattttcttcttctcttagtttaacggctatcatctcaatgtgtagcattttgtttgtctcctacacaaaactgtgcatgctttaaagtcagaaattttgtttccaaaaatttctgtcccctatccctatccattggttaatatttgcagaattgattctagactcaattttctcctttttttttttaagctgtcacatatgctcaggatggctttggaagatcgtagagaatgaggactctaaaccatgtttgattaaacatttaacctagcagatctggttcttctggttcgattgtggttcccatctgtagagaatgttttacttgtttgcctgatcatggacaagcaggctggctaaactacaaattgttccataaacattgaacttctcaccaggactgcctattcctccaccttcatttcctgcaagtcatttcttgtttactgtgcaccagttgcactgatgtccctacacatcccaagcttgttttcttcctcatcgcctttgcaggtgctgtattctgcttagcagggtcttttcccatcttcttggggctgtctctctcctccttctggtctcgttaaatatcagcttctttcacaaatgtgaaaagtcaagttattctccttcagagctcctacgtattttcttcatgacattttaagtcataatttatattaggttggtgcaaaagtaattgcgttttttgtcaataacagtcatggcaaaaaccgcagttacttttgcaccaacctaatagttattttatgtgcctgcttacatatattcatctgtttctcccattagaagtgagtttcatgaaggcaaggactatgtctgtcttgagtattgtgtaacaacgtttcacaataattatatattgaatggatacataaagaaaaaaatgaatacaataaggacaggtgttacattttggggtatctatcaaatacagcattttagtaagctaaacaacttcagacaacaaagacttcacaaggagaaccaatcagagagtcaatcagttaacaagcctgcagtgacccgccggtcatttgggaagcaaacttcgttaggtgtcctactaagtacaggagatgggccaatatacaaaccatggctttccattgtttttaggatgatgaacaaaacactgggtgatttgcttcagacccacttagcttcaggtgactatccccctcgttgattgtgacccagccatactggccttccttcaatgtctccaaaatgccattctactcattgcaaacattaccccactttattccttcaaaaagctacacaagatcaatttacctgactctctcacaggctcttactgtttcttgtctctttcctaagttttcccaaagtttcccaatgagcgtatcctttagcctgtgctctttattgccaggctgttgttgcaacagacgtctgtctttccgcactcctctgggactcctgtgactttctataaaccaaataaacaaaaacacacattttaccccaatgcaacttggaagagaattctatgaatcattgtcagtctcaacaatagagtaagtgtgtttgcttgagagaccatggtgcatatttgaaagactataaaaaagttcattaatgcaatggaaaagtgcttcaagaaggtcacagaaaaggaggagaaaagttaaaaacagaatcaatcaagttgaatttcatcttagagttttattttagtcctttagaaagagtcttttgggcaaataaattcactaatattagaatgctttttataatataaacagcatatttaacagctgtactgatcaaaaattagaagaattaatcttaagaaaaacaaaggtaggattttacttgcagttcctccttcttttccaaacaagaacctttttgtccctcatgttttgactacattaacatttatgttgtttgcatacagttgataaaactgcacggaatataatgtctttccaaattcatcaagacataccttgtggttccccactatgaactggtgattaatgcagcttgttacgcctctagtgtgactttataaacacaagccagctgtactcatcttctaaagttgaaaaatgagaactagcttttctccatttgacttcttctaaagtttctgcaagattgtgctcatgttacagttaaacatcagctgtacagctttctctttctttagctattagtcccttaggtataagtctgtaatcaaagagaggtcaactgtatccaaataaaaaatatgccagaatgtctctggcataaatctctccctaaagattcagtagtgttacttcagcagacaggaaaaaacactatgctttatctaaaaatctaagaacttaatttatttaaaaaataaaactgacttatccagttatccttatagagagctatacaagcatagaatttccatgttactcatcaagttgtttttctttttactaagtttggaaagcacttaaataaccatagacaaaatatggctgtacaggaactgaatggctactattgctgaacactttttctactgttataaactacagagagggtacgttaattaaaagcccttttgagcatcatagtcattgcacagtatccaattaattttagaagcagcttagggccaattattgacaaacatatgcagtagatggagaatatctttctatttagatctcagttgcttgtctaagtttctgcatttcttcactaataattaattgttctattcccaataacagtcttaagatggaatgcctcttatgggtatatgcattttccttattgcatttgtcttaaatgtaaatccatctcttatgtagattgtatcttgaagcccagaggcttcccatcattacaagaagaagtgagttccagtggagtcacactgaaagctgctttccatgagagcattgctgtctgtgatgggtcatacaaatcttaaatcagaagtcatttaaaacagtttcactactgggaatatatttactgatgcctcgtaattgcaaataagcataacaagaacaagcaagtttcccatcatttaatgccattaatttccaaatattccatttacttaaaattgttgcctctccttctctcttctattatgaattattttttcaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttcatgtaaaacagaaaaaaagagtgaaaaagagaatatacatgaagaatagaaacaagcctgccataatcctttggaaaagatgtattataccagtgaaaaggtgttatatctatgcaaacctactaacaaattatactgttgcacaattttgataaaaatttagaacagcattgtcctctgagttggttaaatgttaatggatttcagaagcctaattccagtatcatacttactagttgatttctgcttacccatcttcaaatgaaaattccatttttgtaagccataatgaactgtagtacatggacaataagtgtgtggtagaaacaaactccattactctgatttttgatacagttttcagaaaaagaaatgaacataatcaagtaaggatgtatgtggtgaaaacttaccacccccatactatggttttcatttactctaaaaactgattgaatgatatataaatatatttatagcctgagtaaagttaaaagaatgtaaaatatatcatcaagttcttaaaataatatacatgcatttaatatttcctttgatattatacaggaaagcaatattttggagtatgttaagttgaagtaaaagcaagtactctggagcagttcattttacagtatctacttgcatgtgtatacatacatgtaacttcattattttaaaaatatttttagaactccaatactcaccctgttatgtcttgctaatttaaattttgctaattaactgaaacatgcttaccagattcacactgttccagtgtctataaaagaaacactttgaagtctataaaaaataaaataattataaatatcattgtacatagcatgtttatatctgcaaaaaacctaatagctaattaatctggaatatgcaacattgtccttaattgatgcaaataacacaaatgctcaaagaaatctactatatcccttaatgaaatacatcattcttcatatatttctccttcagtccattcccttaggcaatttttaatttttaaaaattattatcaggggagaaaaattggcaaaactattatatgtaagggaaatatatacaaaaagaaaattaatcatagtcacctgactaagaaattctgactgctagttgccataaataactcaatggaaatattcctatgggataatgtattttaagtgaatttttggggtgcttgaagttactgcattattttatcaagaagtcttctctgcctgtaagtgtccaaggttatgacagtaaacagtttttattaaaacatgagtcactatgggatgagaaaattgaaataaagctactgggcctcctctcataaaagagacagttgttggcaaggtagcaataccagtttcaaacttggtgacttgatccactatgccttaatggtttcctccatttgagaaaataaagctattcacattgttaagaaaaatactttttaaagtttaccatcaagtcttttttatatttatgtgtctgtattctacccctttttgccttacaagtgatatttgcaggtattataccatttttctattcttggtggcttcttcatagcaggtaagcctctccttctaaaaacttctcaactgttttcatttaagggaaagaaaatgagtattttgtccttttgtgttcctacagacactttcttaaaccagtttttggataaagaatactatttccaaactcatattacaaaaacaaaataaaataataaaaaaagaaagcatgatatttactgttttgttgtctgggtttgagaaatgaaatattgtttccaattatttataataaatcagtataaaatgttttatgattgttatgtgtattatgtaatacgtacatgtttatggcaatttaacatgtgtattcttttaattgtttcagaataggataattaggtattcgaattttgtctttaaaattcatgtggtttctatgcaaagttcttcatatcatcacaacattatttgatttaaataaaattgaaagtaatatttgtgcaa

SEQ ID NO: 36781 - DNA, 12551 bp, Homo sapiens
ctctccccggcccgatccgcccgccggctccccctcccccgatccctcgggtcccgggatgggggggcggtgaggcaggcacagccccccgcccccatggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggtgaggccccgctgcgcaccccttcttgggcacatcaggagctgagactgcagaggggccgctgggggccgcgtgggctgaaggcaaggggaagggaggatgggtggagggtgagatgtcaggtggagcggcacagggtgacgctccctccttcccagcaggagcctgcccaggaggagctggtggcagaggaggaccaggacccgtcggtgagtgggcgtgggcgcggtctgcaggctgctggggcatgggaagtgtgcacagccgaggctgcaggtgtgtgcagctgtgccagccgtactcgaggtgtgtgcagggtgtgtgtgaacacagtgcgtgcatgggtgcgtgtctgcaggggtgtgtgtgcgtggtgacaactctgtgtgaggggtttgtgctggggttgtgccacctgagtctgaggtgtttattggctgggggtgacgtggttgtataagatatgtgagtctgcgtggaagaggggtgcggttgtgtacagggtgtgtatcctctgtgcgtggtgactgggtgcgggcatgtgtgcaatgtgccaattgaatgcagggtctgcgttggttgtgtgtgtgggtgggaaagtgtagctggtctagaggaaagggtgaggactggggcctgactcccagcttcacctttgcccggggccccagctgtagttggctgaggggcttaatctgtccctgacttctgtgtctattgctggctggtggctctcctgacaggccccgtatgtctcactttatatctctgggagtctgtggttgaaccctgccctaattcccctaggaactgaatccccagacagaagaaagccaggatcctgcgcctttcctgaaccgactagttcggcctcgcagaagtggtgagcatccctctatcccaacctcaggaagcgggcagagcaaaaaccattatccacagggagaaactgaggcacggagggtgaaaggagttcagagtcatgcagctaaccagccaagactcaaacctagggattctcgccctcctctgaagctccttctgtcatatggatgtgctccttcagaccctaccccaaacaggaaggcagggtggccatgagttagaagaactactgggatcctgatggagactaggcctggcagtcagaggcctgggccccggtaggcaaagagacttaggaatgggatgatggggtggccggatgaccacgtgtccaagtcggcatgcagttgtcctggcccccacctgttatctcggtgtgattaatagcagcttcccgttttgctctcagcagtatcccagtgtggatgacaaattatagtcactctacttactgaggaagatgaggcctgagattctaaggccaggagtctggacaagaataaggatgccagggttcctgagaggggaatggggctgggagagttgctctgggacccccactagggcccgctttgctcatctgtctttccttgatcctcagcacctaaaggccggaaaacacgggctcgaagagcgatcgcagcccattatgaaggtgggtgatgggtgagccatacccaggaggagaggggcaggtggcagagggtcagggcaggtctcaccagccttttcctgtactttacagttcatccacgacctggacaggacggagcgcaggcaggtgagaccccatcccccgacacagcactggcctcctgggaaaagggcccttgaaaacctttgacctcccactcccttcccggccatcagtctcagaaccacagaagccagttcatgaaggtcttggttctctctgtgacccaggcgtgggaccccatgaaagacccctactcttccccagaactctgcccagttcccccagcaaatcactgtcccagctctctccttcagccctcattcttctccaagaagcacttttcattcttttttcttctgtctcctccatattccacgttctgatgatctttttctctaaatgctgctagtgtctgctcatcttttccatttctaccccaccctctacctcagcaccgtgacctcagaacctcaaatccagcctcttgctgcttccccactccacaccctccctacccctccactccatctgacctgtgctgccatgctgagcccctaaacttcacttttcttgtggtattggctctctacatggcttccagtctcttcgtggtctggtctcaacctaatttccctgcactcttatgctgtcttcatgtttgctgcgctgacacccctgctcccggtgtgcctcttctggactttgcacataccatccccctcaccagaatgtctttccactgtgagaggcagggaggcatgaggagtgctcagccgaggggttcacagcagagatggtgagaagtggatgggttcagcctgtgtcctgaagatattactgacttatgggttggaggtgaagaataaaagaaagggaggaatcacagatgacttctagattttttattttttttaagacagtctcgctctgtcacccaggctggagtgcagtggtgcaatctcggcttactgcaacctctgcctcccaggttcaagagattcccgtctcagccttccaagtagctgggattacaggcgtgtgccaccacgcctggctaatttttgtatttttagtagagatggggttttgccatgttttccaggctggtctcaaactcttgacctccagtgatctgcccgcctcggcctaccaaagtgctgggattacaggcatgagccactgcacccagccagcttctagatttttaacttgggtatctctgggaagaatgatgccatttcctaagaagggattgaccaaggaataaataggttgggaagtatgtaagataattattaacgttgagaagtctaaaataaacaagcggataaatgacaataaagtaaattccagaaatggatggctggacattgtcgactagcttaggctaggtcaggacggataaagccaggagtcatggccatatggatggcttttttttttttttttttgagacagagtctcgctctgtcacccaggctggagtgcagtggttcgatcttggctcactgcaacatctgcctcctgggtccaagcgattctcctgtctcagcctcccaagtagctgagattataggcgggtgccaccacacccagctcatttttgtattttttagtagagacagggtttcaccgtgttggccaggctggtcttgaactcctgatctcaggtgatccgccagcctcagcctcccaaagtgctgggattacaggtgtgagcccttgtgcccggcctatcgatggcatttaaagccacaggattgggtgagacgccaggagaaagaagggccccacgaatgaagccctgagactcttgggcatcttgaagtggagctgaggggaaaaccagcagagactgaaaagaagctggagagagaggaagaaacccagggagggtggcatcctggattcggagaaaccactgtttcaaggaggatgtggctgtctgtgttgaatgcagctgagagatcacatgaaatgagaacagagaaatgatggctgggtttggtaacgtgaaagtcctgctgaccttaaagagggtggtttcagtggcatagttagaacaggaaggcagtgtgcattgggttgagaagaaaatgagaaataaggaactggaggcagggacaacctttttttttttttttttttttttttttttttttttttttgtgacagagtttcactcttgtcacccaggctggatccagtgcaatggcacgatctcggctgaccgtaacctccacctcccgggttcaagcaattctcctgcctcagcctccccagtagctgagattacaggcatgcgccaccacgcctggctaattttgtatttttagtagagacagggtttctccatgttggtcaggctggtctcaaactcccgacctcaggtgttccacccgcttcggcctcccaaagtgctgggattacaagcatgagccactgcacccggcctaggacaaccctttttagaagtttctctgtaacaaggagcagagaaataggccagtaggtggaggggtgtgtggaccaaggaaaagtttagttctgtgaacaatactattttcatctgatctaacatgtactgagggctttcttgagataggcactgtgtctggcacttgtgtttggtcttatctaatcctcacaacagccctaaaaggaagatactctaattacctccattttacagatggaggttacacaacttgtctgaggccatgagatactaagtggtggagccaagatttgaacccagctagaatgtgcctgtgtactggacatggtctgcatgaaaggcgaggtggctggtgcaggggtgaggggtccatgcaggggccacatccaaaaaggggagagggaagtttccagaaagaagagaggacacatctcccaccattaccagagggtcaaaggagaacaagagaccaggtgggtttgtagatttgctggggggagatgagggaacctttgctcgatgacttctaggtcctctggacaactagggagatggagacaggagatttgaggagaaatggtacaaaatctcaacttgctgattatgaaagcaagcttcgtgggggaatgtaagattgccaggcaggacggaatgtccaggtgaggtttgtggctggagacaagtgatataccaggcaagccctccgtgctcctgggcacaccatgcccttaggctacaagcagcctttgcttaggctggcttcgtagctaggaatgccctctcttctctgccctccctactcttcatgcccagatcagccttcctcccctctgtatagaccacttattttggcaattatccagacattcattcattcattgactcaacaggcattgaagacctactgtttgctaggggccaggctaggtgcccacagcaactaatatccagactcttttttttttttttttttttttttgagatggagtctcactctgtcgcccaggctggagtgtagtggcgcgatctcggcttactgcaagctccgcctcctgggttcatgccattctcctgcctcagcctcccaagtagctgggactacaggcgcccgccaccacgcctggctaatttttttttattttttagtagagacggggtttcaccgtgttagccaggatggtctcgatctcctgacctcgtgatccacccaactcggcctcccaaagtgctgggattacaggcgtgagccaccgcgcccagccggtcagacccatttttttttttgagatggagttttgctcttgttgccccagctggagtgcagtggcgccatctcggctcactgcagccttctcgggttcaagtgattctcctgcctcagtctcccgagtagctgggactacaggcgcctgccaccacgcctggctaattttttttttatgttttagtagagacggggtttcaccgtgttagccaggagcgtctcgatctcctgacctcgtgatccacccaccttggcctcccaaggtgctgggattacaggcgtgagccactgtgcccagcctcagaccaactcttaaggagtcactgtctaggagaggaaacaagcatataaatttgtaattacaggaacatacaaaaaaaattagccaggtttggtggcacatgcctgtaatcccagctactcaggaggctgaagcatgagaatcacttgaacccgggaggcggaggctgcagtgagccgagattgtgccactgcactccagcctgggtgacaagagtgagactccatctcaaaaaaaaatttgtaattacagtggaatatgacaagaacaataataaaagtggccaagatacctggcaacacaggggaagacagacatggctgtggagtcagggattctctccctgcatcgcaaggtgccgctgggccttgaagcaggagcgtaagacaagacaggcaaggggtcaagaatggtgggtgcaagcagaagcagcccctggggcaaaagccccgggtttgcccagagcatgatgaggctgggggactctaagttcagcgtggcagaagcagaaagtgctagaggagcgagatggggatgaggctggagacagaagccaggccacacggtggcatgtgggaactattctgaggtgagccatcggaaggaggaaggcgaggcgaggcgggcttacgtctgcatcttagagactcattctgtggctttgtgtagggaataaactggaggaagccagaatggaaacagggaatgctgtgaaaaccagacagaggcaccagatgggggagagaggggagagagctatttaggaggcaggatagataggaactggtgatcgattaatgatgtaggtaaaggagagggaggcttgaatatccccctggtggcaaaaccagaagccaaatgtggaaaacagacagtaaagcaagagtgggatgaggggggtcagctcagtgttggttgagatgagtttgaggggctattgctgttcagatggtgcagttggcagggtaaggaagggaaggaaacttcagggctggagactctgcagagcacaggttgtgggaacccattggtggaaataaaaatgcccagtgagcgttttttttgtttttttttttttttggagacagagtctagctctgttgcccaggctggagtgcagtggcatgatcttggttcactgcaacctccccatcccaggttcaagtaattctcctgcctcagcctcccatgtagctaggattacaggtgcctgccaccatgccctgctagtttttgtatttttagtagagacggggtttcaccttgttggccaggctggtctcgaactcccgacctcaggtgatccgcccaccttggcctctcaaaatgccgggatgacaggcgtgagccactgcacctggctgagcatgatgttttcaaggcacatctgtgccatagtgtgtatcagtacttcactctttttatggccaaataatattccattatatggatagacattttgttgatggacaattgggtttcattttattatttttagttgtactaattcagataatgtatgtttacatcctccatataaaagaagcaaataatatagatatccatgaagtaaaacattaaatcccctcacgcttctccttcagttctactcttctccccagaagtgactgcaggtgacaatctgccctgaatgtctctggccatatacattagattttttcacataacttcctagtcaactatgggcatcataggggatgggtcctcccttgcccggggtgatctatgtgtcttctgggtaaagtgggcgccgaatgttcatatgctcaatggatccctggggagtgtgggggagtcctgtagagagacgtttccttatctctgagcatccgtgttcaggtgtggacgggacagtgagtggctgggaggaagccagaatcaacagctccagccctctgcgctacaaccgccagatcggggagtttatagtcacccgggctgggctctactacctgtactgtcaggtaagccccatctggctgcatgggtaacgcagtaagagagtggcgaagggtttgccaggagagtgggggacaagctacagggctgggagggtgagttggggtttgggtgggatgggatgcctgcgtcgctgaggaaattggaaattgaggcgagggcaggcagaggcctggactcggcctgttgtccccaccccaggtgcactttgatgaggggaaggctgtctacctgaagctggacttgctggtggatggtgtgctggccctgcgctgcctggaggaattctcagccactgcggcgagttccctcgggccccagctccgcctctgccaggtgtctggtctgttggccctgcggccagggtcctccctgcggatccgcaccctcccctgggcccatctcaaggctgcccccttcctcacctacttcggactcttccaggttcactgaggggccctggtctccccgcagtcgtcccaggctgccggctcccctcgacagctctctgggcacccggtcccctctgccccaccctcagccgctctttgctccagacctgcccctccctctagaggctgcctgggcctgttcacgtgttttccatcccacataaatacagtattcccactcttatcttacaactcccccaccgcccactctccacctcactagctccccaatccctgaccctttgaggcccccagtgatctcgactcccccctggccacagacccccagggcattgtgttcactgtactctgtgggcaaggatgggtccagaagaccccacttcaggcactaagaggggctggacctggcggcaggaagccaaagagactgggcctaggccaggagttcccaaatgtgaggggcgagaaacaagacaagctcctcccttgagaattccctgtggatttttaaaacagatattatttttattattattgtgacaaaatgttgataaatggatattaaatagaataagtcatagtctctctctttattggggctcaggggacactctcagggtagctgggggccacgtgaaggggggcgttgcggagcggcacagctggaactccgggatgatgttcaggcttgggggcggggacctccatgcctccagcccccaggtgggagcagaggtaggaaggcacactgcccaggaaaaaaatcaatcctccgcccaaggtacagcagaagcggcctccttggcctaggaggcagacttcctcctgcggggaaatcccttcctggctgggaggagcaggggcccttcctcttggtggcctcggacattcagcaggtgctggcacaggccctggctgggaggtggggcgggcaggagccagcctggaggaggggctgagagtcagcaggcacacgggaacccggaaccctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcaggtgagtgaggggaggagggtgtctgggagaggatggttagcatggggggtctctgggcctcctggtctgcaaagtttcaagggggtgcaagagagggtctccggtttggaagtcaggggcgcggccattccaggaaaggaaactgttaaaggttaatgcttctcatacctaacaaatcctggagggcagccagcaccaacactcagggtgctgggaaaaggtgcgtgagagatctgaggcatctcgggggcaggggagggctgggaaggcaggctggctgggaccctcgcatcttaacctaaccttgaccctctttccatgagcagagttccgatgccctggaagcctgggagaatggggagagatcccggaaaaggagagcagtgctcacccaaaaacagaagagtgaggcttccagggtgcagcaggggtgggaggtgatcaagcagcgtggggattgtaagcccgagtcagggtgagggtggaggctgccaacagcacaacgggggaaagtggatgcggctgagattccctccttctctcctcagagcagcactctgtcctgcacctggttcccattaacgccacctccaagggtgagcactattttaaataatggctttggggaggggcaataaccaggaactcgggctggcacttgggctcaaggggtccttataggtgaaagggaaagaaccaaaaagcacctgagagtgccaagaagtcctgaccgacacactctcacctccagatgactccgatgtgacagaggtgatgtggcaaccagctcttaggcgtgggagaggcctacaggcccaaggatatggtgtccgaatccaggatgctggagtttatctgctgtatagccaggtaaccccagccacactctgagcttcacagagggcctctttggccccctactgagggttcctgacccctctattcataccaaacccagcagacccttctttcttccctcgttagcgctcctgaggcctcccagaactgagccaggccatcctgttttcttcaacatctcccttccctgccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgagagccgtgtgggcagccgaaagcaggacgtctctgaccgggggtagcagtgcagggagctaccgctaggagggaggttggaaacctaaacagaggcgggtctgaggagtgaagtgcagaatgccgggtccttacaggaggcagaggaacggtggagctggagaaggcagggggaaacagggcatctggatggctgtgcttcactgcgaatctactttctctcttttctcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgataccccggc

SEQ ID NO: 36782 - DNA, 26710 bp, Homo sapiens
gtcccagtgaggacagggacacagtactcggccacaccatggggcgcccactgcacctcgtcctgctcagtgcctccctggctggcctcctgctgctcggggaaagtcgtaagtgcccctcgcccttcagacccaaaagcagcgccagggagcagggaggggcggcagttggggaaaccctctcatctctgcagcctggacggtgggtgccttgagtgctgccagaggctgggctcggatggctgggcttggcctttccagccaacggcatcctcaaggccagctgtggctccctggggctgagagtcagacgggcggatcagaggtcacagagacaaaaacacaaggacagagtcagagagagaaagggagagggaaggagaaacggagacacagtgagatgggaggccaagaggcagagacagaggtagaaagacggagacagagagagagggaggggttggggcaggcagagacaggacagttagccatctgccaccacagggaggcacaggacgaggggcacagcagaggagctcccagggaggaggaggctgagccgagccagtgccaccactctcggactggctccgtcggggaaggagctgcctaatgcacagctggacaggtgggggcagcagggctgtccaggacccccgggtctgtccaaaagcagaggcccagacaggacagaagccaggcaagcctggggacagcggaggaagaggaggcccctctggtggggacacgagagacagggaccctagacttgtttgcatcctggacaaagtggacaggcaggggcaccaaggggacccaggcctgggaagggaatgtgtgagggagagacggagcagggggagaccctcgtggggtggaaaggggagacccctgggaaggctgagtggatcctcagtgcatcactgacctaaacggcccctccgcctggtgacttggagctccagtcacatcacacgggggtcttctccatcccaccctcaaccccctgccctccccagcctctgtcccctgagccacatcttcctgtctcccacgcggaacgggactcccgtcttcatggggtactgtgtggctccaactcgcccagccttcttcctccccctcaggccacactgccccctgcaggagcccactgtgatgcttgtggtgggatgagatcagcgtgggtggaacaaggccctggaaggacccatgccatcatcatcgacagcaaagctactctgcaaacagacagatgcttccgcgaattggtagaaaattctgcagccggaatgctctaggatcctgaggccctaagcccggcccggggctcccgaggccctaagcccggcccgggactctggaagctgctctggcttattgggaatggaagttggcaggactcctcttcctgggaagaagcagagggtggggatgagaagacaggccaggagcccacccagacccacaggaggaaactaggggagttatgcagagtcctggtggagcgccagcttcccttcctgccaatgggaaatgcaggcgcccacctcgcggacctctgggtccacagggtattggcacccttagctgtgtgatgcgggcctggctcataaccatggcctgtggtgtccccgggggccggcctggaccctgggtggacatggccagccccggagagccagggccaggccatctctctcccctactctgcctcagaggcctcggcagctgcactgtggggtgggtggggctgaacacaggtcccagaaggtcccactcaggaccctgctgtgcacacttttgattttaataaaatcagaatgcgcacagcatctgcagtctagcctttaaacgagcacagctgtcctggcagtcacggaagttcttctggggcggtgggacctcagcattcctttgctggtactgctacaagaaaggacaatggaccaagtagcttaaagcaacagaaacatttctcccacagctctggaggctggaagttcaaaatcaaggcgtcagcggggctggttcctccagaggctgggagagagtctgctctaggcctgtttcctggcctcggggtgccagcggcctcacagcccatggcttgtgggagcattgctcccatcgctgcctccatcatcgcatggggttctcaccatggctgtttttctgtcttcttttctctcagaaggacaccagtcattggatttagggctcactctactcccataaaatgtcttcctaactaaatacatcacaaaagttctatttccaattaaggtcaggttctgaggttctgggaaagacatgaatttggagggacattattcagccctgtcctgccacctgtgagtgttttctgcaatccaactttttattttaataaaatcagaatacgcagagcacctgcagtgccagcctttaaactactgctgttgtactggcaatcattaaagctacgtggcttcagtttcaatctttacattcaacaagtttaaacccattcttcatgagtttggaccttactgactgaaaattttgcttgctggtaaaacttgctcaaatgcagttgctgactgtggaattcactgatgttgccaaaacaacaaacacaactgtgtgctcgaggattgcaatgctcccaacagcttctgaagaaacaaaccacacgacaaatgtctaccaatctggatgctccatatcagagttctagagtgttccattaatttcttgagacaagtgcctaaaaaccttgttttaatttcgttttgccaaaatcccattttactcacatcagaaagtgtggccacgtggcccagacccggcctgctcagtctgactgaagcgttgatgcgactcagccataacagatagcagaagcgcccagattcagtccagagggctgagccaggcacgccatctttccttcattccctcaacacatattggttaagttccggccgtgctaggcacgggcatacagctgtgaccaaacacgtcaagtctttttccagcggagggaaggataagcctgtcagcatgtaatgtcagagaggggttgggtgctagaagacaaatagcacagtgtaaggggatgaaagagacacgagtgggggcaacgtcagagggcgtggtcagggagggtgtctcggagggcgctgggcctgagccacttgggtatctgtggaaagaatgttccagacagggaggtgactggtgcaaaagtcctggggtgtgagtgttgggctcagccagggtcagcgcagagcccagtgtggcagagagaggtgaatgagggcagagttgaaggtggtgaggcctgggaggcctggccatgggaagaccctgggctctgttctaagaccactagaggcagattctgggtagtccttgacttccttgcatcaccctttccaccccgtgcctgccacctgtaccctcttcctcacacagtccagctcaaccttataggccgtgtcctacccccatgagctggggagagctgagcaggcttcagggagatgggaaaaggcgggaactggacaggggctgcaaaggaaaggtgacttcttactggtcaatcagcctggggatgctcgggggtggatgccaaggggaacagagctgtggccgctatcacagaacagcgagttcctctaagaggtcagaggaggcgcaagggatcgaccagagacagtgagggcgtcaggctccagttgagtggggaccaatccttgtggcaagtctgtgaaccatcactgtggctctagggtagcagagaaaaaagcaggcatatgtccatctggccacaaggaaggagaccaaggggaagagagaaggtaccaagagaggtgttcacatggaggtgcgtcagaacaccgagggcaaggcagaacgcggtcttcagaccccaactggagcccaggaggcccgcgagtcccagtttgggaaacactaagccaggcttggataacttgtctgaggctgtggtcatcccaacatgagagccagaggccccaagggagatgggcattccccacccctcagcttcctcagtgccttttgtggagtggaggtgacatgaggctgcaggttgcagggagccacgtgtgggctgcatttcagagcaagtgtgtgggagtggagcagacacgcagagtaatggggcagggtcaagaaataataaatctaagtctagcgttggtgggataatgtcggtgtcactaaaagaaatggggaatttggaaggtaaagtaactggaggtaggaatgaacccaagatttactaagcaccttctgtataccaaactcaacactaggagtttatacaatctttaaaacagctctaagagtagatattataattcccttctgccaataataaataataagtgactaaggtgtttttgaagctcaagattgcttgattctgcagtcttgttttaaattttggacatggagagtttggagttctgagatgagggaaggcatctgtcatagtgagagagctgaaaacatggagctcaggacaaaagtcagtgctagagagatcagttggaagagttatctttattgtagtgagacattgaatttttcagtggaaaaaaagcacagaaaaagactacagagggccaagaaaagaaactgaggctgtcaaaatgaaaagaggaggaggagtgggtgagagacaaaggagacacaggcagagagatgtggacagcacagcccacagacacacactctacaagggacacagactctcggatccagggcattttaaccagcagatcaagactcatttgccagtcatgaaatcaactcagtatttttttttaaaagagtagaatcaaatagaaaactttgtactaagtactgtattttaggaaatactaataaatactatttcttgaaagttggcatgtatgtgtgtcctggcacttcataaattgtactattatagtttgtaattgaaacagcatcaccaatccccacataacaaagagcagagaccttaaagacgagtggggccaggctgaaggggcacagcttgagccaaagcacagaacagtgggctgaaagcaccctagggagggagaattcaaggaagggggcttgggtggccaggctgagccagcgtgagcatgtgaggaggctggtgagctgattgggtgggatgtgtctacttctccagagaagggtgcatgggtctagagcaggtgcctcatgctgtacctcatagagaactggggggaggggggaaatgggcatttccctccacagcccccaaagtgcctgaggaaagtgttgataaagaagccaaactctgtaaaatatttgaagagatttattctgagccaaatgtgaggaccacgacccatgacacagccttggaaggtcctgagaacatgtgtccaaggtagttgggtcacagcttgattttatgtattttagggggacagaagttacatacagacaccaatcaataagcataagttgtacactggttcgttccagaaaaggggaaggtgggggcttccaggtcataggtggcttcaaagatattctgattggcaatcagttgaaagagttattatctaaagacctggaataaatggaaaggagtatctgggttaagataagaggttgtggagaccaaggttcttgttatgtagatgaagactcataggtggccacccttagagggaatagatggcaactgtttcctcttcagacctttaaaaggtgctacacacatggccaggcgccttggctcatcctgtaatcccagcactttgggaggctgaggcaggtggatcacttaaggtcaggagttcaagaccagcctggccaacatggtgaaactccatctctactaaaaatacaaaaattagccgggtgtggtggtgcttgcctgtagtttcagctactcgggaggctgagacagtagaatctcctcctgaggcaggacaatggcttgaacctgggaggcagatgttgcagtgagctgagattgtgccattgcactccagcctggatgacagagcaaaacaccatcttaaagagaaaaaaaaaaaaaaaaaaaaaaaaaggtgctagactctcagctcagaaaaagacctggaatggtaagggggttctctacagaatgtggatttccctgagatagctttgcagggccatttcaaaatatgtcaaacaaatacaatttggagtaaaatcatttattttagggcctgctatatgtcatgtgatcctatactagagaagtcaggttggaaactggtatcttattgctacaaagactctgtttggtcagcctcaaggtctcttaacgtgaatgctggtcagctgtgcccgaattccaaaggaagaaataatgaggcgtgtgggacctgcttcccctcatggcctcaactagtctttcaggttcctatggaattcccttggcagagaggacgggtccactcagtgagttgggggcttagaattttatttttggtttacaagagagtgatccgccttttgtgatctggatatggcaagggacatggcagtcagggagcataggtgagggggagcctgggtgagggtgaccagagcttttaaccctgtcctccctgccttccagtgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacggtaagggctggggatagcctggctgttggtaaggagctcaggccacagcgccctcgctggccccgctgctccgtccatccaggggggcggcctggaggaaggggcagcgtgcgcgaaggctttcaggggcggggcccagcaaatcgaggcctcggcggagtcctgcccacagggacatcagtgccgcccccgcgctgactccttcccggcgaggactcagcggggagggatgcgcccaagtcccttgagggtcacagggcttctgccagagttaagttctatttaaaaataaaatgttaacctaaaaaccaatagtcatggtctcggccagcgcctcgccgagttgcagtgagctgagatcgtgccctcccacgcccgcagcccgcgtcctgccttggcctccgtagtcgctgagagccacagcctagagcgccagcgcgcaggcgcacaactgacgccaggccacgaacccagtactgctcctgcacagcagaagcactagcactgaggccgggcggcgaacccggcactgcgcctgcgcagcaaaaggacacgcactgaggccaggccgcgaacccagcacggtgcctgcgcagcaggaagaccggcatccacaccggacgacgaacccagcatcgcgcctgcgcagtaggaggagagcaatgccaccaggccgcgattgcgcagccgcagcagccccgcgcggaagacgctaccctcctctcccccgaagaggcggggcttcgaacgaacctggaaatggccgaggggtctcgacttcctcaccccaggcatcaggaaaggtgcctgcaggacagggctctgaagtggaagtgggcggtggtgatgccgaactgacaagaatgagctgaagagaagaaagtagccgagaagggggccaagccggagctcagtgagcaacagctaggccagccgcggctggtgccatcagccacaccactaactgtggacccaaatggaaactttgaggccccttacaggtcccccagcgcaggccaccgccgaaggttactggggaagacccctgcagcttccatgtggacattactcgcttgcttcatcccggagtgcagtcacctgcagcctgggaccacctgactgatgtcaccctggagatccatgccaaaagagctggggaaagttcaccttctaatgacccctgcggaccagggtgaagttacaagttatggccaggtcaaggaattataagtcaataaataaactgcctcagggagacgtactcagagtccaggaaaatctaggaaacaccaagaagggcgagcgcagcatcagcccctgcaaaattgcactgctgcctcctggctcacatgttgccccatccttactttagcctcaaaggcaaggagacccaatattatttgagtacttggatttgatcctgagtgactttctgagaaagcagtgtatcatctgccctaagatcaccacatatatgacaaggtttttggatgagttgagatttctagacattgaaaccctcatgatgaacgtcatcccgggtagcaggggctaagcctttcatcacctgctacaacaagctggacattaacttgtatttgagaattgctccaggactctaccttcagatgctggttagtagcattgactggatttatgaaattggatgccagttaaggaataagagaatgtatttgatttgccaccctatatggtctgtgcagactgtcatgatctcattgaaatccaagaaaagattatgtcagggatgaagcacatcacaggtggttacaaggtcacccaccatccagatggctcagaaagccaaacctatgggttgacttctcctcacccttctggagaatcagtgtggtagaagagcttgaaaaagtgctgggtgtgacgctgccagaaactaacctctttggaactgaagaaactcaaaaaattattggtgatatctatgtaacaaaagcttttgaaagtcttctacctcagaacatattcaggcgccttgataaacttgtcaaggagttcctgaaagtgacttacatcagtcccacatttatctgttatcacctgcagataatgagctctttgaccaaatgatctctctaagagggtctcactgagcactttgagctatttgtcatgaagatagctgaatgtttccatgcagcaacagcagcagctgttgacaaacaagacaaggccagcaaagatgatgaggccacattcatagatgaaagcttccatgcaaccctggaatatgggcttccgcccacagctggttggagcgtgacaatcaaatgtgttaccatgtttctcacagactcccacaacatcaaggaaatatttctgactcctggcatgaaacttgaagaaagagaatgtagcagccactaatacaatggaaagcgcaacattgacacgtctatctagaaaattttaattgtctaagttgtgtgactcagatatctttgcatttctgcaaaagatcaaggtctactctaattcttaattaaattaagaattcctttttattacttgttagcaaataaatggcttgtctctaacagaaaaaatttagaattttcggaaatattttcaaatacttcttatatatacatatatttttttccactggtagaatttttctttagtaaaagtaaataatgctgatccaagtttatgtttcactcagcatcgtttctcaaacactcttctttacttatatatagctaccctatagctaagctatattttattgtatgatgcatttactcttttcagagtttggccatataagttatttctaaatattgctattaggaaaacacatatgcatgcatttcttctagattatcatctaagagtggcttctccagagagagacgactgaattaaaggttatcaacaagttccaattccagataagatgaagaaatcacattccacactgcctctcccactgagtgtagctccaaaacatggatagaatgcatgtagcagctatttgacgaccctaaaaagtaaatcgcagtgtattgcagaataagactacaattagatgtatgatatgatacaactggctgtgagtttatcattttttcctccagtcttccagacatcacttgacctgaatctaatggacatttataggattctcaacaatagcaaagtacactttccttccacatatggaaaattcctcaaggtagactatatcctgtgtcttaaagcatacctcaataaaaagattgaactcacataaagtatgttttctgaccataatggaattaaagtaaaaattactaacagaaaaataactggaaacttccctaagtactcggaaattaagtcacacatgtataaataatctgtgagtcaaagagaaaattttaaggggagtaagaaagtattttgagctgaacaaaaatgaatatgtaacataaaatctgtgggatgcagctaaaaaagcagtgtttcaagggaaatttatagcattaaatgctcacatgggaaaagaaagacggtctcaaattgtttatgtaagcttccactttaataaactagaaaaaaagaaaaaaataaaccaaaaggaaattgaaaaagcagaaatcaaagaaatttaaaacaaaaataatagacaaaattaataagctgatgaaactcaaacaagactgacaggaataaaaacaaacaaacaaaaacaagaaaaaggacctatgttggaaatggaagagaggggacatcactacagaaactgtagatgttaaatgtataataagaaaatactttgaacaactctgcatatataaatttgcatgagatttgaacttggatgaaatgagcctattcttcaataccacaagccaccaaaacatacacaaggtgaaagagatacctgccaattcaattcttaatttaaaaccttctgaaaaagtaatgttcaggtacagatggtttcactggtagaattttaccaaacatttcaaaaagaacaccaattctatacaactcttccagaacatagaagagggaacacttcttagtttgtcttaggccagcattaccctgatgtcaaaaccagacaaatactgaaaacaaaaaccaccctacgtaacaatatctctcatgaatctagacataaaaatcctcaacaaaatattagcaaacggtgcagcaatatatttttaaaagagtaataatacaccatgaccaagtgagtttttctggggcacacatgactggctcaatatttaaaaataattatgtaatccaccatataaacaaaagagaacatccacataatcatgtcaattgatgcaacaaacaaatctggcaaaatttaacatccatttatgattttataaaaaacctatcagcagaatatgaataggagggaattttatgaacataataaagttcatctacaaagagtctacagttgatattatacttaaaggtgaaaactgaaggttttctccctgagactggaacaacacaagaatgtccattcccaacactcctaattcaacattatactggaagtcctagctctaaggaaggccttcagtaagtcaagaaaaagaaataaagttatcactatttgaagatgacatgatcatgcatatagaaaatcctaaagaatgtgaaggggaaaaaagcttgttttagtcccttctcacgctgctgtgaagaactacccgagactgggtaatttataaaggaaaaaaggtttaattgactcagttctacatgtctaaggagacctcagtaaacttacaatcatggcagaaaaggaagcaaacgtgctcttcttcacatggctgtaggagggagaagaatgagagccgagcaaaaggggaatcctcttaaaaaaaatcagatctcatgagaacatactcccacgagaacagcatggaggaaccaccctcacgattcagttacctcccacttggtccctctcactacacatggggattatgggaactacaattcaagatgagatttgggtggggacagagccaaaccatatcaatgctcctaaaatttgcaaatgagtgtaacaaggtcacagaatacaaggtcagcacatgtgttaatcacatttttatgtaatagcaatgcacagttatttgtaagccaaaaatttttaaatgccatttacaattgcttcaaagaaaattatatacttatatgtaaagctaataaaacatatacaggatctttatcccaaaatctacaaaattccaatgaaagtatttaaacagacctaaataaatagagacacatacagtgttcatggattgaaagactcaacatattaagatatcaattttcggccgggcgcggtggctcatgcctgtaatcccagcactttgggagaccgaggtgggtggatcacctaaggtcgggagttcgagaccagcctggccaacatggtgaaaccccgtctctactaaaaaaatacaaaaattagctgggcgtggtggtgtgcgcctgtaatcccagctactcgggaggctgaggcaggagaatcacttgaacctgggaggtgaaggttgcagtgagccaagatcaagccattgcactccagcctgggcaacaagagcgaaactctgtctccaaaaaaaaaaaaacaaaagaaaagaaagaattgtctttttcaacaaattatattagtctcagtctgtttgtgcttctataacaaaatagatcagactgggtaaattataaacagaataaggttattgctcacagttatggaggctgggaagtcctccaagatcaagaaaccagcagatatggggcctgatgagggcctggtctctgcttccaagacggtgcctcatggctgtatcctcacctgacagaaggcagaagcacagaagggacaaacactgtgtgaagcctcttttataaggacattaatcctattcacaagggcagagccttcatggcctaatcacctcctaaagatctcacccttaatactattacattgtcgattaaattttaacatatgtatggggggcatgttgagaccatagcagtgttggaacaattatatatttatatgcaaaaaaatgaacctgacctaaacttcacaattatacaaaaattaacacaatatagataatagatccaaacataaaatacaaaactataaaacttttaggagaaaatacaacaaaatttatgacatggagctaggcaaaaattcttagacattgacaccaaaagaatgattaataaaagaaaaaagtcataaattggactttatcaaaattaaaaccttttgcacttcagaaataaacactgttaagaggatgaaaatacaagctacaaactaagagaaaatatttgcaaatcacatatccaacaaaggaatcatattcggaatatataaagaaatcttaacagatcagaagaagaaaataaacactcagttaaacaaaagaccttaacagccaactcgccaaagaggatatatggatagaaaataaacatgtgagaagatactcaacattattagctcttacagaaatgcagataaaaaccacaataagaacgactatatactcatagagtaaaaaacactgacacagaacagcgctggttaagacacggagaaagcagaactttgatacactgctcgtgggaatgcaaaatggcacggccactttgaaaaggaatttgacagtttcttataaagttatataaggttaccacaggactcggcaatcccatttctgggcatttaccctagagaaatgaaaacttatttccacataaaatcctgtacataaatgtctatagcaactctagtctttttttttttttttaatttttattttttgagacagagtcttcccgttgcccaggctggggtgcaatggcacaatctcggctcactacaacctcctcctctcaggttcaagtgattctcctgcctcagcctcccaagtagctgggattacaggtgtgtgccaccatggcaggctaattcttgtactttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtgctgggattacaggcgtgagccaccgcgcccggccaattcttgtacttttagtagagatggggtttcaccatgttggccaggctggtctcgaactcctgacctcaagtgatccacccgcctcagcctcccaaagtgctgggattataggcgtgaggcaccacgcctggccagcaactctattcttaattgccaaaagctggaagtaagataaatgtcttttgctgggtgtacccatacaatataacagttgtcagcaacaacaagtaagaaagtattgatacaacttgcatgaatttcaaaggctttgtattgaatgaaaagctagtttcacaaggtcctataataaacactttcatttacatgacatgctcaataggttgttatcattgtgataaagaatagattagtggtgggacagggtttgccaagggttggcaggtgggggagatggcatggggtatttgggggggaaggatggacctgtactgcatcctgatgatgctggtggctacagaagtctctccatgtgttgaaattcatagaagtgtacaccaaaacattggttttgctgtgtgagaattttaaaagtaaaaaagtaagaagatagtgtatttgcttcctagggcaaccataacaaagcactacaaacgccttaaaataacagggatttattgtcgcagctttggagacaagtctgaaattagggtgtcagcagtgttggttccttctggaggctctgggagagtctctgtcccaggctctctgctcgcttccaggagcacccggcaatcatgggcatccttgggctgcggacgcgtcgctcctgtctctgctttcatcttcgcatggccttctctctctgtgcctctgtgtgactttttctgtctcttataaggactttctcctttatttagggcccacactgacccagcatgatctcttctacagccttggcttagttaacatctgcaaagacccgatttccaattaaggttctattctgaggctgcaggtggacctgaattagcagggagggcactattcaaccaactgtagagagttaaaaaacaataagcctgtggacattttttagcgtaatctaggctcttgatgacctgttttaaactaatcagcaatgaatatttttcagctaacgtaatgactattgacaagcacgtgacccttgtctgaatgttaactcaggcatagcaactaaaaaccatccattgaccagctcgggagtagcaaacagagcaagccattcttggtgcaacctgtttctaggtaattaacttgaaaatattttcaatattcaacaaagatggttcatttaagatgactgaagccacatcttcacagatgcagaagatctgaatagctttcctctttagattgaatagttctagaacaattcattcctaaaagtgacttccattggggaaaatatcctattcagcttgagtcacttaattatggttgttattggtataaaatgtctctgttttccctaatatatttttaaatttcttttttccttttagaatgaattctggaataaatacaaaggtcagtattttttctgttttaaccttcagtgagaggggttcatcaggatatttgaattttgaaaatagttcctgaatttcctttctgcttttgttctcattttactcatttaagactttttccctcagggtgtttccataatagttattgtaaaagagtttttagagtaattttatactaatcctagttttgttattgagttagagatatatatttaaatcagttcattctcatttgaggataccaaattccatgataacttttcttaaataaaagtgtattcggtaaaagcaaaaaacagagtctgaaagattagattcccgactaaggtaaccaccttgatttaatgcttaatagcatctgaagtggcctcagtcatgactacctggtaacagtattcacatttctcaaaatgacaactgggcctatctctaaatgagattgtgtaaatcctccaagaaatgggaagccccgtgttagtgtttgccttctccttttgccccaggatgatttggaaagaggaaccctaacctcctctcccgtcaaggcccagcccagaaatgagcatcaggctctcacctttcctccatccttccagttggtccctgtggtcacctctgactgtaaacacactgcaaaacaccggcaaaaatcaaaaagctgggccggtgatccacctagataaaggcatcacgtacacatggccacaaaagggggtggatcaaataaagtccaaagagggggagttgtttacagagaaaccggaagactcttccagttatctgaacggcagggccaaggttagcacagcaaaactgtttccatgatgccggaaacagcttgcagactccagtttcgaaatcctctctttgcagatggcgaccagtgtgagaccagtccttgccagaaccagggcaaatgtaaagacggcctcggggaatacacctgcacctgtttagaaggattcgaaggcaaaaactgtgaattatgtaggttcctctgcttggtataccttcagatcagatgcccctgaagagtggcaggtgggcgggggaagaagtgaaaacgcctaatgaaacaatcttaagtcatttctgatttacaaagtctgggctctattatacctattatactgtgccactatagcaatagaaaaaaaagccccaatatgtcccccaaacgattcggtttgggggcatgatgagagagacacagtcacttctctgctcctccgagagagactgtagaacattgatgaagcgtgtgatccattcatgtgtaaacaggagtggactctctgttttccttggggccaagtgcattgccctgttattcctgctccttgtgaccctgtgcagtgattctaaatcacctcttatttatgtgtatggatgcaggtgtcaatatttgtgaatatttgtgattggccaattataaaaatttgatacatttaattagttctacgtggaaaaatcactaagtgctttctctaatgtggtgattaagttttaaataaaaagttaggctactgttagatcaatttccctaaggaaaaagatttgcatttcttttaaagtacttaattgatcatcttttttttttttttttttgagatggagtctcgctctgtggcccaggctagagtgcagtggcacgatctcagctcaccgcaagctccgcctgccaggttcacgccattctcctgcctcagcctcccaagtagctgggactataggccccggccaccagtcccggctaattttttttttttttaattttttagtggagacggggtttcaccgtgttagccaggatggtctcgatctcctgacctggtgatccgcccgcttcgacctcccaaagtgctgggattacaggcgtgaggcacagcgccggcctaattgatcatctttagactgtgttcttagattggattacttttgagttttccctgatgagaatatcaattacgcatcattccattccaagtccgcagtcgcctccctggaacaccatttggtaacttatgaggcataaccctgttcaggctcccagggctattatgcacattttctaaaatttcaggcatgttgatctttgcactgtgattactttttcatcaaaagccacacagagggatgtggagtgaccgtaatgtgagtgctgctggggcagggggtaccggccatcccggaggtgtgaggggcaggtacctggagcctggcttctggctacaccgggcactgcaccatgagctccccgtgacccgtgaggttgcccttcaaggcaagtgtacctgtcgcctggctctggccctttgctcaacccaatggccgctttgtggctgacaggcaagtggatgtagctggcacccttgggccagcccagcctccatttctccagctgtccccagagccaacgtgcctctcctttgcagtcacacggaagctctgcagcctggacaacggggactgtgaccagttctgccacgaggaacagaactctgtggtgtgctcctgcgcccgcgggtacaccctggctgacaacggcaaggcctgcattcccacaggtaggaggcacgttgggccacagccacccgctgccgctgggccgggccagggaggacaagcccgtgccagggggtggggacacaggcatgttctgggcgggcctggcaggtaacagtgacaccaagaggacaggactgagccctgggctccgggcccaggtggttcaaacatgaagaccatgaggtttggaaacagacccattatttctgtaagccagatctgctgtttaacctcagcttccccatctgacaaatgggaccaacactattgcctgactgcttgggtgatccctggagcactttgcatgatgcctggcccaccgcaggccctcagtctgcattgggactgtggggggatccagtgcaagggctcaaagcaccagggcaggcaaagggcagagctggcccgaggaactggagctaaggtgcggggctgggataggagtcaggggacgctcaggctctgagctccttttaccaggaccagtgttcattgaacgtagtttttcttttccttgatgaatgtggacaacaggcggccagagggcagtgagcacaggacaggcaggggactgggcagggtggggacgagcctccctgtcctgaccccgtgggcattgcctacgctgggcttgcctggctgccggcacttccacacggccagcacacatgaggccctcgaaggcggggcctaggcgtcacagctgcaccttgcacagcaaccccactcccactcatagctggcccgacccgcagcgttggcctcacccgggggcatattcgaagggcagagttccaggcccgccttttcaagagcctggtgacccagctcaccttccggcttcaggtgcggctcagcccccagaccgtgttctgcccccggctaccatgactgtcccctccagacacaggttactcccgagtgttctgtcactcttcctttcatatccttcttaccgaaaacaatttacttccaaagatgagtgatcacgaaaagaccgggttccatatgcatccttcaagcgctgcttcaattatgtgcctgaaacatctcagcaagtgaaagacactgtggctgaccttgctactggcaatgacattcaagcttaagctggttaaaaaatattttaactgaagtcatttcttgacatacacacgaatattttttaattctagaaacaatcacaaatccatttaaaaccaagtgtgggccgggtgcagtagctcatgcctgtaatcccagcattttgggaggccaaggcgggcggatcatgaggtcaggagatcgagaccatcctggccaacacagtgaaaccccgtctctagtaaaaatacaaaaaaaaaaaaaaattagctgggcatggtggtgcacgcctgtagtcccagctgctcaggaggctgaggcaagagaatggcgtgaacctggaaggcggagcttgcactgagcactgagccgagattgcgccactgcgctccagcctgggcaacagaatgagactctgtctcaaaaaaaaaaaaaaaaaaaaaatcaaaaggcaaatgtgatgtgtgaaaataaaattacataatctactttgtagtgcaaaaagttcaggctgggcaaggtggctcacgcctgtaatcccagcactttgggaagccaaggtgggtggatcacctgaggtcaggagttcaagaccagcctggccaacatggtgaaaccctgtctctataaaaaaaaaaatacaaaaacttagctgggcgtggtggcgcacgcctgtaatcccagctactcgggaggctgaggcaggagaatcgcctgaacccaggaggtggaggttgcaatgagccaagatcatgccattgcactccagcctgggagacaagagagaaactccatctcaaaaaaaaaaaaaagttcagttccaaataatggatgaactcagaacttggaagggtggtgactgcacacatggacagagctgaggcacggcggggtggaggcccctgcggctggcagattcaccggagcctcctcagactgcgcaggagcacagcaagtaaacagctaagctgtgcccatctgaccccagacacgtgtggccacagagaagccccttgccatccattcccccctcctctcctctcctgctcccccacacccctgccttcctccaacatgtttcagccattctcttggccttggtgccctaattggccgttatacaaaaggaagcttcctaacatctcggcgtggcctctctgggagctgtgctattccagacgctctcctgtgcctccagttgtttgcgtgcgccattccttctgcctgaaaacttttttttcttcaatgtttcattaggaaaagttttccaacacacagcacactggaaagaattttgcagggagtcgcacacgcccagcacttgggttctcctgttggcatcctccggccagatgcattcatcccatttcgcccggcccgtttgtctctgtccatccgtcaagctttcttgacttcttggtgcattttcaggcaaaccgcagacgccaacactcccctcgctgcctgggttgctgcctggcgtccattgttcacaggcggtcacctgaggggaggccaacgctcggacagctgcgctcacctgcagatccgacccctgccgacgacgtggggcctcgccctgcaagcccgctgcccctccgggtgcccctgcgctctgcctcccggctctctgactcttctccctcagggtgagctgtgcaggctatggggagcctctctctgtgctgaaggccccggccgtcctctttctttcagggccctacccctgtgggaaacagaccctggaacgcaggaagaggtcagtggcccaggccaccagcagcagcggggaggcccctgacagcatcacatggaagccatatgatgcagccgacctggaccccaccgagaaccccttcgacctgcttgacttcaaccagacgcagcctgagaggggcgacaacaacctcaccaggatcgtgggaggccaggaatgcaaggacggggagtgtccctggcaggtaacagtaggatgtcccctcgggcctgctggagagaccacctgtcccgctgtgcacctcggggaggccagcctgacacttggaatagcaatccgggaaggaactgttccgaactaggacagaggggctccgccacccaagcctgcctgcctgtcccctccctccgggcagccaaggaggctgtgagctccacagggaagtggccggggctgagggagaggctgggcccaggcaacgcccccctcagccccttcccactgggcatttccatggctgcccgtggcatgcccaggacgatgctgtcctgtgaaacagaagagagggagaaggcgcagccacacgctcaagtgtcctcaaacctcccctacaccaggagacaaggctaaagccagggagccacccacactgcaggggcatcagcgggcaggaggacggtgccgggtgggcaaggcctccatctgctcttctgtttgacgggaggcagaaagagttggtgtcctcgcttcatttctaattttggaatttttttacccaaacacctaaatcctatggaggtagatagtaccttagagaaaaacacatctacttattttcaaaggtaaaaaagaaaatcactctttgaggcttttttgttaagagacagtaccttgctctgttgcccaggctggagtgcagtgtcgcgatctcggctcactgcaacctccacctcctgggttcaagcgattctcatgcctcagactcccaagtagctggaattacgggcgcccgctacttacgcctggctaatttttttttttttttgagacggagtctcactctgtcgcccaggctggagtgcagtggcgcgatctcggctcactgcaacctccacctcccaggttcatgtcattctcctgcttcagcctcccgagtagctgggactacaggcgcctgccaccacgcccagctaattttttttgtatttttagtagagacggggtttcaccgtgttagccaggatggtctccatctcctgacctggtgatctgcccacctcagcctcccaaagtgctgggattacaggcgtgagacaatgtgcccggccatgcctggctaatttttttatttttaatagagacaggaatttcaccatgttggccaggctggtctcaaactccaggcctcatgtgatccaccctcctcagccacccaaagtgctggagttacaggtgtgagccactataccaggtcctaatctttgattgttgatttggactaatgctgccagattaaacaaataaaagcacaatactttcaattaaatttcaatttcacataaactagaaatacattaaacaaaagcacaatactttcaattaaatttcaatttcacataaactagaaatactttcagtgtaagtatgttccaagtatcgcatgaagcatacatatgcgaaaaattatttgctgtttatctgattcaagtcaaactaggtgtattagtcagttttcacactgctgacacatacatacccgagactgggtaatttataaagaaaaagaggttgaatgaactcacagttccacgtggctggggaggcctcaccgtcacggtggaaggcgcaaggcacgtcttacatggcggcagcaagacagagaatgagagaacaagcaaaaggggtttccccttagaaaaccatcagctcttgtgagacttattcacttccaccagaacagcatggggaaaccgccctcacgattcagttacctcccaccaggtccctcccacaacacacgggaaatatgggagctacagtttgagatgagatttgggtggggacacagccaaaccttgttgctgggcatcctgtattttctctggcaatcctcacttggacttgaattttcagcgcccaaaaccagaatgtcctctcctacaagcaagaatctcagagctgccagcgcccccatgaattcccccaggtcttcccccaccccagaccgtgtggcgggtgagcctctgtctaactataaagagccaagcgagagagggatgcactgaggtggctctgcaatgcatgtttgttgagggccttctgtgtgtcaggcactgagccgggtgctgtgtaggtgggatatgaaaccatgaagcctctctgtgaccaatacacagaaatctcaacctagttagggagctgagaccgaaatcctcccagtcccaggcactgtgtggttggggcaagaacctcgatgcaggagaccccaccgaggatgagcaggaaaagcctcttgtggggctgaggagctggacttggagctgcaggcggggttttggaggggttcctgggctgggggaccagggtggggcgccctggagggctcactggaggggccctcgcccagcctgttgaggtttgcgattcttgtttcctggttcgagtcttggcaagtgggcctcatctgcatctttaggaagaatggttggtgttcgtgtcttagaaagcctgactttccctcatgtaagctggatgatgagttgacaaattatgcaaaaaagaggcaaaaacatgaccccttttctagccatgaatgttttaagaaatgttttaagactcggtattgtcagtagtttcattggtctgtacatgtgcccagccactatcacaggacgggaaactccccagagaaaagaaaaccaaaatatgcccgggctccaaacttgcaagtccagctccctagggacagcatgtggcacccctgtcagtgcttgctcccctgggaccgtgttccaagtcctggcaggtaggagacccttcacaggagctgccacagggacccccaggaagtcacctgggatggaggtgtccgtgcaccatgggggacaggctcacactgctgaaccgtcgggacaccaggcaggcacaccggttgaggcagatgatgtttctgcacagactggcgtctcctggtcccaggtagaaatcctgccacagagacgggaaaggctgctcccacagggagcatcttttccaaagcatggacagatgtgtcgtgtgcatgagactttagagagctctgtgatggagttggtagaaagaagagatgactccctatatcagtgagtgtgtggcacaggcagagaaaagagacagacaaggaactgtccttgggtggatggcaggagaccgaagaggacagcttggcatggggagggccgggcagtgccacctgaagagctggcttctcagtcaggcaacacctgtccacctggccagccacactgagcctgtcacgtctgtcacaggccctgctcatcaatgaggaaaacgagggtttctgtggtggaaccattctgagcgagttctacatcctaacggcagcccactgtctctaccaagccaagagattcaaggtgagggtaggtaagtgaccaacagcccccagggccgtggtgaggggcaccgtcactgtctgcttttcagaaaccactaaagctgatggaatttgttgggaacactggttgaaatcctgaaatcctatttgtaggggttaggggcatttcacagaggaagaagatgaggaagcagaggaaggggaagagtggggaggaggacggggaggggaggcgaaccagcccagcccttctcccactgggtgtccaggtctcgggtctccgagtctctgggtcccgggtctctgggtctgcatgtccagctaatgttctgtgtctcagtgtcttttattgggagccttccagacctccctttctctttaacatactctgaacaccaagcacctctgtctcttctatttttatttgtgggattgtttcattaacatctgtctttgtccactagaccctagagctgctcagtacaaacccaacacaagctacaaatgcaagcaatatatgtaaactgatatttttctaacattaaatgttctattatacattttaaaatataaaaaaacaggctgggtgtggtggctcatgcctgtaatcccagcactttgggaggctgaggcgggcagatcacctgaggtcaggagtttgagatcagcctggccagcatggcgaaaccccatctctactaaaaaatacaaaaattagccgggcatggtggcacgggcctgtaatcccagctacttgggaagctgaggcaggagaaccacttgaacccgggaggtggaggttgcagtgagctgagattgtgccattgcactccagcccgggcaacagagcaaaactctgtctcaaaaaaaaaaaaaaaatatatatatatatatatgtatatatatatgtgtatatatatatacatatatatacacacacacacacaatttccataatatatcttatttaactcaacatattgaaaatattactttttccatgtgtaatcatgttaaaggtgtaataacacattccgcacattttctttcatgctaagtctctattttacgttcatggcacaactattttacactctcagccagcggccacaccgcacaacctgggtctgggatgccaaaagccttcggtcctgggacgcctcgttggtgcccacgactggcacagacgatgcacccgccaaaggacacaggagtggcggccgtctaaagaaccaaacgtgtgagacaggaccagtggttccctgggcagcaaggctgacaggcacttttatttgctgctttgcacttccctctatttttcaaattttcaaaagtgatcacgtgccatttttaatttaaaaaaatatatataacttccttaaaaagcaacggatgtgcgagagcatgtccctggctgagctgagcacagtcccactcgtctgtcccaggggaccggaacacggagcaggaggagggcggtgaggcggtgcacgaggtggaggtggtcatcaagcacaaccggttcacaaaggagacctatgacttcgacatcgccgtgctccggctcaagacccccatcaccttccgcatgaacgtggcgcctgcctgcctccccgagcgtgactgggccgagtccacgctgatgacgcagaagacggggattgtgagcggcttcgggcgcacccacgagaagggccggcagtccaccaggctcaagatgctggaggtgccctacgtggaccgcaacagctgcaagctgtccagcagcttcatcatcacccagaacatgttctgtgccggctacgacaccaagcaggaggatgcctgccagggggacagcgggggcccgcacgtcacccgcttcaaggacacctacttcgtgacaggcatcgtcagctggggagagggctgtgcccgtaaggggaagtacgggatctacaccaaggtcaccgccttcctcaagtggatcgacaggtccatgaaaaccaggggcttgcccaaggccaagagccatgccccggaggtcataacgtcctctccattaaagtgagatcccactc

SEQ ID NO: 36783 - DNA, 31788 bp, Homo sapiens
ggcaaagaagaaccatgaggctcatcctgcctgtgggtttgattgctaccactcttgcaattgctcctgtccgctttgacaggtaaatcttacttcctgtgttccagtctctgtgtagaagagaattaaaggttgtttccttacagttcactttttttttttcatttgcctccacaaagggagaaggtgttccgcgtgaagccccaggatgaaaaacaagcagacatcataaaggacttggccaaaaccaatgaggtaagcatttagagggatattttatcttttcttactgttctctaaaagatgcttcttcttattttactgtcaatgcccatgggactacaaaagactattgaacataaggggaaagcaggagctatctggataattcagccaatggccaatacttcacctgttctggttttggtcttggtttccaagactaccacttctgtttttcctcccaaaagcttttcaaacaccagctttttcaaggtaaaactatgaaatcaggagctgttcttggcctccttatcagggcatctttctcttgcctacgggtgccattccctctccattctccccactccgaccctcatctcctctggtgccataatttctcttgagtactaactgaaaacgttgaggcactggctaatatcaagatgtgaccctttccaagagcaggtacattttcaaataagacttttaaagttagatcaatcctttaaaatccaacagcctaatataattttatcatgtattcagctgctcctatttatgttgcaccagccaccttatatatgccatttcaaattctccagcagattctcaatgtcagggttataatgtaactcatttgaaacagaagagctaaagtgcaaagacaataaattaaatgaccaagattacacatcaaatttaaacccagaactgggtctgggatttattccagtcaaacatacagttacctctacatcaaatcaatcaaaggccctgcctattctaactcccaaatgtttctcaaatccacacattgccctccattccactgccactgccaagttcatgttcactctacctcttgcaaggagaatttccatagtcccttaactagcaatcagggctctagtcttgactcccacaaagccaactctgcattgcaacctgattgctcactctaaaacttgacaattgcattcctccgtttgagggtcattactaagaagcagcctagtacggaaaaagcattttcttcaaagtcaaacgcttacattcaaatccaagctctacgctagctctgtagccttaggcaacttactcaacatctctgggtctcaatttcttctgctataaaatggggataatagtcatagctacttcctagggttgctacaaagactaagtaagcgtttgatagcacttagaagcaggcctgccatattaagcaccatagaagcgttttttgtttgttattgtttttgttttgagacagagtctcactctgtcacccaggctggagtgcagtggcacaatctctgcagcctccgactcccaggttcaagcgattcacctgcctcagcctccctattagctgggattacaggtgcccaccaccatccccggctaatttttgtgtttttagtgaagacggggttttgccatgttgcccagctggtctcaaactcctgacctcaagtgatccacccgcctcagcctcccaaaatgctgggattacaggcatgagccaccatgcccagtcagaagcattttcttttggtattggtatagcattcaaagcgttttatgatctgccaaactaccagcctcttcaatatcctgctcctccaccttcttccacacccttcaagccccataaacaccaaaatctcacccaccttggccctgtacatcttttctcatgaaaatgtgtttctctcccttttgacctgggtaagtcctacttatttctcaagatccaactcaggcagtgtctcctgcaggacgtctcttctgttcatcaactctcgtgactcagttttggctgctccttgtgctcctggaatacccggttccttcctctggcattggttaacatgtgggaaacatgcatgtatgactctgtgttccacaccaaacctttcacatctcataagtcccttattagtctctacaactgtggcacccagctctttgcctcctgcttaatacatgaaagttcactaagctctaagctcctgctgcacattaccctgctagaacacagaaatgtctattgtgataagatggctctgcctaacttgcctttgcatcacactacatctctcatatgtccaactcatgatgtagctttttgatcaaaataaacattggttggttcatagcagcctcatattgtcacttgattgacctcgaggtagagggggactcaaccaagaaacagccaggcagacctgaacacatacacaagcaggggtggaaattgagcttttccttcacatttcccaggctggggacttgtacttcatttagtttcacaattgagtatgattttgaagaaccacaagaactggaatcttttcaatgtttgcttttgtttttgttttttgtgttttttctgagacagagttttgctcttgttgcccaggctggagtgcaatagcgagatctcggctcactgcaacctccacctcccaggttcaagcaattctcctgcatcagcctcccgagtagctgagattacaggcatgtgccaccatgcctggctaattctctatttttaatagaagtggggtttctccatgttggtcaggctggtctcgaactcccgacctcaggtgatccgcacctcagccttccaaagtgctgggattacagtcgtgagccacaacacccagcctcgaaattattttgatctgaatgctatacttctgagctcatataccaaatttttgaaattgtcagctagaggaagagaaaggaaaaaaaaatctgcacctgttaactgtcttcatgccccagacctcagacctatttcacaatcttcacaacacttcccagtggaccctcatttgccccattatttcaggagagaggagtaaaatttaaagagtcctagtaacttgcccaaggacatattgctagaaaaatgactttgctgggggtctatgccaactgtttgatacaatatcttgtatcaggatttccagagtttatagggacatcaggttttgaggactaactaaccagatatttaacttaaatttccaattagaggcagattctgtggctagatgaattgtgatcccattcaatcccaaaattgtggaagaaaaaaattaaccaaaagatctgcccatcctttttaacttgatagacctgaagtccttaaaaaaaaaaaaagtgatcaggcactaggaaggtttctttcctcctccctaatattcaacagttcttaaatatatttgcaaaaatcccataaacttattaaaagaagggtctgtatcttagttatgctgagccccaaattcctttcatggtgtatgagacatgatcatttcttaatcaataagtgttgggtaagcaaataaactctgactaacattgagcttatctctgcagcttgacttctggtatccaggtgccacccaccacgtagctgctaatatgatggtggatttccgagttagtgagaaggaatcccaagccatccagtctgccttggatcaaaataaaatgcactatgagtaagtccttggcaaatattgaaatttgttggatattcaaagttttgggagccttgaagtagaggaaagtattacaatggacctatttttaattgggccccccagaacgaaagctctttctgtaagatacagatcacagttacttccaaacacattatcgaagcctgtttacagaggtgatagaatcaaacttggcagttcaacatctaccttacatttgctcttagctataagaataacaattacctatatctaccatctccaaaaccagcccctcataagcacagagcccacatgagcaggcatgaatggtttagccacatgtcatcactactgacaggtaatcggcccagatctcatgagctactggcgctggcctccttttatatatttgaattttcctgatacataaaaggagaccaaaaaaaaaagtcattggtatgtcagaaatacagcaattggtatgtcattggtatgtcagaagtacagcaattaaaaatatacaataaataattctttatgaaaaaaattcttcctcagagaaagcacaagcagagcagtagaatacagtttaaatcaaagagaaaagaatctcaaatagccaaagatgcagaaatgagtcattctggccccacagagaagtaagagaaaatctgaatatattgagcagcaaccatgggccatgcccagtctgggccctgggcagtgaatgagaaggaagcccagcaatgaatatcataaatcaatgtgtaatttagaaaataaaatgtgttggccatgcgcagtggctcacgcctgtaatcccagcactttgggaggccaaggcaggtggctcatgaggtcaggagttagagaccagcctggccaatatggtgacaacccatctctactaaaaatacaaaaattacctgggcgtggtggcgtgtgcctgtagtcccagctactcgggaggctgaggcagaagactcacttgaacctgggaggcagaggttgcagtgagccgagatcgcgccactgcactccagcatgggtgacagagcaagactccatctcaaaaaaaaaaaaaaaaaaaaaaaagaaaatgtgtttttatactttcaaacatttcatagtttgatgtacagagggatcccattttaacttccccaggccatgttatgccaggattcccctttgttgagaccctcattgtcaaaacactgctaaacactagttcattttttttttttgaacttgccattttatacctccattacctgacttggtactttaactcaaaaggtctgcttctggctgagataaagaaagagcctgttgatgtcagtgatgttatattgcagagcaggatttactactgctcaccataaacttgattttatttatgatattgccacaatatctcaaataaactccattgaaatttaaaaatcacgtacataagtgagcaaaaaacattcttattcacggctttaaagataacattctattatttgtgatggttattgatgactttttcggttttgttactgtttcaagaaggttgtggcagaaatgtaaaagttaacaaattgaaaatatataattcacgctgtgcacatgtaccctagaacttaaagtataaaaatatatatttataaaaaaaactaattgataccagcttttaacccttttaacttaatatactaagtttttctgtttttataaatcacatcattaaaattagacacttcaaaaatgtaactacaagactgcagaaatttgtattacattatctgtttacattaaggttcagataatgtattgactctttcatctaaaagaaatcaaccctctatcttaaataacccctggttactgtgtctcttgttttgttttttgagatgaagtctcgctctgtcacccagactggagtgcagtggcgcaatctgggttcactgcaagctccgcctcccgggttcacgccattctcctgcttcagcctcccgagtagcttatactacaggcacctgccaccatgcctggcttttttttgtatttttagtaaagacggggtttcaccatgttagccaggatagtcttgatctcctgaccttgtgatccactcacctcggcctagccaccgcaccaggcctactgtgtctcttgattcacttcattgccagctttctagtatatgtgcctaaattattacactcttcactttacttcaataatatagacctggtctggattcctatgataaactaattcttacaaagcattcagcccaaggtaaaataaagtagtggtgtggccaaattttatataatttggcttgaacagcaaggtaaagaattaggtattatgttttccttaatagccctataacgcagttacaatgtagaaaatgtatctagaaaagctagttgcttggcatgagcatgaatagtggagtaaatcactgtaagacacctaggcaggcagctagcatccttccaatttatcaaatagctcacatcagccttttttctcctttggtcctctaggcctcttctatcctgaaatgattctgattcaactagatgtctaaatccagatcctcaaattagtgtgtttttcactctgtcttatgacaaaggagtttcttgctttctacgtcaagtaccaaagtgttaaattacctacaaaaattggttttatcaaattaaaacatgaattctacaaagtggcccaaatcagccacagttatgggaaagccaaataattagatagttacctccctcagaaatataaatatgtaaagtgataagtgcagacaagaactacttaaaatcttgtctccaagtactaattatatagataattttatttgcatattaattatatgcattacttggtgtcagtcagtaacagaaaagagttctaagaacagaaacatctggtcggacccaggcaccaggctgaattaaaccatattaaaaggctggtttgacacaaagatttacttacacacccttcattagacagggtatatcaactactatttagtttaaagcatctgtgtggtttttctttaatttttagaaaattaagttagtaagccagattttattttaaagtagcatacttgtttctttttttacttatttacaaaatcataaaaggccaagttcaaaaaacaaacaacatggatatactaacaaacccaaacagactggcaaacaaatatcaaagggaaggcacgtccatcggactgagcctctggggcagacactatacttggactcagcagttaaaaatcctagtgtttttaacattgttcacattttagacagtcaatttttaacattgtcttttctttgatcaaaggttaaaattagaaaataaagagttgttaatgaaaggtaactcagaaaacaactattaatataataagaaaactcaaatggtacaattaagtaaaatcttacgaggatccatataagattatgtgagaaatgcaaaagagatctatgccaaactgacacagtgataatcaacacctaatattaatgtctaactgcctaataataatgttcagtcagatacaaattcatattccagggatatacacagtcctatccagtgtttcaatcaaatcattctaatgtgtcattccattcatttttttcttctgcttcacatttttacgtattacttacctaagagtataacatgcatgttatactacaacatgctacatggtacaaatgttgaagttacaattggtcatgtgacaaacaggagtgtggaaggtaggaaagtgggttctgaagcaacgctgtctgggtccagtcccactgaagccatgcattagatactcaacattggcaatttatttaactttgctttacctcatacctcatctataaaatgggaataataatggaatctatttcataggggtttcatgaagattgactgggatcgtaaagttgctgtctgcctggtcctttacttctatgaatacacacacacacacacacacacacacacacacacactcacacagaaacagggaataactagaggctatcaccagatgttccattttcctcccagtgaataaatgagtagtattcctcaaactttgagaaatccatgtcagtaagtgtagaatttgatgtgtggtaaccaaattagggagttaccagggggatattgaatcttagggaaacctgaaaccatgctttttgaatagcaccatatcctgatgtaatgtgggcatcaggagaatccagtcccatttataagtcaccctgacagtgactctgccttcctgaaacatctttccccagtgcatgcacgcgcgcacacgcgcacacacacacacacacacacaccccagagcctacgatagtcacatatattggcccatagttctccagtcctttgttgctttctaaaagcagcaaaggatgggagccttgaaactgtcaaagtagaatttatctcatctcttctctgaacctcttacttgctccctgaccttgggacacagacttccatgagagttggttgattgggccaactgtgcaccaacctccgaagactaaggagagtgcagatctgacggcaatacccaaggatttcactctcatgatgaaggcactattgtacaatggctcacagctacggtgctgatgtcagaccctccaggttcaaattccaacttctgtattttaacagttgtgtccattttggaaactggccaaaccttcataaaaacaagagctgataatggtacccagttaatcatgttgagtgataaaatgtaaatacagtgctgagaaaagtgcctggcacataagaaaggttcagtaaacattaaacatttgtattattcaatactcagtgataattatttatcctttcacctatatttaggaattttcttaaacaaattaagcaaattttggagctcaaaataatatttgagaaaaagtaatttggtttcatttgtttatgcctggctgctggttagtagaagggcttgtgaaaataacatctggccccagttcttaatttccagccttaggcttaatttctagtccctatcagcaacaatctggcaccgttctgatgttctcatgcagctacatcatttgtggaaaggttgtacttcaactcacactgttttttttgctttgttttgtttggttttgttttgctgctgttatcataagagctaaattgatatgtgtaagtctaaaaatattcttagatacaagcttcctgtgactaattaatactgccttatgttacaaatcaacctctgggaccataaaatttctcttctgcctggtttctccacttctattaatgcaggtggagcaaaagccacgtgccctttttagagcttaaagcaattagttatgtctgtaatgaccacccaaaatataatttcaaaccttcccgggttttgtgtgagtttcagtgcaacatgctccacctgattccaaaattgctgtcacaagtttattttctcagaaatcctaggttcatcataagtcaaaagcaaagcatacagtgagttagatatgatgtacataatgatgtgcttgtcagtgctgctaataggaatcaatattcatgagcagtacttggtcccatgtgctaaataaactctaattaagggaatacagcgtttgtgttccacatcagaactcagatcagtcagtcaatcagcaaggagaaaccaacaagtagagtggagctcagcagtgtcagtgtcatagctcattattataagaaattgaagaaatcaaagagtcaaacatctacataccatcaaagcctgctttaaaaacatgttatgactgtaaaatggttgtcgattttatgacccaacttcactattattctgaagttcaatgggagcctgaggccaccaagcacttaggttttacttcatttcatcctcaccacaagcctggtcaccacaattgtaaaagttggaaaactgaggttcagagggtaactaagccacccaagatcacatgttcgtattatgtagctgaactggggttggaacccaagaaggtctgaacacaggtcactcactgcttccttatttgataagatttatagtgacggaaagagtacatgatattgtcccaaagactagagtgaatgttaaaaaatagacttcttcctgcacccaggactcactgctaacagcagaaaaaaaaatacatgtgcatttcattaccaaaaggtgagtaattcctttatttatatagagtcaatgagaaatgagataagccaaataagaaaattgttcagataagtacgacttcaagaaatcctttctttttaatatttttattgaaacatttccattataacgataattttctgccctacaaaatagagtatattgaatatggtttacctttgggtaaagaattatcattatcaatatgaattttcatactgtgctatgagaccactgacccatgttttctaagtccttctgtctagggagttttttaacttttctctttttttttctttttgctgtcagctatcacctactgataacagtgtgttcgctgcttgctttcagcaagtcattttccctagatccaatgcattccttctgggttaaacaagatttttagaacagtatctaaaataagacagacaagattttttgtgagggtatttgtaaatctcctacagctgtaaaataatatttaacaaaataaggaatctaataataggttttaatgcaaccatacatcaacggacaataatttgatcatataaattgatactgccatattaatctcaaagtggcattcaacatcattcttaacagtgaaagataagttttcctgtaaaaagcagaaaaaaagaatgccgtctatggctactattatttatcatagttcagagagttttccaatgcaaaacagcaaggaaaaaaagaaatagttattaagaaaattagaaagtatagatattggcagaagaaataacacagaaaataccctaaaaacataactaaaattcttaaaagtataaagatagttttttaatctaataaaatagctaagtgtaatcaaagtaaatggttttttaatatatgaatactgtaataaccaaaaatgtagtgagaaaaaaagtcaaaaaactggtaaaatatatatatatataaatagatgatcaaaatacttaacattttactgaagaatcaaagatacaattatgttatgatccattattaataaaattcttatatttatttataatttaatgtctatcaaaaaatcccattttttctgatcattctaattcctaaaatgattctgataagacattttttttttttttgagacagagtctcctctgtcacccaggctggagtgcagtggcacaatctcagctcactgcaacctccacctcctgggttcaagcaatttttatgcctcagtcacccgagtagctgagactacaggtgcccactaccacacctggctaacttttgtatttttagtagagatggggtttcaccatgttgcccaggctggtctcaaacttctggcctcatgtgatccaactgcctcagcttcccaaagtgctgggattacaggtgtgaaccaccatgcccagccaagacatttatttaaaataggtgaaattactcaaaatttttggaaaaaaagaataagatacattatccagtattaaattttactgtaattaaatatgatttggtttctattaaggcataagaaaaaagattaatgaagcaaatagaaaattcccagacaaaataaataaaatacttgcatatatgatgatgacattttttaaaaataaatcttgaaatgaggcagtttgtattcaaattcccaactccatctcatacactgtgagtatttaaaccttctgagcactaacttccccatctgtaaagtgataatactgacaagattaattaaataatgtgtataaagcagtacctggcctgtattacacatatggatatctgaatccaagtgaaaacgtcatgtaggcagttggatgtgtaagcctagagttcagaggagagtcaagtataagtgaccatcaggtgaccattacagccactggactccataaaatgatgacatgagatggctcagaaagagatgaaaataggaagatgaggccgggagcaatggctcacgcctgtaatcccagcacttcaggaggctgaggtgggcagatcacctgaggtcaggagttcgaggccagcctgatcaacatggagaaaccccgtctctactcaaaatacaaaattagctggcgtagtggcacatgcctgtaattccagctgctcaggagaccaaagcaggagaatcacttgaacccgggaggtggaggttgtggtgagccgagatcacaccattgcactccagcctgggcaacaagagtgaaactccatctaaaaaaaaaagaaagaaagaaagaaaaaggaaataggaagataaggtgtaagccgtaagcctcttgaccctcaacattagtctcctagtgatttttcccacctcttatttcacccccttcaaatcatgttagccattttctagatccatcactataggcacgttgtttcaacactttgtacctcatttttctcatctgtacaataagcataataatctaatgtgaagattaaatgaattaataatgtacatatggaggtcagagcgatgcctggcacaaggtagtgctaagtacctgcttactattataattatcattattattcaagtttctcccagctcagaaggtgtgaaattataaggtatgatctgtagatgtgtgcatgaaagaatcccttgttgcctgtgtttatgtggatgtagatgtgtgtgtgttttggagaaggatggggagtactatagcagtacaatacgagccacatgcataattttaaaattgtggtaaccacattaaaaaagtaaaaagcaacaggtaaaattaactgtagcaatacattttatttagcccaatatatctgaaatttttattctacacaacataaaacttattagtgagatagtttatatcatttttatactatcttcaaaatctggtgtatattttacacatacagcaatctactcttggacaagccccacttcacatgtcctgtatgcacttggggctagagactatcacactggacagcacagctctagataaatggggagatcagaagccagacacatgatatgtctaaaggagatagctagaggagaataatgaagaaacagagcaaacttgattaaagataaaggagaaggaagagaaatttctgcaaatgaaagataactgtgttttcctttctcatgataaaacatgtattttatcattcccctgtcaaacagaatcttgattcatgatctacaagaagagattgagaaacagtttgatgttaaagaagatatcccaggcaggcacagctacgcaaaatacaataattgggaaaaggtacagtaaaaaatgcctgtacttttttttaagttacccttaatatttattgtcattttgttttcttttattctaatttctcaaaattgattttgctcttaagattgtggcttggactgaaaagatgatggataagtatcctgaaatggtctctcgtattaaaattggatctactgttgaagataatccactatatgttctgaaggtaaaaataactcaagaaccactaattcttattactgttgaaaaacatgaatttaaaagttactttgtaacacaactaagctaattctgagctaatacatattatctctgaaagaatatttaagctctagacatccattaaagaatagaaatgacaagcggttttggtggaaccaagaaagtgtctggataaacatttgtcagagattgcacagtggacaaacccaaacaaatatttcatcccacagctttattacaagagtccatgatgtctctggtataaaaaaaaccctcatcccttaaaatgcagtgaaactgatgaatgaatgtcatgaagggaatttaaatatcatagcatcataggactgtagaacagtgtgttaggcatttcaaccatggattgcttgagggttccctatatcagagccaacaatttccactccattgctgctggatttttgcacatccaaagatactgctccctgaagcagccacttaacaagtgagaagcccatccacatcccaaacccccattcattcattatctccaaccactcaaaacaaacctgcactctcttcaaaatgacagccattcaagtatccagtactatttcccttccccactccaacacaacacaagatcttctccattccagggtaaatatccccagtttacacaaccagaaaaacaaaaggaagtggcagaaacaaaagtgactttataataaatttctcagaacacaggatgttagtaataaaataaaaacaatggactacaaatttttttcaaaatcctaccagctgccctgacactagaaaaattttttgaaaaatatgcattgtaatagattatgaattatgtatagacatttaaggatatgtcccatggtcccttctgagaacaatatgtgcatacatggttctcattcaacaatagacaggggaaataattgctttgagaatatgaatgagttattggtcaacaagggatcaatgtgtgagtttgttcaaaacaatatctcaagtttacttttaaatagattggggaaaagaatgaaagaagaaaggctatttttacggattgtggcattcacgcacgagaatgggtctccccagcattctgccagtggtttgtctatcaggtaagtgaatcagaagactcccaattctcctttgactgccaagtctccagcacttcactaagtggcgacatctttccaaacacgcaattccacttagctagaagagcccatacttggtgctgtcagggaagaaacgctctgaattttactcatcattacagtttttatgaaattgacaacttccctccaaacaattcttaaactcaagctaagagtttatgaaactcacacttttcttgggctatcacatgaaagtttttactgtagtcaagtatggaaaatctgaaacaaccttcacataacctacaaatgtaacttttcttcaatgagctcaaaacatagatatttaattttaattcctctttagataatacattggccgcacatgtacttggaattttaatatttaagtttcctttctgagtgaaaaataactcacttttttcttttttttttttttgagatggagtctcactctgtcacccaggctggaatgcagtggtgcaatctcgtctcactgcaacctccgcctcctgggttcaagcaattctactacctcagtctccaaagtagctggaactacaggcatgcgccaccatgcctggctaatttttgtatttttagtagagactggattttgccatgttggccaggctgttatcaaactcctgatcccaagtaatctgtccccctcggcctcccaaagtgctgggataacaggtatgagccaccacactgggcctacaattcacttttttaaaaggtttatctagtttatatattcaatattcctctcactctattgccaatgtattttgactcctaccatattttaattttctctttctgtcagcttttgcacatggcacagtggtgaaatatgtgtaacaatggttttctgggcatagatatttttctagaaaagaatccaccaggaagtgacctgtagttacttttgctctcccaactgagggccaagagctccccctactcaacacataaaggaatgcacatcacaggtctacaaaaaatcttgtctccaattcagatgtacctagaaggacttcccaagagtggtgagagagattttaggtagctacagaaagtgcatgtgattagagaaatttcagtcagatatagaaaaaaaaaagttgttcaatctctgaattcttgggtattttattaatacaattttttatttaatcctgcttataactatctcacaaattctctccaatattttcatattcctgtgcttacagactctatctatatttatgtaaaagatgtgagagaatcaattaaaaataagttgtattacaaattttccatttggcttccaatctttctatgaaacatatctctcatgctacatttggaatgctataagtctcgataattaaatgctcctttaaagactattcatttccattaatgtcactagtctaaataagttaggtttttttcccctttaaactatatggattgtttatttttgttcattttagggaaaatatgcttgaaaacatgtgaccttgggaagtgactcaagttattactattataaccacagctttccacataatagctaaacttcataccaatagcttaattttttttcacctccgacaggcaaccaaaacttatgggagaaacaaaattatgaccaaactcttggaccgaatgaatttttacattcttcctgtgttcaatgttgatggatatatttggtcatggacaaaggtactgctctctactctcttgtttgcatttagatattatttgctggctttaatacacaatgttatgcattcagcttagggtttaggtaactagttaattctaattcagaaaagtatattttttaaaatctcagtttcaaattaagtatgatttcttggttgcataggtatccttgaaataatataaaatttttgctgctgaagctagttatgtgggaaaatgaaataaagtagtaattacagaggaaatgtatgattgcattatatgatatggcatatctagctaagaataaagccaattaattgattttaaaacaaaaacctttgtatttcatcaattttgaatagaatttgaggtagaatcattgtatcaaaaaaaataaaagagaggtacagatacctatttgtctttttacagtatattttattatcctgcttttgctaaataagaactctcaggcagacactgtcacatcaaattattttctgcaaataatgctccaacagtaaaaatttgacctgcattatatctgaatctatatatggtgaacaagctaatgaagttataatttaaattatggttaatttcagaacaccgttagtcatcttctaatactgtgaactaatcaacagtgtttaaaattaactgaattatttcatcaaagcctaaggatataatattaaaaaccatgattctgaaaatactacaaattataagaaaacaatatttttttctttttataataaagggcctcaagttaactagatagatttcaaataaagttgcagacacctgcagagagaatttgaaatgatcaaattgaaaaatgcaaactgatcttgtgtaaacacttacgtcattcaatctggcagaaccgcatgtggagaaaaaatcgttccaagaaccaaaactccaaatgcatcggcactgacctcaacaggaattttaatgcttcatggaactgtgagtagcagacttgctatcaaggaaaattgctataaggaatatttaggtcccaaacttaactaaaacacctacttgttcagtaaaaatagttatgctttgagtgagtgttaacttttgtatctataacatgaaagacaatcatcactaccattgagggatgtcttgctgtgtggaaggaaatgaggaggaagggactgtttatcaaaccatctcttacttactatatctagtttgctaaaaattaagcacaatccaaatgtataaaaattcagataatctgaataaagacctcagattcctctgcttcctgatgtgagaaatgtcagtggctaaaagcaacatacagacagtttttcagatatttagtgaaaagagtcatctggagcaaagaaagtgaaaaagtttaacagaaatacgatgataagcagaggcctgctacatcagacgatgctttagttgctatacaactatgacttcatcactgcacactttcaaggagaaattaccattgccccaatttatatatttcttctgtgcctaattttgttgaaaacatcacctgagcttttaactgtattctaccataatgaacatagaagagcagcagctatctctaattgagagctttctgctgaaaaaggctgaagaaacttgtgcccagggaaggtaattcacaccagcccccagcgcattagagctggggttgaattagaactggagtgtatctggctccaagtcatggctgcttctgatttattactcctgtggccttgggaaaggacaaggaagtaaacaaggcttagaatattccagtgggctaagtctgttacaatctggcatgtgtgtgcaatgttaatctgtagtgactatgatacaagagacattgaagcagccctgtaaacatgagaggcaaaaacatttaaaacattctgtgaatctataatacattagaagaggcaggagctatatggatggggagcagactgtggtctcatccacctatgtcttctgcagccattcctaacaccaatgacccatgtgcagataactatcggggctctgcaccagagtccgagaaagagacgaaagctgtcactaatttcattagaagccacctgaatgaaatcaaggtttacatcaccttccattcctactcccagatgctattgtttccctatggatatacatcaaaactgccacctaaccatgaggacttggtacgtagacaaaagtttgcacttcatgcatcgacaataccattgactttcagtctgttcttcattaacttgggtatgttgaaagaatttcacattttaatgtcaaagaaaagaactaatgaaatttgccttgaagttaaaatcatgatctttagattgatttttcattgataaaagtatatagataataaattcctttaatgtgattctcaggaggaaaaaaaaatcaggaagaaatgtctaggaaaggcataatagaagtctattacaacacagctcattgtggggtttaacatttaccatgggttgtacggtaaaaccatgcacggaaaaagcccaatagaatagcaaagacatttactagtcctgccccccagatatcagatttaagaagatacattgtatttttatcctgatcaacttggaaattatattcttttacaatccaaagaagattataaatgtttgtgaagcttcttcactaagaatatgttatctttccaaaactatgatccattaagcaccattttgtttataaaaactgatttgataatgtgagctttaaaaaaaaagtctgcatatgggttccaatgaatcacaggaagtgacagagtgaatgggtgcatagagggataaatattttgaattgctatagaagaaaataaataaaacagaaaaagtttagtggcccagatcccatggtgattggcaaatatagcactttcagtaatagctgtggtccaaatactgcctcataaaatattttaaaatttttaagaggttacaattttcattctgacctcagtccattgtatttagcacaacagcatttaatgttaattggagcagagacctgaatcagtcattaaaatcatctccatatatacaacaaagaagacataccagcaatatatggcccatagtcatttattatccaatgtaggtgataatctgagggcgtgagttcaattaatgcataccaatgtacagcactgtgatttcaatccactgttaggaaaatgatattatgggttaaaaaaaatacatatccacaaaaaaaaaaaccactttgagtaaaatgagagttcttgcatagcaactaaattgattaagaaaaaaattatttattggttatatacgttatatgtatagtcttttaaaaatctttgtgagtgcaaatatgttagtaactatattccattaaaattcattctgacaatcactctcatagcacaaaacactaacgtgtattaaaaggtcatgacaaaatgccactctgaaagagacaccctaattaacaactattttaaaaagcggtcaaccacccttcttcccttggtatgctgaagtcagatgagtagagaagatcctgtagcaatatgagcctgttagggaccaaggaatgtaaaacatggaagaaaatggagaaactgtcagaagagacaattatctgaagccaaaaaaattgacaggaaaaataatgtatattttatattttagaagaaaggaatgaggagagagagagaaagaagagtagaaacacaaaatgagatatggcattactgtatataatcgactgcatatttaagtcttttttttttttttttttttttttagacggagtctcgctctgtcaccaggctggagtgcagtggcgcaatcttggctcactacaacctccgactccctggttcaagcgattctcctgcctcagcctcccaagtagctgagactacaggcacatggcaccacccccagctaattttttgtatttttagtagagacggggtttcaccatgctagccaggatggtctccatctcctgacctcatgatctgcccacctcagcctccgcaagtgctgggattacaggcgtgagccaccgtgcccggccaagtctttatacttaccacatatattactgaaaataagtttctcgtttaaccatttattttattttgatcttcaaatgccaaatacctggtaaatttgacttttttcatccctagtaatttacatatttacatatatatatgtatgggctttggttttgttaaaaccaggaactgaattccggcttcaccagttgcaactaaccaggaaatagtactgtccatctcatagggttgttatgagtcttgaaactaaagatcaagggataagcacagtgcctaacctgtaagactccattaaaaaattgcatacatacataattacatattccttggtatttacacagtatcctattatttcactctaactttcctttctctccaggccaaagttgcaaagattggcactgatgttctatcaactcgatatgaaacccgctacatctatggcccaatagaatcaacaatttgtaagtcattcctcttatttactgagcccttttccctaattattttttacaaatattaaagaaaattatggaatttgcaatttaggttagagcatctggaattgctaatttaaattctactttttacaggatattctgaattatacgtgaatctaggggatagattctgaccttttcttgggataagatttttctagaaacaaattatactgaacttttacagggttacaaggtcaacggaagctattaagtcaagacagatttacagtttactttatctaccttcctgtttcccacctgtaccaccaacaatgttgtatccttccaggaactaatgagaattcactggagtgagaaaaaaaaaaaaattagccaggcatggtgacctatgcctgtagtcccagtttctctggaggctggggtgggaagatcatttgggcctgggaggtcaagactgccatgagctgtgatcgtgccacggcactccagcctgggcaacagagcaagacctcatctaaaaaaaatcacataaaagaaattagatggagtagagtctacattttttttaaccatttaactttaactggactctttcttacttgccttgtctacatgtaagtatggtcttttccctagctgaaaaacagctaggataggaaaacagatagaaaatcagtttcagctcctctggtcgtgtaaaacaagttatctctccttctcacttgctccttctcactatgttcagccgaaatctgtatggtgaactagaagggagatcacaagactctagttctgtcacttttgtttcatactctcagcaccatttcttactcttccctatttttaaatttatgttgtctttgtgtgtttttaagttattgacttggatttcttggccttgattttcttgtctcttattctatataaaagaaatcagtaatttttttttctgtaaagggccagatagtaaatagctttggctttgtggaggtacagtttctgttgcaggtactcaaccggagaatcatagctcaaaaacggccatagacaataagtcagcaaatgggtgactatgtgccaataaaacctcattcacagaaacaggaggctgaccaggatttgccaactcccatactttatactaaataatatctgcaaatttttatggagtctttacaagttaggcactgtgcttaccccttgattttcacaatctcaagcttcacaacaaccctatgaggtggggagtagtatttcccagttattagtaaccggcgaagctggaactcaatctcagattttaacaaacaaaagccctgatcctgaccactgcacatactgtttgtgcatttggattttgtagctgaaatatccaggattttctatttgcaatgaacagccaaaaaatccatttgagtatcaccgaagacaattaactcagatcctgggaagtgagaccactttctgctcttacagcaactcccactaagcttagtttgggaattatttagtaaaaactaccttttctccaaaccaagttcaagcttcagttcttagtctcaaaatttatacaaaattccccatgaaacttctcaaaagcaagaattatgcttcagatttcctcttagaccctgtaacatatagtacagtgcacggcatggaacaacagcagaattagttcccataaacttgctcaatgataatggtgtcctggcttattcaaaagaagtgaatgtgagttgaaaccacaacagtactggacttgattaagcctgcatcactctctagaccaaatatccaacagtgtttagcattaagactaccatttaacttttaaaaatttcatgaacaacccttccaccaccaaagatacactcatatttttattacacttttagaatctgtgcattaaaaaatacatatgtgcatatgaattcaggattccttgcaacaattttacctgaccacagtttttaagtcactttcgtattccaagctgaaagtataaactttgaactgaaagtctacatcctcagcaattgcgatggaatttgaaaatgccggaatcaacatatacagtttctaggacttacttattagatgcttctttggcagaactggaaaatgactaaaaaatggacaagtccctttcctcgagcacattcattaacaatcacctatcaaccagtcactgttaaggtgctgaagaaaaagtgtagtgatacagatgatccccagcatccacatagatcttgctacaacctagccatgctggggactcattacacatacaggtggatgaccacaagatttcaaaatacatgttatgtacccagctatgtgagtggacaaaaagtaagcaaagtaaagaacaagaagacagactagaagatcagtttaaaatggcagcccacttagtagatactaataaatagcagggccagattggccacccagacaccacatgagagcaattcctctaagcaagaaaaacccacagatagtcttagaggcaaagaacaaagcattccaaacaggaacaaactttgcaaaaggcaattaaagcatcaaataattatccgtgtgtgtgtatccacaaaagtatgagaatacagagctgtgcatagcattgcattaagacctcttaatgaacaaaaatatatggtgtacctagctagcaggctagcactttggagctttcagagataaatgagaggacttaggacacaataaactactcttaaggaagtcacattctaagtggaaggagcggagagccaaaactaccatagctccatgccatcatgtgtcactttcaaaatggaaagatacagtcaagagggattactattctgtttaactgtgcagcattatttaaaatttttattacattatactacaacattttaaaggcattgagatttagaaagaattgcctttgtcacgcagtgctgcagcagcttgataaacgatcaagatttctagaacagactgctttaataaagcatctgatagaatgttaatcaaacatgcatgagaaacagggtagcaaagcagttgacttggtaagaataaaaaataaaaatgtgattaaagtttagtcattccaataacctgattgtcacttaacatgtccccagatttaggaacagcatctagcatttgtcagtgatttcctgtcttcgacttgatgaagacagaaaaaaaaggactgggggagcattttttaaactcaacttatggaggatctctggcctttagaaaaaaatatatatatgtttgctctttgaacatgagaggcaaacatatcagataagttaaaatcataaattttgaaaccagggagaaacataggcaatgatctattccatggttctcaagcctgacttcccattagaatcatcaggaagctggccaggcctggtggctcacttttgtaatcctagcactttgggaggctgaggagggcggatcacaaggtgaggagtttgagaccagtctggccaacatggtgaaaccccatctctactaaaaatacaaaaattagctgggcgtaatggtgggcacctgtaatcccagctactcagaaggctgaggcaggagaatcacttgaaaccagaaggcggaggttgcagtgagccaagatcacgccactgcacttcagcctgggtgaaagagcaaaactccatctcaaaaaaaaaaaaaaaaaagaatcatcaggaagcttttaaaatacatgaatgattatacccccagcccccagagattctgatttcatcagtctgaggaggagctcggcactcaatttttttttaagtaccttaagtgattctaagatgaaactagggttgagaatcgctgatctaagcaaaacttctcatttatagactgaaattcagatacagaaatatttcatcactttagggcagaagaaaaacaaaaatcagcattcaacaccagagttaaaatggtatacctaccactttgccccaaagcagcaatattgagatggcacaaaaaagtaaatagtaatgtttaatgtgaaatgattatatttgcatataaacagcatatccaatccttcatcatcttagaaataactaaacatagtacctagtgagcaagaatagttatttgagttgataagaaccaagattgcattagtaataaaattcatctgtgagtcacatcatgaattaaaaagttaatttcaaagtacatttcttgtagcttcctttgtgtaccaaaattgctagatctaccactgattctcaacccagtgctctttttccatattctacatattctactttttcaaaatttacattctgaaaaagaaaagttaagacttgtagttcataacaccagatctctacttactaagagacattcaaactgatattacagagaaaatatttcagtgtatgcccatgtatctctggcttcagctcttgcttctaatataattttcacttagtattaatataaaagtacaggttattatattgaatacatttaaataatattttttaaaacgatacaatttttcagaaaacactgtatcaagtaagcaataaatgcagcacacattaagtcaccaacgtcactttatatggatccctttgggctgaaatcagatttctagtttggtacggtttcattttgatttgttctcattgaatttgttgcaaccaatattgtgccttgaaataagtaggaaatattttcttaatgttgaacatactcagaatatgctgtcaacaaaaacaaaattatcttatagaactgagtaaagacttggtattggctagtatatagagtggcacataggtagcacagtacaatgattaacaacatgaactctgaagacaccacctgggcttgaatcctgattcgaccatctactagctatgtgtttttcagcaagttgcttaatctctctgagcctaggtttcttcttcggtaaaatggtaattgttacttacatttgggataggaattaattaaatgagttaacatgcataaagcacatagaagggtacttggtatttagcaagtgattattactgtattttataaatgcatacacatgttttagtaggtacacatggagataaagaaaaggctaagtatcatgttaaacaaattaagttctggccaggcacagtgatgcacacctgtagtcccagctactcaggaggctgaggtggaagtatcacttcagcctgggacgtcgaggatacagtgagccatgatcatgccaccgcactccagccaaggtaacagagcaagaccctgtcacatacacacacacacacacacacacacacacacatacacacacacacacacacaaattctatatttttttctcaaagtaaaaacttgcaatgttgtatttactttatgacttgatatagttttgtttgcaaatttaagatctagaagatatgaaatgtattctacttcatagcatcacataattatgaaaaatcaaattccatatattctcaatcaccactattaatcttaatgacaaactccacataaagtaaatctctcaaaatagaatagccatgccctttaacccttggaaatcacagcagtttactcgactgcaaatagagagctactgcaactaggaactggccaagtttattaaaatgtctaacatatcctaaattacaagacataattcctatttactttacctcctttgctaccaagcttgcatcttagtgtgatttctttctcatgaacttaaatccaactagctaaaagtggcaatctgtttgatcactgaagccagtctctatatttcagctcacgtgctccataaattacatgcaatatttgaccctgttaataacttcttgccattcctttggcttccttgactttgaactctactggttctcttcttcctcctcctcctttttttctactctcccactgactgcttctaaaagtagacattttccaaaaaatagggtacaatatatggatacttcctcaggttctctcctcaggtccctcctcttacttctgactctcctcatcaagaaataacctctatccccacaggctggaatccctcatttgttacctagggcaccaggcaatcaccttttacccactaagtgaaccaaccagaccaaaatagcaatgcaaaggctttgaaaactatattgtcagctgagcacggtggctcatgcctgtaatcttagcactttgggaggccaaggtgggaggatcacctgagaacaggagtccgagaccagcctggccaacatggtgaaacccggtctctactaaaaatacaaaaattagctaggtgtggtggtacgcacctgtagtcccagctactcaagaggccgaggcaggagaattgcttgaacctggaaggcagaggttgcagtgagctgaaatcgtaccactccacttcagtctgggcaacaaagtgagactctatctcaaaaacaacaacaacaacaacaacaaaaaaccaaagcaaaactgtctgggtgtggtggcacatgcctgtaatcccagcactttgggaggccgaggtaggcagattgcctgaggtcaggagttcaagaccagcctgaccaatatggtgaaaccctgtctctactaaaaatacaaaagttagccaggtgtggtggcaggcgcctgtagagaggagaagcacttggacctgggaggcagaggttgcagtgagccaagattgtgtcattgcattctcgcctgggtgacagagtgagactccatctcaaaagaaaaaaaaaaatactatattgtcatcagtatcacaagacacaaaagtaggccagggcctgtttactaaacctgaacagggtgattacctgctaaattgaagatttaagttacaatttattatttaatgtaatagctaaaatgtccagaatataatcaaaaatcgcttgtaatactaaaaacaagaaaaattacagcttgaatacaaaaagataatccacagatgccaacactgagatgattgcagtttcaaacattggaaaagaatttcaaagttgccatcattaaaaaaaaaatgcctcaacaaacaattacagatggccttgaaacaaatgaagaaatggaaactatcatcaaagaaataaatataagatacaaaaaggaaccaaatggaaaccatagaactagaaaatgtaataacttgaacaacaaaaaaactggaagggcttaatagcagaataaatatgacagagggaagaatcagtgaacttaaagacagagcaatataattcactcgctctgaagacagaaaataaacaaaaataaataactaaacaaagcctcaggaacaaatggcataataaaatatccaacattcatgtcatcggtccaaggaaaagataaataaagggaacaggagctggaaaaaaaatgtttgaagaaataaaagctgaaatatcctacatttgacaaagacataaactaacatagtcaagtagctgagtgaaacccaaacaggaataacccagagaaactcacatcaaagtacatcataattaaacttctgaaaactagacaaagaaacaagtcgtaaaaggaatcagacagaaatgatctagagttaaaaacagttccagtgacagcagatttttcatgtgaaaccatggaagtcaaaaggaagtgacattttctcaagtgctgaatgaaaacacctatcaaccctaaattcaataaattcaatgtattgcaaaaatattcagaaatgaaggagggaataagacattctcatacaaagggaaatcagcagatgtgtgccccgcacacctactcttaatggctaaaagaaccctctgaacaagaaggaaataatcacagcaaaaggcttggaactgcagagaggaaggaagaaaaatggattcagtataaataaataaattaaataatagactatctttctccacatgatgattgaatcaaaaattgtaagtctgtttgatgtgatgttcaatgtatgtagagaagtactcaagacaattgtactttaaaagtgggaagggaaaaaggatctgaaaggaagtaaagtttctacacctcacttgacatagtaaaatgtcaataccattagactgtggtaagttatgtatgtgtattatagtacctggagcaaccattaagaaaactaagcaagtgagactataaatcaatcaaatggaatcctaaaaatgtcatgtaaccaagaggaaggtgtaaagcaagaaaaaaaagataaagggataaaaacagaaagaacaaaaaaaaaaaaagaaataatggcatgtttaagtcatatcaataatttacctacacgcactaattaaagacacatgggcagaatgaattttttaaattataattcaacaatatgctgtttataagaaactcatttccaatataacaacacagataagttgaaatgagaatgatggaaaagatatactatgccataggaagaatagctacattaagtatcagataaagtgaatttcagagcaaagaaatttgctagtgacagagacattaacaatgataaaaggatccatcccaccaagaaaataatgatcctaaatgtgtgcacaccaatttcacctatgatgtctatgccaataatttaaacattcatttttccaagctctttcttgaatgtctgattgatgttaaacgtatcactttgtcttcctttgccttttctttttcccatcccaatgctctctgagttcccatttaacagtatgttttttccagctacccagattgaaacatcaatcatttttatgaaatcccaatgtttcttatgtagaatccctcagttgtttctaatgtggtgactctaccctagtcaggctttcatttcacactacttcataactggtttctattcttttcaatccagattaacaaacctaaagtactagaaggcctccaaaagaaaatctaaacacctagtcccgattcacaaggttttccaagctttactcacaaactctcactgctccctttgctctggtccagctggatctcgttggtttctaacaatgcctccatgcttttctatccttgtagttcactggctagaattcctttcttccatctccagctgaaaacacactagcctttcttcaaggctctcctccaataccatctcctccatcatgaaggcagtatttgagctggcactgggcatgaaaggccatactcctcatcaagaataatctcttttttcttttaaatcttggtaaaatattgtaccttttctatggtacttagcatattctgctctgcctctattgacttataccttgacttctgcctcctaaattgtaagttactgaagacaccagtggcatcttctgcatttttgtaccctgcaacaattactctccccagtgccaagaaatgtgtcttgtaaatattaaaggtttaataaatatttggtgaccaatttaagagccaacactatctcttcatcaaaatatcccttctctctttcatcgcagctttgaattcttatctttcaaatttttcagatctttcaaactgttattattagttaaactcattacttgtcctagaacataaatgccttcacatacaaaaaaaaccttttatatcacataaagcaaaatgtgagcacataaatgcaattatgatatgtatatgcacttgtatatgtatatagcctctagatgtgagttatatgtatataacctttagatgtgtgtttatatttccaatgtttttaccaaaaaatagaaccttgagttaaatttcataaaagttgacatggaaattttgaattaggagattaaatatgtctttaaaataactaaattacattttcttggtcttttgactatgaaatagtttaccctagcaacatgaaaaacaagagacctaagctattagaagaaatgcaattctatgtatcttgtgtgtatagtttttccctggtggttttcaacgaccagtgactccttagctggtttcctcagctgctagcacttgctctgggtacttgtcctcaacacgtccatctgcaacaatgtgtgcctaggaaataaactcaacttactactcacccaaccaaaatgtaattttttaaacgcagcacacactgggtggattccaaagtcatgattatgctttactatgcactctgtactattcagaccactactctcattcattactgcaattaactgcacacataactattttttattgctaattatacaccactgatttccactttaaaaaaacattagcatttgtctctaattaaatatttactgcttgtgttttacagacccgatatcaggttcttctttagactgggcttatgacctgggcatcaaacacacatttgcctttgagctccgagataaaggcaaatttggttttctccttccagaatcccggataaagccaacgtgcagagagaccatgctagctgtcaaatttattgccaagtatatcctcaagcatacttcctaaagaactgccctctgtttggaataagccaattaatccttttttgtgcctttcatcagaaagtcaatcttcagttatccccaaatgcagcttctatttcacctgaatccttctcttgctcatttaagtcccatgttactgctgtttgcttttacttactttcagtagcaccataacgaagtagctttaagtgaaaccttttaactacctttctttgctccaagtgaagtttggacccagcagaaagcattattttgaaaggtgatatacagtggggcacagaaaacaaatgaaaaccttcagtttctcacagattttcaccatgtggcttcatcaatttatgtgctaatacaataaaataaaatgcacttaatgct

SEQ ID NO: 36784 - DNA, 200922 bp, Homo sapiens
ccgggaggaagcggccgcgcggcagctgcggggcgtgggggtggtggtggcggcggcggtggtggcggcggcggcggcggcggcagctgaggccgaggaggcggtggctgtggcggacgcagcagcaccccagctagggacagggctccgccgcgcccccttgctggccccatggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccaggtgggtccctccgcctcctgtccctgcgggtctgtggggcagtgtgtgcgggggcggaggttgcgagtggggcgacagggctgcccccagggacccggaggcctcggccagttctgagagagaggactctgcagccggggatggcggcgacgcccttgtccccgggggacaccagcctccttcgcagctcagctcctcgcccagtgctgggtgcgctctccccatcttccttccctgagacagtctgacactctctcccctcccccggccatttctggggttctgcagccgcccagacccaaagtttgtcctgttctggaagtggtgtttgttttggctgctgcctggtttaacctctgctcgctgctcctgcccctccctctcctgagtgggttctcagggtgccttgctgggatttcaacttgaagggtgtgtgtgtccgtagggttcgaggcccagggctgaatgttgtcctctctatgtagttgtaatatataagtatctactatatgtaattgcccataacatatttctaaatattaatattaaatcgaaaaccttaatgacaagttgcagaacagggacacgggactgcaagaggacgtttgtcaagtcaaaaccaaatttcccatttgagattagaggtggacttcagaagtccaccatgggaaacagctgtagtttcccatctatcattacttggacttgaaatagaattgaaaggtaagggatgtcatagctaccaccttttggctgttctatacttggaaaagtactaggggatgatacataccagacgctgtttttgttttgtgctttccttggagcttggagaaagactacttgataagcctttgtctgtcatttcatgtcaccagcacttcatggtgataagactgttaatatcaggttcaaaacgtgaaatgaagcttttcctaaaagcaatagtatgaatgttattaacaccaatggaatatttagagtggcgagtggtattttaaaatctagtttcaaaggagaactgagggttttatggttcacttgcaatgtcattgtgttcatacgtatttttaaaaaaattgcttaagactgcgttttatactgctggagtgtttttactgctatatgtttgtgagcataactttagacactttgtaatctttcacccttttgaatttgggatttctgaaactgtaactagtattcacagaacttagcatggctgtttatccctaaagaagtccttgatatgtagacagttctgccattgctgatgagtagttgagctggatcaggtaaagagaaagtcagtgtcttaaaacacaaaccgtggctattacatgaggccctcagaatagtcccgagcataatacatttattcagtgctgtagctgcttcccagctgaaagaggaataattgactgaggctatgcagcaagtaagtgacagctgggtacctattaaggcttattttgttgtcagtaatgcatcggataagaggaggtgggcatagtaaatctgaatatgttggttgatgcctctttaggaattgggaagaaggatttcctgatgttagaacccatgctttcttgaggtacatatagttttaaaaggacccaaggcacagtggctgtgcgtgaatgagattatatttttgatgtccagttgaaatctgcttgcaaaagactgcttcagatactggcaaaaggggacatccctgcgagattgcttggagtaaatctctcagagctcgaagctcccttattcagcctagcaaagcaaaacacatcatccacctttaatccaacaaaattaccataactcaatattcttggtacaggtgaaaatgaacattgaaggcatcctggacatgtgatcctaagagagtcaaacaaagtcagcaaccagcagacacctaattttcacccatcactttggtggtggtggtggtggtggtggtggtggtggtgtgtgtatgctccatccactttaatttgcattaccccatcagtgtattagccattctttaaaacaaacgtagatgtttttaccctttctctgttaaacaggaacctgtaagttgagatttaagtgccccaacaggtataactgctcaaatcttggaggcactaaccagtcctgatattttctatggtaacaaccaggttttcctcttaataagcatacaattaagattaccataataatgttccaggaagagtgagaatcttgcattcttaccacaagtaaatggtctataaaaatacttattttttatttatttattttttgagatggagtctcgttctgttgcccaggctggagtgcggtggcgtgatcttggctcactgcaacctctgcctcccgggttcaagcgattcttccgcctcagcctcctgagtagctgggactacaggcgcacgccacctctcccggctaatttttgcatttttagtagagacggcgttttgccatgttggccaggctggtctcgaactcctgacttcaggtgatccacccgcctcagcctcccaaagtgctgggattacaggcgtgagccaccatgcctggccttaacatattttttaatagactatttttttttttcagagcagttttaggttcacagcaaaatttagcagagtacccatatatcccctgccccgacacacccgtagctttccttactctcaacgtcccacatcagaataatagagtttttacaattgatgaacctacattgacacctcattattccccaaagtctatatattagggctcactcttggtgttgtacattctgtgggtttggacaaatgtataatgacggttccaccattgtagtatcatacagaatagtttcactgctctaaaaatctgtgctctattgattcatccctccctctccactaacatgtggcaatcactgattttttttttttttttactgtccccatagttttgccttttttagaatgtcatatagttggagtcatacagtatataggcttttcactttggcttctttcatgtagtactatgcacttaaaattccttcatgtctttttatggtttggtggctcatttctttatagtgctgaataatattccattgtctgcatgtactacaatttatttattcacctactgaaggatatcttggttgcttccaagtttgggcaattatggataaagctgttataaacatctgtatgcagccttttttgttacatgcaggagataagcttttgactcatttgggtaaatagcaaggggcatgattgctagattgtatggtgagagtatatttagttttataagaaactgccaaactgctttccaaagtgattgtaccattttgcgttcccatcagcaatgcattggtttctttacagagtatttattttcctttgctgacttattttaacagcaggattctagcactaggtggaaaacgtatatgagtttctgatgtgtgtcaggtactgtcctaggtgctgaggttataatagtgaatccaacacaatctctgtcttcatggagcttatgttctcatgtgaatgtttttacacttcagagtttttatttggttgagaaaagacttgaaatataacatccaaaaataaaatgtcagcctggtgctgtggcgcacgcctgtagtcccagtgctttgggagaccaaggatgggaggattgcttgaggccaggactttgagatcagcctgggtaacatagtgagaccctgtctctacacaaaataaaatagccgggcatggtggcatgcgcttgtagtcctagctactctggaggctgaggcaggagaattgcttgagcccaggagttcaaggttatagtgaactatgatcgcaccattgctctccagcgtaggcaacagagcaaaaccctgtatcaaaataaagtaaaataagcctgtcaaacccaaaccaaatacatgtcaaacccagacctgattcttaccacacactatgccttctagtaaaattctggcctttgaataccaacaaaatacttcataacctgggaaaccaactactctaacgtttgttgctctgtcttgaaatactaaacaaaaccatttacctgttcgtagacatattttctttttctagtttaaaagtatcccattctgccattttccacctagtgctagaatcctgctcttaaaataagtcagcacagggaaataaatactctataaagagaccaaaagacctttcaaaataggctatggccaggcccagtggctcacgcctataaatcccagcactttgggagtctgaggtcggaggattacttgagcccaggagttctagactagcctgggcaagatggcaaaaccccatctacacacacacacacacacacacacacacacacacacacacacacacacacacacacacacccccgctacctacctctctctggggcatgcctgtagtcccagctattctggaggctgaggtgggaggatcccttgagcccaggagtttgaggctgcaatgagccattatgacaccactgcactccagcctgggtgaaagagccagaccctgtctcataaaataaataagtaaataaataaaatatctaccttaaagcagcaagttttgtatttgatgtaatgaattaacagaccgctttataatatctatcttttaggatagtgtcagtctcttggaatgctgtgcatgagtcatcattaaaattggttttcattaaaaaaatttttttaacatatacacatcttattggagttttcttttaaaattcaaaaatgggaacattattttttcaaagccaagtaacagaagagtatataaaaaagtcaattttgtgcatatctttttacattttctatgctcatgtaaaacatacatgacttatgtaattatacacatatgctccagatctcatctgtattaattttttaaattatactttagttctgggatacacttggagaacgtgcagttttgttacataggtatatatatgtgccatggtgatttgctgcacccatcaacccatcatctacattaggtatttctcctaatgctatctctcccctagccctgcacccctgaataggccccggtgtgtgatgtttccctccctgtgtccatgttttctcattgttcagctcccacttatgagtgagaacatgcggtgtttggttttctgttcctgtgttagtttgctgagaatgatggtttccggcttcatccatgttggttttcatttttgtgatagttaattcttggacattaaggggaataattataaaacactgttgcttccatatcaagggaaatcactgaatgattaaaaaaaacccaataagtgttgtctgattgtttaaacagctttcattgaggtaaataagtaaaacaaagctgtgagaagtagggaatatttaaacaatttgtgcgcatgccctcacctttggggagaagtcttttctgaaggctctcttctgattttttgaagcaactgtttaatcattaaagaaaattataggtaaaagacaaattcttgtgaactttcgctcattgctagattattaggcagaactattttttaaaaatttaaatgaaacaactttatatttttacatctttagatcatatcattttgtaactatactttagggaaatagaggccagcatattaaaacagtaactaggggctgggcagggtggctcattgcctgtaatcctagcactttgggaggccgaggcgggcagatcagctgaggtcaggagtttgaaaccagcctggccaacatagcgaaaccccatctctactaaaaatacaaaaattagcaggagaattgcttgaaccggagaggcgaaggttgcagtgagctgagatcaggccattgcactccagcctgggagacaagagtgaaactctgtctcaaaaacaaacaaaccaaaaaacaaacacacacacacacacacacacacacacacacacacacacacacaaacacacaaaccagtaactaggactaactatatgctgttttagattgacagtattctttttttctaaaagagaatgaatgccagcagatgtaggaagtaccagagctaaaccattgcctggttaaaaggagtacctctgcataatagttacttgttgactcttttgtaataaaatatttcaggcatgtaaaactagacagttacccaagaaataactgtgtatccaccactccgtataagtaaaacagcccagctagagtgaaagcctgctatgtccccttctctggtcccattcccctccctccctaccctggagttaccagagtcctgaatttggtgtgcatgatttgaagatttctttctacttttattgtatgtatatgtggatatatatatttgtgtatatataaatcactaaaaaagatattattttggatgtcttttcaacttaaggaatatcgtattctgtgtaaccttctgcaacttgcttttcctctcattgttttgtttttggaattcatcttgttgacacatgtaatttcagttcatttatgtttccttttaaaaaatctttactacttacgtttacaatgactcattgttacagtgcggtagagacccttatgccaaaaggaagtaggtggcatttttccttatttatatagaatgtcacatgactgggggactgttcgaaacgtgtatgaaaattaagaacaccttcatagatagcagaatgcacacttatattcttgagcgtgctaggggatgtttgagctaattaattgactttcatgggctttctttttttctcatcttttatttttttgagacagggtcttgctgtgtcacccagactggaatgcagcaatctgatcatgactcactgtaccctcaacctcctgggctcaagcaatcttcctgcctcaggctcccgagtagctgggaatacaggtgtgcagcaccaagcctggctaattttctttttaaaaatttgttgtggagatggtgtctcattatgttgcccagcctggtctcaaactcttgggctcaagtgatctcccgcctcagcctcccaaagtgttgggattacaggtgtgagccaccacaccctgccatttttcatctttttaaaaatggaacatctcaaataagcaagtagatagaataatgcattaaaccctgctgcacttgccactcaggcccaacaactgtcaatgcaaggttaattcaattccatctacatttctatctttgttccctctcacctttgttatcctgaagcaagtcgcaaacatcatatggttcatagggcttatctttaaggaaggaaccagggtgggcagaaggaaatggaaacatgcaggggtttaggttggccagaaaaggtacctgtggcctatggtcaaatggcaagactgatgatggttcaatactgtcaagcctttggctgtcatggagatagacgtgcttgagaactgatttagaatagttgggaaacctgtagggagattgaaaaagtaaccaactgaagaccaggaatacaagatggatttgaatattgttctagcttcacactcctaagtaggggctgtcctattttaagggtgtagacaattggttttgaggaaatcttgggttgtttttgctaattatttataactttttttttttttttttttttttgagacagagtcttgctctgtcgcccgggctgaagtgcagtggcgcaaggtcggctcactgcaacctccgcctcccaggttcaagcagttctccctgcctcagccttctgagtagctgggactacaggcgcccaccaccatgcctggctaatttttatattttttagtagagatggggtttcgccatgttgactaggctggtcttgaactcctgacctcaggtgatctgcccaccctggcctcccaaagtgctgggattacaggtgtgagccaccgcgcctggcctatttataactttaaaaagagggtttggttcctttccagggtttttcaaactttctgtttgtttcgtataggcaagtttctcatgttttgtattgatggcattctattattcatacctatctgttggtgggcaactaatcaacctgggttgcgcaggactgaaggatttcctgggggcatggaacttcagtcttcagacagtcctaggcaaactgggatggtcaccccctctcttggttgctgcattagttatctattgctctataatgaattaccacaaacttagcagcttaaagcagcacacagttattatctcccagtttctgtgggttcgggagtctggacatggctcagttgggtcctcagctcagagtttcataaagccacaatcaaggtgtctggagcttggagtcctctgtggaggtccaacacttggttgcagaattcagttccttgtgattttagaactgaggctctcaacttcgaggcttcctgcagttccctccacatggccttctccataggcaattcacaacatggctcttggcttcttcaaggccagcaggagagtgtctctctccagttagctcagacacctttgccatagtccattagttagaagcaagtcacaggttttgtctgctctcaaggggaggggattatacaaaacaacagagaccaggaggtgagaattttgcgggggacaccttaggatctttccaccacacttgctttccaggatttgtctgaagtagaaaattattctgttgagcctttttgtggccagaatatacatatgttttgctcagccactaatttagaattcctttatctttttaagaaacattttcatgcgtaattcatcctaagtagaactggcaaatatgtaacttcttaggtattttcaattttagtctttaggcaattgtttttcctcttaactagtaggaggcaggaaaaaaaagtggaaaagcagatgcaaatgccctgcctggctactcctgcacgcagtgctctaaagcaggccttctcagcctgggttagttcaggggtctgtgaatttagatgtggaaaagaactacatctttttttttttttttactaactgcccttcccccaactgaaattgagcacttccttctattatgcatgtaagcaaaaaaccacagcagtttttttttttttttttttttttttttttttttttgagacagggtcttgctctgtcacccaggctggagtgcaatctcacaattttggttcactgcaacctgtgcctcctgggcccaaatgatccttccatctcagcctcccaagtagctgggactacacgtgcatgccaccacacccagctaatttttgtattttttgtagaaacgggattttgccatgttgcctaggcaacagggttcactgctttcggtcaaatgacagcaatgctgctggcaagtccatggtcaggagtgagattccctcaggctgctgtggtccctcctcctccagtctgtcctgcaggaagctcagagtgaatggatgctcagctgtttcctctgagacctcaccagggacagttcctgcagtcccggctctgagctctgctcctgaccgttttatctggccctctcagctgtgcttcactgcaaaggaggaaggacaaggccctctggagccagtgccagctgcttgtggggcctgttttatttactactgctatctctacttcagagacttgggctaggacatagacttgaagaaaaaagccattttaacagacttgagaaactcagccatcctcataataccattcagaaccaggagaggccattattaacactaggctagtaggaaatgttcactttgactgaattcatttgtaacactttgccactggtttacaagaaaaatactttggttcagtctcctggaggtaggtaattaaatgtttcacctgtgctaattttccaaataattaaagtgaatcccataaatgccagcaattaagaattgttgtttttggccaagtgtggtggctcatgcctgtaattacagcactttgggaggttgaggcgggcggatcacttgaggccatgagtttgaggccaacctgggtaaaatagggagacgctgtctctacaaaaaatacaaaaatcagctgggcttggtggaatgtgcctgtagtcctggctacttggtaggctgaggcaggagaattgcttgaatccgggaggtagaggtttcagtgagccaagattgtgccactgtactccagcctaggcgacagaggcgagattctgtctcaaaaaaaaaaaaaagttgtttcttaagtgcagaccttctgagatgtgtagtgcttgccccatgccttcaaaagaacatatttaatacaataatctctttgtctctcctttacttcaaagtcagccttgtgaaaaacagatgatgatataccaacagttttttgctcttggaggtgtttggtgtgctctgctttttgagttttgttttttggacttctttaaaattattttaaaatgttttaactcctctcctttgcatactctctggtacccttatagtcccaatactgagtaaagcatgtaaaatttagcatgcagatgttttagcctcttttattttttgttcgagatccagattttttagtctcagcatgactgacactttggggctgtatcattctttgttgtggaggactgtcctgtgcattgtaggttgtcaagtaacatccctggtctctacccacaagataccagtagctattcttctcctgattgtgacaacaaaaaatgtttccagacattgtcagatgtctcctcggggcaaaatttagttctacatatatgatgataaaaaccatggtagcagccaacatttgttcactatcatccccattttgaagaaagcaaaaacggaggcactgagggtgaggttcacttacttgcccaaggtcacatagataaaagtcacttcttgaaatacttttcataatatatatgggttgaatctcagtcttaattgaggaggcagactaaaaaagaatgtaaaaacggggagtttcctgatgatgtctcaattgagaggctattgctttcatagtgattctgtgtaaatgctggaattcttgcttaaacggggtgattccatgggcatgtgtctgagtaaaggacttggatcatttctaagaagcttctgtggcatggtgaagcagaacataagacagtctaggatcaaggataactgatcaaactttgaaaccaaggaagccataggaaattggggtaaggctatgtatcacttagggtcccacaggaaatggcatgctcaaagggttttagtgaaaacaggaatgttgaggcacgaagggactagcagcaggaagctattgccattcctagacctggtggggcaaagggaggggagggaatgtcgttgctggagctgtgaaaggtactccctctacaggaacaatagtcatgaaagaatacagcctttgctagaactatggccagagaggggccagtgggatgaggggatgggagagaagtaaccaatttctgtttcctgccctctcatttgctgcagtgccttttgttgttctaacccaactagaagccacaggtaacagagcctgggtgttgaagcttattgaggttagcctcttgcgctgagtggatggaaagggctgagagtggttcaagggggcaaatagagcaacagccagcacaggctatgagcaggagtgggaaacactaccctggatcctaggaaggatggggcatggccagtgataggagcaatgaaagtctttttgtgtgaaaaagagcctggggatacagacctccatgaaggagaagagagggttggataggagtgactggttcatctgaggttcttcctatttctccaaggaagccttgaggaatgtggggttgtctgtttgcatttggatatggaagtatgtgtgtgtgtatacttttatttattttgagacagggtcttgttctgtcacccaggctggagcacagtggcaccatcacagctcactgcagcctctacttcctgggcttaagtggtcctcccacccaggcccccccaggtagctgggaccacaggcatgtaccactatgctcggctgatttttaatattttgtagagacagggtctcactatattcccctggttggcctcactcctgggctcaagtgatcctcccaccttggcctccagaagtgctaggaatacaggtgtaagccactacacccagtctgtttgtatactttttggtcagagtgaggctttccgtgagttggagtgtttgtccttattcatgacactgggaaacatacaacagtggagtgaccctcttgcagattctgctaggagtagctacatatggtgggaaaggttgctatgggaatggagataaattcaaggcagtagagagtgctttataatgtttgggggtatggccaagcattagttttgctttttccttcccagtaggatacgatttctgtagcaattcttccttacccaaaaatagctatatgtgctcccaaaaagaaaaagcccaggaccagatgacttcatggctgaattctaccaaacattcaaagaagagttaatactaatccttcttaaactcttccaaaaaacagaagtagagagagtacttccaaactcattttttgaggccagcatcaccctgatttcaaagccagacaaaagataccaagataccataagaggagaaaaccacaggttagtatctctgttgaacatatatgcaaaaatcctaaataaaatactagcagaccaaatttaacaacacctcaaaaagatgatacaccatgaccaaagtggcacttatccctgagatgcaagattggtttaacgtatataaaacaatcagtgtaatatgccacattaccaaaataagaggtaaaaaacaagccaggtgtggtggctcacacctataatcccaacactttgggaagctgaggtgggaggattgcttgaggccaggagttcaagaccagcctgggcaacatagtgagacactgtctctacaaaaaattaaaaaaaaatgagctgggcatagtggcatgtacctctagtccctgctacttgggaggctgaggcagcaggatcgctggagccgaggattttgaggctgcagtgagcactgattgtgccaccgcactccagttgggcagtacagcaagaccctgtcttcaaagaaaaaaaaagagagaaaaacccatgatcatttcaatacatgtagaaatagcatttgacaaagttcaacagcctttcgtgataaacattttcaacaaaataagtttaaaagggaatttcctcaacacattaaagaccatttatgtagagtccacagctaatatcataatcagtgggagaaaactgaaagctttttttctaagatctggtacaaagcaaggatgcccactcttgccacttttattgaacacagcactggaagtactaacatgagctatcagacaataaaaagagataaaaggcatctaaattgggaaagaagaagtaaaattatccctgtttgtaaatgtcatgatcctatatgtagaaaaccctggactccacaaaagccctcttaagactaataaatgagttcagtaaagttgcatgatacaaaatcagcgtacaaaaatcagttggaaatcaagaaaactgtcccatttatgataacataaaaataataaaatattcaggaatacatttaatgaaggaagtgaaagatctgtacattcaacattataaaatattgatgaaagaaattgaagacacaaataaatggaaagatatgccatgtttatgcattggaaaaattaatagtgttaaattgtccacactacccaaaacaatatacaggttcaatgcaatccctatcaaaataccaatggcatttttcacagaaatagaaaaaacaattctaaaattcatatggtgtgacaaaagacctagaatagccgaaacagtcttgagaaacaaaaacaaggttggaggcatcacacttccttagattataatacagtataaagcagtagaaattatgatagtatatcctggcataaaaacagacatatagatcaatagaatagaacagagatccgagaaatatacagtatatatacagaaatccaagtatatacagtcaactaatttttgacaaggccaccaaggagacacagtggggaaaggatagtctcttcaataaatgatattgggaaaactggatattcacaggcaaaagaatgaagctggatgcttatatacaaaaatcaactcaaaatgtgtctttaaaatatacaacaaaacctgaaaatggaaaagaagacctaaatgttaataactcaaaccattgaactcctagaagaaaacataggggaaaagctccttgatatcggccttggcaatgattttttagacatcacaccaaaagcacaggcaacaaaagcaaaaagaaacaggtggtactacatcagactaaaaagcttctgcatgacaaagggaacaatccgcaaataaaagggcagcctatgaattggaagaaaatatttgcgacccatatatatgataaggagttaatatcaaaaatatataaggaactcccagaactcaatggtaagaaaatgaataacccgattaaaaaataggcaaaggacttgattattcattttcccaaagaagccatacaaatggccagcaggttgtgaaaaggtactcagtatcactaatcataagggaaatggaaatcaaaaccactatgagatatcagctcacaccttttagaatggctattagaaagacaacagataacaaacgttagggtgtggagaaaagagaacccttttatacttttgatgggaatgtagattggtacagccattatggaaaatggtatagaagtgcctcaaaaaattaaaagtagaactaccatatgatccagcaattcctctgctggatatgtacctaaaggaaatgaagtcagtgtgtcaaagaggtatctacactcctgtgttcattgcagcattattcgcaatagccaagatatggaaacaatttaagtgactgttgatggatgagtggctaaaaatatcgtgggatacacacacacacacacacacacacacacacacacacacacacacacacagatgacagaatattattcagccttaaaaaaggagatcatgctatttgtgacaacatggatgaacttatgctaagtaaaataagtgagacacagaaggaaaaatacttcatgatcttatttatctggaacctgaaaaaaagagtcaaatatatagaaacagaatagaaccacggttaccaagggtgggaatggggaggaaataaggcaatgtaggtcaaagtgtacaaacttgcagtgatgtaggctcaataagtctagagatgtacagcaggaggactatagttaacaatattgtattgtatatggaaaatgtgctaagagtagattttaggtgctcttacctcttctccccacaaaggtaactatggaaggtgatgagtatgtcagattgcttactggtagtaatcatttcactatggatatgtatatcaaaacatcatgtcatacatgttaaagttatgccataaaaatagctatatgtgggccaggccaggcatggtggcttatgcctgtaataccagcattttgggaggctgaggcaggaggattgcttgaggccaggagtttaagaccagcctgggcaacgtagtgagaaacctgtctctccaaaaatgtttttaaaagttatctgcgtgtggtagtgcatgcctgtgatcccagctacttgggaggctgaggcaagaggattgcttgagcccgaaaggtagaggctgcagtgacctgcgattgcaccactgcactccagcctgcgtgacagagtgagaccctgtctcttaaaaaaaaaaaagattaaaaaatagttgtatgtgtatatgtatacgttcaggatttgttctatttgttttctttttcttttttttcataggcagtggtcaatggcctaaggatttctttatacattgctcatatccactaaggctctattgagcaaaccacgccttaaaaatcttacaatcctcttcatatattttaaaggcaaatgcaaagaaatagctttgttctgttttgcattcttcatgggttaacatatcttctggaaaacttgttgctatggcaatgggatattatctatcttggtaatgtactacataaaaatagccctttgtgtttgagaatgatgttagtgacaggtggttgggtgaatgtatagcaggctgctttgtcaagaatagtttcccaacattccattgtttaaagttgtgaaatcaaaatgagtataatttttttctctctcaaaatgtaattttatctggaaaaggcaggcagtggtgctctgtttaattatgaattacaagccttcctttgcaggtcaggtcaacatgatgattgaagccacctctcactgtaataagtaaacgacttctctattctttctgtcagggtgtgcagcacaaggttgcgctgggggggccagtagggataattttcccattcttgaacacatcgttcttcctaagcacctcgtacttataaaccaagaagtaggaagtggtcaggtggaagagatgagctctgagctgttaatcaaatccgaatttcttgtaggttcttaggtgaaacagttccttgggaaaggtcagatttccatgttgcttttagtattgaactcacacatatagccaaggatagaatctgacccaaatcttaatttttcctttgaaaaatcctttgggcaatttttttttaatttaatttaattttattattattattattattttttattgatcattcttgggtgtttctcgcagagggggatttggcagggtcacaggacagtagtggagggaaggtcagcagataaacaagtgaacaaaggtctctggttttcctaggcagaggaccctgccgccttccgcagtgtttgtgtccctgggtacttgagattagggagtggtgctgactcttaaggagcatgctgccttcaagcatctgtttaacaaagcacatcttgcaccgcccttaatccattcaaccctgagtggatacagcacatgtttcagagagcaccgggttgggggtaaggtcaccgatcaacaggatcccaaggcagaagaatttttcttagtacagaacaaaatgaaaagtctcccatgtctacctctttccacacagtcacggcaaccatccgatttctcaatcttttccccacctttcccccctttctattctacaaaaccgccattgtcatcatggcccgttctcaatgagctgttgggtacacctcccagacggggtggtggccgggcagaggggctcctcacttcccagtaggtgccgccgggcagaggcgcccctcacctcccggacggggcggctggccggacggggggctgaccccccccacctccctcctggacggggcggctggccgggcagaggggctcctcacttcccagtaggggcggccgggcagaggcgcccctcacctcccggacggggcggctggccgggcggggggctgacccccccacctccctcccggacggggcggctggccgggcagagtggctcctcacttcccagtaggggcagccgggcagaggcgcccctcacttcccggacggggcggctggccaggtggggggctgaccccgccacctccctcccggacggggcggctggccgggcagagtggctcctcacttcccagtaggggcgcccgggcagaggcgcccctcacctcccggacggggcggctggccgggcggggggctgacccccccacctccctcccagatggggcagctggccgggcggggggctgacccccccacctccctcccggacggggcggctggccgggtggggggctgacccccccacctccctcccggacagggcggctggcagggcagagtggctcctcacttcccagtaggggcggctgggcagaggcgcccctcacttcccggacggggcggctggccgggcggggggctgatccccccacctccctcccagacggggcggctggccgggcggggggctgacccccccacctccctcccggacggggcggctggccgggcggggggctgacccccccacctccctcccggacgaggtggctgccgggcggagacgctcctcacttcccagacggggtggctgctgggcggaggggctcctcacttctcagacggggcagctgccgggcggaggggctcctcacttctcagacggggcggttgccaggcagagggtctcctcacttctcagacggggcgtccgggcagagacgctcctcacatcccagacggggtggcagggcagaggtgctccccacatctcagacgatgggcggccgggcagagacgctcctcacttcccagatgtgatggcggccgggaagaggcgctcctcacttcctagatgggatggcggctgggcagaggctgcaatctctgcactttgggaggccaaggcaggctgctgggaggtggaggttgtagtgagctgagatcacgccactgcactccagcctgggcaccattgagcactgagtgaacgagactccgtctgcaatcccggcacctcgggaggccgaggctggcgggtcactcgcggttaggagctggagaccaacccggccaacacagcgaatccccatctccaccaaaaaaatacgaaaaccagtcaggcgtggcggcgcgcgcctgcaattgcaggcactcggcaagctgaggcaggagaatcaggcagggaggttgcagtgagccgagatggcagcagtactgtccagcttcggctcggcatcagagggagactgtggaaagagagggagagggagaccgtggggagagggagagggctgggcaatttcttagagcagtaactctcaaacattttgtcgtcatcatctcacttttcttctacttatcaaaatgagtattgatttaattgtaatgagtaaataacagctccctgctactgaaatgaaatttactctagctttgagaatttgagagaccctcttaagaaaataccacagctggaaatttgagacctaaaagtaatacaatttgagtatctcatatctgaaatgcttgggaccagaagtgttttggattttggattttttcagactttggaatatttgcgtttacataatgagatctcttggggatgggacccaagtctaaacacgaaattcattaatgttttatatacgccttatacacatagcctaaaggtaattttatacaatattttaaataagcttgtgcatgaaacaaaattttgactgtgttttgactgtgacctgtcacataaggtcaggtgtggattttttcatttgtgacttcatgtcaacactcagaaactttcacattttggagcattttggatttcagattagggatgcttaatctgcagctctaattctgatatgcacggtactactgcagagatggaaccattgcctttgtcttttctgttggagtcagtatagatatcttgctactaataatatcagaagagagtgttgagtggtttgctgggtgcccaatactacttttagaacattttatgtattaactaatttattcctgtaaacattcttgacagtttttgtgactatttcccaaatgaggcgtacttgttagcatgtctttctgtttgtggtgagtaagcattcttgtgtattggaagacttgcttactagcatgtcacagtgttcttcatattgaaagcattcttctatcaggagttgacgtaattcagcctgtgggccaaatccatcctgccacccattttttgtgtattttataagctaagaatggtttctgcatttttaaatggttgggaaaacataaaaagaataatttgtgacatgtgaaaattacatgaaatttaaatttcagtttccataaacagttttattggaacacagctttactcatttgtttacatattgctaaggctgcttttgaactagagtggcagagttgagtagttgtaatagagaccatatagctcccagaccctaagaaaaagtttgccaatcccttctctatattcttctgtatctagaatggcagatggtcctcaataataacagcagattggtcaggtgtcatagtttatgcctgtaatcccagcattttgagaggccaaggtgggaggatcacttgagctggagttcaagaccagcctgggcaacacagtgagacctagctctgcaaaaattagccaggtgtcatggtgcacgctggtggtcccagctacttgggaggctgaagtgggaggattgcttgagcctgggaggtcaaggctggagggagacgtgatcacaccattgtgctccagcctgggtgacagagcgagaccctgtctcaaaaatatataaacagattggatttatgtacaggttcatatatatattaattttcttttggtatgcaatatatttttctttcttccactaaacgtttctcttgtcataagcttgatgtcatgtactatggcatatctcaaatatacgtgatttcagctctttgcatacccatattggttttcttttttttttttttaattgatcattcttaggtgtttctcgcagagggggatttggcagggtcacaggacaatagtggagggaaggtcagcagataaacaagtgaacaaaggtctctggttttcctaggcagaggactctgcggccttccgcagtgtttgtgtccctgggtacttgagattagggagcggtgatgactcttaaggagcatgctgccttcaagcatctgtttaacaaagcacatcttgcaccgcccttaatccattcaaccctgagtggacacagcacatgtttcagagagcaccgggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccattgtcatcatggcccgttctcagtgagctgttgggtacacctcccagacggggtggtggccgggcagaggggctcctcacttcccagtaggggcggccgggcagaggcgcccctcacctcccggacggggcggctggccgggcggggggctgacacccccacctccctcccggacggggcggctggccgggcggggggctgacccccccacctccctccgggacggggtggctggctgggcagaggggctcctcacttcccagtaggggcggccaggcagaggcgcccctcacctcctggatggggcggctggccgggcggggggctgacccccccacctccctcccagacggggcggctggccgggcggggggctgaccccccccacctccctcccggacggggcggccggccgggcagaggggctcctcacttcccagtaggggcggccgggcagaggcgcccctcacctcccggatggggtggctggccgggcggggggctgacccccccacctccctcccggacggggtggctgctgggcggagacgttcctcacttcccagacgggatggctgccgggtggaggggctcctcacttctcagacggggcggctgccgggcggaggggcccctcacttctcagacggggcggctgctgggctgaggggctcctcacttttcagacggggcggttgccaggcagagggtctcctcacttctcagacggggcggctgggcagagacgctcctcacatcccggatggggcggcagggcagaggcactccccacatctcagacgatgggcggccgggcagagacgctcctcacttcctagatgggatggcggccgggaagaggcgctcctcacttcctagatgggatggcggccaggcagagacgctcctcactttccagactgggcagccaggcagaggggctcctcacatcccagacgatgggtggccaggcagagacactcctcactttccagacggggtggcggccgggcagaggctgcaatctcggcactttgggaggccaaggcaggctgctgggaggtggaggttgtagcgagccgagatcacgccactgcactccagcctgggcaccattgagcactgagtgaacgagactccgtctgcaatcccggcacctcgggaggccgaggctggcggatcactcccggttaggagctggagaccagcccggccaacacagcgaaaccccgtctccaccaaaaaaatacgaaaaccagtcaggcgtggcggcgcgcgcctgcaattgcaggcactcggcaggctgaggcaggagaatcaggcagggaggttgcagtgagccaagatggcagcagtacagtccagactcccacggcatcagagggagaccgtggaaagagagggagagggagaccgtggggagagggagaccgagagggagagggagagagggagagggagagagggagagggagagagggagagggagagatttggttttcataataatcataaccctttccaaatgagggagagtaatgaattttatcattttattagttagtgtgcttcctttgctagatcaggaattatatctcctagtaattataaccctctatttattatttttaactatattgctttctacttttgggctttcagccaacgtgtaaatattgacagtttaataatctgaaccaagccacctggactgattgtaatattttaatttaataaatcttgcatatggttaagattacatcttctacattcatcagattggatttaatgcactcaccataatcaactctggaacattcttgcaattattattgttatttttaaaggttttctcctttgtctgttgttttcccactttttttttttttttttaagacggaatctccctctgtcacccaggctggagtgcagtggcgtgatctcggctcactgcaacctccgccccctgggttcaagcgattctcctgtctcagcctcctgagtagctgggactacaggcgtgtgccaccacgcccagctaattttttgtatttttagtagagatggggtttcaccatgttggccaggctggtctcaaactcctgacctcaagcagtctgcctgcctcggcctcctgaagtgctgggattataggcgtgagccactgtgcctggcctgttttcccactttttaaagtaacagccttgttgagatgtaattcacataccatatagtcacctatttaaagtgtacaattcagtggttttagtatattcacagaattgtgcaaccatcacaactatttccggaatatttttgtcacccaaaaaagaaaccccatactcactagcaatcacccccagttccaccattcctaggcagccatggatctactttttgtctatggattcgtctattccagacatttcatagaaatgaaaccacatagtgtgtggtcatttgtgattgtcttctttctcttagcgtgttttaaatgtagcacgtatcagcacttcttattgccagttctgctgtatggctataccacattttatttatcaattcatgagttgacagacatttgggtcattttcactttttgcctcttatgtataatgctactctgaacacttgtgtataggtttttgtgtggacatatgtttttatttctgtcgaatatatacctagaggtggaattgttgtgtcgtatggtaactctatgtttaaccttttgaggaactgccaggctcttttgcaaagctgctgtactatttgacattcttgtgagcaatatatgagggttccagtttccccacatccttaccaacgtttgttattgtctatctttttgattatggctatcctagtgggtgtataatggtatctcattgtggttttagttggaatttccctgatgactaataatgttgcatgtcttttcacgtgcttattggccacttgtatatcttctttagagaaatgtgtatttagatcgtttgtccattttaaattgggttgtctttataaaatgttgaattgtaagagttctttatatattctggattcaatacatatgatacaatacatataatacatattttagtcatctatcagataaatgatttgcaaaaattttcttccattttgtgggttgtctttttactttcttgatggtgtcctttgaagcatgaaagcttttaattttgatggagtttatttattgttttctattgtcacttgtgtttttggtgtcatatttaagaaaccattgcctaatccaagatcacaaagatttcacttatgttttcttctaagagttttgtagttttagctcctatatgtcagtctttgattcattttgagttaatttttgtacgtggtgtgaagtaggggtacaacttcatacttttgtatatggatatccacttgtcttagcatcatgttttgaacaaactgttcttttcctaatgaattgttttggaacccttgtgcaaaaccaattgaccttatgtaaatgtaagggcttatgtctagactgtgtcagtatcacactgtcttgatttgtttaatctatttttgaggcagactttcgctccctgatctaaaattaaaatgtttcacaattgatgatgtcttatatgcatcaaaacttgcagactgggtgtaagtggcttgagaaaatatattggagactaaagtggggctgttggagactcataggaatcaaatagttagaaggtgggggagtgagagaggcagtaagttggatgcttcccaggtgtttagcagccatcccaaagtggcagtcaaaaataggctagctttacataatttcaaagttaggtactgatggttccagtttctttttatggattcttttaaaaagtgctgtatcaccaaatgctgttgatggcatagaagacaacactgtggaaaaatgtggacattgaccagtctgagtcaaaaagatggacagatattcagttctaaatgtgaggaatttttaggaaaaccttgagcagttaattttgcttatttccctttctatgtgtatatgaatgataaatgaaaagtctaaaagagctcctttaataagcctgagataaatgctaagtcgtagactactgcatcatatcttatttggcttttttttagtgccacctaaaatactggtgttttagctttgagatgctcttatcctcctgcttccagctctatctacacctcagaaggagctgggtcctttcccagagtctattgtataaattaaccttcttcctgtagtcactctatgtccatctgtttcccagccactttaattttgttctttttcctttctcttgtgcttgtagatttaagtcttaaaaacaagccaggtattattgtttatagtggaattttgagtaggagtggaggttaacctgtacatcaatctagtaggaatattcattcaatcactcaagggatgagcttatggaaaagttacaaaaatagtagcattcctttatattcctcaccctgctcccttaatgttaacattttatataaaggatcaagaataggaaattagtcttggtacagtattattaactaaactacagagcttatttgaattccatcagtttttccactggtggtctatttctgttctaggatcctgtccaggatcccatattgcatttagttattatttctccttagtctcatccagtttgtaataatttcttaatctttaatgacacctttgaagagtacagatcaatattttgtagaatgttcctcaatttgtatttgtttgatgctttcttatgaataaggttgttcatttttggcaagaatataatgatgcatatttttcagtgtatcatatcaaggagttcatgatgttgatgtgtcttgttactggtgacatttaccttgattccttgtttaaattgctgtctgcagggtttctctacagtaaaattattactttttctctttatggttaaaatatcttgggggagatgctttgagactaggcagatatcctatttatcctcaaatttttgtccattgatttttttcattctttggtggatcactctgtatcatagagtatttgtgacaaatatttgattagcagaaataaagctatgccctacaagaagcaaagatcaattacattgaaatcctattgtattggttaatataacgctagcagctgtgttcctcaactttcaggagcttaacacaacagatgcttttcttctcaatatgggcatttctggttgtgtaggcagttttctgccatgttaattcaagtatccagactaaactttttatactgaagtaacttcaaactgacagaaaatagggatgcaagaatagtaccaggaaatcctgtataccctttactagatttacttaacatttgctacatgtgccttatgattttctttgtctattcatatatgtatatgtattttatatatattttatatatctgtatttatatattgattgccatatactaaatcacttgagattaaatcacatacatcatgttcttctatgccttaatagtttaaacttaatatatttatttgtttaaatctagtatacagtttcagaattgctaacccatatctgtttgagaaacactttcactaactggattacagcatttatacaattcttttattctttagttttgcaatatctagtcaagatacgattttccagtttcccactgaagtattaagtttgaaaactgtacataagcacactgttattcaaatttaggaaatttaatatcagtactttagtatgcagtctgtattccagtttcattaattatccccaaaatgttcttcagtggaatattttttttctcctgatacagtatcaagtccaggatcatgtattgaatttatttgtcatgactttttagtttcctttgatctggaacagatcttataagcctttctttgtctttcatgacatcgacattttgaacaatgacaaatttatgacattgttttgtagaatgtaccaaatttgggctgggtgctgtggctcatgcctacaatcctagcactttgggaggctgaggcaggtggattgtctgagttcaggaactcgagaccagcttggccaacatggtgaaaccccatctctactaaaaatacaaaaaacaaaaaaaattagccatggcacctataatcccagctactcaggaggctgaggcaagagaatcgcttgaacccgggaggcagaggttgcagtgagccgagattgcaccactgcactccagcctgggcgacagagctagatgctccatttcaaaaaaaaaaggaacgtaccaaatttgggtttggttgatggctcctcttgtttagattgagattatgcatttttaaaaaaacttttaggttcaggggtacatgtgctgatttgttgtataggtaaattcttgtcacgggggtttgttgtacagattatttcattacccaggtactaaacctagtatgcagtagttttttttttctcttctccctcctgccaccctccatcctccaataggcctcagtgtctgttgttcttctctgtgtgtccatgtgttctcatcacttagctcccacttacaagtgagaacatgcagtatttggttttccgttcctgcattagtttgcttaggataatggcccccagctccatccatgttcctgcaaaggacatgagctcattcttttttatggttgtgtagtattccatggtgtatatgtaccacattttctttatccagtctatcattgatgggcatttaggttgattttatgtttttgctattgtgaatagtgctgcaatgaacatacgcttgcatgtgtctttatggtagaatgatttatattcctttgggtctatacccagtaatggggttgctgggtcgaatggtatttccgtttttaggtctttgaggaatcgccactctgttttccacaatagttgaattaatttacactcctaccagcagtatgtaagcattcctttttctctgcaacctcactggcacctgtttctttttgactttttagtaatagccattcttactgatgtgagatgttatctcattgtggttttgatttgcatttctctaatgatcagtgatgttgtggtttttttttcatctgctcgttagccacgtgtatgtcttcttttgaaaagtgtctgagattatgcatttttgtctggaatactgcataagtgacatgtccttctcaggcaatgcatcaggaggcacatgatgtctcaacccctcattggtgattgtaattttgatcatttggttaaattactgtttgcttaagtgttaactatttttagatatgacgtatcagagtgatcaatactgtgaagcctcttacaacagtgtttagattgaaaaattatgagtgaaaagcctttcacagtcattcggattgaatatgcctaacatgaaatccaaactgtttcaacatttctttcaagtcattttctactatggaaataataatgcatgatttagccatgcctgagttttatttcctcacgcaggcatttatttctttaaaaaatttaatttaaagttcactataaaacttaccattttaaccatttgaagtgtacacttcagtggcattaagtacattcacaatgttgtgcaaccatcactaccatccatctccaggacttctttatcatcccaaacataaaccatatctactaaacagtaactccccaattccttctccagcccctggtaacctcattttatatgccatcacaatattttagaataaacgccaacttcctggggtaagatcatttgacttttgctcccagatcagaactatgataaaaatattatttgctatatactaacagggaaatttctggattttggcatgagttactgtattataactctaaatcctggtaagggaagcatttttattctgaaagtaaacaaaaataaccattagtatgataatctttacctctgggggtggggtattttggagggggtgagtacaaagagaggtgaaattattcctctagggtggcagaccagagtttaaattgtttcttatgtttttcatcttggttgtctaccaattggatatagtcactcagatcatccatgtttttgtacctggtttgataggtataaatacctataaattggaataaattctagcaattagaggtccatgttccttggtctgtaaagtgaatataacaaaactgacttctctccaaagggtgctttgagacaaaactataaaacactttggagagtagaaggggggtccttatttttagtaacattcctcagtgttcttcaagaactcacctactgccaatcattcctctgagttaagaatatatattagaactagttttaatagcactataaactatagatagcatggccatatgtccctgtttgcctggagctgaataaattacaggttcaaaaatactcaaataataaaattgcctaggtggtgacccacctagtttgttgctgtatggtgttgggtatctcttttttttccttgacaaatttgaaaaggccttgaaaccatgagcagattccttggttcagatggtctgtaataggagacaccaggacaagcctgagtctcctgctcttgaaagattagcatattgatagattgcgtacccattatcagttaggtatctgccaaaccatttgcagcgtttctctggagttcatacagttgggaagacttcctagaggcaagaggtcttttacctgaagattcagcagttactataggggccttcttttggcttcttgctcttgggacacctttacttgaatgaggtagtcttttgccattagtgcctgtggggccttaatgattcctattgggatgagttggccagaagtgaggctctccacttcatgttgaaactaacttctgcctgagtattaaggatgggtgattctgaggtcctgagccagctggaaggactttcattcactttctactcttgtctgaagaatgcttaggctaccttactgttacttctctggtggtaccaaaggccatgtaatgacatggctggatgcgatcactcacgtctgtaatcccagcactttgggaggccaaggcaggaggatcacttgagcccaggagttcaaccagcctgggcgacataggaagacccccatctctaaaaaatttttaaaaaatctagctgggcatgttggtatactcctgtagtcccagctactcggcaggctgagatgggaggattgcttgagcttaggcgattgaggctgcggtgaaccatgatcacaccactgcactccagcttgggcaacagagcaagaccctgtctctaaaaaaaaaaaaaaaaaacaaacaaaagatgtgatgattgcctctttcggttatatcctgctgcctaagagcccaccccagaatttagtggcttaggataaccattttcatagttttgtcagtgagggattagggaagatgtcagctgagctcttcatttctgctccagatggcattggttgggcaatgggactggaggttctaattctaagatagcttcttcactcttatgaatagctcctcagtgtctgtggccagtctctctccatgtggtatctcatccaccctggcctttccacatgccttaggcttcccacatcatggtggttcctgggtagttactcttcttacagagtagggatgaaatgaaagcctctattctaaattcagttaaatactggtacaaatatttagtactgggattgtgggatcattttcttatatcataattataacccaatcagggtagaaaagtgaaagaaagaaggacacttcattttctttgctctttgtgtggatgatgggttgtacaaatagcaggaggttcaacttttggcttgttttggattactgagtactatccttcagaaatgatttcctaatactttcccggccatctggcatgagcacagaagaccttttactcaataaaagtaagctaataataataagttgaaacatcttgataataaatatatttgtacagcttttcaaatcccaggttattgaaattctgtcagccttggctggtttccatgctccttctgtgcccttgtgtttcctttttttctttttttttttgttgagccactcctgctgacttccaaaggatgctctgagctctaaaaggaggagcagttttgctggcatgcagaagtggtgaaggtaaggcttggattcaattacagtaatctcagaagttcttggtagaagaggggcacagaatcccagcctccattttgcaggtaaggaagaagaattataaaaagataaaatggcttttcttaatgtcagcatctgattctttaccttctttcaccctagcaaagattgttaacataaaacagatgttccttggacaagagaaaagtaatagagctggatcttttcatgatcctgcatttattatttgtagcactggatctctaaactaggaaaagcaatgtcgattctaactagaaattatggggcatttaataacacgtgaggcaaaattatgaggaaaggcaagaaaccaagtggctcctagcttctaacaccttattttctatggtgtaagttaatgaatgatccatttttaatgccataaaaaaggaaatttccgataggctttaccttaacttcacgttgctgtttatattacagacaaaatgctaaagttaacaagtgtaaaatgccctaggtcagggtttcgagtgcccataagcaattctctagaattattttgagtgctcagattatagatttgcccccataccatatactgtattacctatcactgcaagattctttatagggtgtcaagtatgtgggaggatttaaactaattgtcttaaatgcttcatgggataggagatgatccaatgggaactgaatgttttcaattaggatgtttccatggatactattaagcatgccaagattcatagccacaggagatttttacttacttcaatattgattaagaaatctgagaacaatctcaagaagtgtaggatgtaggcggaggataaattttgaggatagtctaaaatttgctttctcttccatagttaaggcctagtccagaaaaagtctaggcagtcagccaagtctaacagcaggatttatgtcaagagaatgtccagaataaaagtgaacatgggttgtttcatttaccccaggtgtatttattaacatttatttaatgttacttattatttgtttattaccattagctttcttatgtactcggtacaaagcattagaattacaaccctttgtatctttgttgtttatgaggaaaacatcctaaatagtgtctacagacatcttaaaattcacattcctctgagaaaggtttatcccttaggttattacttttttttttttttccacacatgggttttttacctgggttctcagatctccaagaaatcggtggatagaattcaaggtgacttcttggatggagaaaaagtacgtctttattttgaccaaccatggatatttagcattttcatcaattaatgaatgcaggtgacaaatcacagtactattggccccatctttgagtttgtcctcaatagctcacagatattttcatattgtatcacagttgttgcagatatcttgaaatattgtttattctaatcactccttcaaaatttgggtggttattggcattatcaccagttttttttttttttttgaggcagtctttctctgttacccccaggctggagtgcagtggtgtgatcttggctcactgtgacctctgcctcccaggttcaagtgattctcccgcctcagcttcctgagtagctgggattacaggcacatgccaccacggcccggctaatttatttatttatttattctttattttttatttttaaattttttttagatggagtctcactctgtcgccaggctggagtgcagtggtgtgatcttggctcactgcaacctccgcctcccaggttcaagcgattctcctgcctcagcctcccgagtagttgggactacgggagcgtgccaccacgcccagctaatttttctattttaagtagagatggagttttaccatgttggccaggatggtcgcgatctcttgacctcgtgatccacctgcctcggccaaaatgctgggattacaggcgtgagccaccgtgcctggccacattaccaccagttcttgatacttaatgccataacaaaaggcacatgtatcactatatcacaaattagcattttataatattttaataacgttttcaatataagtggcttcccttgtaatcatatattttatttttgcacttaaaaatataattcctaaaagggatccataaagcttcaccagactgccaaagcgtccatggcacaggacgttaagaaccctgttccaaatggaatgaagattagaagcactatcatatgttcattttctgatcgcagtttaagaaagagtttcctacttaagtgcttttcacagaaaatctaaacttaaaggttaaaagggaattcttttgtgctggctcatgtgtgggccctacaaagtactttgcagtcatatctgactttcgtttgagagtttgtcttcagaaatggaagaagaaaaggcattcaggtatatgacaggttgcattctgtagaacattgttaaatctatgggaggggagaaaagttccattcagtgtcttgtggattgtggtaggagtcagttgtgttcttgcagaaatttccctagacagtgcctcttgcctcctcctttcttgtcccacagtactccatggagcagatgtgggaacttggatgcctgatgggaattgtaaccccatgctttgccttatcctggtggggactgatctgaggtttatccattaaactgtatcagttcatggctgggagtaggaatgcagaaaacacaagcaaaatgactgcaggaaggtttaaataaaatctcatatgtggcttttccttaacacattattttgcaaaaagtggcagagtgaatttgctgtgatatgataggatcattctggacttttacttaatttacgtgttctctagcagaatgctgaaggagcacacataaggagtggggagttggtatttggttctgtgacaagtgctatcttataacagaaaaatacatatttttgtgaaacttcaaatgcatttttattccccagcacatctgtgattctggatccactaccttcttccaagtgtgatcaagcactgtacctgacagtatcgattatccttacccgtaggcaaaaattgtattacatttattttacagtgatctggaaaaaaaaggatgacaacaaaaaccagacacacttcatttctattccggtaacattttttggtaataatttattactgtacaagtcacacaccatataagtcacacatttaaagtgtcaaattaaatggtttttagtatattcacaggatcgtgccatcatcacagtcaaatttagaacacttattacccccaacaagaaacctcatacgctttagcagtcaccctccattgccccccagttttctaaccccaggccctaacaaccactaacctactttctgtctctatgaatttgcctcttctggccatttcatataaatggaattacacattttgtaaccttttgtgactggcttttttcacttagcataatgttttttaaggtctacctatattagagtatgtatcagtactttattcctttttatggccaaataatattccattttctggatataccagattttgtttatccattcatctgttgatggacatttgagttgtttccactttgtgctattattatgaataatgctgctatgaacattcatgtttacatcatgtatacattttaatgtggacatatgtttttagttatcttgagtatatacctaggagtggaatcatatatatatgtttttaaaccaaaatcaaattttaatgttgcagaatccctgaagcacttttaggaactgttcacttccatagaacagtttgcaaatcagtgttaaagtggagagagtgttgatttttttgtgcatgtatttggtagacatcgtttgaatcttgattttataggctgtgtgaattttgtcaagttacctgtgaacatctttcttctagtatagaatgttagtacctctggatgtttcacgagttgatagactgtattattgcttgaaaaattcactgtccatttattaccatcaactttggccacggatttgctttggctagtggcctgtgaggggaagtgatgtgtgccttcttccaggcagaagctggtggtttgcctcatctcttttcctttctgccatgatgaccattgatgttccagttggacacaggctccatcagcttgtgtatcagaatgaaaatgatgtggggcagagccctcatagattttgttgcatgagtatggaaaaagtgtcattttaagccgtcaagatttggtgactatttgatactttagcacagtggtcctcaagcaatggcagttttgcatttctcacactgagatatctggcaatgtctggagacattttttggttatcacacatggggaagtgctcttggcatttagtgggcagatgctgctaagcatccaacactgcacaggacagctcccacaacaaagaattatctgatccaaaatgtcaatagtgctgaagtttagaaaccctgctttagtataacctagtttatcctggttaagatagggtgttgagaagattaaatggaaaaaaaatatataaaatacagcacacagggtggtctttttttggtaattatgtgacagagcttggcaatggctctgaggtcttcccttgcatttgtgggtcttttccaacttccctagggttcagtattcagtttaattgtagttgtgtttataaatcaaggctcgtttttagcagaatcatataccctttaaaaaagggggagaactaacattagatgcctgtttggcaccaggctctttgtatgtgttttgaatttttacagatattctctgaaactgatattccttacctccattttgttttgttttgttttgttttgttttgagacaggatctcactgtgttgcccagactggagtgcagtggtgcgatcttgtctcactgcaacctccacctcctgaattcaagcaattctcctgcctcagcctcctgagtagctgggattacaggcatgcgccaccatgcccagttaatgttttgtattttcagtagagatgggatttcgctatgttggccaggctggtctcttaacttttggcctcctgtgatcccccagccttggcctcccaaagtgctgggattacaggcatgagccaccatgcccggccctccattttgtttttgatgaagacattgaggcactgaagttaagtaatttgaccaagatcacatggcttataagtggtgggcctagaattcgaagcacatctgtttgcctccagaaccctcttctttccacactgctatactacctctttagcagtgactttaacatagagaaatgaaggtaatacctgatttctaacaattatgtgttgtattagttatctattgctgtataacaggttacctcaaaacttagcactttaacacaacaaacagttattgtctgacatagttttgagaatcagtaatttaggggaagctaagctgggtggttctggctcaggatctctatggagattgcaaacaagttgtcttccagggctgcagcgatctgaagacctgattggagcaggaagatccacttccattgtggtgcactcacagggctgttggtgggaggcctcagttcctcaccatgtgggtctctctttagggttgcttgattgtcatcatgacatggcagctggcctccttcagagtgagggatctcagagagacagcaaggcagaagccacaatatcttttgtgacctagccttagaagtcacagatgatcacttctgctcttttctattggtcacatacacaaccctgatataatgtgggagaggatgatacaagggcatcaagaatactatgagatggaaatcactgggggccatcatggaggctggttactacatgttaatgatcctcatttgccatagttacaaaattatgaattatatttccttttcatattctaatattccaaacacctgttttgtactttaagatacttaaatcatttagaatgtgagtgaaaatacaaattggcttttgtaaacacttactgaatgggtaaaataaaggccgtggtacagatacttcattggggaattttttttttaaataggtttgactagctgaggcttcttgaatcctgaaaagtttggtctgatgtacttttttttttttcctggaaaatctccttgtaccaaacactgaattcttcatttgccaaagtccacccaactttctgatgtttttattgctggtttgatgtgcttgaatgccagccagagtataaggtgaatggtagatgcaaggactgtgcagtttccacggagacttctttcaggagcccttcattttttcattcagctattgctgggaggcatccccttccagttaatgtgtggtacacatcaatttgagtggctcttagaaaggggctcagtttatacaaattaagaattgaggttttttttttctctgtatatcttcaacgttaaattagatttctatgaaacttgaagatgttaacaggaaatcttcctgaaacagtttaactatacttttgtttattacacttgattttgagcttttgggaataaaagtagggtcctggctaggtacagaggtatatggatttactgtgtctaatcgtgcaaccatgaaataaacgtttgcacttcaggaatcaacccatcactttttaaccactgttgtttgcattggcttagagctttgtgcttccttcaactattttccttttttctttcaaaactgtgttcagttggttgtgaccaattttacacagagactggctcactcacttatgttcttgactcctgctgtcccaatatcatgcttcatttacacagggatagcttttcctggctttatctgttgacttgacatcctgtgcatcatatttcttttcttagatatagagaagactgaaaaaaatccacgatttgaagaaaatttgcaaaagtgcagagcaatgtgaaagagatagctttaattttaattttcactgtagtcagaataggtggcctcctgatgggcagacttgctttctcattttactctgtccagtgtagatacccagatcaatcaaggtcaagctggtctggtcattaatacaacttttggttttaaacacagctgtgtacgggggttcttagcattattaatagaggttataatgaaaacaaggtatagtcatacagttgtctgtgtgggtagtggcatggaggtggagttgttgcttaagatctgaaagtcaggaagctggaggtttttgtaattttattcattatcaatcttaagaatttattttgatcattataaatgcatgactggtgctattttccaatcctgaggttttttgggaaatttttttgaaaagaggccaggatgaggataaaaattaattttgaaaatccatttcaaagactcattatgctatgctccatcactgcaattttaatgcaacttatatattgtgcttttacctttgggactagcattcttaaaagctgacttttaatttggactttctaatatgtgtcggctctgtcagctcacgagtgtgtttttatctgtgcatcatgttatattgggacctgggtggaatgtaaatcttttactggcctaaatctgagtctaatcctctgcatggctttggtagaaaatcaatttcctctgctctgtcaagatttttcaggtcagtgctctttggaagtttcccagttctcttagattaaaatagattttgtttctgtgctacatactggtattagttagtaggacactgggatctaaaagcaagagaacagaggcagacaagatatccatgagttcttctatttcagttaacttgttgacacactgcacctttgaggaaccaaggagtttgtgtgctttcaggcatcatttgggggagcaattgtaaatgactcctgtaggtgaggctgtgcacttaattttaatgagttcaggttcattaagtgacctgctcactgggtcattagaagtgacctcactagaagtgaatggtaaagagaagaactacctaagttccactcagcttgtttcactactgtggggtattggaagtagagtgacaacttggactttctcagttttagcactgaaaagtcccacatcccaggaacttactcagtccccagcaaactagggggagcgggggatggttggtccccctagcagtgaaaagtaaggggatggatgatttggaactggttagtacccttatagatttttttttttttttctgagacaggttcttgctgtgtcacccaggctagaatatagtggcatgatcatggctcactgcagccacgatctcctgggtccaaatgatactcccacttcagcctccccagtagctggaactacggggacaagccaccacacccagctaatttttatttatttatattaattaattaatttatttttttgtagggacagggtctcgctttgttgcccaggctggtcttgaactcctgggctcaagtgatcctcctgccttagcctctcaaagcactgggattacaggtgtaaaccaccatgcctggctgtcttataaatactttaaggagggatttattagagacatgtagcaccttgctgcccagtgatgctagtaaatgagtgactctactttgatttgacagaagaaacaatggaaagaggagagatggaagtttttctacctaaacttcctaagaggatgtgtttaggggatgtgttggtaaaaagttattagcattaatgtttacctgtatctttctcatagataatgcaaagacctttaactccacttatccctccttttaacttatgttgttattgccttgtattttaatactatatattaaactctacaagacatcattattttatgcaggcattgtttatttaatcagagttcagtaaactttttctgtaaatgccagatggtaaatattttaacccctgcaggccttatagtctctgtcacaactactcaactccactcttaatagtgccaaaatggctatagacaatatggaaatgattgtgtgtacccatgttccaataaaatttatttacagaaacagacagtgggccagatttggcctgcaggccttactttgacaactcctaatttagatttatctacatatttatttattttccctttatttcttgctatatctttgaggttctacctgggatcattttcaaggcaaggatgtctattctcatcactgtttttcagcgttgtgctagaaattccaaccagtgcaataaggcaagaaaaggaaataaaaggcatacagagcagaaaggaaaaaaaaaatgaaactggccaggtacagctgctcatactttgagaggcgagctaggaggattgcttgagcccaggagttccagaccagcttgggcaatgtagggcgacccccatctctacaaaagtaaaaataaaaaaaaaattagcagggtgttatggtgcatgtctgtggtctcagctacttgggaggctgaggtgggaggatcacttgggccttggaggtgaagtgagccatggtgactgtatcactgcattctagcctgggcaacagagtgacaccgcctgtctcagaaaacaaaacaaaaacctgtctctatttgcagatgacatgattgtctacatagaagaccctgagaaatctacagtctacagaataactcctagacctaattaagtgagttcagcaaggtttcaggatataagataaacatacaaaaatgagttgtatttctacatactagccataaacaaatggacactgaaattaaaaatacaataccatttacattcactcaaaaaatacttgggtataaatctaacaaagcatgcacaggacttgtatgctgaaaactatacaatgctgatgaaagaaatcaaagtctaaatagatggggaaacataccatgttccgggtttcaggatataagataaacttacaaaaatgagttgtatttcacatactagctagaaacaaatggacactgaaattaaaaatacaataccatttacattcactcaagaaatacttgggtataaatctaacaaagcatgcacaggacttgtatgctgaaaactacaaaatgctgatgaaagaaatcaaagtctaaatagatggggaacataccatgttccaggattggaagactcaacatagtaaagatatcatttctcccccaaattgatatacaggtttaatgtaattcctgtcaaaatcttagtaagatttttttgtagatataattataaaatttatatggaaagggaaaagaactagactagctgaaacaattttgaaaaagaataataaagcaggaggaatcagtctgtaagattttaagacatataactacagtaatcaagactgtgtgatattggtggagggatacatgtatagatcaacggaacagaacaaagaacctagaaatagaccaacagaaatgtgcccaattgatctttgacaaaattgcaacagcaattgaacggagaaggaaagatagcctttttgacaaatggtgctaggtcaattaaacatcaatatgtcaaaaaaaaaaaaaaactcttgctgtaaatagtacacgttatatgaaaaataactccaaatgtatcacaaacttcaatgtaaaacataaaactataaaaataattagagaaaatcttcaggatctaaggctaggcagagttcttagacctgacaccaaaggtatgatccataaaagaattgataaattggatttcatcaaaataaaaaatacttactctgagaaagacctcataagaggatgaaaagacagactacagagtggggggaaatatttgcaaactacgtatccgacaaaggactggcatctagaatatataaataactttcaaaacttaacagtagaaaacaacccagttagaaagtggaaaaaatacaagaagggacatttcactgaagagcatatacagatgacagataagcatgtgaaaagatgttcaacataattagccactagggaaatgtaaattcagaccaaagtgagctatcactacatacctataagaatggctaaaattaaaaatagtgacagcatcaaatgatggcaaggctgtagagaaatggaatcattcatactttgctgatgggatgtaaaatgatacagcccctctgaaaaacagtttggcagtttcttaaagacactaaacatgcaactaccatatgacccagcaattgcactcctgggcatttatcccagagaagtgaagatttatgttcatataaatgccagtatgtgaatgttttataggagttttattcataatagcccataactggaaacaatacagatgttctttagtggatgaatggttagacaaactggtatatccatagcatggaatactacccagcagtaaaaaggagtgaagtactgatacatgcaatgatctggatggatctccagagaattatgccgagtgagaaaagccaatcctgagtggtttaaataccatatgattccatttatgtaacattcttgaagtgacaaaattatggagatggagaacagattagtccatgccaggggttgagggggcaagggttgggagtaaaatggatagctataaaaggcatgatgaggccaggcgtggtggctcacgcctgtaattccagcactttaagaggccgaggcgggtgaattgcttgaggtcaggagtttgagatcagcctgaccaacatggtgaaaccctgtttttactaaaaatacaaaaagtagctgggtgtagtggcaggtgcctgtaatcccagctactccagaggctgaggcaggagaatcgcttgaacctgggaggcagaggttgtagtgagctgagattgtgccactgaactccagcctgggcaacagagcaagactctgtcttaggaaaaaaaaaaaaaggcatcatgggtccttgtgagcatgaaaatgttctctattgactgtgtcaatagagacacacaattatgttgtgtgtcacaaccataatcacaacattatggttgtgatattgtactgtagttttacaagatgttaccattgggaggaagtgggcaaagggtacataggatctctgggtatcatttcttacctctgcatataaaactacagttgtctcaaaaggtttaattaagaaagtatttaagaaaaagaaccccaggatctaaaaagatcagagtcagagaatcacaaatgctaaataagaagcacttttgtatttggtgatgttctgaaattctggctcagttttgttatgaaatggagccacgtgggtccatgtgagtgagtccctgtgcacaggtgtatgattgactttttccctcaagtgcttctaatttgggatgttcttcactgtgtgccctttgagtgtctcttgcctctggttttttgttagacaaaaaaaccagtttttaaatgtcagttccaaggtcttttctgggtacggttaacttttatgatttcatttatgcagtgggttttcacctaagggccatggtttctagacactagactcgtttttcccaagcgattcatctctttgcctgtgggatggagagattcattctcttcttctcttttgcagtagaaactccagttttgagctgggcacctggatgcccagagtaaaggttgtactgcccacatttcattgtagctaggtgtgcctgcgtgaccaagtatgaaccttctatttagattaagccacaagataagtggagctatcaattggctttaacaaatatttagtgaataggtaaaataaaatactttatataagagctgtgtgttctgggttgaattgtgtcccccacaaaaagatatattaaagtcgtaacccttagtacctcagaatgtgaccttatttggaaagagggtctttgcagatataattaatttcaggtgaggttataccggagtagggtgggctcctaatccaatatgatgagtgtcctcagaagaaggcagtcaggcacatgtaccctaaaacttaaagtagaataaaaaataaataaataaataaataaataaaaaagaaggcagtcaggtgaagacacagacacacagtgggaaccccctatgaagatgaagatagaagcaatgtatctacaagccagggaccgcctgcggctgcaagaagccaggtgagacacatggagctgattctccctcacagcccttagaaggaacgtgccctgctgacaccttggttttggacttccagtctccagaaccatgggataataaatacatttctgttgtttgaagccacccaatttgtggtactttattatagcagccctaggaaaccaatatactatgcttttgatattatttttaggatgttgtggtttgaatatttgtgtctcccccaaattcctatgttgaaacctagtctctgatgcgatagtattaagaggtggggcctttaggaggtgcatgagggcagagcccttatgatgggattagtgttcctagaaaagagacttgagggagcttgtttgccccttccagtatgtgaggatacagcaagaaagtgccatctatgaggcagagagtgagccctcactatacactgaatctgctggcaccttgatcttagacttcccagcctccagaatggaaagaaatttctgttgtttataaattactgagtctaaggtattttgttgtagcagccccaacaaactaagacatggagtattttaaaaaatgggttgaacattcagaggcttcttaatctgagtccttagatatttggactgactctgccttctttttccagtgaaaagatctcgctgtatgaaacatagacattcttcattgccccaaagcccttccaccttccttatgtttttattgctggtttgatgtgcttgaatgctagccaaagtataaggtgaatggtagatgcaaggactgggcggtttccatggagacttcttgcaggagcctttcctttctcagttcaacagttgtcaaggaaacatctagtttcaattaaataaatgtttgtggggtctgccaatttgagtgtctcttggaaggggatttggttaaacttcttaaacatcgtaataaacaaattcagagcagaggctttttaggttcccttccagttatattaggtttttctgtaacttagggatgttaactagtcctctgtctgaagtgatcagactatttattcatatccagaaaatattatttttgagtcttgtggggaggaaaactgaggcttaaagaaagagaggccaaagccagggagctggtgttacatggcaccagctatatatacatgactatagtccatgctctttagtacgtcctgcaggataagagatccaaggggcctgacctttacaaactgtttacaggctatggagtttgctggctcagcactgtgtgtttattgcttctagttagctattgttgtatcagtggctggagttggtgatggttcacggaaatagtggtgagagtacagattctaggtatatgcaattctaataaatgagacttccctagtgttatctgtattgtgacagcctccccattgtgctctttatcaaacagtaaggtatggtatattgcaaaatgctcacaatactttgcaactcttcccatcaagaggtagagtcagtttctctattcttaggatcttggctgtcctgttgatttggtctgaccctggaatacagtagaaaagaccctgtgtgggttttgatcctaggcgtgaggtagagcttcagtttcttgctgctttgggaactctgccaccttgtaaaaaaagccctggctggcctcctggaggaagagagactatgtggaggaaaatgaaggtacccagacaacccaatagtcaactgcagaagcataagtgaccctcatctgagatcaatggtgcctggctcggatcagtataattgtccagctgaactcagcccaaattactgacccccagagttatgaattaaataaatgctgttgctttaaggcacttaagttttggggtggtgtgttatacagtagtagataattgatacagccaagtttggaagctctggaatgatcagggctcacctttgacctgtcctctataaaacccaggattcttagtaacacagtcctgttaataacagaacttgcctatggcaaatctaagcggaaaagcagtttattggcaggatattgtgtagctacatctttctttaggaagaccagggacaaggcttgaaaactgcacaactagggggcagtactgccagaactacagccagataacctcacagaattggtagctactgaatattggatgcctccacctacaccaccaacattgcctgcattggacattgggtatggggctgctcctggaactggatgttgttcctgtcactagaaaacaatcatctactgttcttgctgtttcacagcactcattactgattcagatgcccgtgtgccacgtgtttatagcagtgcaatttgtaattgcaaaaatagggaaccagcccaaatgcccatcaatcgagtggataaagaaaatatatcaaaaatatattttatatgtgtgtgtgtatgtatatgtgtgtatatatgtgtgtatgtatatgtgtgtatatatacacacacgtacatatatatacatatatatacacacacgtacatatatatacacacacgtacatatatatgcacacacacatatatatacacacacgtaacatttataatacgccatggaatactactcagccataaaaaggaatgaaataatagcatttgcaacaacgtggatggagttggagaccattattctaagtgaagtgactcaggaatggaaaaccgaacgttgtattttctcacttataagtgggagctaagctatgaggatgcaaaggcataagaatgaaacagtggactttggggcctcagagggaagggtgggaggtgagggataaaagactacacattgggtacagtgtacactgctcggctgatgagtacctcaaaatctcagaaatcagcactgaagaacttaactcatgtaaccaaataccatctgttcccccaaagctatttaaataataataaaaacaaaaacaaatgcctgtgtgggtggtgtctggcagagcgtaggtcttgtgcccataccctgattgaaaagaaatcaggaaagtgagaatctgacacttttagcttatttagctgaaagcaggtggaaaatttcataaacactggcaaagggttcggataacaggcagccaaaagaaaaatggcaaatgttcattagtttctgttgtatactctggttagctcagttggttacagcacagttatgatgaagccagcattgtggtttgttcttaagttttattgaaagaaaatagttctgagattgtcccccttacacctgctccctctctcacagatgtgtgctgatagccatttgtaaggccaggcaatagtggggcctaacttgcatctgtctctggctgctaaggtacaaagattatgtgtctttcagttggtgggcccagagactccattcactggcatagtgtgccacataagagaactgaatgaatggtatctgtgtgaatctaaggggttggctaattgcgcagtgaatttggttcatgtaacatttataatacaaattgttgggcagcaagatctttcaatccagacggtttctagtttttcagaatttctctgataacttctctgaactctgaaattcttatttgcaaaaccatctatatagggttcatttaaatattagaaatagtactcataaagagaaaagcataatgcctagaggatgtgtaatagatgttcaataaatgttgatcatttccctcaaacttcttagattcacacaccccaaccagattagaaactctgacacggcttgccctttttgtgttcaattctctctcagttgttaagtgaagacccaatccagttgttaaaataataaatgcacctcttgcctccctgacattctggcaaccttactctgaggaggctggcccggttcgaagctggctgctccagggcactaaagctggagaagggcccttccaccctgttcataactgtggacagtaaactgtatttgggatagaggatcttgggaacaataaggacctagatccaagctcatgcattgtggtgggactgtcaatttagggggatgggtagattttatcagatctgtcagtggaaagtttggggagatggaatagtatctacaggtagttccaggtaggaggaagagatctacctggctcctagggatgtccatcctggcaagcattgctcagtggcaggagttgtaagagtagggaaggtttaggaatttggatatcagggaagtgtcagcaggtagctggggatgaggtgcaggacaaagacagacgagaggaagaccaagccttaaagtgatgagtatctagatagggaagaggatggatgggtatagcttggacacagaaaggggattcagtcatggaaagaggtcagtctgcaatgtaatgtggctatcaggtcacaggagggccaagagcaggacaggtttggggcttggttctggttagtcgaggcagagccccttagaggtgtttggatttgccatggtgatgcaggggacctgagtgtgctggttgtcatgagatcttgttgctgggagaacagtcaagaacagggtagaaaggcccttccccagctttagtgtgccttggagcaggcagctttgaatagggccagcttcttcagagagagctgccagaatgtcagagaggcgagaggtgcatttgttattttaacaattggattgggtcttcactgggagctctacaaagaaaccaaattagtgaagttagattgcctatcccaccaacaatggatgtttatggtatgagtttagctctgtgctagagaatctcaatatatttagatttgggcttgagagagagaacttcagtgtgatctgagactgaacttccattcacattcattcctcgaggaagcatgttgaggatctatgtgtaatatactggtgttccatttacttgaaatatcctggcttgctctattcctctcacttaggcactcactcctctaaaaaataaatgtgtatatgtgtatgtgcatgtgtgtgtacatgtaggtgtaagtgtgcataaaatatggaatagactgaaatcaacaaacttataaaaataccaaataacctcaatctgtaattttatttttgagaagcactaaaaatgtcaataaatgaattgtctgaaaaactaatcctttggctggtgagataagtctgagttgccagaaccagttaaagctttatataatttggcagtacatttgcgttcacctgagatttctctgcctccagctgtacaaaaattctgtgatatgcagagcctcgaaacctgggccagaatgctaaaactaattttctttcgtaatctgagccgtaattgcattttaactcagttctagtgtgaagactgcttttgtatgtgtgtgtgtttacttcatgtcattaatttctggcatttaagttagtgcctggcacatagtctaccctcagtaaatgttagttcttactgccgagtctactgttctttccttctaaaccagtggggtagatgcttcctttgtgcctcagtggttcattcccttgccctcttcccctctcctcacccttgagttgttagatcctggttttgccccaggcaggtgccaaccccgaggaactcctgaccctgtggtgatgcatgcctgcatgtgtgcagccagctgggcagcttggaaagccatagtattgacttgccaaataaggactagtttacaaaagtcataagagatcactgtcatcaactgctatcactatctattatcctttctctttccaaaacacaatttaggtgcataataaaaacatctgtagaattactctgtcaagcctatgtatgcccatcagttgtgcaagagcctcagttcctacttctaatgaattttatactgattatcccagacctttctgccagctccctaatagcagaggagagaatacactgttggagtcaggggcaaccaaagcagctagtctgagtatagaatttctttgaattctcatctttaagaaccatgctcagctgggcacagtggttcatgactgtaatcctagcacttcgggaggccaaggtgggaggatagtaatggcctggtgtggtggctcatttccataatcccagcactttgggaggccaaggtaagcagattgctggagtccaggagttcaagaccagcctgggcaacacagggagaccccccatctctacaaaaaaacaaaaaagtagccaggtgtgatggcacttgcctgtagtcccagctatttgcagagggctgaggcgggaggatcacttgagcctgggaggttgaggctgcaatgagctgtgattgtgccactgctctgtagcctcgaggacagcgtgaccctgtctaaaaaaaaatggatgatatatccacatgattcagaattgaagaggtacaaaacaataaccaataaactctttctccccactgtgtcctagccaccttgttttcttccctggaggcatccagaagccaattttgttagtttcaacttctggagatggcttatgaaaatataagtaaatgcatctatattcaaccccattttagaagaaatgatacctactatatcagctgctttctgtgcaccttgctttttttctttttcacactttagcatgatgatttttctgtattggcacataaagagcttcttctttgttagttggtggttcttatggcagacaactgaatccaccctagatggttaagccaaaaagggattcggattttaggtaactcatggaatcctttggagggctggaggaacaggctagcatccgggtgcccagaaacaaagccccaagacacacgtagtactagcattaagtggaagccacctgtgctgctgcctccactgaacagcagatgctaggtatttgacttgactgcaactgcctctacctccactcctgcaccgggaaggcaacctagcagtgacacctgcaaaagtagaagctctgagcagagcctctttccttacatttctcacttctaaagcaaaatctggtgtggatgtatctgattagtggtgactaggtgacacatttgcatcttagcttcaatagagtctaggaattttattctcaacttttaaacttggaggtgggacttgtaataggtgaaatttttgcaaatagagaaataattttcaaagtatgatggacagtcacagatatggcaaatgtccactagagctgcttagaattccattgtatggatcaaccacaattgattaaactaatatcttagatggtagacctctaagtgttttctagttttctagtctgtgacttaggcaatactgtattaatgaccatatacatgtgtcattttgctaatgtaaaatggaatataaatttctagcagtggaattgctagatcaaaaggtaaattgtaattcttgtggatattgccaaatggtttctggatgctatactgattttttgcttccactagtgatgttcctgattttttttttttttttttttttttgcacagagtcttttccttttttagattccttctgagccagagtggcaggctgagtgttccctgctactggggtgagttttgggccttgggccaagaatgctgacaaatcagatctgggccataacctatgccaatatagactgtatttagcatctggactggatttggcttatagtttattgtagtccttctagccctaaattaaatggcatcttggggtatctaaaagataatgttgcttccaaaattgatttgcaatgtgggagtagcttacatcttggattgttatgtgttcacaaatgcataaagatgttttcaaagaatggttctaaagaattataataccttttctttttaaaaaagcaaaatcttggccgggcacggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagcaaaatcttatttctagtgtgtgaactattgcatagattttgccaatatctgaactatggcatccaattgctctggttggttgccatgaaagtttatagtaacataggaagctcctgtttgaaagctcctgaaaaatttaaacaaatgtatataaatgggtgaaaaatgggggctgaggaagaaggtgaatacatgtgttttcttctcatggaagtgttcactattttttattaaattttttttagagacagggtctcactatgtttctcaggctggtctcggactcctgggcccaagtgatcctcttgtctcagccttccaagtagctgggactacaggcacgggcctccacatctggctgtgtttgcagtctttaagttggcatttacctagtgcagttgattatttcaagaaaatacactttctacatggctactgagggtatctgaaaggatataaagtatagcccagggaagtagcatgttgttaggcaggggttagtaactctttctggaaagggtcagttggtattttaggctttgcaggccaagaaacagaatcaaagatattacataggtaattctataacaagagaaaaaataaacttctacaagctttttattgacaaaattcaaaacataataactgaggacttttttttttggtaatacaggtctactcataagaagaacagcattcttactttggggataacattttgcttaatgggattcaaagaatagtgttccctttcatcaaatcgattgcaaatgttcatctgtaaataccatttattttctccttgtgggccatagaaaaccaagcagtgggctggatttgacccatgagcggtagttttccaaccactgatgtaatggaaagaccatgagctttggacctggatgcatgtaggtttgagtactggctctgaatttgtgaccttgaacatatcacttaactttctgaattgggaaggtttatttgtgtataaactgagtgtaatgacacctatctcatggaaaaaatattacccccatctttgtgattttgcattagtattctagttctgtagatgctgatatgatttagctagacttacctagaaaattagtatttaactgattttaaagctgacttttcaagggatagaacactcacatggtcttaaagtacaatgtaaaaacatagctttgcaatgaagagatctggcagtcaccacattaatcaaatgaccaagctttgcaatcagtaccaatggtgggatgttctgacattgtgtgcccctcactgctgtgtacctctcactatatctcagtatcacctgtgtggtgttcttgccagaaacttttgactttaatgtaatcacaataaaacagacaaatccaaaacatgggatgttctgaggacaactggcctggattcttaaatgattcagtgtcattaagaaccaagggggattgttctagattagggggagactaagggaaaatgagataaaaatgcagtgcatgaacattgactaaatcctggatgaggaaaagaaaattcagctctgtaggcattttctggataatcaagggaatgtgaatgtggaccatatgttgtatgttagtccattttcacgctgctgataaaggcatatccgagactgggaagaaaaagaggtttaattggacttacagttccacatgcctggggaagcctcagaatcatggcaggaggcaaaaggcacttcttacatggtggtggcaggagaaaaatgaggaagaagcaaaggcagaaacgcctgataaacccaccagatctcatgagacttgttcaccatcacaagaatagcatgggaaagaccgatccccgtgattcaattacctccccctaattgttcaagtccctcccacacacgtgggaattctgggagatacaattcaagttgagatttgggtgaggacacagccaaaccatatcatgttgtatgataatattgtgttaaagttgatttccttgggtgtggtgatgatggtgcggtggtgtacgaaaatatccctgttcttagaaggtgaatagtaaagtacttaggggtggtgtgtcatgaggtgtgtctgtaacccacttttcagatggtttggcaaaatgggagggaaggagggagggagagagagaatgtgtgtgagtttgtgtgtatgtagaataggtgattctgtgcattgctgctcagttcttagcatagcactcagcacattgcttttgatagggaggtgcccaaccaaaacttgttaaactaacaagtactttaaggttttagtaggattctctgaaatcacacctcagcactgcctgtctgccctctctttagcagtgtcatttggcttaggcatatactataatgcctaatgttgggtaatcagatatgggggttcatgttttcttgagtagctcacccatgtccctctggactgaaagtctctcttgaatgttacagtataaatgaatgggaaaggaaaacccagcatagaggttgacctgcgtgttcagctgttccctgagaggctgaggtacaatttgtaagcatgtacttcagattctcttctgtatttctgttgctgagtttgcccacttggggagggttgacacctcctggggctgtgctgagtaggaggtgcatctctggagttctgactggctggagcatcactgaggtattctcctgggctatgagggctagggccaggataaagaatggtggatgcctttccttatgccttgatcctaaccggtaccctcttagctgagcaggaagggaacagagaaattaatattctcttatattcctgcaggaactcttatggctatatggtgtgagatgactaaagccaatttagcagctacttgtaaaagtaataaaaatggaggggaagaagaaagattctgatgcaacaggctgtgaagactaattcaacatttatttattgagctactgagcatatagcaggcatagtaaagtatgagtcctgggggatacaaataataagaatataccctcgctttctgctgggcacttagggcatagggaaaggagatgggctacagtggagataattatcaaaataccaattgtgctgtgttgcaaggctagggatgtgttagaaagctagtaaaaagtgttatgggaatgcagagaacatgccatgtggaattgactacagtttcaaagataaggttggtcttgaggtgacttgaagaatgagcctggcaggcaaagaaatgggcatctggtgtgactaaagtcttaattagctgtagggtggggaggagagagacatgacgatgttggaaaggtagtttgggccagacaggagggcctcagaagccatgcttggtttcacaggaagggcgtgaagagtcccagaagccctttgaagttggagggtgatgtggttttgataagaggtcacggagggaatgtagaagctggtgtgtgaaggtgtgtgagtctggagacaggacttgaaacagtcgaggcgagagcaaagaatctggattttgctagctgcagcagagggagagtagaaaatggggtgctcttggagaattcttccagcccctcctactaggagtttttacattttcaaatctttctaaggaaacctttaataatacttgagagaagcttatttaaacctttgaacagttctgaaaatgtattacatttcagccaggaaagaaagtattatttcaggcaaactggaacatggttactcagcacagtcgcctaatcttatagaattaggtaggagggaagctatgttagtggccttcaaccttcttccagaactttgttcagatttctcccaaatggtcggtgaatttttctgatttgtatccagcatcccagccatttagtgtacatccgtaagctgtaaggaagttgatttaatctatttctttttttcatctcttgccttccacctgagaaaacactactccataggttcttattctgtattaggaatttgcacaatgtgtaacctaagatggatccagctgggagttggatccagctgggagtgttacaggtttggagtttagactaaagaagaggagtggaatcttttcatttttttcccctttattttgaggaaagcccagtgatttggattgtttgaaggatcaattatatcaaatatctccactaattgagtatctgggataaactttttttttcaccttattttctttagataccattaagcatttcgacccacaacttacagcttttccatggagattttaaacttagaaaactttgaaccttgatgaatgaaaaaaacctttcagaactaacctttttttttttttttttgattcagaagtccatgtgtaagttccaaaggcttataattcttttctcttccttgaggcttgactatttcagaacgttcttggtatgtctcttggaggtttggtgtacaaagagcaaggaaagtaacctatgggcttaactcacttatgtgtatatattctactttggctccaaagcaatgattctagtggtgatatgggaccaagggacagatttcaaggtaaataaggctgtttactaatgtcagattaaggtattagtcttcaagtaccataaatgttttactagcaatttcagttacctgtagtaaagagctttccagttccatgtggtagttatggtaaaggagcaactgaaagttaacttgatagtagattaacactcactgaaaatatagttgttattttttcacataccaaggattacaatgtctttttttttttctatttttaaaatagagacagggtcttgctatgttgcccatagtcttgaactcttggcctcaagcgatcttccttgaggcctcccaaagtgctgaggttataggcatgagccattgtgcccggcctacaatttcttaatattaggagttattttgcaagacaactatctcaatgttggaactacactaatgttggtgtgtttttttccttgtgtgggatagtctgtatcttaagatgtgtaatgtatatattcacaataagggctacattataaaattcagagacattttatttttgaggtaggtttcattcacttaattgagaatttgttgactgtatcttgggtgcctatccttatgctaggagatgaatggaagttgccccctgccattgaagagaagacattttaatgggaggcagagataaacagataattaattataatgtgatacatttggaaatagtcacaaaaaacttgaatatggagattttcaaaagtacaaagaataggatattgaaccctcatgaacccactaccaaacttcaacaattactaactcttggttatgcttgtttcacccatgtgccccacctcctcccttcccccttttattttgaagcaagtctaagacactgtatcatgtgatggacattaatagatacttggatagagtactctgagaatacactgggaaaacatactgtatcgggacagggaaaggagctacagaaaagtaacatttgagttcaatctaggtggggaggaggatgttgttccaggtgatgggatggaaactgacaattattacaatgtcttgaaaaatgtgtatatacaacttttttgttcctctgaactgagcacccaagatgtaatttccaagattaggaaattgttttgcctgaggactttataaaaataattaattcacttttaatttagataaactagaataatccatgagtagtggtaatgactaatctgttctcttttcaccccagtgactttctagactttgaacattagaatccactccctgaaaaagtcactctcctttgtaactagagcaacagctatcctttgtcacctttatttttctctttggaagaggaggaataatcagtggctcacttctgaaacatcatgaataggtagaatttagtaatctgaattaaaaacctccctgtaaactgaaggaagaggaaattgaccagtgggcacacagaggttctcaagggacttttttggttagccactaggtgaaatccttgatatttcatcatgtaccttgtctcattttcctgttgtgaaattgggtgttcagcattgtttttcttgtctgttctcagatcacagaactgtgtggtgcaaagcgggttggttattttggtccaacacagttttacattgccctgaaattaattgctgcagcacaatctggcctcccggtacggatagagagtattaaatgtggtgagtatctcacatttgtatgttttattgtccatggcgagtcgctcatttatgagaaccatttttaatgagtttaaacttttgtggaatttctccttgcttcctccaactcttctgcaaaataaaataagaaaacttggcaggtaggtagcttagtttctttcttttttaaatggggaaaattctgagagtaacctgagattagttcattttaactgatttgcagttaaaatagattttattctttagcaggaagagattgggccaggaattctagagcctgtggcaaataatcacattgactttaattttccacttgaggtatctataatgttattgaaggctctgttagaggagtaacaagggagtttgagtggaactatgccttttctctttcccatacctgccagtgctcagcctttaattcttagtttccaaagcactgttctgatgctagtaagtacttgggtgctaccaaaattttggcagaatgaatttatcttcttaaggttctgatttaatattttctcatcttgccatccctgccctcaacccactgtatgcttgagcactttctacaatttaaacaaaaagcaaaacccccaactattagcagtatttctgctgcctcaggattggttttaaaaatctgtatgaaaaaggtgattattcaaggggtgtgccaaggtcctctgataattcagtttgatacagattactttcatatgtccatacaggtatgtaggaactttttttctttttctcattctgagactaaaaacctcttaactgctcatgcctgtcctgtgaagtctctgatagacatacaagtggattcaggatttatggtgagcccatggaaacctcgtaggacaatccaaatggccgagaagattgccatagatggctggctgtggaagaccaagcccttcacactaaccgttagcaggtggcagtcatcatgctaatctttatcagggggctagcttgtgccagacactttcatttaatcctcatgacaccctactaaattaggtacttgtgtcagtttgattgcttaggataagctgcgataacaaatgtcacaatctcagtgcctcaaccagacagaggttcgttttccactttgcagtgggtcagggtgaccctccagggcagctgccctctatgtggtgaccatgtgatcctggctgctttatcttgtggcacctcccaacacaacacctgttcccataatcgccacaccagggaaagagtatctcaccctagcggttaaatgctttggcccagacatgactgaagttattgctgcccacactgcattggccagaacttgtcacattaatctgcttcagtgcagagcaggtgggagaacacaattctctcctgtgcctgcaaggagaggacaactgcgagtctctactatggctgcacactgcaagtctctactatggttatggctgcacactgcaggtctctactatggtgctgccgttgttcgtatcttacaagtatggaaatttgaactttagggaggttgagtaacttacctaagaatataaggttagtagaatttggagccaggatctacttccagtccccatgctcttaatttctatgcaaaatagccttgtctcaattttttctatttagtaagatgctgacagtaatctgttatacaatattttctgaatgggaaaaatattggacttgaaaggcatctcttggtatgacagaattttgttctttgaaataggtttcttgatggagtgtcatttgacaggcaggcttagtattcattgctgcaagacacagcggccatttgctttgattagttgaaagttgcatcacactgaatttggatttgtggtaggcactgatagtttttattccattgtaaatgatcattaagctttattatagtatcttccaattttatcttctggaaaagttagagctgctttattgtatacagaataaacttttgacacttttgttacttattttaagttagacctaagtcttttacctgatttgtgcccagattgacagtttaatttcctgagggcagggagcaggattgttgaagttatcacttgtgtaaaggattaacagtttatcacaaatataaggctttctcagttttattttataaacccagttgctgccttttacctctgagagtttatatatgtccagagttaattctgaattatcttccttcaccactctctactaatccatttaaagattgattaaataaaattatttgcagttagcatatgttgaataagaattagggcaagattgggccaaactttgagctgccacttagaattttccagtttgttgcttgaaatctattagcttaatgcttgatgacacaaatcttgaaggccaaagggatcactctgtgagaacctaatctgaaaggctgtgctagccctgtcacacccagggcatcatacccagggagttgtggatggatacccttatgtcatgaataacatgcacctgtgtgtatgtgcgtgaccctctaatccctagtccttcccatttcggtaaatgccaccaccatcctcagctgcacaagccagaaactcagcagccatcctggattcctccttttccctcactccttaatagaatccatcaaaagtcctagcaatgtggctccaatctcactccctgttgcctctatctctttgtccctgctagaccagacaaccttcatctacttacctggacaccacaatggattgacatcctagcccctcctctcttctctactgtgatctctcttttcccactggttttttgtttgtttgttttttgacagagactcgctctgtcacccaggctggagtgcagtggcacgatcacagctcactgcagccttgacttcctgggtgcaagggatcctccaacctcagcgccccgagtagctgggactacaggcatgcgccaccactccctactaatcctactaatttttgtattttttgtagagatggggttttgccatgttgcccaggctggtcttgaactactgagctcaagtgattggcctgcctcagcagcctcccaactttttttttttgagacagggcctcactctgtcacccaggctggagtgcagtggtgtgatcacggcttgttacagcctctgcttcccaggctcaaatgatcttcctgcgtagctgagactacaggcatacatcaccatgcctggctagtatatatgtctttttgtagagatgggggtcttgttatgtttcccaggctggtctcaaactgctgagctcaagtgactctcctgtgtcagcctcccaaagtgctgggattataggaatgagccaccatacccagcctcttttcctacttttgaaagtgtgatcttttcaaaatacacagcagattattccatcctcatcctttaaaccctccagtagtctgcttgttgtactttgtaaaacattcaaagtccctacactgatctgtaacaccctacacaatctagttcttgcctacttttccatcctcatctcaaatcttaaacccttgctcactacctgttccccagtctcagtggccttctagccatttctgggtgacttttcctgctgcaggccatatgtccattttatcttgcagtcttgggttcctagggatctgtttttcctttctgcttcccctggttggctccttcccaaccttcaggattcagagtctgtccctactatcctacctaaagtagttctgtcagattcattaattcatgaaggaaccagcatatggtaaaactggctcaagaaagtatagagagtcagatttatttatagtcatagaaagaaaggatgctggaatagaattgctaaattaggtataaagctaattaacgccctacggggtaatacaagtgcagcctggctattgtacttttttctaagatgaaagtatttgcattgccgtcagacaagaattacttgttagctaacagttttttccaagttaatatctaccctttcaggattatcaaatgcccaaccaagagtaaacagtaactcagagcagaagtccatatccctaggaagtgaggtgatccttgggtgggcctgctgggtaatgcttctgcagggcaatctcctccccactttgttctttcccagcatctgtttcctgatagcacttagcagagtttgcaaatattccttacaggtttcactattttttttgtctgtcttcctcacttgtccagtttgtgtaagggggagggaagaggatctgacaccccttgcattgtggggcattataggcactctgtgtgtattggttgaatgaatgaatgaagaggtgcatgtctacgcatgaggagggtgtcttaatcatctgccactctttaatctaaaacgattggaattcagattctcctggaactccagaggagtttttacagaagtcatctcagtctgcatatcatctttcttaggcactgattttcaaccttgtcggcacttgagaaccacctggagagctttaaatataaaataaaaaaatacagatgcctgggtccatctccagaaattctaatttcatatatctgcagtccggtctgagcatcagaatttttaacagctctccaggtgatttttgtatggagacatgtttaagaataaaagctgcatcaagcatttttaagagctttgcttaaactgtgtgtgtgtgtgtgtgtgtgtgtgtgtgtgtgtgtgtgtgtagttacagtagctgcatctgaactagggtgctgtacgacacagggcacatgatttaagggggcacttactctcagggcaagtgccgactctacatttacaccaccctgagagtgcgtgcctccttaaatgttggcactaggtatctctctagccccaccctcgtctgagttggggttaaacagatggcaaaacagctagggcagaaggaaagaaggtgaaaattaaggactggtagagaatttctgatgaggaaatcatgtggtgaacatttgccctgggacctgctgttacctttctttccagggtctgaagttgagcacgtgtgaggactgagggaaggttaggcagaacctagagtagggtttctcatcatttttgtgccaggagcccctttggcagtctgaagcctgtgggccctttctcagaattatgttttaaatgcaacaaagacataagattataatggaaaccaattatactgaaataatcactaaaatagttaaattgttatataacaacatacatgcttctaggcctggcacagtttctcatgcctgtaatcccagcactttgggaggccgaggtgggcggatcacttgaggccaggagttcgggaccagcccggcaaatgtggtgaaaccttgtctctactaagttcgagaccagcctggccagcatggtgaaaccttgtctctactaaaaatacaaaaattagccgggtgtagtggcacatgcctgtaatccctgctactcaggaggctgaggcaggagactagcttaaacccaggaggtggaggttgcagtgagtcgagattgtgccactgcactccagcctgggcaacagagtgagactatatctcaaaaaaaaaaaaaaaaaccaacccccaaaacatatatgcttctttattaatgcattaaataaagcatctaacagtgtttgaaataaccactactttttcaaattagtaatatgcataaacagtacttcaagatgttggcccggcatggtggctcatgcctgtaatcctagcactttgggaggccgaggagggtggatcacgaggtcaagagattgagaccatcctggccaacatggtgaaaccccgtctctactaaaatagaaaaaaattagctgggcgtggtgacacacacctgtagtcccagctactcaggaggctgaggcaggagaatcacttgaacccgggaggcggaggttgcagtgagccaagatcacgccattgcactctagcctgggcgacagagcgagatgccatctcaaaacaacaacaacaacaacaacaacaacaacaacaaacaaaaccctaatgtgataggtgacaaagttaccggtattgctagtgataatacagtggcttgttgcctacattcataatggaaagaaatgctaaatttcagttatagtagggaaaatgaagttgtaatttttttttttttcctaatcaaggtgacagaccccgtgatttcttttcactagtccctttgggagcctgtgaactctgatggtgcaatgacatgattcatgtagtctttggggctgtgttccccaaactggtttatggtctggttgcagtctggcacagtttagaattaggacaaaaggatgagttatttataaagctaaatgtattcaaatctaagattgggttttttttggttcctcttgttaagtgtcctttgtgaaactgctaatgggtaatagtttggggtaaaattcttgacgagataaaacattggcaactttatgttggctttcttcatttctttttttgttgttgttgggggagagatttttcctattttgtgaaatccccaaatttgtgagccactgttgtggtcacgattctactgccaagaagatactgaggcaaatcattgaattccctttgactcctcccttatctgcaaaacagttgttctccacctaggtgatttcgtccctttagggactttcggcaaggtgaggagacatttttggttgtcccagctgcggaaggggactgcctggcatctagccggtagaggccagggatgctgctcaacaccctacactgcagaggacaggaccccctcttccaacaacaacaaacttatctaatctaaaatgccagtaatgttgagactgagaaagccttctgtaaaataaggatcaagacttaggaactctaatcctgctgccttgcttcctgtgctctagttagtttttttgtttttttaatcatacaagaaaggtagaaggattttgcagcattgagtcctatttctgtggcttttgttttcaaagaagaattattttattcaaggaaaaataaaagcagttattctctggttgaattgagggtggggttccctgtgctttgcctatttgacaaaccctccctatctcttagggctaggagagaaatcttttgagtgtgacaaccagtttggtaattcatagaaaagacaggataggaagcccaagggtaaagaaagaagcccaggaggtaaggttgtagctggctctgtgtgtgtgtgtgtgtgtgtgtgtgtgtgtgtgtgtgtgtccacacagtgtctctgtattttgaacactaaatactatgttgggatgtctcattaagctaaggtcaactcatcctttctgactgacgtccaacccaatccccctttccttttttttcctcagtgttcctttgtcaatttcctttaccccctctcccagccctgctacagggacacagagctgctttggacaaagttcgcctatgcaggttcactgactgtacggctggacatttgtgttttctaggggtctgtccctctaccccatagcgctgtcattagctctattgttgctcctccccaaaggttctccccaaccttttgagctgtggattttcaccttatttgtaaaaatctttgttgtgggattctttgacaatctagtaaaagctctggatcttagcaggaaaatacacattgacattatgtaaaaaatgttgccttcaatgtcaggggtttctggacccctagagctggttcatggagcccagtgaagagcccttcttccagagaaatgcagtgtatgggatggatatagaggaggtaagttggaagatgcatagtggggaaattgaaggccaaagaggtaaaataaaagggatgctgcttgctagcagcagagcccagtggattgtggacctcctaactcactcctggggttctacccgtggtatggccaggaaattgaacttatccaccatcctcctctgccaaacatttacaagatcacccttcccattgtaacctccaccccgccatctagcgattacctacccatttcctaattgacaagaggtatttcagatcaatgggcagataggaggataataggagactagatagctttgattactcaggcctgggttgataagactggcctgatttttttttttgttttgttttttgttttcccccaaagtaacttcaggaaaatgtgtagggatggtttcactttggaattatagaacattattgtcataattctttgttaacgtataagtagctggtataagtgaataggtaacaaaaagcagtgggagagaagggagccagcagtcaggagtcaagaatttttgttacggtcttagctctgccactgtattgctgcatgactaaggcaagtcttgctctctctttcctgggcttatttcctcacctgcaaaatgcagacatttgagcaggttttctctagattattttctgaaatgccacagtttcatgctaaatgttcaaatctgtactagaaagaattttaatgttcaggatggtagtatagccttgtggctgggaatgtaggtcctagcaataggctacctcattatgaatctttccttcattaccttttatttgtgtggcctccggccagtttcttaatttctctgtttcaaatgactccctggaggaaaaggtataccaataacacctgccttatagacttgttgtaagcacaaaatcagggaatcccttatcaaacattgtagaaaagcatctacaactttgttatttaatatcgtagccacttgccatgtgtggctattgagcacttgaagtgtggcagtgtggctagtgtgactgagaaactgaatttttcattaaatgatttaaataaaaggttttaaacagtgtaaaatattttctgttaaatgcaaccttattgatttagtaggaccacttttcacttcaaccatcaaattctgtaagacaagggtcaacaacctttttctttttttttcttcttttttaaattttattttattattattatactttaagttttagggtacatgtgcacaacgtgcaggtttgttacatatgtatacatgtgccatgttggtgtgctgcacccattaactcgtcatttaacattaggtatttctcctaacactatccctccccccttcccccaccccacaacagtccccggtgtgtgatgttccccttcctgtgtccatgtgttctcattgttcaattcccacctatgagtgagaacatgcggtgtttggttttttgtccttgcaatagtttgcggagaatgatggtttccagcttcatccatgtccctacaaaggacatgaactcatcattttttatggctgcatagtattccatggtgtatatgtgccacattttcttaatccagtctatcattgtgggacatttgggttggttccaagtctttgctattgtgaatagtgccgcaataaacacacatgtgcatgtgtctttatagcagcatgatttataatcctttgggtatatacccagtaatgggatggctgggtcaaatggtatttctagttctagatccctgaggaatcgccacactgacttccacaatgattgaactagtttacagtcccaccaacagtgtaaaagtgttcctgtttctccacatcctctccagcatctgttgtttcctgactttttgatgatcgccattctaactggtgtgagatggtgtctctctgtggttttgatttgcatttctctgatggccagtgatgatgagcattttttcatgtgttttttgactgcgtaaatgtcttcttttgagaagtgtctgttcatatccttcgcccactttaaagggtcagatagactttgtgggcagtatgattttggtcacaactactcaaccctgttgtagtatgaaagtagccatggacagcatgtaatcagaggatcatggctgtgtgctaataaaactttatttatgaacactgaaatttgaatttttaattttttttattttttatttttgagacagagtctcactcttgtcacccaggctggagtgctgcagaggcacgatctcagctcactgccacctccaccttctgtgttcaagctattctcctgcttcagcctcctgagtagctgggactacaggcctgtgccaccacgcctggctaatttttgtattttagtagagatggggtttcaccatgttggtcaggctagtctcaaactcctgacctcgaatgatccacccatcttggtctcccaaagtgctgggattacaggtgtgagccactatgcctggcctgacatttgaatttaatataattttcacatcatgaaatatttttcttttttctttttttttttttttttttttgcaaatattcaaacattgtgcttgcgggatgtacagaaataggcagcagactggatttggttcttaggtatacacccaagataaataaattcatgtccatcaaaaaacatttataagaatttcacagcagctttatttacaatgggcccacactggaaacaacccaaatgtttatcacaggataatggattaaaattttcaatatattcttttagggtcttgctctgtcacctagactggagtgtaatggtgctgtttcagttcactgtaacctccaccttccaagctcaagccatcctcccacctcagcctcctgagtagctgggactataggtgtacaccaccatgcctggctaatttttgtattttttgtagagatggggttttgccatgttgcccacactggtctcgaacttctgagctcaagaaatctacctacctcggcctcccaaagtgctgggatcacaggtgtgagctactgctcctggctcaatatattcttaaaagtggattgctccatagcaatgaaaaagaatgaactatgtgtacaatacattgggtgattatcacagacaaaaaggtcgtaaaaaaagcttgtcacaagaacaaatactgtatgattcaatgtatgaagttccataatggcaaagataatctgcaagtatagaaattagtacagaggttgctcggtggaacaaagggaggggattactggaaatgaacatgaaggaaaattctgtatcttaatttgggaatttgggtgttggttacagggatatatatatatatatatgtatttgtcaaaattcttcaagtggaacacttacaattccctataaatcatcccaccatacagaatactctttacataatttaaaaagaaatcaattagttgcttacatttaacattgtaataataataaaatacagtaaaatacagatttctggccacaatggctcacattcccatgtagcaactatcaactagagctgtgctgtttcagtatggtagccagtagctgcatgtggctgttgagcacataaaatgtgacaagcacaaattgaggtatgcaaggagggtaaaatatacatgggagtttgaaggcttaatatgaaaaaaaatgtaaaatatttcattaatagtttttaatgttgattacatgttgaaatgataatattgggttaaattagattattaaaattttgccattaaaaatgttttgaaatggaaaatttttaattgtgataaaatacaaataacatttcccatcttaaccattttaaatgtataattcagtaatgtgtaaatatagtcacattgttgggtaactagtttctagaaccttttcacctcaccttacaaaatggaaactctgtattcattaaacaccttcccattttctttttcctacccagatcctggcaactgcctttttttttttttttttttttttgagtgcagtgacgtgatcatggcttactgctacctctgcctcccaggctcaagagattcttgtgcctcagcctcccgagtagctgggattacaggcgcatgcaccactacacccagctaatttttgtatttttagtagagatggggttttgtcatgttggccaggctagtcttgaactcctggcctcaagtgatctgcccacctcagcctcccaaagtgctgggattacaagtgtgagccactgcacctggcctgcccatctactttctggttctatgagtttggctactcttgatgcctcatataagtgaaaccacacagtacctgtctttttgtgaccagcttgtttcacttctttctttctttctttttttttttttttaatgtggctcacattcttttttggcagataacattgaaagactgtgaacagctgctgccattttgatggaacatgagttctctgcccagcaccctccactccatattgtctagctaatgaggctcaatgtcacttgccatttattattgcatttatgctgtttacattttttctaatggattgaggaaattgaggtatttttttttcttttttgagtgacagggtttcactgtcacccaggctggagtgcagtggcatgatgcagccttgaactctcagactcaagcgatcttcctgcctcagcctcctgagtagctgggactacaggcatatgccaccatgcccagctgattttttatttttatttttttaagagaaggggtcttactgtgttgtccaggctggtctcaaactgctgggctcaagtgatcctcccacctcggcctcccaaagtgctgggattacaggcatgagccaccactcccagcctaaagtattcctaatatatctgtatctctatcaaatatggaaaaacaaaggatttttctctcttgtagagggtcaagtgtttaaaaaggagcaggcataattttctttgtggaagggaaaaatagtcatttatgtttaatatacaaagcatttctgtgttcaaagaatgtaacctaagatgaaacaacaatgaagcaaattgtcatcttggatggccactctcattgtctcctcagaccctctaaacatttagtgtgaactcttactttgtttgctgtgtgtaattcaattcagtttgggagacaagattctaaccaatgactacaaatagaccttcttcttgacagacatcattgtatagcaggtactttattgattaattttttcaaagtttcactattaaattttgtgtatgtgtgactaggaaaaacattcagttgagtatggtgactcatgcctgtaatcccagcactttaggaggccaagacgggaggatcgcttgagctcaggaatttgagacctgtctgggcaatatagcaagaccccatctttacgaaaaataaaaaaagaaattagccagcatggtggcaagcacctggagtcccagctacttgggaggctgaggcaggaggatcagttgagtctgggagttcaaggctgcaatgagctatgttagtgccactgcacttcagtctgagagacagaccttgtctcaaaaaaacaaaaaccaaaaaaaacattcagactgaaaatttacaaactacttttacctttcactttttaaaagcttgcatcagtttaagggaaatggcaccttcatgaaagttttccatgataagaatattattatgtatggttatacttctgttaagtgagagttgcttggaaccacctgaccaaagaaagtatgagagaacttcagctgtattttgtcttttgctgtttggtggctgtctgggggagagaggtggttttctaggcacatagctctaaagaaatgccatagacagggtggaagaatgtgtgaagtgacaatgtcctagacaatatctgggagccctacttaagtcctaatataataattgatattcataattcagttagtgtattccattgttccttggaggtatctgttgaatgccagtaaggcactggtcagggagcttataaatactgagcatttatttcttttctccctcaagaagtacttggaagtagagtcatcctcttatgggtagatcagggtgcaaattattttatgtgatcttgtttcatctttttagatcctttttcctgactgagctggagcacatacctgagaccaaaaccatagagttagcttatatttgatttactaagaatctagagtttcttttctcttgcttttttgcttttgaagcccattcctgctttgagtgctggagagctgcccgagattgggaaacattaagattggttactctatttatgtctcttgggcccttggctgattgatcacacagggatttgtcatattgcctgcttcttttttttttttctggtacagaattttgctcttgttgcccaggctggagtgcaatggcatgatcttggctcactgcaacctccgcctcctgggtttaagcaattctcctgcctcagcctcctgagtagctgggattacaggcgcctgacgccacgcctggctaatttttggtatttttgtgtagagacggggttttaccatgttggccaggttagtttcgaactcctgacctcaggaggtccacccgcctccgcctcccaaagtgctggaattataggcgtaagtgagccactgcgcccggccgcctgctgctttgaatcaaatgtgaacatagcaactaaaagtaaacatcatgtggatgttagagaaccaggggccttctttgcctggggaactctaggatacttgcttgctgttgctaagatgttttctggccttagcacagcatcagtcattgaaagtgcagctgtgtttttggaatagagagctgatggaagtgcaaaggcacactgatgagtattatcctgaacaatggatacagatgcaaatcattatgcataatccataatgtccccatttttgtagggttttgtgctacgtgattgtgtgtgatttgatgtgctgagaactagaagtgtgccaaagtatcatttccgctttcagaatagttttgttagaattttgaaagatgagtaaatataccagaccgttgcttttcaactctttgtagcattttgagtggctaatggttttgacagaagaatgtggctgaatgatagattgattgctctgacttgatattgttttccttattccattatgaaaagacaaccagagattggatgtgaaaattccttaaagaattacataggatgagaaactgttctacccactaagtttgccataggaacaagggaccattctgtagagcactggtaaagtaccagcttgcctgcattcaaaccgtggctctgccacagatgagttgtgtgatcctggggacattacttagctcctttatgactgtttctacttttgcaatgagggggtggtaatgatagttttatcatacagagttgttgtgaggattaaatgagttaatatttgcaaatctttaatactgtgcctggcatatttaagcattatatgaattttacctgccaccatttgtcacttattattgtattatacagtgtcatatcctttttcttggttattgaaggatgaaatgggagatcagtcccaaatctgaatttattctgcgatttggcaacattgaaaaatgttaagccagaatactttggttaaaccatagcattttaaaaatcaggacgttattataggagtactcattgtatctaaatctaaatttatatttagtgctctggaatttttcctcaaaaatgattcatcgtttggccattgagttccccttttttgcagtttttaaattaagtctgactagagcttctctgatttctggtcccaaagaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacaggtaaacagtttgttcagatgtgttcatttgattctgaccatgaaaccgcatgtagcagggcctcgtatctactgttcagcttccagcaaatctcaccatctggaacccaattacagacttggaagtgagccagtaaagttttctcctagcaagaaagagagaccgacacatatgaatcaccaccacccacttaagggccctttagagcctactttaaagtagaattgtgtctaaaataaggctaccgatttaatacatttattgatttcactagctcagtggttttctaaatggattcttggaaatgtaacttccaggagtttttaataggttctcttctccaaaaagaagtctgtagaaaaggtttctcctattataataaatgtgtttggagaatgctgcttcatattcccttgttgagggaaggactaaatcctcagtcttggaaattcgtagtgcacattagcacggtaaaagccctgagaagttctgcagtgaagagacctggaaatgtgtgtttactaaacttctttcaccaggaaattctttcttggggaacatatttggaatactatcttgggaaatgctgccattacccatttagcaggtttggaaccagaacagggaggataggcttttaaaattagaccactaattgcaatggtcagatgatgattggtggagacaacagtataaaatctcagaagagtgggcagatccagaagaagtaaatagtctacacattggtgtaccctgcaggcatcaaggtatagctcatacttccagcaaagatactgaatcatgcagagaagtcaaattatgttcaacatagtgtcttctataaggtaaagaaatttattataggaacacttgaggctgggcacggtggctcacgcctgtaatcccagcactttgggaggccaaggcgggtggatcacaagaggtcaggagttcaagagcagcctggccaacatggcaaaaccctgtctctactagaaatacaaaaattagccgggcgtggtggcatgtgcctgtagtcccagctacttggaaggctgaggcaggagaatggcttgaatccgggaggcggagattgcagtgagccgagatcacatcactgcactccagcctgggccacagagcaagactgtgtctcaaaaaaaaaaaaaaaggaacactcgaatgaaaatgtttttaaaatgcaatgaatattaaatgattatgttggaaaactaacttctgtgacttaccctgtgatgttgtgtagatgaggtgttgctacagaagttttatatggatagttaggggaggtgtagcacatcctgttaaacaattccatgtactgtcactttcataattctgacacattttaaatcagttcttcagggatatatttaaaaaggaagaggtataggaattttcagtcaatattctttggcatattttcccaccagcatttggagaggaatgagggtccactgtcccacggtggttgatgccctgggaaatttccaggcccagtccctgattgtgtgaatgagaatacatcctttcacttcaggctgagtttatgcatgccccacccaatctatgggtgtgagctcatgctttagagcaaacatattttgctttttcttgaagaagagtatttgatcagtatttcagattacatatttctctttagactaagggagcctatatatatagtctgtgtgttgatagaaagcattgttttggctgggtgtagtggctcatgcctgtaatcccagcagttggggaggccgaagcaggaggattgcttgagcccaagaattcaagaccagcctgggcaacatagcaagacctcatttcaaaaaaaaaaaaaaaaaattagctgtgtgtggtggcgcatgcctgtagtagctactgggggtgctgaggtgggaggattgcttgagcccaggaagtcaaggctgcagtgagctatgatcacgccactgtgccccagcctgggtgacagagcgagaccctgtctcaaacaaacaaacaaacaaaaaaaagcactgttttcttggtacttgaatactccaaagttaccagtctactagtaaagttttttttttttttttttttttttaaagaggaaactcagcagcagataaggttgcttactttgcctagggttctacatcaggttcatatttgaattgagattcaaattgtagcttgttaagatttcatcttagtgtttgggagtaagctggttggaatggtttacctataatgaattgttttgcagtctctcattgttaaaaaaaaaaagctagcattttactttgacatggtaagctccaagaatattaagtattaagcatttagaaatatatattttaatattcacatttgctggaagacttgataagtataaatccaggaaataaatttattaatgaatgaaaatgaaatctatccacagagagatcacaattgggagcgggtatgaatgttatttcatgtgatcagtgtctttcattttccaaaggaaaatattattggaataaccaaaagtgtttcaggctggttttagtaatttaggtaactcagcactgatgagattttattctctgggagactttttgaatcctcagacactgctgtttaaccatgctgcatttttgagaaaacatttccccccatttgttaaaccagctgggtcaccagcagtagagttgcgttatgcttcctgactgcagctcagaacgccaggcttgagtgagcgcctctgaactctgatctggttctttgaagcaggaaacacagtctcccacgatgtcacccctcgcctcccctccttcttccccgcctcattaccagagggtgcccttgagccatggctacagcaaactgcggagcagcgcagaacagatgcatccaggtaagaggcgacctgggggccagctgtcccaggcagtgtcttagagactccttaatttaccaggcggtaacgcttcaagctgcttaatttcctgatttaattacccctgtctttggaaacatggctcaatttaattttatattctcaagcaaggtttttttttaaaaattgatttaaacatatttgagtaatgtttcatctcctgtcctagaaactagttcgtctttagacttgtaaacagctagatgatttaatctttcatatacagattttattgaatagaacataccatattaagggcttgtattttttttggaattgttattcctttctgtaagcacaccaaagatatttatatagtaactgctttaatgaaatttcttaagaaatataactgcaaaagcaaaagagttgatccaacctttgaagactgagcacgtaaatgaaaatatataggtcctgtgctttggaataaggataaaggaaatgctaggggtagcattttgctgaggggtatgtagcatgcacagttgtggggttgccttcttgctcacatttatgctctgctggcctcgttaggtggtaaaatacgttagttctgaggatgacttgcagagttggctgtttaggctgcagtgcctaaagcactggaaattcactgcagcatcttgtgcctcctggggttcagactcctagtttaagatatgaccaattaaaggtattctagaactggatatctgtaaacccccacccccccagttttgttttgtgggctgtggccccaaatgacccagtttctgcaggtttttactgcattaaaaatagtggtgacttttagagggacacagaaataaaactgcgcgctaggctgaataaagagaggctgtaatcttgcagagagaagcaggcgtggcataatggcaatagcttttgattggaagcagaaggtgtgtgggtttctgtgactagctgtaggactttgggcaggccattgaacatctctgaaccacgattacctcttctctcttaaaatggagtaacagtatcctagaggggtattagaagattaagtgagaatgtgagtataaaatctgtttggaaattaagtcctatgcacatgcaagatgatgttgctaatggatagtaacaaaaaaatcactgtcctgtaacttgaatatctcagtggggttagaaactaaatggagttgagaattcttcattttcctcttatagtttccctgatctgatttccctattttcaggagtgggttttttttttttttttcctatttctaatcttacttgggtttggaagttggtttttaattcacaggtgaaactttttgttctactgagtcagcctgtcagcaagttctacctttggtattccttagaaaacttttctgttcctcctccttaatgccccattccctcctcattccatacaaattgggcttccatttccccagtggtaaggaagcagcttgcttctctccatctttcttgactctcagcagcctgtgccaaagctgtccatgccttcatttcttttcatacttttttaaaagtgaggtaaaatatacatatgataaaatgtacccgttttatttgttcatttttgagacaggttctcactttgtcactcaggctggagtgcactggcgcgatcatggctcactgtagccttgatctcctaggtttaggtgatcctcccacctcagcctcctgagttggtgggattacagacatgtgccaccacaccgggctaattttctttttgtatttttttgtagagatgggatttcgccatgttgcccaggctggtctcgaacccctggactcaagcgatccgctctccttgtcctcccaaagtactgggattacaggtgtgagccacaatgcctggccatgcacatgttttaaatcttcaatttgagttttagcaaatggataggcccttgtagctaccactttgatcagtaattgaacatatccattatgccagagatgaccctctccggtcactccctgccccctaacgcaatcactgttctgattttcatcaccatcattagttttgcttcttctagaacttcatatgaatgaaaacacacagaatgactgactgtactcatatgtgtttgccatctttccttcagcataatggttgaaatttatctgtattgttgtatcagtagttcattcctttttattatttagtagtgggatatattgtgtgaatgcatcacagttcgacgatctgttctcctggtgctggacatttgagttgtttccagtgtttggctattatgaataaggatactatgaacattcatgtatgagtccttctgtgacatatgctgtcatttccctggctcctaggaatagagtcactcagttttagggtagttgtatatgaaactgccaaagagttctggtttgacactgaacttcagagtgatgaaatctttaggtttttttttttttttttttttttgtacacctccccttggagaaagatggtacttccagttcttattaaacctcttgtaaggggatcaaagaattatttgttttgcactgtattgcatgtttggggtttcatttgggaagaaagagagttgagtaatagctactttttaaccttctgaattcagatccaattaaggaaggagccagaagtcagacaattgatggcctgaatatcagctttattactgatatagctgatcagagcacatgtcttagatttgtgaccagatgggctttagacactcacctttccagtcacaggcaggcttggccatcccagatttcccacacaagtaggaagagaaaatctgcctctccaaaaaaggccccccatgcagctgagtcttcatccaagccctactgatgagataggtctgtctcttccaagggaaggcccttgtaggtgagggatagaagccaagggccagatggtggcctgttcccccatgtgtctcccctggaagtagaagtagaagctcttatgggaagcagaggcacgtgggattcacttcctaaggaaagctcatgactgctagcaccccaaccatgccacagttcactgtgtttcaaaccttttggcagagcgcaattggtattagtgatttaattcagtgctccatcaacacagaatgattttaaaaatcctacttctcagaagacaatggtggcctaccagctgagacttactttttaaaatttggattatgtgctctctatgtatgtatgttttgcagtttttatatctgtattcattcttagcaggttctgaaaatctacttgatgggttgccaggcaattgttttgctattttaatgtgtgttaatgtattgtaacattgtgttccagttactaggaagaaatacaaaaagcagatgtgagcccaagagtgatttatcattcttgatgtgctattgttgtaccttctttattttaaaaagagcaaactatgttaaacatgaggtcataacaggctgctctgctctctacctaattttatttgtaagtaagctacagaaataaaacattttacttatttatatattttcaaaaacttgaactattaacctatagagatgagaaagaatttcaacttgggtgataatttctgctttctgttggagctgcatactacctggttatgtttaactgtctccctgccatattggtaaggtcattattaagtcttctggaaataaaaggagtgaaaacatacattcatttttgtggcttaaaaagttattttaaaggcagcaaaattgttttttaaaagtttggttattgaatagtagaataataaatataaaatatatttattcattttcgtagtcttctctacatgattttacattctgtttgatttatttttcaaaaataatgttggttcttagtgttcaaaatgcacattagttttcttcttggggaagtggatgatcaatggaagacatttacttaggggggatatatagaatttacctcatatttagaatttgaacacttatgacacttttctagctattgttgctttctatcccaattgaagttctcactgttccaccttcacaatttattcctaatcataacccagtgtaaatatttttctgcttatcatgaattggttgaatgtctttagattgtttagtgaaattgtgccaaagagaatcaggggttgtcagtcctagatggccctatgagtattctgttgccagttctttcctgaaaagcagatgctgtatcagtttgaatgtgaagtcataatttttgaatggaatctttgcataccatactgactttcctttctgctgtttcagcaccttatgaagctaggcagccccttgtccagcccgagggatcctcatcagggggcccaggaaccaagccccttcggcatcaggcttcccttatccgggtaagtgatgatgcagggttatgccaatgggacagtagagtcaagctttgggcttcggggacatggctttttgatggaccctttttcattgcaaggaagatataaaactgatccttcatgcaaatattgcatgtcttgtttggttgcttgtataaattactaaatcttttctactgtgtatgtctctacgccttctcagtgtctctagaataaactaggctgcttcttgatctttagtatatctaaaatgtccctctgccttcacctatctaatcattagccaccactttcaggagagcttcactttttctaaagcagcccatcttgtctctgccttattctttattattactcatttaatgcatagttaactgttttccatttgttttgtgcctctaattacatggtaaacttttggaaggcagaagtagttctgtattctctctcagtgcctagaccaagagaacagttattgtacaatggcagcagctgctgtttccttatgtaataaatacaaaagaaatattatggcaaaagcttctggctataccacagcttagacaatttcagcttccctttctgcagtgttttcctttggataaagagctcttattttgttctctgtctgcagctgttgccttgtgtagtgtctctgggtcctgtgctggggaagttatattctcaaagaagggtgtgtgtgtgtgtgtgtgtgtgtgtgtgcacgcgcgggtgtgcaggtttactatttgacactaaagaggaagtggggcagtttgtataacatttcagtcatctaactcgggaataaggaacatttttgcacaggcacttctactcagaatagaagggtggtgtcagacactcccataaagatgtgggctgctaggttggaataggataaacaaagtctaaagaaggtcctggggttcatggaataccttctggggatggggcactgtgttagatgtggtgcagaacttgattttctaaggtgggactctgtgtacaaataatttcttaaagataataatttagccataggctattttttatatttaatgcttcctacaaccataagatctagttactgctgcttctaatagtataagtgagttgactgtggttgagagaggtcaaatagctggtttaaggtttcattcataactagtcagtgacagagccagaatttgaatccaggcctgtccaatgtcaaaacctgctcctttcattactttgtcctacattagagtcccatattacaagaaggctaggttctagagttgctacataaagaaacgttgggtgtagtaaaaaatactcttgaaaaatcccttattgataccacactggagaaccaatatgccatttgctcccagggccagtacagctcagttttatccccaagttggaaaacacatttgtttcttcagctgagctccagatgtagtagttggctgtgtttagagatcctgtggtacaaaaatatgtgcctttaaacacgagaatcacacccactgtggagtgaggtttacgttagaaaaggtatcagtaggactgggatttatccctaagctctccaaaatgtggctgtgtaggttcctacagagtgtgtcctgggaatacagaggccagatcctgaatggttaggatgatagtcaaactaccagtgcatactgagctttacagcagtgtgactgggctcactagaccctttctacctagcccctggctggcatgggcatggatgctcatttggattggcaccctgtggcttctcttctaatctccatgttcccttttctgctgacaaacatgcttcatgagcccttcactcaactaatatttagtgaacacctattaagtgccaggcactgtgttgagaatacaaaaatgaggtataacactaacagtttctgccctcatggagctactggagagatggtcattaaccaaaccaccacaaagtaaatgtataattatgatatgggatatcagtaggaattacactgtactttaaggatgaaaatgggcatggggtatgacctagccttgaggggcaggggctgatcaaagaaggcttctggtgggggagcaacattcgagttggaataagggtacatgggtgttatccaggtgacagggtgggagtgcgggagcaaggtgacaagatggagggaaccgcatatacaaagacatttcctatgggtttgccattttatgaacattatctctttcagtgcccacagctatcttatgaaataattagtgttgttatcccattttcagatgtcagaacctgaggtttagagaccttatttaatttgcccaagttcacagctaggaagtggcagggctggagttcaaacactggtcaaggttcctcagtctctggctcaggaaccagatagatggtggtgtcacctgttgagctaggaagccctagatgaaatactggcactggggaaagatcacaggttcagtgtttgatgtcaggaactgaggttttgagatagtccagagaagctgttgaagaactggtagattacatgggtctggagcttgggagagagcttaggctggacataggtatttggcagcaattggctatcagaaggtctcatggtatagtgcagaaaaaaccagacaggtgctcgcccaagtccagcaaaactctgtgtgaccttgggcaagttccttctcttttctgtaatacaaatgacttcgaatggatttaacagcccattgtaacaatcagcaacagtccgattctcttaatgtgtctgtggttttcatggctggtgtgtttttctttcctctgttcttaggtttccttcttatgcctgttaacttggtttggctggactccgtgttccagaaagcaaaatgccaacctggattagtcatgtagatgaggggatttgaagtgaaggttcttggtgataagggattaatgtttactgggcatggtgctaggcctaggctggggtgactaatccccctcatgttgtcacgttgatgtgccgatggcaaccttctttctcttctaactagttctctggccttgtattcaagttcttcctgcctgattacaagggggcatgtcctctgggtcctgggggaagcctttagggactcccagccagtgctgttgcaacccatggtgttggcattttagaggtgcttatgccaatccagtgcctaaacattggaatgatttgtctttttgcttactattttaggaatttcacttttgttcgggtgttggatttttttccctttgaaatttcagacactaagcatatcctatgttggtagatgattgatagtgctttgtaaagaaattataagacttattttctgcttcatctgttatcatatgtttagatgttgttttgtggtttgtttttcacaaattaccctcaacatctagatgatgtagtcatttgtaattttgctggcaaaagatttagaattgcacgctttattcctactgttctcagctgcctctgtttttgccagggtcatgagaaactttatgttaagccgttgtctttattgtctccttggcagctgtggacactgaccatcttctcgaaatgctctcatcatttggtgtccattatgcctgctctcctggttttcctcatgcttctatggctgcccctgcctcatttgtttcaatcctccttcctctgccctccccttgttatgctggagactgctgggcctacttctcactctacttactctttagatgtgtggatgctcatgaccacatagcaccatctgccagacatcttcactctaatgttccactgtcactttcagctgacatgtctttctcataaaatcagctttcactcttccactcctagctccacccacccatcagcacaggccagaatgctggtcattgtctttgacttctctttctctccttatgcctgttcagtccccaagtcctgaccataccacttttcaaatagcttgtgtctgtccatgcctctgtacttcttcgttcaggccattatccttttcactgattgtattgtattagcctctctcttgtttcttcttgcttccacccttgccttcttccaattcattattctcattgcacacaaaaacaatcttaaaaacacaaatctaatcatcctgctgacttgattgaagcctgtccctctctgcccatggctcttaacatgtcatccatgttgctgtctggccctcgcctacctcctcggccacagcagctcactgccgctttccctccactctctggccatttcccggatggtcagtgttctctgcgtgggagccttactcttcaccctcacttttgccttctttgttttctcctttgtctcaattcatctatgcttttttccccattaagaacgtgaaacgtaagtgttttctgatattttcttgtatatgcgatgtttcctttttttttcattcttaaaaagaaaaagatctattgcttgtcagctcatttatgtgtgcaactcagccagagggatgggcgtctgatcattattggtttcccatctcagaggcaaccagggttgcctgtttcttttgtatcattctaggaacattttacgcatgtacatgcaaatataggtattcatatatattaatatgtgtgtgtatgcactatatgtatttatatatttatttatttttttagacggagttttgctcttgttgcccaggctggagtacaatggcaccatcttggctcactgcaacctccacctcctgggtccaagcgattctcctgcctcagcctcccgagtagctgggattacaggcattctccaccatgcccagctaattttgtatttttattagagacggggtttctccatgttggtcaggctggtcttgaactcctgacctcaggtgatctgcccgcctcggactcccaaagtggtgcaatatatttttacctgaatttagggagacatgtttggcaaatgaatatattcttccagctagattgcactagaaaaaattatcttttatttaaaaccaaaacacattcacttttcaaaccctcaggatactgttgtgatgttttctttgctttttggagggatgaaagtaacagttttctagaacatattctcaacactcactactcttcttcagagatgaaaaaatgacaaacagaatttagatacctctattactctaccattcctcagggggcttagctatatttttggtgtaagttttctaatgatcaggtaggggaggggatgttaggcattgttagccagcaccatattcatctcgaagtgcataacttgaaaaatgtttatttaacttagttatctcctttcctcctcatctcagtttcttgccgtacctcctcccctagatataactgcaggtacttacggccagaagcaggtgatctccactccttgggtcctcttggaacccaagagaaaaggcaagtatatgaaagatgattaaagaaatgaatattcctgaggctctgtcagagtggtgttggcctgagtcaaaagataattgatagtcaccacaaataaattgttcattctaagagctttgatgaaaacagcaggaaatagcctttgggggaggctgatattgcaccgagagatcttcttgtggcatgaaagatattttatgggtagactggaccaggatgcaagcaggataaggagagcggaggagtgagaatgactgatggtttgggatgggattgagtgaggtgggttagagttgagtcatgagagagttggtcatctgagtttggaagaagagtgaagcaggtaaacaagcggggcatactgggtactgtcttggctactctggttgtctaacctaatactcagcccagggaattgacccacagagcaggtcaggcccgcccggattcttttggggttcaagaattatttaccaaggcattacttggtaagtaagtgttcatacgaacgtgtgtgagctctcaaacacacttgttcttcagagcaaatacagattttaaaaatatgtcaaacattcaacagatacaaaagggcacagtgaaaactgtccctaccatttccccgcacagccactcatcccaggggcaactgatatgacccatttattttgtatagtactatacaaaacatttatataatattgtatatgaatatcttttttatatacaagtgaaaataggtattatatataattacatgtaatatatgcaaaacacagttatgcttttttacacatatggtggcatactatacatctaacatgcatttagcactaacaataagctttattaacgttctatagcagcacataaagtacttcctcatctttttgttttttacagatgcatagtatttccttgtctgcgtcttgtgtaaatcatttagccagccccttttgattgacatcttgtacttgcaatcactgcgttgtttgcagatatatgggagaccaattcctagaaattgaattattgggtgaaaatgcctatatatttgtaatttttgataacgactttcaaattggaggtatagcagcctatgtacttgccaacaatatatgaaaatgtctgttttctcgtacctttgtgaaaacaatgtgctaacaaatttatgggtctttgccaatctgataggtgaaaaatgatagctcactgtagtttaattagcatatctctttattagtgaagtgaaatatcttaagtttatgagtcacttgtatttccttttctgtgaactgttgattcatatcaagtgcccctttttcttttgagtattggtttgtcattcttaatggcatgaaaccagaagctggtctgtcttttcctttggaccagagatatactggagtgtgtgtggaagatttctccctgagtggtgagaggagatgctggcacctgaggctctcgaaggaggttatggaccccagctgcttcccagttctggagaaccccaggcctgcctgcagtgcagatttcttgtttataaggtcatgacagtaaagttgaattacttagtttatgggtagagattagggctaaaaaaaaatcctctgttgttagagatggtaaatgtcaacactgtgtgtgtgcgttgatctctcagcattgcttagacagctaaattatgttcctttcactgaaatgggtgggaggaggagatagaggtagagataaagatagatagagggagagagtataagtgtgtgtgtgtgtgtgtgttaggaagagtgagtttgatgccttttctaggtatgtatgtgccttattcttgagatcttctttcaccaaattcattcctcgtttcatttgagaccccagctggacgtttataccatctcctaaggggtcaaaggttaacatgtcctccaggtgtcctacttcactgagtctactatagaacccacatatacctgaacggacactattgccacaaggaggtcctattttttcatagcctccagtctcctgcttacttattttcttcacctgcttgtagttctctttctgattttctagcccttaacttttgaggaaggatttctagctcttaacttttggggaaggaaacatttaatctcaactgatactgaagtttattttctcagtgccaatcttttctacttgtttcttttttcttttttccttttcttttcattgattgattgattgattgattgagatggagtctcgctctgttgcccaggctggagtgcagtggcgcgatcttggctgactacaacctctgcctcccaggctccagcaattctcctgcctcagcttcctgagtagctgggactacaggcgtgcgccactgcgcctggctattttttgtatatatttcttttagtagagacggggtttcaccatgttggccagggtggtcttgaactcctgacctcaagtgattcacccgccttggcctcccaaagtactaggattacaggcgtgagccaccatgcccggcctctacctgtttcttagtgtattcctcaggtgctcactgtgtaccacacttcttgacaataaaagagatgtttagttaatttagcctcccagaggtagctgaaaacactggtttgaactgctggttccaggcagtactttgtaaatctggaaaggatagtagcttattccccaggaccttttggtctcagttatatgccaggctatggatatggaagacttctttacaactggcaccattttagcccctgggcccatcagtctttcccttgatctcaggcgagcagggagtgtcatgcccccccagttgcctatcccaacaatagtcactactgactgaggtgcttctttggtcccagtgctgtgctggcccttttcagtcctcccaacaatctcacaaggtaggtattattacatcttccatttgtccatttggaaatacttaagtggcttccatgagtcagccaccatgccaggggtacactgaggagtacacctatagcctcttgctctctaggtgcttgcagtcaaaaggaggagatagatttgaatcaaatgatcccacctatgcatgtggaattaaaaactgacaattgccctaaaggccttaaaacatggtaccatgtagcaaaggaatccagcctatagctagaaagtgagagaaggctcctttaacaaagtatgtgttgagctgagctgtgaaggatgaatagaagttaaccaggctaaggaaggatggtcctgggaggtgaggagaggagtggagtgtttcctgtagaggtaagagcctctccaaaaccgcacagcagagctgggctgctgagagagctttgcttctgtcacaatcagaaagctacagcattgggaaactgctgccctagtgtcagctccaaccagatccacactacaaactaccttggcagccaaatgaaagctttgttccctgcctgtaacttgggtctgcatccgtcttccgtgggtgtatttgttgagtggaacctaagtcctatttggaattctagcagcaaaggtgttttgacagtggagtttttagctagccagcttgtgcagtgctgggacttatgctgacgggtggaatggactcgtgacccagtctctaccatatttcacagggagagcagatacatttgaagaactgaaagaaggcagctgtggctagagcctggagtgggagggagatgaggtcggagagggaggcagggccctgtgggctatgtgactgccttgcaggtgggagctgatggctcagaagttaatttactggttagtaagtgaccatgccaaattggaacccaagtctgtctgcctctggaacctgtactctttttgcacctccagtcagtagcctcattctccaaagcattcttgaattctgtccaagttgtggatgcatctgtttcccatctgaactcagactgccttgagtgtgaaggggagaacgtagtgaagagacaggcagccttggcctgaccagcaaggacaggggtgggaacgtcatcgcttcgttaatggaagtctgcagccttgtcagagtctcctcttactgctgatttctcatttttcttggctttctcctctaagcagagcacaaaatcctgataatagtgaaggaaaagtgcccttctggaacagcaaatcttggcccctgaggggagaattggaggcagtggttactaatgagcatttcttatgttaatcaaaatactgttagcgccacatactgcaatcacagtaaaatgattacatacctggattgtatggctagctctaggattcttttgtgatgacgtgccagatgcttacctgcaaaaattatgtgagaaataaaatggtgctctgtcagtatgatttaatagttcgccagccaaaatctaaaactaaactagatgatggggaggaaggtgtaatacagcatagtcatagctcaagcacagatcctcaatctgcaaaattgcagcaatgatttaggcattgcagtgaggttctttttgtaataaatgctctatttttacaggatggatgaacagatagagataactatagagcttgatgatcaagtgtacgtactttggacccagtttgtattctggctctaccatgtgccataggtgtgtggtcttggtaaattacttcccttacctaatcctcagtttcctgttctgcaaaatgggaattaccggatttacctcgcagggttgtgaagatgaaaattgattgtgtgcattaggtacttacagtgcctggcacttagcaaagcaatgaatgcttgttacctgacattcttctgtgtctaagtgatcgtttcaaaaagtatagcttattgtaataagcagcaactgtgtgttgcacattaggctcagagagattcctacagtttggcagtcagccttctgaactattgaaattagatccctaagtaagttaggtaatatgtggttaaaggcatctttgtgggtttatttccctgaagaaacagataaggttaaatttctctgttgggacttaattttaactaacttctctacagaaaaaccaaattatttattgcaacttcctgtgaatctataattattttgaaataaagactagaaagaaggagttttttaaaaagttctctgacttcagaggtaagggagagggctcagcctttatagtgttggatgacattatgtgataaatgcatataaagttcagcttcagtcagcttaagagaactcaggttaacctttctctgtctctagactgggattgagaattttttcgaatgtttgtttgtttactcattcagcaaataacttattgagtgttttgtatgtgttagtgacttttccaggcatttgggatatagcagtgatcaggatagacaaaattttctgtcctcctgggttttatgggatagcatggggtagggtgagaggcagagcataaacaagattgatcaagcataatttggaatcgtttcatgttaaaacaaaattgctaagctctgtctccttttctaggtccttttcttcatttctcattgaacactttccccacaattttacttgagctgtcttttctttttaactgggaatctccttcaaatccatggaagatgaacctatattactcaaacacagaaagactactataaaaatgaatcagcatcctggtcctatagattgtctgcatagataatcaaattagaatgagaaagttgtttgggctcataatggtctaatgtcattggtcagattgcaaaaccacaatagcttcaggcttccatctccaggatgggctttgtggttgtgaagggcagatcttcctttcctttgggtcttgcttgaaggatacattcattgagggaacagctgctataacaaataggccccacattttaatgactttgcacagtaggtatatttctcactaatataatagtttggcaggccgctgtcctcagcatggtgattcatgcaccagagctccttctgtcctgtcactgtgccatcgtctgttcagtgggcacataggaaagagagtagaggagtgctacagggtactagtcctgcttggaagtagggtaggccactggtgctcacattgcaatggctacaactcagtcacatggctgcatgtaacttcaagggaggctggaaaatgtcatttctggttgggcagccacttagtgacacctctacaccaggcatagtagagcatgaattattggaggagtctgctgtaatcccacctatcagcactgccaccacttgcttctgtgacttttttttctcagccccatgactgaccaatttccttgatctttctttagacaaattgatattcacttgggctatagtgtagtctcaccagcccattagctatccttttctttacagtagtcaagtcttctcacatctttgctaatgagatcgttttgatcagcaattgccttgtggtagtcttatttccaaaatatttttggcggaggaggcatcctcagatattcactgtgggcttagtatgagcttttgctactccaaatagtttgtttactaaggcactaacaggacactgttaaaagatcattacccctcataggtgaaatggctggactctaaaacagcatttataggatgccttcggggtaggtttatattttaaacagaaatgttctatgattgaaacaatacacacacccttcttaagttctctccaacaatgcttccttgcaattcatattatttagctttgtttgatttttaagatagtttgatagtaggggtaaatgttaccttttgggattttattaatagtattactttttaatgagtcttttgaagtctttcattataaacagcctgctttccccagagataataacttgccatgccaaatatttgcatttcacttgaaacaaaaccaaggggttgaatgttttaaatataagcaaatctaattctcctgtgtctagagaaactgtataatgaaccatatgtatgtggcttaagcagacagatgtgaaagatttctccctctctccttttatttaaaaaacaaaacactggcagagctcaaaattggcaccaagtagcaaacatctctgctcagccaacaaaaccactggagctggagttgatggggggaggcctctttagggtgcatgcaaaagtggagcttttcctggtcctggcttctacttggaaagctaaggctccacagcttatttgccctcatttctcagtgccttcaggcttcaaaatgagccattctcaggtgactgacttttcagatctttgagaagattgttgtggttgattgttggactggttcagaagacatgggtccacgcatctgggtcctgcggtgacatggcctctagctgctgacagagtggtgctgagctaccaaacagactcataggcttcctttcacaaagaacatcatagggcagtgtttccacatctcttgcaatacaagacatacctctgaacttcctcaagcttgccaataagtagagctcacactaccttttagtatctgtgatgtacctgccagggactataggtgggataaagtatctgatatggctcctgtccttcacattgaaacctgggtgaagatgtttaggaacactttaaatgttcaaactgtggtacttaccatgactatcataaagattcatatatatttttttgagacagggtcttgctctatcacccaggctggggttcagtggtacgatcatggctcactgcagccttgacctcctgcgctcaggtgactctcgcacctcagcctcctgagtagctggaactacaagtgcatgccaccatgcttggcagtttttaaatattttttgtagagatggggatttgccatgttgcccaggctggtctcaaactcctagagtcaagtggtctgcctgccttggcctcccaaagtgctgagattatgggtatgagccaacatgcccagccaagattcatattttttaagacgctcaaatcacttggcttagtaaatcaatttcaagcatacagcgagaagcaaggggaaagagatgggggggtaggttagcacacttagtgcaaaccagtagaagggccactctatgggttacacagaactcatgtgccctctccctttgtcctaaggcctttctaggtttaggagtaggaactctccttgcccacttaagttttcttggaagaggggttgggttctcatgggaatctaagaaatgagagccaaggaatggcccactggtctgtaggggtgggagttcttggctgttcatgcttgttctactgttaacaggccttgccctggttgtgttaagtttgctccactgtccacttatctttaggcttctgcagcctttcttgcccccccccccggctttgtgtcctttctgtacctacctcccagcttgtgctgatgcttggttctggcgccctcataactttaagtcccacctaccctttctctatactacagccccactgagcatctgtttagggtctactttctcttctcattggccttgatatttctcatccacattcccaagaatgagcatctgacctaagcccttgtcagagcatctcaaaggccagtatactgtgtgcccatgaacccttactcccactcaggtgacgccaggtgtgaggtgggtcatggtgcccacacaaggctgccaggcccacctttgcagcagagcatgggaacgagcagtgccgtctgtcatggccgtgggtacggcaggtacattggaggatttgagcaggggaagagtgttctgggaagaagacaaacatcttacccctgaggagtgagcatgtgcagtcggaaagcctgctgagaggaggctggggtgcgaggcttctgaaggccaggtggaggaggtggacttttctgttaggcagcaggtcatctctgcaggcttttaagcagaggagttaatcacccccttctgttcattcctgatttctgttgttagagtagacctgagacctgcctgctaagaggccactaatgccacgctggagtgaggtgatgtcaagaggagctagaaagcagatggttatggcattgaggaaagagcacacatgggctgacagggacagctaagcagcagcttcatgagcaggagggaaagggcgtgttctaggggagcagcagcttccatgtcagactcaggaatgcagcagacccaacatccagcttggagatttcttctctttttcttttttttcaatggaactgtattttcgcaaaatgttacagatcacttatagcaaacagaatggtgatggtcaaggaaactgactctgggctcctttttgaccgcagcagctatgtggaagcagctgcagctgtgataagggccgcccagcatggatatttctgtgtcttcgttcactgggaagtggagggacagagcttccgacccacatcccaccttcttcacgaatcatctttgccaccaaatcgttggctcataggtgtctgttcttgtctttcctgcccatgcctggcttttaggttcctttgctccagctctttctgtcagggctgacctggagggcagtgctcctgtgagttctccacattatatcatggccggtaatctaatccaattcaagctgacattctccaccctatgttctaccaatggaacctggtcagacatctgggctcattcaggaagtgctgctagggcatggctctggaatttggtgggagtattttggaaggttgtgtggtctgtttggttgtttagtgctcggactggattttgattttttttgctttacttatttttactgagacggagtttcgctcttgttgcccaggctggagtgcaatggcgcgatctcggctcgctgcaacgtccacctcccaggttcaagtgattctcctgcctcagcctcccgagtagctgggattacaggcgcctgccaccacacctggctaattttttgtatttttttagtagagacggggtttcaccatgttggctaggttggtcttgaactcctgacctcaggtgatccacccacctcagcctcccaaagttctgggattacacgtgtgaaccactgctctgggcctgtttatttttataataataagaggtttttgaaaaaaattcagatagatgcaacccagttaaaaaaaatcccggtatacaaaatcctgcctttgaataagagattaaaaaaagatggtcattatttgctgcctgcaggggttcactaagggatatgggtaagttcccttagctcggaaaaaggataataattaatacccgcttacatctccaaagtcttgaggtgctcaaacaagtaggagtgtgtgaaatgctttgtacatatcaaaacactctgtgaaatttaaggtattaactaatggataatgacttcttgaacatttaagagtggtttgatttacgtttagtagaaactcatctagtatgaaaatgatacatttattacaaatgattaacaaccctacagctctcaacctctttatgtaaccttccttctgactaaaggacccagatgactttgaggaatagcctgtttgctgggtgcattctcactcagcacttctggaagtatccattctacagttagtatttcatctcattgtcctggccttccgaaagcacccttaacccaaggtgtgagatatcaaagtaatacatattttacttcagagatgacatctcaaggttttacagtagctcaacattttctagtctcctttctctgaacattgtcagaggggagacaggcgttcctgggaagaattaattcctggaatggtgtgtgtgtgtgggtgtggggaatgggaggagatggccggccttcttttctagggttagtgggtggaattgcccgcccaatgattaattccctccttgacagtgtgttcagaagcaggcaccttgatggctctttagcagcaataccctcctcttctttcctagcctccttttgtcataaagcctcatcttttttatttatttttatttatttttttttttttgagacagagtctcactctgttgcccaggctggagtgcagtggtgcgacctctgctcccaggttcaacttctgcctcccaggttcaacctctgcctcccaggttcaagtgattctcttgccttagcctcccgagtagctgggattacaggcacgcaccaccatgcctagctaatttttgtatttttagtagagatggggtttcatcatgtcggccaggctggtcttgaactcctgacctcgtgatccacctgcctcggcctcccaaagtgctgggattacttgcgtgagccactgcacccggccaagcctcatccttctggtgttcacctcttggtcctgttaaggtggcccttggcaagtacctctttagtcttagggttcatgggagggatagaacaaaggcccacgcctccccctagcatcgacatttcccttcgtctgccaatgcctaccatagctttgttttctcccgcactgcttccctggttttctaggctcttaaatcctcaaatttgacttgcatgccctctagtggcaggtctgatgcaccccttgttaccctgtttattgtggtaccataacagctgttctcaccacccagctctgttactaaatattgtctgtaattcacaaatgccaaatgagaggttcagtggtcctgacttgccactcaagtaggagctggaaatgtgggatttgaattggagcttttgattcctggatttatacagcatttcagtgtaacggcaacagtaaaaaagatgtggttatagttgttctagtttcttttttgtcatttaaaaagaatccagattattttactatccactcagctaatctgaaagaatgaaaatgtgaggaatagtggaaaataagaatgatcatctttttttaaaccctttattacaattagaaatttttttgtcacttactgagtattcagtatttcatgcctcagtcctgttaactttgaagaatacaaaaaatacataaagcatgatgtctgcccctaagtttctgttctagttagattctagttatgaggcagttaaatttcttcacctgaggaaaaaaattaagcataacacatgataacttttattggtgtttaatttttctacttctcactaaagacaggttctctgagcatttactttttaatttattcttacagtccttttcagtggagagggaactacaggataacagcagttaccccgacgaaccctggaggataacagaagaacagcgcgagtactatgtcaatcagttccgatcccttcagccagacccaagctctttcatttcaggtaagaatgtgggctccctaggcatcactctcaccagaacatagccaccatcttgagaaatcattcacgcaaaatgagtatggcagccttctgtgatttcagtttgtttttcatctaaagtcgaatttcttatcagatgtaaaccatgcagaagaaaagttgccaatgacgtttggaaaattatatttccatttcaaagggcttaagtgggaatttgggggcaacttggcccagaccctgcaccttatcagctgaggcagttcttgaaatgctagcgtgtcgccccaaggggccacctctcattgcttcctcgttatattagagctcgggcaaggacagaatgtggcctcctaaggagttggtgtcacaagtctttttatgttatatgtgccttcaaacttcaaactcaggctcgttttctttggctcaaatgtttgtcctccagtttttctgagagaaattaaaatgggggaggaaaattggccagtgctttcccacttgtcagttcttctgggttgtcttcagatatatagattcctgttgagttctcatgtaaaattcaagctcagaggaactggtttaatgccagtgtggctacattttaccaggctgaaagactaacagtgaaatagtagagtctagaagaaaaattcataaagctttctttttagactttaaaatttgaagaataacaatatgtccttaataattgtaacctgccatattgaagtgtgggcaaagattagttttatcttgtgaaatgaggcacataattgaaatatacttgtataagtaattgcaaacatcatttactgattggtggtaatggctttattgacggcagaatagtacagatacaacaaattaatgttgacgtcatgattaaggaaaataagcagaaacccatattgcacgatttgaccacttgctaaccttaccccgtgctcaggtgagtttctttacgacatgtgcagatatttagccaaatacaaacaggtacttgttagaaatgtttttgttttcttttaacttttgtatcttgcagaatttcagatatagacacaactagtctggctgatacaacaaacctctgtgtacctatcacatagccccaatgattttctcttacctacagttaacacataaggttgtttcagtcagtcaatgatggcggtaccataacagtatcacggagctgaaaaattccagctccattaatcacctagtgatgctgtagccatcatgatgttgtagcacaaggcagtgctcacataaatgtgatgatgctggtaaaaacaaatctgtgctaccagtcgtataaaagcctagcacatatgattatgtacagtatataatacttaataataaatggctattattagcttattatgtatttattatgctatactttttttctttcttttcttttttgagatggagtcttgctctgtcgcccaggctggagtgcaatggcacgatcttggctcactgcagcctccgcctcccgggttcaaatgattcttctgcctcagcctcccgagtagctgggactacaggtgcatgccccacaccaggctaatttttgtatttttagtagagacggggtttcaccatgttggccaggctgctctcaaacccctgacctcgtgatccacccacctcagcctcccaaagtgctgggattgcaggcatgagccaccgcacctggccttttattatgctatacttttattgttattttagagtatactcttacttatatataaaaaaaagttaactgtaaaacagcctcaggcaggaacttcaggaggtattccagaagaaggcattgttatcctaggaggcggcagctacctgcaggttattgtcctcttctagtcacctccacagtatagaggtggaagacagtgttattgatggtcctgaccttgtgaaggtctaggctgataagtgtttgtgtttcagtttttaaccaaaaagtttatacgtgtttgtgtttcagtatttaaccaaaaagtttaaatggtaaaaaaattaaaaattttaaaaatagaataatagaataaagatataaagaaagaaaatatttttgtacagctgtgcaatttttttaaatttttaaatttttgtgggtacataggtgtatatatttatggggtacatgagatgttttgatacaggcacacaatatgaaataagcacatcatgaagaatggggtatccatttcctcaagcatttatctattaagttgaaaacaatttgactacactcttaagttattttaaaattgtacagtgtgtttttgttttaagccaagtgttattacaatggagtcaagaaggttaaaataaattttaaagtttatgaagtaaaaacttacactctaaggttaatttattattgatgaaaggatttttttttttggtaaatttagtgtagcctgagtgtgcagtatttataaagtctacagtagtgtacagtaatgtcctaggccttcacagtcactcaccactcactctctgacttacctagagcaacttccagtcctgcaagctccattcatggtaagggacctacaaaggtgaaccatttttcatcttttataccatatttttactctgccttttctatgtttcttctttctttcttcctttcttcctttctttctttctttctttctttctttctttctttctttctttctttctttcttttttttttttttttgacagggtcttactctgtgcctaggctggagtgcagtgatgtgatctcggctcactgcagccttgacctcctgggctcaagtgatcctcccacctcagcctccctagtagctgggactgcaggtgcacatcactatgccttgcctggctaatttttttgtagagaggaggtctcactatgttgcccaggctgttttctatatttagttgtgtttagatacacaaatagttactattgtgtcccaactgcctatagtattcagtacaggaacatgccgtacaggtttgtagcctaggagcaataggttctaccatctagcctaggtgtatagtaggctataccatctaggtttgtgtaagtacaccctgtgctgttcgcacaatgaggaaatcacctcatgatgcatttctcagaacgtatccctttttctagaaatggaatctcataatatgtggtcttttgtgtctctttcatttagcataatgttttagttttttttttaattaaaacatttgtgtgggtacataggtgtatatatttatggggtatgtgacatgttttgatgcagacatgcaatacataataatcacatcatggtaaatggggtatccatcccctcaagcatttatcctttgagttacaaacaatccagttacattctttaagttatttaaaatatacaattaagttattgactatagtcaccctattgtgctatcaagtagtaggtcttagtcattctttctaactagttttttgtacccattagcaatccccgcctcgcccctactctctccctgccactacccctcacagcctctggtaaccttccttctactctctgtgtccatgagttcaatcattttgatttttagatcccacaaatgagaacatgcgatgtttgtctttctgtgactggcttatttcacttaacataatgatctccagttccatccatgttgttgcaaatgattggatctcattatttttttttaatggctgaatagtaccccactgtgtatacataccacattttctttattcatctgtcaatggacacataggttgcctccaaatctcagctattgtaaacagtgctgcagcaaacataggagtgcacatatttctttgatacactgatttcctttcttttaggtatatacccagtagtgggattgctgggtcatatggtagctctaattgtagttttctgaggaacttccaaactgttctccatagtggttgtactaattcccaccaacagttagcataatgttttaaaggctcattcatgttgtatgtaccagaatttcattcctttttatggctgaataattccattatatcagtacatcccattttatttatccattcatcagttgataggcatatggtgttcttccacttttggagtattaagaataatgctgatttgaatatttgtgtaccagtttttatgtgaacatatatttttatttcttttgaatacatacctaggagtggaattgctagatcaaactgtactgggagctgaaagcattcaaattcaatctcagtaaggtctaacatttcaagaacagctgggtcttgcagttatgtaacatgtaaagtggaatgattgcctgatttcagttgatacaggtaaatcaacaatgaaggaagaaagattcctggataagtttctcaaaatgccactaggaattcttaaatctcaccaaaagctttcccaagatgtctgtcttatctctgtgtggtgtgatcaatggtattaattttcttctttttggtcagttttctattacttttctatttgaaatttctatttgaaatctgccaaatttgttcaaagttttgaacttcgtcttctaaatttttggaaaaattttgcagattttggtaaaaatgaagcagaaattaatttatgtgatttgcatctttcatgagcattatgttattgcttcttttgccctattgtaatttacatatttttaaaaaagctattcatgtgttgcttttggtcccatgattcataattgctttgaggaataaatatgtttgtggttatacagaagagattgctgaatgaaaaaattgtgattcatttgtatataaatgtaaaagctactctagctgagtaattaatggtttatttaaacaatggcacttgacaggttctgtggccaagaacttcttcaccaaatcaaagctttccattccagaactctcctatatatggtaagtacaattaatgccatatgacattcataccatcatccataactcatcctttagttcctacctttgcattttttaaaggcttatgttttgaatgatgtttttaacagactacaggagtgaatacaactcagatttttgttgctgtgaaaattaaatgttatatgaaaagtacaatgaacaatgtctggcacgtattaagcactatgagtgttaactattattttaaagtaatttcctaattattatccccatctcaatcccttttcagtctaggcagttgtgggcacatgagacttaccatcctgtagatttcattttcagacttttctgctaggtgtgatacaagtaaccagaggagcttgacaaactattttttatattttataaggctgagtgaacagaaggttgaggaatattttggagttaggttagatttgactattctagctgcctctgagctttgcaaatttggctggtgtttatcagttgggccctaattcagacttgcagctgtggtatccactgcacctttatgcactctggttccaaaagggctatgctgggatggtccagatggctctatttgcattcatgaaaatgcttggtgctgctgtaaactctcggctgtgtgtgggctagttcttccccaaaactgggcaggagatcgcactgctataaatatataattaaaaacattataatgtttatataaagctttttgcatgaggatttacagaattatgataggatttaaaattgcttgtcatgttttgtgcatcttattggaaaactactccaataatactcatgcatgtcaatgtatctgggattctgagctggatttaggttcttcaacaatatatactctggcataatttttttgtttttacaagccttatattagttttgtttttgttttgttttttgtttgtttgtttgtttttttggagatgagggctcactctgtcacccaggctggagtgcagtgacatgattatagctcattgcagcctctgactcctaagctcaagcgatcctcctacctcagcctcccagctagcttttcatttttttctagagacagggtcttgctatgttgaccagtctggtcttgaactccttgcctcaggcaatcctcctgccttggtttctgaaaactctgggattacaggcatgagccaccatgcccggcccttatattagattttctggctagggaagaataaagaaattatcattttgaaaagaataccatttgttttggcagaattcccagtctaaacattgttggcatgagacctcctatctttttgttgagacacgcctatgaaagctgaatggtattctttcgatctggcgtatgaagcagtttcctgacccctcactctggggaacagctatttcagggccccagtgcattcgaaattggaggaggaggatgtaaatggtctaaaggaaagttatggagcttaccttagaaatatattttctttcaaatagtaatacctttctagaataattttgtatttgtcttatctctatgcttgtcctaacacaagtacacttgtccctgtctacctaagagatggttaagcttatggggtcttagatataatactttggcaaataagtttcttttgtgctgagtaaataggtctgtgccttttagtgggaaataatgactgaagttaagcctgtttgagactccccctttcttcctttttgtcttatctggttccagtcagctttagttactagttttatcctaaaacataattcattccattttttattgagcttacttgtgttttcccaggagggagttctcaagcaaagaacagtttggtacaaaaatttacgtgacttgaaaagttcacggttttcctttaaagctgaaaaacaaagagcttatttctgtgctccaggtaaactgcataatggctaggacaactataaaatggctggggccacccttcctctgactgttttgaacaccatgtccagggcttttcaccccatgcagcctgcatttactgaatgactgtggacttctgggtatcatttttatttctgtgccatagtttcttgtcctatgtcctcagtgttgtaagacacaccaactagggaacctgaagaatttaaatttttatttataaaatgctactgatgctgatcccatcaatcggcatttttcttcctcggagtggcccccagagatttcaaatggatttggctaggagggtttgggtatctggtagggccatcaccacagagtctgggagttttattggcacgtttgggccaagtaacttgttctgtaagccccatggtaggtactcatgacatttgtttcatttagggagcttagtgatgctgactgtgatggagccctgaccctgcctgagttctgtgctgcgtttcatctcattgtggctcggaagaacggctacccattgcctgagggcctccctccaactctgcagccagaatacctgcaggcaggtaaggcctcaccatcaactgtaaaccttaagtacttttcctccaggctgtgtaaaaaacttttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaataaaaaataaaaaaacaaacaaacaaaaaaaaaaaacaaaaaaacttttgtttcttaaaatgatgtccagatactttggggagtccttggtatttacagttattgttctttaactgctattagactttcacatctcataatgtgaggaatagggctgatctgggtaagtgtgtattacctgtttttctcattctataccctctggatggatttgaaccaaagtcacttaccctttcatgacagttgtgaaataggcaagtactgaacctcccagctggtataaaatgaagaggaagatcctgtagagccaagtgttaacttggcatttttaggcacacccgagtgtctccgggtggccctgggcaatggagtggaatggaactcttatacctaatttaaaagtcaaaaaattagccgggcgcagtggctcatgcctgtaatcccagcactttgggaggccgaggcgggcggatcatgaggtcaggagatcgagaccatcctggctaacacggtgaaaccccatctctactaaaaaatacaaagaaaaaaattagccgggtgtggtggcgggtgcctgtagtcccagctactttggaggctgaggcaggagaatggcatgaacccgggaggcggagcttgcagtgagccgagatcgcgccactgcactccagcctgggagaaagagtgagactctgtctaaaaaaaaaaagtcaaaaaattacatgcagtgaaatgtgcaaagtgttgtcaccttaaatgtatgcttgatgaatttttgtatatgtatacacccatgtaactacaatcagatgaagatatagaatattctagcatatcagaaggttagaatagaactgttatatttctccttaataaaacagtctcgctcaaattattgttttggaccctttagatgggaaagagtcatggtgagtataacatatgtattaattcctttgggagagtagaaaaattaatagtgtgtcttgcccttttcaaaggcaaatgggcactggtctgatttccattattcatggaagtatagtgctcattgagaggccccagaaacagctggtgctttcaacaacctttctcactttttagggaagggctgttaaagaaatgagagcttagtcatgggtgattattagcaagagagagcagtgtctaaagaaactttaattacttattagtagagtatgaattttgtgattagatctgcaaaaggccttagattatcttgtctagccccttcctcatgatgacaccagattcaaagtggcaaatgtcttatctaagtttgtctcggggcctctgactctcttaaataaaaagtctgtcattttctgtgttaaatagtgagaggagaggaactcaaccaaagggcagaggccaagtttgtggctgctgctaagtgacaggtaaacatgttgggggaagagtgacccattctgggatcttcttcaaatgtcctcataaaatatgtgaaggggagagttcagagagcaaaacctactaatttctggacttggattttgctaacaatacctgctttctgcctattgcaggctgtaactctagcctgctgcccttccttagatgcttggaagactctcatgggtcccaggaattagcttgcaattgaggagcatgggaaactcctcttttctctttggtgtctttctgtctccatttcattctctccctcgtcttgtcttgtcttgtctttttcttttcttttcttttctttctgtttcttctgaatcagggcaaagaagcactggcattctgggggctatcttgacgcctacatggctctcattgccaaggcagtgcggggtcatagaggagccccttttcttgggattggagacacatggggcttttgtctctctctaaagggaattaatagctggcaaagggccaagttctgttctagggttatatttaataccttcgccgtgtcctctttcaagccctggagagagtcctgggtaacctcatctcccatacccacactgagttttctgtttgggggtcatgactagtactgttttattgttttgatgccatatggccatggaacctgtgggacatgccatgactccttatttgataagtcacttttgtaggtgtccaagtgtttcacagactatttcaaaagtcactgacataacggctgggtgtggtggctcacacctgtaatctcagcactttgggagtccaaggcaggtggatcactggaggtcaggagtttgagaccagcctggccaacatggtgaaaccccatgcactaaaaatacaaaaattaaacagatgtggtggcgcacacctgtagtcctagctactagggaggccaaggcaggagaatcacttgaacctgggaggcagaggttgcagtgagccaagattgtgccactgcactccagcctgggtgacagagctagactccttctcaaaaaaaaaaaaaaaaaaagtcactgacataatttttagacatctgaaagccctgagctaaaagtatgttaacaggaaagaagtaatctcttgattcctttcctactgccaatggcttcttttgacctgcttattcagtagaggggaatctataaaaaagagtgccaatgagccccatgtttcttcctggacttttatggagactgtcagcatgcatttatacaggaacaagggaagaatccatcatatacacttcaattaaacaaaaattgcacatcatttctagggcttgtgggattaatcttaaataataattatatagttctaacagaaaacatgaaagaacccataaaactctatcaaactcagtgacggtatattttaaaatgctttatcacctatgtttatcattgtatgaagcttaagaaaatggccagaaccacctaggtctcctctgtgctttttttgcttttctttgcaaaatatgagtgatcctattcatttttttgttcattttaatggcatctcatttagtgtttttcttttttctttctttctttctttttttttttttttgagacggagtcttgctctgttgcccaggctggagtgcagtggtgcaatctcggctcactgcaagctccacctcctgggttcatgccattctcctgcctcagcttccaaagtagctgggactacaggcacatgccaccatgcccggctaattttttgtatttttagtagagatggggcttcaccatgttagccaagatggtcttgatctcctgacctcatgatccacccgcctcggcctccgaaagtgctggacaacacgcccggcctagtgtttttttttttttttttaaagcttaactcttacctttttccaacttttttctaattgatctatattcagtctttaaaaaatctaatccagtttttgataagattggtgaagagtataaatttggttgatatcttcatgcattcataactagacaagcttgttttctaaaataataattttttttttgagatggagtctcgctctgtcacccagacttgagtgcagtggcatgatcttggctcactgcaatctctgcctcccgggttcaagcaattctcctgcctcagcctctcgagtagctggaactacaggtgcctgctaccatgcctgacagatttttgtattttagtagagacggggtttcaccatgttgaccaggctggtcctgaatttctggcctcaagtgatccacccacctcggcctcccaaagtgctgggattacaggcatgaaccacccaccacacctggcctgttttctaaaataatggaacaggaattgtatctgatgccattttacttgcaattatggaaatagtcccttttccctaatagtaaaacttcaaggacagagttgtattagttggtggcttacccgctagccttttgatagtttcatcaaaagtctccttttgatagtttcatcaagagtctccttttgatagtttcatcaagagtctccttttgatagtttcatcaaaagtctccttttgatagtttcagctgggtggggtggctcacgcctgtaatcccagcactctgggaagctgaggcaggaggatcaattgaggtcaggattttgagaccagcctgggcagcatggtgaaaccctgtctccaccaaaaaatacaaaaattagccaggtgcggtggcgtgcacctgtggtccccagctactcgggtggctgaggcaggagaattgcttgaacctgggaggcagaggttgcagtgagccgagattgcgtcactgcactccagcctgggtgacagagtgagattccatttcaaaaataaaataaaataaaaataaaaaaataaaaaaagtcaccttttgataggtgattgggtgggttctggtagaaatttttgccatagagtttgttaaaaaatacctatggagtacttactgcgtgagaggtaccacattgttcactgtggtcagaatgctgtatgacagagctcctactcccatgaacttgtgggcagttgatacgtgccatgaaggggaagtacaggtgcagcaagagggtgcatgatcttagggaagatttccttaaacgtttgggctgagatgtgaaggctgagctaaggactacataggtgaagaagagagaagcttaggttctgggaagggggaacagcaggtatgctggggaggctctgagagggggcttggagcataggaggagtgggaatttcaggccacagtggctggcgtgcacagaaccggggtagagaggctgggttgaagctgaggaagaaggtggggaacatatgacgggcaataatgtcaccttattttaggcagataagtgacacaatcagatttgctatgtgaaatgatcatgcaggttactgtccagagaacaggttttgaggggcacgggtagaaaccagaagactaagttgtggtagctggccagtcaggagcagcggggtgcttgcaatggggaggtgacagtgatatggagagatgtggacaccttggagagagatttagcaggtaattgacaaaattatagttttggaaagtgttagctttcttcacaggaagatccgctcatgataaagcatcagtcatataataccagtcagagccttgattgatagactagaaagagaaatcggtgaaattcagaccagagtaagcaaatgaacaaattaaggtgcttgtactcaactccatgtggtgctgatactcagaccagtacttccttacttacttactgtatgtatgtatgcatgtatgtatttatttaaattagatagacacgtaggtaggtaggtaggtagatacaaagacagatgaaacagggtctcactatgttgcccaggctggtctcaaactcctgggctcgagcaatcctcctgccttggcctcccaaagtgctgtcattacaggtgtgagccaccatgcctggccaatggccagtactttactgcagaaggatattggcatttcagtccctgatgggagtgggagggtggggaaggattaaaaacaatgccaatccacttttcacatttgattcaaatttttttaaaccttgcattacaattttatttcctaatagcttgttgtgacaaatttgatttgtagcttctgtttattatctgccacagtctgcttttcctctttggaatattgacaaattttctagctgttgagatatttctttcctaattactttgtgacaaagtagtgaagcagaatccgcttctaagacatagcctggtgtgaagtaattagcttaccaagtagcctgatctttcctcgtgtgaattcactcaactaccgaaataacagccagtgtcactattgcatattgaaagaaacccttaatgtgattctttttttctttgttgtaaatcagcaagaatttatgctcttatttttatcattcctgccaaccaaggagataaatatttcgtaaaatcatgttgggtgcacatcattataagatcttgcctatttctaacaatagttaaatgatgtatttccttagttaatgtccctatacattagaaactacactagtaacatagttaagacttacatattgtgatagtgatggttattgtggaaaattactatgctataacatgaagtgttcagagcacatacccttcagccagactgctgagagttcaagtccctgctcttccatttatcagctgtatgaccttgagtaagttgccctgttctcagtttcatcacatgtgaaatggggataatagaagtactgggttgtccatataaagaactgaaagtactacctcagcatgatgaatgccatatgtggtctatcagagctagctgattttgttgttatatttaacaagcacagaaaagctgatgggaaacactgattactatggctataggaaatattctgatatattctttttgtttcttcttagcttttcctaagcccaaatgggactgtcaattatttgattcttattctgagtcactgccggcaaatcaacaacctcgtgacttgaatcggatggaggtaaaagatcttcatatgctaataaataaggatgtgtatggagctaaatccattggcctatgttctttacaaattctggaaaatgaactttttttttgtttgaaaatgagcttttataacatttccttttcatacttggtaattattaatactttgatgctcagcctttcagatctagacaccagatgtatctataatttttttcccttttctccctaaaactggatgtggtaaagtaagtaacataatctctagaccttctagatgtgaaatgtagatatagccaaactaagacagaaaattctagccaagttatttactttaaccaagctttaattccctagtaaacaattttgattctatttttatcagttgggcattaataagctatactgaatcagaactgttttgagaagaggtttgagaactttatatgagggccccaaatcacattcggaactccctcagggtttttagcttttgaaccaaatgaggactgatttggatgatccccagaaggaacttggagaattcccccagtgttgggccatggatggaagggcttagccaagtgcttaggaagccttagctatggatcaataaataggagttgttatagttattgttgtcatcaccattgtcattatcatcatcatcaccattatgattactgtgatgacaatttaggatacctgcttttcccttccttaaaagatctggaaatgtttaataaatggagctttattcacagactccataatagtcagagactattagagtcctctgaccctagttgaaaccactgcaagatgatagaagtcaaagtcagggaacagggacatttctttaatttcttgtgactgtgcatgatgatttattctctcacatgaggccctcatgcctgtagcatgtgttatggatggcaccgtctgctcccctgtgagccagtcaagcctgcctttccagtgcccctctgactaacatctctctgccattttgcttctctttctttgagttgtgtcctccatggtactttcctcagatttctactcatgggaaaaagacataaagaaaagtcacttcaggaggaatgacagatgtgcatttgaagaattttggttaaaattttttttttctgcagaatgcttatgacaaagagagagataaaatagtttgccacttttcatggccctcagtttactttggggcttctagcagtgtttaaagagctttgtttatcaagccaggatggatacatctatggctctctgactatgtgtgtgtgtgtgtgtgatgggccccctgcttgcataaaatgatgaagttattagttggtcttctttaaaacggccataaaatctgttacacatgcacacgtctgttttactgttacacacacacacacacacacacacacacagtctctctcgcttgctctttctctctctctaatgtcctggatggcgttacatatattcacctttgtggattttatatgcagctagttttatatacttttgcatactttaagtggcctccttggggaggggagattaaaaactacctagtcttttttttttttttgccctatccaaagaagaaagcaaaacaacaacaaaaaatcccctcttttccaaccaaattgttatttttgaggatgctatggttttagacaatgaatgcagtaaacagaattcaaggacaaagtaatagggtttattgatggtttgttcatttaagaagtacgggtcagattgcaataatgattcaatatttcatgttcttctaaactattactgattgttctttctactagtcttttaatctatcatgaatgcatggagtttaattagattttggaaccagccctgtgatcgatgactccagtataggtggttgtgttctgaacaaagctgcagctgatttaggtctcacgtcatgagaaattggcttagtgatacatctttttctaaagacagcagagctgttagccatgtacttatttccattaagaattacagatgataatttcaagtatatttctttttatgagtgtctcttacattactggatttctttctttttctaaacagctttattgatagagactttacataccatacccatttaaagtatacaattcagtaatttttattatattaacagttgttccaccatctctacagtttaattttagaagaacatcatcagcccaaagagaaacccaatactcatgagcagtcacttcctattccactgtctctgccagcctctgataatcactagtctattttctgtctctagatttgcctattctggacatttcatataaatggaagcatatagtatgtagtgttttgtgaccgtattctttcacttagtataatgttttcaaggttcactcagatcataacatgtatcagtgcttcattcctttttaatgctgaataatattgcattgtatggatatgctacattttgtttgtccattcatcagttgatggacatttgcattgcttccacttttggctattgtaaataatgctgctatgaacatagatgtacaagtttttgtgtgggtgtgtgttttcggttctctcgagtgtatacctaggagtggagttgttggattgtatcataacttaactttctgaggaaccaccaaactgctttccaaagcaactatactattttacattcttccactagcagtgtatgagggttccaattttcccacatccttgttaacacttattgtctgcctttttgattttagacaccctagtggaatgaagtggtatctcattgtggttttgatttgagtttcctaatgattaatgacgttgagcatctttttgtgtgcttattagccatttgtatatcttctttcgccaagtgtctcgtcctttgtccattttaaaattgcattacttgtctattgaattgtaagtgttcttgtgcttttggcatcatatctaagaaaccattgcctaatattaaatcacgaagatgtacttccatgttttcttctaagagttttgtttgtttgtttttttgttttgttttgttttttgagacggaatctcgctctgtcaccaggccagagtgcagtggcgtgatctcagctcattgcaacctctgcctcccgggttcaagcaattctcctgcctcagcctcctgagtagctgggactacaggtgcgtgccaccaagcccagataatttttctatttttagtggagacggggtttcaccatgttggccaggatggtcttgatctcttgacattgtgatccacccacctcggcctcccatagtgctgggattacaggcgtgaaccactgagcctggcctcttctgagagttttatagttttagacctttacatttaggtgtgtgattttgagttaatttttgtgtatgttctgaggaagaggtccaactttatttttttgtatgtggatttctagtcgtcccagcaccatttattgaaaagatgtttttttccccattgaattgtcttgcacccttgttggaaatcaactgaccatagatgtaagggtttatttctgggttttcagttctattctattgatctatatgtttatgattatgccagtaccacagtgtcttgataattttagatttgtagtaagttttgaaatcaagaagtgtgaatcctttaacttttttcttctttttcaagaatattttgctattctgacttccttgcatttccatatgaaatttaggacaagcttgccaaattctgacaaagattgcattgaatttgtagatcagtttggagagtatggccaccttaccaatattaagtcttctaactcatgaacatgagatgtctttccatttatttagatatttaatttctttcaacaattttttgagatttctttttatctacattgcctacttctaaattatgttattctccaaaggggcctgatttataatgcaggtgggaaaagacaatgaaagaaatgcactgttatgatacattgtctgttctattggagatagtagactttgaatagaaaattatatctggatacttcgttttaatgagtaaatcccagcactatgtgaggccgaggtgggcagatcacgaggtcaggagattgagaccatcctggctaacacggtgaaaccctgtctttgttaaaaatacaaaaaattagccgggcgtggtggcatatgcctgtagtcccagctactcaggaggctgaggcaggagaatcacttgaacctgggaggtggaggttgcagtgagccaagattgtgccactgcactccagcctgggcaacagagcaggactccatctcaaaaaaaagaattacctgagtgaagactgttaaatcttagaccagttttctactgagtaatacttcagtctctttcttcagaacagtttaaaaacaaaagtattgcttatctctctggggttgtttaggttctgagaggtaaaccaattaactttttggaacaccagatggctccaggcatttactctccttccttcaagataaatgttacaatttatctttatttaatttgtgactatgttttaaatataaacaatatcaaaagacatatgttgacaagtcttcctcccatctaccaactcacctttcaattcttacatatctttccagagtttgtgtatataaataaagcaaatgtgaatatatattattcttgaacttaatcttataggcattagagtgcatattcttttccagctttgaggtataattgacaaaaaatatatatttatgatgttttcatctatgtatatattgtgaaatgattactgcaatcaagctagttaacatacctgtcacctctcacatagttacctttttttggtgtggtgagaacatttaacatcaactcccttagcagttttcaagtataccatacattgttattaactatagttagaatgtgtgttaaattgagaatttacaagaagtaaatttacagtaagtagattttaaacggtttaaaactaattcatacttgatagatttgggtattcatattagtgtgaggacttcccccctgtttgcattaggagaaaattttaatctgctcatcagtaaaattcttttatcccacaacaagaaggctggtttaatcaggtttagacaccatctgcatgacagatcttggcaaacacccacattgtggggccacttgtcagaacttctttgtgtttgtgaaaaaatacataaagaacaggtttgttcttggccaaatggaccagagttgctatgcaattctgtggctgaatcccagtctgaattcagatttaatacatgtgccttaatctgaatcatttttttcctctgtgtatgtaaaatttcaatacaaattaacatatacctcactaggaacctaaaaaaaataaggtagtattaaatgcagggtttactgcagatggaaatggtggcaagaaataatagcttttaagacattttcggctgggcgcggtggctcacgcctataatcttagcactttgggaggctgaggcgggtggatcacgaggtcaggagatggagaccatcctggctaacacagtgaaagcccttctctactaaaaaatacaaaaaattagccaggcgtggtggcgggtgcctgtagtcccagctactcgggaggctgaggcaggagaatggtgtgaacccgggaggtggagcttgcagtgagccgagatcgcgccactgcactccagcctgggcgacagtgcgagactctgtctcaaaaaaaaaaaattttttttcatcatatgtgcgcatcacttaatttctgttccaaccagtttaattcatttacttttctttttcaaagaagacatctgttaaagacatggctgaccttcctgtccctaaccaggatgtaactagtgatgacaaacaaggtaggagaagaatgagttttcttctttaaccagcgttctacctgttaccttatctactcctcttggaatggtggcttctagagcatatgagggtggttctcagcatgtaaacacatttggatagactaagtagttcaaatcattgtcataaaacaatagttcacaaagtggtagcaagagcttgagtgtccagagtcttccaactcattggccccttagtcattgctgaccctcagcctactcttaacaccttacactggaatctgatcgtagcaattaggaaatgacaggaagctgaacgaattgagaacatgttgtgtttgcggatgtgatcccagacatcagtgtaaatgcacatttgcatacagctctaatccatgaggaagttctcttctggacacagcttctgtccttagtgtttatctgtttcttggctttgtgagtgtgggagtgtgacatggagcccagctacaattttcctatcttactgggcagctgagaagcagtgcagcacagcattccgtgttagagctactcccagggaagagttggcttgggaatatctagaagtgtgggagggaccctctcccccacctcctatactttgtatagtgctttataatctaccaggtccttgctcatatactgtcttattcagtcctcacaaaactgaatggaggctggtaagttttatcacctgaaatttagagatgagtaaactgaaattcagacactatgaatcatttgcctagttattaagaaaaagatttgggacaagaaccaagattttttctaagcctcaagccagtattctgcctgttatttgatattgatttactacccatgaatgagaggcttatttgaagggactaaaaatcagtgaagctatttcaggttttattgttaaggcctgccattgattaggcattgtatgggggcttaacatgaaaaataagttttccattaagtgacagtaattgcatgttctctatttaaatacttgcttgggagagacaggtagaactggacattgtctgcagtagcgtgtactctgaccattctcctaactgcacagtggaataactgggcaaactgtaaaaatattgaagcctggatttcactcccagggattctcatgtcatcagtctgggtgtcaggaatgaaagagggagaaactcccaatacttcctggtaatacttctcctatctgcttgaggtgctgtctctggaaagttgaaaatacatctttgctctttgtagaaggagaacctatttccatactccaggaggtctttattgttttagtaaatgctatagcaacttttagaggtttgtgagacctgtttttgtaagtgatgactagcgattctttgtttgaatccaatttgcctcagaaataacattttatagttttaattttttttcctcttttctctttctttttgcttaaaaaacaaaacacaactagctttgaaaagtactatcaatgaagccttaccaaaggacgtgtctgaggatccaggtaggagaaaaccatttttgtatactttatatataattattttaaaataaaaaaacagcaagtcagtgagtagaagattgatacctctgtgatagtgtgtctgtttctctctatttatttgtcttgtattttattacaaggaaaccttttggctttttaccctttctctcttttcaggtatgagaacggggtgatatcttttcaagtttttaagtttcactgaaaggatcacgaaggatcactccgtgtgaatatagggtcttgttactaagtgcaaaattgagaaggcttgaggttgagatgatttcaacaagccattttgggttttgtgtagagtaaggaacttatagggtagatcaattggaggcccagagttggtattttccatttccaaagcagaaatctcaaatatttttattatgcttcaccaccaggaaggcaactatatgtgcttatatatggagtggattccaaggagaaaaataaaagttgtccagttttttggagagtcagacctgtgtctgtggagtcatggagaatggctgcccctgtgtccgcagctctctgttgatggagccatcattgaaccaagttgaatctagttaaaaacaaagtggctacagaagacattactatttggagctctagttataaggacatgaaaaaagttgttgctttctcttttgctgttttatttcttgtatatttttaataagtcaatcatgtttgttgtgataagctagctatcatcctaggcttatttgttgaacattggaacagaggaatcaatataatgttgaggcttatgctgtggtacaatattttccaaatgtcaagttcattcagagtttcaaagagagatgggtggagggagaggaaggagttgggggagtgggagaaaaatatggtagggggaaggagagagagagagaacatgagaatgagaataaatatgaatgaatgtggatgatgaatttcaattatggaagcctgagaaggtgtatttttaggcagctccccagttggttctggtacatagcctattttgggaaccaccagctctggaaggtgatgctacaaaatagaaaattaaggttatagatcaaccatgactccaaaagtgatgggaattcccaagcttaattttgactcttgaaacagatttgaattcattccttattgggtgaaatgctctgttaatgtaggccaacgcctggggtcagttctttctagctcttatttctggagctaaagtggatgcattccagtttttgtaaacttcatgttgtagtattagtaaaagctgtttaaatttggagtgttaaattggtgcttctccaacagcctttgaggatcataacttttcctacttttttttttttttttaagggattttagcacaagatcaagtgtcctctggggcatgagctttagatctcatttttaacattccttcattgactaggacatggcatcaccaaataaaacttgtcaggtgtgccacagcatgagaagtatgtcggaattgatttctcgttgtgcctggcagcatgctatgtgttttctgatttgttcttcccactactgcccctctctgggtatgagggagttcctcatcttaaacatagttaatccctccttttctgggaaatgtttggattcccagtgggagacacaagcgtttcaaggtggtgatttagaattctggatggctgtccttgccatgtggacctcagttcagttgctgctttttggagggttaatctctaggcctgctcctctttccattcccatttcctggaaagatgacatgccttgagtgttctaggaaggtggcagtccttttccctctttccagctacacgagaagctatgatccacttgttgtaattgctgagagtgtctatgttagtggagccttaagagattttttaaaccaatatcccattccaacctaattcagcagagcaccatgcacaatggtggtctttttcttgatgtttctggcccatgttgaggtgttttcagctggttcaccctcacagtgctgtctttagactgttgttggtgattctagcagctgctccattgccaactatcaccccatgtttttattggagtagagcagttctgtccttccattacctgctcctacctgcacctcctttgctgtcctagaagaaactaaatttagaaaccagatttccaggcttaaaaaattaggagcctttatttatgcactctacaatagtaatattttgcaattctaaagtacgttcagtttttaaattactttcaccttatctgtccctgtgagaaagaaactgcatttttattgcctttgttttctaggtgaggagactgaggttcagggaagtaacagctagttagtgtcatggccaggaggagggccttagtctcaggactcctggcctggtctctagtcctgtctctccactactcatccacaccctcaccccatctgtctgtctgtctatctcttaccagcagggctcacccctccttccacacccatccctaccagcaaaaagacaaagataatggcacttgacaaaggaattaacagtcaccatggtctgatttggggaacagtattttatcatggcggggacctctcctacccatgtatttcttgaaagcagtggggcctgagggagaagagggccacggagccagctgcaggcagcctgcgtagagggcttccccagctctgtggtgagtctggtccactctgtccacccagccccaaggcagcctcctgagctgggagagaggcttcctgaggtcgctttctttgctgcctggggtttgtaggagggagggaggtctttttctgtctatatccaggtgtgggtgcacgataatgggcaaaaggggactcaaactccttgggctttccaggctttcctgcactctggcagcgtttcagctgtttgaagttggaagatctctgtgttctcactacaacaagccaaaatgcttgggttgggagaagtgtatctcttgtgcagctgaccagtagtttgctttgtgccttgttagcatttatgaggattttcacctcccctctctgtcctgttatctaacccaaggattttaatgatcatcataaattcaggctgcttcataccaaggagggtttttatctttggagcaatgtaaaagaggatgagataatgcagtgagacattttctttttggaagaattcatgcagacaaagaaattacattcttcttgttctgtgttactagcaccttttctatgattttttatgacattttatgatgaaaaatttgcaatgtttgtaacacctgagcatagctactggttcctaaagttgtcttccatagaggattgaaagcataaaaagaggatcagtgtttttgtaaatgtttctaattactcctcacaacttgtgatggggaagaaggctgtatgggcgttggtagtgagcaagttagtttatgatttaaatttgatgaggaaaagtcatatggctgggaaaagattcagcgatattgttcataattctctgtatgatttggtcacagacatgtgggacacaaggatattttcttacaggagaagctgtatagctcatttccacttacttgtgagagctttgtttttttgtggccatgctgctctggtagtgtatttttttttttttaaaacgtgtagttagatagacttcttcctatccttcagggtagactagttcaaaatctattactagactatcatgatagaacaagaaaccctgaagtgtgaatccatcattatataaaaagacaaccccctttcaagggggttgtctttttatactggaatgtcttcattaattaacttggatttgagaatggcctctcaaatagtgcttgaccaaaggaaaaatatgctggtttttctttccttttaatcgtttctttagattttgaaataaaacaaggaaatcatgaaaatgtgggagccgtccagttctccacatgggcacttttacctcacatttacctgttgatgtgttctgtactagcccaggtgctgcatataaacttgtttaactgcagaaatgaaacccaagcaatatctttgtttcagcaactcccaaggattccaacagtctcaaagcaagaccaagatccaggtagtgttcgtttaatttctgctttaatgccctttgtgccgtgcccctgcctagaaataagaaccacaaaccaaaacccaacccatgatttcctcttcctttagatgtaaagcttaggatatgagccatttcgctcgtgcatggcctgatgggaacatgcagtaatgctgggagccttggtttctgtggtcattagtgctagaaggtgaccatgaatgccctacggcccctcaacgtgaagtggattgtgtgagacaacccagttgttgcaagatgataacttatagggggaagtagctttggaaagaggaaaatatgggtaaggtaacagacacgaaaatttgctatcatgacaaggtgaacaccaaaaagtaaaaagtctgggtaataaaatctacagtagggaaagaaaatgcttctgataacttcagtgaagcttgcagtttcaggtaagcgatgtttatggtctgtttgagcctatcttagtgcccctgtaagcttcacattttttaagaggctagtacaagagagaaagccagtaaggcagagctgtggttgatgtgagactcagaagagaggtgcagaggggaaatacagagacactaatagaattaatccattaaggaagggaaatggtattggtactgtatttcactggtagaactgcagtgtaagataggataacgaggataccatgtgtgtgttttctgttttgctttggctgttagtgacatttttccctcctttgcctactagacacaatcctgaaaaagtaaatttaagtctgatcatattttatatgcttgaaatactgatatttaaggaacctcatctctttgtaagtcaaagagttatcctttagtttatatgtgcattttccaaattggggttttgtttccttgtttatgtaagatacagatatctatatttttatatttatgtgtatttaaaaacaatagagtaattcatttaggtaggaagaaaaggtgtaggcattctttctgtggtcaacacatttactcatcctttgtaaaaggatgaatggatcttttacaaactagtctgtactagttgtgggatatgctttcatagtaggaattgcctttgaattgcagaaatctgttatgtgtactatgttaaccataaatcgaacctcaaagttttagcttctgctgacttcctctctccctgaaagccagtgaaattataaaatctcatagccacacgttctgttattaatgtgtctggctaaattttacatattatcctttcagagattgcgcttttggtctaatttggaggattttattttcattacttctcactgggaagaagagaattgaattgtttttatcctcctttttgaaataataaagttttgtagaaatataagggaaagagggaaaatcaccattttaacaccactgcattcatcattttgttaactccctgcacatttatgttttaattggttgcagcagtcatggttatacaatctcacttattttatattcagtaactttccatatgaagatataaacatacaggttatatatgaaaataaaatgaaaatgaggaatgtgcgctgtgggattgtgtgcttaacagtgtgcacgcatacacattatttacacacacattatttcttttttgagtgaaagatgtcactaaagctatatgtggcatagaaagctcttttcatttctagctagggtctctaattgtcttttttaagtgaagtgttcccatttaagaaccttgtccttccgtatcagttccctttgattcttgttgaaagagccagagcattcttccctgctagtttctgcctgttgctgccttgcctgtcttgccagttatgttacagggaccaccccagaacacgtcacatgccattatggtggctttattaaagttacaaccttgtaagacagacagaaccctcaactaccacaaagaatccttgagaaatttattcaggaaaataaaaactcacaatgtcaaaaacagctctgtcaagaactgaaggggtttaatagtaactgatatattctaacttcataaatgccactctaatagctaagtacgaagaaggttttcagaggttaatttgtctctctaggatgtacctctgactcagaggtcgttttctgctttgacatgaagctagttgagaagctaaataaaacagatgtatacatctacatcttagggccttttcgtgatcatcgtattgggaacccgtccttaaacctattcctaagcagtgtatggagttgaattttatttggaaagtaagtaggtctccaataaatattctagttgctatcaccaaagtattcccccgccaactcataggcagtatgagaacattttaaaaatgggatatagaaacagagattggagtttgaatcgaactgtgtaactttctatctgaccttttgcaagttatttagttcctttttaaaaagatgatattaccagagttacaatctcagaagttgcctagttaattatgccttgctatagattgaggaagaaggttgaaaatgagacttttgctttctcagggaaagacaagctagacccctcaatctgattgatgtgtgttttcctttcccagcttcgtttgtggcatattcccctgaacattgaattcttaccctcagcttatctgtcccaattccacatgagcctgtcatcacatttgcaagtgaacaggagaaaagttctctgatcagtttataccatgaaataccatgaagcccttctgttagaacatggaaatgcctaagctgaggggctccatattattcttattaacaattccaatagaaatggatttgaatttacacaaagttttttttggggggttgattcagatctaaggtataataagaacaaagaggttgaaaagatcccaattcatagttggatttggacaattattgtacatagtggcattcaatgggtaatagaatttatggctgctttggtagctcatcggttctttgtagtcactttgacttcgtgggtattttccatttcaccccaacttcagagagtaaagctttgctatttcgcttctgaccttcccttattttgctacagatcttactctagcacctccatagaagaggccatgaaaaggggcgaggaccctcccaccccgccacctcggccacagaaaacccattccagagcctcctccttggatctgaataaagtcttccagcccagtgtgccaggtgaagtgccccttgccccctgagcccttccatttcctgttggagccagcggatgtgtgtctgccacagtggcctctgtgagtccggagaaagagcagacctggcagtttcgcattccgtgaaggtcttcacgtggctatggtattcttgggagagaaagcaattctagacacatatgtagcacatgtgtctggagccttgcccacacttgttatggatcaagaattaggaaattctctaccaagaggataaaaatgcttcactcccatgcagcctgctgagtgtgtggctggggtcttactctctgcatcattggtaatttgtgaacaagatagatcgctgtctgtcatttcctcagatgcctgtgtggtcttctatgaaagatcttggagattaaggcctagccagaaccttctcctgcattttacacttatggagaagatcctgtgtcctgtaggatttaatgctgaggggactctgaatctgactgatggttgggtggttggtggagggtcctagggcaagggctccttcaggtgggctgctctgggcttctggggatgggatgttcttgagcccgcagttgtgtagtggggctggaggtgggggaggcccagaggggccctgtctgctcccttggcttcctgtgaagtagaagataccctcctaaggaacctaaggaatagaagatgggaggcatgcctttgctttagtgaaggtgataggatacggtgctgtcccaagtgttattttgggagcagcaagggcctttccactgactcatgcaggcaagctataaatacaatgatttcctggaactttttctccatctatgtgcattttaaatcaggccagcctcagatgctagtgatttgcagattattatcttttctgctaaagcaagaaaagactttccttggctcacacattagcatgacctctgtgtctgggcagagctcagcatgttttatttgttctaataaagtattctcctcacagtaaagttatagattgttttttaatatactaaaatctggaactctctatcaaatttaattctgtgccatgagttcatcagacaaaaatttgccttgaatttcctctcatactttgatctgaattctggcataaatttcatagtgactggtatgtagggtgggagtaaccacaggtgatgatgctataaaaatttcacatggctggcggattatgacctggaagattttcctatggatgcgagaaaattaaaacaatctgggaagctatctcagtacctttaccttgcaagaagggaggctggaaatgctcacaggtctctctcaggttgtgtgacccagtaaggagatgccagctgtactggagaattcacatgctgtggtttttacgacactgcatcacatagtggaagagacaaaactgggtttggagctcagctcagctgcttattcactgtttgattttcagcaagtagcttaatgtttatgcatctcagattcctaatctgtacagtagagccaatactccatggagttgtaaggttttggtgagataataaacataatccaaatatgggttgaatattccttatccaaaatacttggggtcacaagtgtttcaggctttggatatttttggattttggaatatttgcattatatgcttaccaattgagcatataataaaaaaatctgaaatgcttcaatgaccatttcctttgagtgtcatgttggcactaaaaagtttagggttttatagcattttggattttggatttttgggattagggatactcaacctgtagtactgtatttggcccacaggccttagtaagcatgtaaggcccatattcccgtggcctgcaagtatcaagaatttaatgcctgaaatggcaagcctccaccgaggaggataacaccccgacttccttgacccctagcagacaattctgtgattcctcctacccagtttctcagaaggctcgcaaaaggactgaaccccagttgcctgccgtagtacaccattcattgatgtactttttcttgttttgcttccctcctgccctgtctcactttcccctcactcgaataatatacctgttctcaagttcatatgtcaggggcttctttagagaaaacctgaattaagacagctttctttgatatctctgtgtcaatgtgacttcaagatgaaaagtattttggtttgataatgccctgacgatctcccttgtggtagggcctgataaatctaagatttagacaaataatagctaggtgggtgatgtctctgttcatagcctaattccattgtcttttcagtacaaatttatacagatgaaattttaatgagcagtttaaatttatcacatgaagaatagaacatttctgcagtatgaaaagcaggtggtataattgcatctactttatttattttcatgttggttaattctcacagaaaagtataagggtctgtctaaattatataaaattttagtgtattgcatattgctagaaattatcgaaatgctgacaaactagaaatgcatgaaatagagcttaaacctaccagaagagtctactcactgagaatcatggtgtacatttaggcatccctttgctgcacttatctttatgtatcactttagataaatgggatcacactatgcttgctgttctgtatcctgatctttccaattaaccatctttctatttcatatagaggattgcaccgttccctttaaggtgtgcatgatatggatataccatggttgactgtgctttgatggagagatctctcccttcttctctctgccttttctcttccccatactttcctcttaagctcacccaccaccccacgaccccagcccccgttcctttctcacccttgcaaacaaacctctctctctctccaccccgacccccgtgtcctcttcatacccctctgtttctctttttgtccttctcccccatcactccttcacaggtatgagcctcccctcactctccccttgccaagctcccccacaccaccaccttgttcttataatataaacgaggcagaggttattaataatttcatgtccgtatctttgtttcatcatctaattattttcttaggttaaatcctgctggttggagttgcagggtcaaaggctgtagatgtttaaagtgtagctatatgttgccaaagggtgaggtggaacacctgtcaacttgctccatcatcaacactgtctgaaagtgtttcctcacaatcttgccaacactgcttcatgttcatctttttaatcattacctgtgtaataggcagtttcatgtccctgattcctagtgaggctgagaatctttttgtattgttattggccataaatattccttctcttatgatttgcctgctcagaaggcttggccagcttctgttgctacatctctctttgcctaaccacggggaccacttctttcttcttcattttgcctacgttctggacctccctcctgtcaggcacttgggaatgtgagggtggccatggggaagcctacctcacctgctgctgtgctgttccttgtccctccagccccgccccccatatcccctccttctgccaactttatcacttaagacagactgcctgggtcaccctgtttatgacaatagaagaataaggaaaggtaaagaaaagaggggaaaataatgtgagatgaagcaagatgtggacttgagttgaaagggaaagataaaatgaagcccttgtttaataaaatgagactcaggattgtgaaaagcagtgattgaagctaaggtgctgatacagagtggcttaaagtggagtgatagtgtggaaaggaaataggatggagagaagatgcaaagaaaaatgaaaggaaaatgaagggaaagatgggatggttgttacataggagtgatgatgtttatccaaaggaataagcaggaaatagaataaaaaattgtagaaccaatggaaggagagtccacagactcttggtgtaggattcaagcagcatttaaaggaatagcttagaagtaggtggcattaatgcctttacatttatgaaaataggtaacatgatatggggaaaaagaacaaagggctgatttagaatgtaaatctataaaaatgaataaggccaactttggaaatatagaacagttggcttcaactttggtgtctgtaaagagagtgtgaatgtgtgatttatagtagcctagatgattccagggctctctaggtactggcatcagacccgaggcatgtgttttcataaggagaagcggatacactatgatcgctgtgtgtaacagggagatcaccatttgtaatagctgacccagttcttggagccattgcctcacagtcccacacagctgctgtgtttgagagatagcaaaaatgtgcaagaaagtctaagtcagtgacaatgcaagtatgcaaaacctagaggcagtcagacctggaatttgctcagtgatgtttggattttatgtctctatatttatagctatgaaacatcttttattactgagattcctgtaagaaaaatcacactaagctggtacctaacctccttttcctcaatgaaacagttattttcatgaggtaatttttttttcataaaaaggggtttcttctgtccacggagtcagtaagaactacccctctcttctactcttgattcagacctgcctcttctcaaagccatgcctgaggtttgtagcctgaggtttccatggtgacagtaaaaagccttagctctgccttgttccagtcattgagcatctgcctggcagaaggggcagagatggtgtggaggagacatagccattcctttaaagtttcagaccgggcattttcatcatttccactcaaatctagctgggggacctaggcccatggatagacctagttgccaggcagctgggaaatgtagtccttggcagggcagccatttcccagaaatacgtttcttactgcaaaaaaggagaaggggatgttgatggtcagttgtttttttttaaaaccacatcccatatggccaaatacattgagattcacacattaaaaccattgtgatggctgaacagaacacatccagggctagtgtctgtccatgggtagctaatttcctatctctgctttagatatactgataataacaactcattccatggttaagagactatggtacatccatcctatggaattgtatgaagctgttaaaaagaacaggcacgtatactacatggagagctatctcggataaattaagtgacaaaagtatgatgcagaatgtgtatgtttataaatgtgtagacaatttcaggatgatgctaaagaaactggtaatgatagttgcttctgggcaaggggaacagtatgactgaggacaggactgggaaacaagcttactttctgttgaatgcctatttgtatctttttaattttggctcatgtacagatgtcacctattataaaaaatttgcttttcactctttagctgcaatgatggtatctgaaagtaccagagatgtctttcctgcctgaggttacctatctcaatcttccctacgattctgtattcagggtatctttatgaccatctgctaccacctcctggaatgcagctgaaatgacagaaatgttccgagcactttttttttttttttttttttttgagatgaagtctcgttctgtcacccaggctggagtgcagtggcgtgatctcagctcactgcaagctccgtctcccgggttcatgcccattctcctgcctcggcctcccaaatagctggggactacaggcacctgccaccacgccctgctaattttttgtatttttagtagagacggggtttcaccgtgttagccaggatggtctcaatctcctgacctcatgatccacccgcctcagcctcccaaagtgctgggattacaggcatgagccactgcgcccagccccgagcactcttttaagctctgatgcgttcttcagattccatttcagtgcctttccaacactgaggagtagttctggaggacctcccaaagattacattgtgagatgtatagttgggtaaaacgtcatggtaagggctctgtcttaacttggaagtggctgtgtttattgagtggcgaattgagaagtctttcctcggttttctataaatgaatatttgtttctgtaacttaagaagtaggtaaactccttgggagtaagagatgttcctaataccaaacttacctttcaggttctctaaaagatgaatttggccacaaaagcagctctgaccttatatatttccttactgtatttttcctgtgagtgctacttgtttcttttaaaatctggtaggactatgggattcctgacccaccccaaacctttgggcccacagtgcacagctatccaagggttcaatttggcagtctgggcagtttttttgttttgttttgtttttttgttttttttaaatgaaagcgttattgagatgtaacccatatactataaaattcacctttttaaagtgcacaattcagtgatatttagtatattcatagtgttatatataactatcagcactatgtaatttcagaatattttcatccccctcaaaagaaaccccatacctattagcaatcattcccattccccccttttcttcctctatcccttggcaaccactaacttactttctgtttctatggatttgcccattccggaattctgtattaatagaatcatataatatgtggtcttttgtgactggcttcattcacttagtataatgttctcaaggttcatccatgttgtagcatgaatcaatacttcattccttttatggctgaataatctttcattgtatggataaaccacattttggatatttgggttgtttccactttttgactattgtgaataactctgctatagacattcatgtccaagtttttgtgtaaacatattttttctttctcttgagtatataggtagggctggaatttctggttcatatggtaactaactctatgttgaacattttgaggagctattgaagtattttccagagcagccaaaccaatttatttcattagcaatttatgaggattccaattgtgtttcttcacgtcctcaaaacacttgttattgcctttttaattttagccatcctagtgggcatgaagtggtattgtgattttgatttgcattttctaatggctaatgatgttatacatcttttcatgtacttattggtcatatttatgttgtctttggagaatgttcagaatctttgctcatttaaaaattgggttgtctttttattgttgatttgtaaatgttctttatatattttgcataaaagttcctttacagatatttgatttacaaatattttccttcgttctgtgggttgtcctttcatctttttgatggtgtcctttgaatcataaaagattttaattttgatgaggtctaatttatgtattttgttgcttgtgcttttgctgtcatatctaaaaaaccattgcttaactcaaggtcacaaacactcctcttttcttctaaaagtcttatagttttaggtcttacatttacgtcttcgttctgttttgagttaatttttttatatggcatgagttaggagtccaaattcatttttctgcatgtggatatacagttgtcccagtaccatttgttgaaaagactattaattatccatttaattttcttggcacctttgttgaaaatcaattaaccataaacataaggatttatttctggactctcagttctgttctgttggtctataggtctatccttatgccagtaccacagtgtcttgataattgtagatttatagtaagttttgaaattgcgaagcgtgagtcctcctgctttattctttttcaggattgttttggttattctgagtcccttgcatttccacatgaaatttatgatcagcttgtcaatttctgtaaaaacaaaaaagccagctgggattttggtatggcttgcattgaatttgtatatcagtttggttagtattgcggttttaataacattaagttgtccaatgcatgaacacaggatgtttttccatttatttagatctttaagtgtctttcaacaatgtttcagtatacaagtcttgcatttcttttgttaaatgtattcctaaaagttttattctttttgatatacattatacattatttcttggagatatccatgtcagtactgataattttgtatttcttttatatatcatctatatgctggctgctctgttaaaaaccgtattatgaaaaatttcaaatttatgcaaaagttgagaacctccacccccatattattttgaagcaaatcccaaatatcatataattgtatatataaactctttgtatatctctctaagagataaggtcttaaaatacttgagcacaatacctttgtcatacataacaaaattaacaataattctttaatatcatttaatatttggccagtgttcctatttcctgaattgtctcaagtttgtctttttatactagtttgttccattcagaattcaatcgagggctacatgcacattgcacttgttttggcatattttaagtctcttaactgataggttcttctctcagtcttttttttcctctttgcttttcatttattcataaaaagtcatctaccttgtagactttttcacattctgtattttgctgattgtttgttcttccatcccatgtatttcctataaactaataggtaggtctaggcttgattagagttagtttagatttttgacaagaatactacctaaagatgctgtgtacttcttactgcaccacattaagagatctctagtgtctaatgcctttatttttgtggtgtttgattgattaatgggtttacgtagtattggcctgatccatgtgttatgataaagatcccagcgacctttcaaataatggttttatcagctattgatcatcattgcctacatccagtggtgtgtcagtgaatgtttaacaaccggccacttgccaatttttatggtgtaaacactcctgccatggctaatttcattcctactgatgtgttactgaatgtggagtttggaacagatgcacacagttggctctcacaagctggcatgagctttttccagcaaaccactgcttagatccattatttcattggtagttgcaaaatggcgatactctattttttctacctttattaattgggactatggtttatttaagcattttcctattgttggacatttaatttgtgactattatgaagcttgtgagctgaaggagatcataaaacataattctcagtacatcagtaaattctttatatacatctgaatttatagaattgtatgaaaactgaaatagacttcagtaatggtgaccagaaaagtgtcttattcaaccagtatttaatgagcatttactgggtacttggcactttggaggatcccaagagggatatggatatgcccccaaactctgctaatcaatgtcacagttgtgtgtgattgttagaagggtttagagtttgggtggttgctaactagaatgatcagtggatttgtgggcagggggtgcacagggctggtgagctaaactttgaaggatatgacttttcagtcaaatcctattcttttttgacatctgtcttgatttacttcttatgactagtttcctgggtgtctactatagtagcctcaaatctggcttgcttgctttgttctttccttcataaagcaacaggattaattttctgcagcacacctatgatcacttccctactcaaaactcttcaggacctactatgtaatcaccaaatttctggtggaactgaacccgaagccatgtgattatattagctcagtaagggacacagtactgtggcctggagtgcctggggaggagtgtattacaggaaggaagtagagactagaagattcaagttggctggctggccaagaaaaatggagactggtggagaaggagtttgtagacggtgtctttgggaagtcttaggagaacatcccattagggtggtagggttaagccagattgcaaaagattgtggcataagcaaggaactttggtgtggagaagttgtcatcacaaagtcattttgaaatgtcgaaggtttagcagttgttctgactgtatgtcacattttaaaaaataatggtagtggccaggtgcagtggctcatgcctgtaatctcagcaccctgggaggccgaggtgggtggatcacctgaggtcaggggttcaaaaccagcctggccaacatggagaaaccccatctctactaaaaatacaaaaattagccaggcgtggtgatgtgtgcctctaatcccagctattcgggaggcttaggcttgagcctgggaggtggaggtttcagtgagccgagatcgtgccactgcactgcagcctgggcaaggacagagtgagactctgtcgatagatagatagatagatagatagatagatagatagatagatagatagatagataaagatacataagatagatagatagaggtagaagagagccagttccaagatgatagactgtttttatagattgccttcctcctaacacacatttgtattctctctctctcccccaccgcattattcagcgctaatgaaagtgtgatggaaacagctgctagtgaatgaatactaactaatcctgaaaaaaagatgtgtacttcttgaaattttagtttgatttacctgaaaacatatacagaaacacaactagtgatttcaaccaaccctagagttttaatagtaaaatgcttaggaggaatgcatttgtgtaaatgtaatatgagagaggaaaccagacacccatctttgaccaagattgaatctcatgcatttttgtcacttaagtctgcccatgtctccatccaggacctagttaacccttattgcgtatcctatggtacaggaaaaatgagttattagtaaacatggataaattttagaatcatgaagtgtcaatgctaaaagagaacttgaatgtcatcttggccaactctcacatattaccaacaaggagactaagatccaggcaatataatggctttgttctccatcagaatctttctttccttttttttttttttttttaagatggagtctctctctgttgcccaggctggagtgcagtggcgtggtctcggctcactgcaagctctgcaggttcacgctgttctcctgcctcagcctcccgagtagctgggactacaggtgcccaccaccacgcctggctaattttttgtatttttagtagagacggggtttcaccatgttagctaggatggtctcaatctcctgacctcgtgatccacctgcctcggcctcccaaaatgcttggattacaggtgtgagccaccacatcctgcccagaatctttcgaagttgggaaatctttgtttagatctttgttgcagcagatttggtatcaaagaaagctatctacattaaattaatttggagggcacaccctactacttttctacgggcaataacactaattaatatctaaagttaaaggatgtattaaagaatgaatatggtaacctttgcaaggcactcttcaatgtgtttttttctgtgtttccttctatgtgatttaaaatgttagtagatttctctgaggtacttcagggagataggaaaggagcttttgccctcatagatacttggaaataatatatctattttctttttttaatttcaaaaatgaaattattattaaaagctctaaatatagcaagaatataagacaaatagtatactgaacatccagcttcaacaattaatcaactgtgtcccatcttgtttcatatctgtcttcccccacattattaattatacttttttctacccttagcttaaaaaaaactttattgaggtatatagatcataaagtttatccattttaagtgtaaaatttaatgatttctagtaaatttatcaaatagtgcaactttcaccataatccagttttaggtcattttcagcactccaataatactgcacatacctgtttacagttaatccccatgcccagccccaggcaaccactaacctattttgtgtttctgcagattttccttttctgaatatttcatataaccgaatatacaatatgaggtcttttctgtctgactttgtttacttagcatgatgtttttgaggttcattcatgttgtatcatgtatcagtacttaattcctttttattgctgaatagtattccattatatagctatatcacattttgtttatccagtcttcagtttgacagacatttgagttgtttctgctttttgtctgttatgaataatgctgccattaatatttgaatacaagtctttgtgtgaacatatgtttcatttctcttagctagatatataggggtggaattgctgggtatgtggtaaatttatgtttaactttttaagaaatggacaaattgttttctaaagtatctgcaccattttacattcacatcagaaatgtatgagggttactatttctttatatcctcacccacacttattattatctttttgattatcctacatcctagtgtgtgtgaagtgatatctcactgtggttttgatttgtattcccctgatgattaatgatgttgagcatcttttcatgtgcttattagttattcctgtattttatttgatgagatattgtgttagtctgttttcacgctgctgataaagacatacccaaaactgggcaatttacaaaagaaaggtttagttggacttacagttccacgtggccggggaagcctcacaatcatggcagaaggctaaaggcatgtctcacatggtggcagacaggagaagagagcttgtacagggaaattcccatttttaaaaccatcagatcttgtgagacccattcactatcacgagaacaccatgggaaagacctgcccccatggttcaatcatctcccactgggtccttcccacaacacatgggaattatgggagatacaagatgagatttgggtggggacacagagccaaaccatgtcagatgtctactcaaatcatgctcattaaaaaattgggtgtttgtcttattgttgagttgtatattctgtaattctttatatattctggatacaaatcctttatcggatagatgatttgcaaatattttccacagtctgtgacttgtctttttgttttcttaatgatatgttttgaagtacagaagttttgagttttgacaaagtgtaatgttaaattttttccttttggattgtgcttttgatgtcatatctgagaagtctgcctaacccaaggtcttgaagattttttcttgttgtaaaatttttatagttttagctcttacgttaagatcttgaatccattttgatttaatttttgtataaggtgtgaggtaaggatctaagttaatctcttcgtatatgaatatccagttatcccagcactatttgtcaaaaaatactctccttttcctgttgccttggcacctttgttgagaatcacttgtctgttaaatataagggcttatttttggacactgcattctgttctgttgatttatatgtttatttttatgctagcactatactgaatgttttttaacacaggggagtcatacataatcttgcaaagaggtaatcccacgactcagaagtctttaagtatttgctacaatggcatattttttagatagtatatagtagcttatttacttcatttgtggtttgtagcatgttcagaaggatcctttgagctccttgaggttgcagtacttctttgctttgaagccttctgtcatgtttattccctgaatgtagaataccctctgtctagctgtttatcctccatctctgcatttttctgctctacctgccctgtaggttcaaaatgtggtactgattactgctcgatagtagccttgtgtccttggcaaggtcattttatttctccaggtcttaattttctcatctgtaaagtgaaagaatcagattttatctcactacttttctaaactctgtcgttaatattttccttgttgaacagttacaaggatgtgtaagttaatctcttttaactggtgaaaaagtatattctgttccatagagaattaaatgagcttgtatttcggggggtggtgtgtggtcatcaggggatagaggcaggtatttctggaaaggtgttcttggcaaacattttgttacatacactggtgtatatgacatacatgtccatcactgtatgctgggtgatcaagagatatgtataaggtcatacatgcttttatgattagaaaggagagaaagaatgaacaatttctgttacaaagaaatagccatttttatgaacttgccaagaagaggaatggtccttactgatgaaatccttaaagctttgcatgtggctctttacttgattgatatttaaaagtataggtcccactgggaggctcctttcaacattttccattccttgagtgtttttcccccctttggtattcgaatgcttttattttcttcacataaaatattcctagttaggggggatgggagcccctttccacagctgaagttattccaagttttgttccccctgaagaatcggctctctgttcctgaagctttcaatggccacatctgctgctttatttccactcaataagttggaatatattttcatttagttattgattaggggctatgtaaaaatctgaaggaaattagtaaatagtaatgtttatgaataacattttacctagaaatttctaagcgtaatgaaataagaggataaaaattgttagaggttggagttttggatgaaggtaccaggaagcagagatccaataaatcagtatcagaatctgcatgtctttcaataaacttaagaaattgttttaaacactaggaattattagtctgtcttctgaatttaggattaaatgacagtttcttttcctgaagtttttaatgtggttttcaggattggggtatttattattttcctttggattacacttataaaaatttttggctggacaaagccttgctgatacctagtatcccactttattaactataacacttgacgaataaacctgcaattgcttgacgaatatggtcactttttaaagtatgtgggaacaacattcttctctcgtcttcttgccttcttttccctcccaggaaagcagttgttactattaacaagtatattgtcatcttttgcaactgcacactagattattcagctattttttttcttttttttttcctttgccttccaccatgcgatcaaagtattttttaaatttcactttgcatgaaggtgtactttttcttttgactgattagggcatactggataaaatatttggatccaattttaagtcaagagcagactgaaaatattgtaagagaagatttttaaaattaaatttaattccaattttcaaccactgtgtgagtacctactaaacataaggcagtgtgtttaggtgctgtgggagacaaaaagatgaattagacagaattgatagaatgtagctagattaatatctcccaccattaaaggaaaggaacacagaattataaatgcaaggaagagatttttcagcagcaaccgaacaaggaaaaatgcatgagttaatgctatatatatatatatatatatatatatatatataattttttttttggaaagagtggcaactgagggaaacctgaggctttgggtgcacttctgactctgcctgcttccttgcagaagctgtgtgtgtgagtaggcaaatcttgagagttctcatcgagaccctaggtctagagcaaagtgaaatgaatgagtactcgtaattttcctttttcttgactaagtggaaatgacttcaggaaagagagttggaaaagtaaataatcatagctgatatcctgatattgtagaggggaaggcccagagcttcatgctgaactggggacaaactgaagtctgagaagttcctccaaggccattgatagaactccaagacttaggagaatgcactctgctgcagggttttaaaatgttgattattttggtatttccttcgtaattctaaatagcatatttgtgtaacttcttgtagacttcaatttttgccatcatcttccctcccccattatctttctcctccacccttccaatatagttatattataattttggttagattaatatttagtgtttatattattattgttatagccatgtaagacatatagtaaattactttttttttttacttgcacaggtttttgtttgccttggagtgaataatcaacttgtttcttttcaaagtacttgcccttgattcaaccacagacgtcttcaattttccagagttcctcttatgaaattctcacacctcaggtgttctgtcagtttcagctttttgaagcaatagaaactgattgtcttcaatgcctggtacatagttttcatcatgggatctctctacactgtcatccaaggattcccttcctctttttcccatgttggatttcttttattactgtatcctgtgtctttctctttctttgtttactttcttgttttggtgaagcacatccttcagcagcttccttagaaagggtgcatggagctcaatttgagaccctgaatgtctaaaaatgtatttaattatatcatcatgcaggctgctagtcttggatatacaatcatcagttggaaataagttttctttagaattttgatggaattgtgccaatggattctagcttctaatgatatatgaagaagtctaaaaccatttggacatctgatcctttgtatatgacttgctctcttctcctatgccctgctgaaaacttgtaaattattttgactctagtactttgaaatatcatgatataccttgtcatgagtctgttttcttccattgtcctggatattcagtgagtcctttaaatttagaaattcatattcttcatttctgggaaattttattgaaccatttaattgattatttttcctgctgttttctctgtttctctttgtggatcttttatttggctactaccctattttctggaagatttcctcagattatttttgacctttctattctctttctgctatcttttaatttccaagtattctttttgttttgttttgttttctgaatgttctttgtaaatagcatcccattatttcatcttagcaaatagcatttcttatgtcttactgagactttctctggtgactctagttaaaatttcatctgtcactctctaccccattgtctcttttctcagtagaatatgagcttcataagggtatagctttttttttccctgtttttcccatggatattttcccaataccttgaacaatacctcccacatagttagtgtttaaatgtttctggaataaacttaatgatcattctgatgatattaataatatatattttaacgttttctcctagtaaaggtctagtctgtttctttgaggtcatttcttcctgtttttattgatccctaccttaggttagaacattttctgcagatatctggtaatacttagtcatccacttatatttaataatgaaggataaaaagttgcttggaatatatgagcaaattgatggaagttgccagctattggcttcatggtagaatggtctggccaggccatcctgttggagatcccttgatatcaactctttagatgtctcttcctggctgatctgattctctggaacacattctcctaatctctagaaggaagcagcagtctgggagcagaagggaagaaggctggaagaatctcagcatccaaagtgcatatttttactgaatctgtctgttttcagcatggccctcatgccttcatctgggcctggtgccttccctgaaaagaaaactatatctagcattttgctggagtgagaaacatgctgaaactgtgcagaatgtgggagaaaaaactgctcctaaactgcttcaatcagtctttttttttttttttaatgaggatggaacataatcctatagattttaagatagtttaaagaactatttgttgatcacttactgtattttgagttatcaggtgagacagatataaggcatagctactacagcagaggggactgtaagagtagggcccctgaagccaaaaacagcatgaagaatagctagaaccagatcctgaagggtcttgtcaaagtatgcccttttcctgaagggtaggaaataaatccactattagttcattgctttaggtttttattgctttcctcattttacccctacattcagaggtgtttgatgccaccaattcctgagaactggggggcttctgtggtacaaatttgttactccctgctttctcagatctgtctagtcagctattagttgctcatctgttttcccagttccaaatttaaacaagagcatttaaacagttctcttcatttttgtgttaatgagttaagagtgagattagttacatgtatttgaactgctgtctatactcaaaagtctttggataggacatttaataaaacgttgggtcatacacaagaaacaaggaattttacacagtatcaagccaagattttagtttaaagtggtcccaggttgatagtaccctcagatttctggcagaagcgatagagggaagaggaattcactttccacatgcctcaaagttttcctgtcggtaaagttccaaggaatttgagtttagagtcacaggttgctaagcacactaggaaatgaagcacaatgagcaagaacaaacaggaaatacaaagccctcagatactgaaattatataaatatgttgaaagaaaagaggaagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtcgtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaaagaaaagaggaagaaaatgaatggccaagaaattataaaaatgaaaaaaacattttcaaaaaagaccaaatagaacttctagaaaagaacaattctgtaacataaactcgaagactggattttgttagacattaagaacgactaaagagggaattggttacttggacagtagatcgtagaaaattgtctagaacacagtacagttagaaagctcttgaaggagaggggagagaaaaatggtagaaatacaacatttaaagaatcactgagaattgaccaaaattaatgggttgctacatggttcagaaattccagtgaagctcaagcaagtgataaaatgatggtagagaaatacatgtgcagacataggataaagtttgatatttcagagtacccaaaacaaagaggagatcttaaaagcaaccagagagaagatgggccatctaacaaaagagtgatttgactgagagctggcttcttaatagcaatagtagaaaccagaaggcagtggaatgttaccgtcaatgtgctgggagaaaatagctgtcaatttagaattctatacccaattaaatcctctttcaagaggggaaaaatgacttttcaatcaaataaactaagtttgctactaatagacttctcaattaaggaaattctaaaagacatactttagacatcataaaataaactgtaatggaaattaggaagcttttagcactgagtgataatatcacaaataaaaacctatgatattctactaaagaggtacttggaaaaaatttataaccctaaatgcttacattagaaaataaaagctacaaattagtgaactaagcaaccaatttaagatagaaaaagaacaagatatgcccaaagaaagtaaatggaagaagataagcagcattaataaaacagaaagcaaacatacaatacagaggctcaaaaaagttaaaagttggttttttgaaaagagtaacaaaactgacaaatgccagctgagattagtgaaggaaaactggagtatgaggaatgggaaaagacaattacacatgcagagattaaaataataataagaggggggtatggacaccattatgctaataaatttgaaattttaggcaatgaataaatgcctagaaaaatatcatttatcagaatcgacttaagaattagaaagtctgaaaagtcctataacaattcaagaagcagaatcatagtttaaaatcttgtttaaagaaaactccgggctcaggtggctctcctgggaaaatttttatttgatattcaagaaaaaatttccaatcttatacaacctatttaagagtataaacagggcatggtaggggtttgggggtggtgctctccacctgaatgaagcataatagaggaccatatgagaaaggaaatcacttgcaggtctcactcatgaagatagttgcaaaaatcctaaacaaaatatcagctaaccaaatctagcagatataaaaaacttaccaagttgagattatcccaggtctgcaagggtgttttaatattagacaatccagaatgtaatttaccacattaacaaattataaggaaaaaataataccataatctcaatggctagagttacagctctgattaaaatccaacaacaaattatcctgaaaagaagtctcaaaataaggataggaattttcataataatctatttttttcagggattatatatctatagttttattaagacaaaaactgagagtgtggtgtgaagtttacattcaaacaaagttttcaaagaaatctaacacatgcctaaaaagattttacaatgtagctctagatccaagtctagataatatcaagaactgatggatctcatgactcaagacagagcattttgggtatcagttacttcttaggatttgttaaaaaatggttttgtgtgtgtgtgtgtgtgtgtgttttaaagtgaaccactgcccagtatgaaagtttaatctcctgagaccaaggcttttgaaatcactcaactcttgagtcaattcagtgaaacttgtgctgtcagtgactgaactctgccaccaatggtttcagagttcaaagctcaaaagagaatggctccaaaagttgtcccaactaagagcatgggccctttacttccctcctgtcttatctcctctaccaccctctttcccttccccaacacctcagccagtggctaggatgaacaagctgatatttataactttattattggaaaagaaagggtcttctaatttcaggaattagcacctctgaggcagaatgatctgcttgtactgtatactctccaataaaagaccttccttcctcagtcaatttccatctccaaaatggcaactctggtaacttattaactggcttagtcctttgtgagactaagtacattaagtttaggcagggaacaccatggcttatagatttcagacattcacagcttttaaagtctctcacagtccgtatttatggtgccagtgacatttttttcaaaggtaaaatattctggacatagaagcaaatcattagttttctgttctttgcattgcttcaccatgtcccctatcaggccccaaattttaatcaaaatgatgctacccatctccctttccaccctccccattcctccctctcccacataatacaccagtaatagccaaaaactacacatttgctacgctgtaaaaatgtagagttaacactattgggaagaaagttgtgcgttgcggagatgctctttgattatctacagtatttttttgctctcccacacacccagttctgcaagttttgtccttcataaagggccctttgctttttctcagcaaagtgcagaaaaggttgccttgaagcacttatcccccttcccctccactgggacgggtgtgcaaactatacagcttggaatggctttaaaacacttgggctgctgcagggcacagaaacgatactggctcttcaaagggcatcttctcaagctacctctatggtgtcaagacaagtagaacttctttccttcccacctgaaacccacagtcagatgtgatagaggctggtactcaggagagttaattcttgtcatcatcctctttggggtaggaatgccacgtcagcctttcctcatagaaggatatgacaacccgtgggcatttgacattgacttccttggcagggacgaggtcagcctcatcagaatttttccctttcatcaggaacatgagctctccactggagtctgtagctccaataatctgctccggctccaaaccctgagcaaagcctcgtggcttttctgactcttctttcttcttctttggtttgctctcctctcccttatcttcagaatcagaatcagctttgtgcttgcctccctctgatttgtctatctcatgtgctgttttctgtgacggcagaaactcatgaggtcagggcaatccaagttctcttctgactcccatgtgttgtcctcatctgagaatcccttccactttaggaggtactccactttgccctttaccaatcgacggtagagaactttttccaccacatattcctgttcctcctcttctagcacctcctccactttcttcttgttttgttttttctccatagcgtgtgtgtaaagggtgatgctgctcagagcagtgcccaggagccggaaaggaatcggtgctgcgctattggcgcattgggtcggccagggcagtggcgctcagaaaagcagcaagggtagctgcaaaggagccccttgctgaaatggtgtaccgcaggcctcggctaatggccctcctctcagccgaacaaaagagccctgcactctgtgctgcccactgcccactgcctgcaccgccttcataatctattaaagggtatctacaacatacctacagcaaacaccaacaccataccttatggtgagctagtaaatgctcccctttgagatcaagagaagacaagaatgcccattatcaccatttaaattcaacttttacagtagataattctaactaggtaagactggaaaaataaaaaacgtggcaaaggtactgaaaagaggaaacaaagctgctcttagtatttgtttaatatggttgggcacagtggctcatacctgtaatcccaacactttaggaggccgaggtgggaggattgcttgagcccaggagtttgagactgcagtgttaatgatcatgccactgcactccagcctgggcaacagagtgatatcctgtcaagtataatatttttgatataaatgtgggggcttccccccaaaaaatgctctcagaatttaatgaggaaaataacctatgccaactcttgtttttttttctttttctttttctttctttttttttttttttgagatggagtctggctctgtcacccaggctggagtgcagtggtgtgatctcggctcactgaaagctccacctctcgggttcacgccattctcctgcctcagcctcccaaatagctgggactacaggcgcccgccaccatgcctggctaatttttttttgtttttgtatttttagtagagatggggtttcactgtgttagccaggatggtctcgatctcctgacctcatgatctgcccgccttggcctcccaaagtgctgggattacaagcgtgagccatcgcgccaggcctctatgccaactcttacaatgagagattcagaatgaacaacggacacatacctgtgatactgttttgttgcttgaagctcaattgtgagaaattaaaacaattccatattaaatggcctcagtcttttaccctatttcttcttcatatttggggcaatttctgataaaccacaataaatgatgttgtaggtgacatgcttttatctaaaagtgtattcagaaatagacccacacatcatcttttacaagagcagggcatttgtctttaaaaaaaattaaatcatacaaaagaacttaatgagatccgaatcaggatctaaatactgtttctaataactctcaaggcagtgagtagggacagtcagccacagggctcacctggttggttcctctctctcaggggtcactgtcttttgttgcctgattttctagtgccttgaaaactgttgtttcatatttttttttctatgtgtttttggttgttttaaatgggtgggtaaatctctctgttacttcatcttggctggaagcacaagtcaatttaattaaatggctcatcatttcttgtatagtcctcttttttgttaataaggagttgttttaacacacgttaatacaattgcttggcctttcccttaaagtttgcgtagatttattttattttattttatgttatgttatgttatgttatgttatgttatgttatgttatgttatgttattttattttatttatgaatgagacagggtctcactctgttgcctaggctggagtgcagtggcacaatcatggctcacggaagcctcaactcctgggttcaagtgatccttccgtctcagcctcccaagtagctgggactacaggtgtgcactaccacgcctggctagtttttgtattttttgtagataaggggtttatccatgttgcctatgccagtctcaaactcctgagctcaagggatccgcctaccttggcctcccaaagtgctaggactacagcatgaggcaccatgcctggcttgtttcatttgttttgaaagtaactgttaattttaaaggtccaatctgtgaggatctaaagagtaggagccctgagatgaataattcctgaaggctttcagcattctctcctgctgtgtgctttgttattgacagctgttcaaggtctcaccacctctggagttttaacccaccgatgtgtttcataaattttaatgaaagacagatagagagaaatcatagataggccaacatgattgtaccatatccatgcactggctcaaaatgaaaatctctgtgatattaccctgagttacatttgtggaacacaccaaactccgtcttctagcttgtctgatccagctagctaagggaaatcaaaagtaatttgcaaaatcttttatgttcttttatgttcttggtacattgctctgatttattttttaaggcacagaaaattgtccaaatgcatagtacaaatttgcaaataaactacatatagttatttggacgatggtgtttttctaaggagttttgtaaagaatgtggtttaacttgccagtgtgtaatgctaaacttatttcttgtgtgttattatgaactttatttataatttcatagcagctgtttattttcattgctaaggtacaattcagatgttcttggcttaactcagtattctctatctcacaaaatttaaaattagactgatactttgtaaagattcttcagatgtggccagattattttaggaacagctttagttatccctgataataaatattagggagagaaaaagaaattgaggtctttgaagaatccctaaatatcatttcagtctatcactgtcagcctccctcactgctttcagatccattcccaggagcatttacagggtggccaagcttcctcatttgggttccagctctcttagtttctgtagcctactcattgagctaatgagcagtgtagtggctgagagctagggagaaatatgagagaaatcaaagaagaccctttctgacttttgccctagattgtttgaaacgaaataacattagaataatgaggaattgaccacctttcccttgctgcgttttaggtgtcttttctgtaccattttattatgtcgtcttaatcataacagcctacataaatacttgagtttgggttaggatgacaatgaaaaagggattagaaataacgtgtactcttttttcttaagccttcagaaggactgtaaaaacttaaagatgttaaatgcaaatgccattgccattccaagttaacaagcataagagttttttgttgtttatttttggggggtgatccttaatagtatgtgtttttcttttcagctaccaagtcaggattgttacccccaccacctgcgctccctccaagaccttgtccatcacaggtaggagacatatttgatttatgtaaactgttcggtggtagggaagttgtcctatcgctgtgcttctttgcaagggttgatcgccacagatctggtccatgagattcccaagctgataccctgtgaagagagcagagagtggtttaatttattctcatccagccagctccccagcctcatgtggaagagagaaagtttcctcaataagccaccaagcatacatatactagttcactcttggctgtccaggggtgcgtctgttttcatccccagagaagggtagaagaaggggcctctctctaattggaggtggagacatggtttttctgtatagtatgtgcaatctgggtgcctatattttcgtcagtactttaggagctatgttaattctacataaatgaaaaataaatggttatcaacatggggttagtgccgtggttttggcctatggtgctttctgtaggatggtatttttcctcagaacaaaaagctgagatagcaggagggggagaacatgtcaccaagatctgtttcacccctaaattaattctgccttatttacatgtgccactatggccttattcatcaacactttgcagagctgaaaatgagaagcaaacagtggagtgtggtatatggtgctacagatctttccttttgttaattgctgctgaagaaactttctatctttaaagaccctttctgatttttggcagaaaattttgggaaatttctctgtacacagtccctgtttctacttcattgttctgggtggttcagagctatccttccatacggggacatctcaggactcatgagtcactgaaaccacttttaacacatgcttgtccttctttcagtgaatgaaatggtttttagcatccactcaaccttgagatgcaaatactatgagatattggcttcctgctttagtgcgaagggtaataaaaagcccatttcttcctgacctgcatataaaccagcgagaactcctttccaggatgtaacattggccttaagagatattggttgaaccgtcaacaagtatttattgagtccctgctgtatatctaatgccaaaccttagttttgccctaagcctttcattggctgtaatttcttctcattcaaattattagctgtgtctgttgagcatctccaataaatcaggcattgtgctaagtgctttcagtgcattatttaatcctcacaaaacccctctgaggtagatacaggtactaatattatcccttttttttttttaacagataaggaagttgaagtatatgggggctaagcaagttacccaaggtggcatagctagtaaatagtagagccagctcccaaattgcaatctgtctcctaaaggctcctcctgtcaccatcactggagtctgagtgtctatgtgtacagccagacagcagatccattacacttgcaatggaggctttcatcacaggcccctaaggaggaccttgatgagatgaggctcctgctccacaccaacagcaaacctggacttggtcacaacaaaatgagcaggcatttgctagctgctagttcaagcctggggcttgagagccacctggttgaatgcatggaagacctgtctgaattgacttttgtaaccaaccttctagctttctcttcctgcacaaatgccagtagttactacccggtcccaaaatatgctgctgctatcagcagtcttcatctgagctgcttgaggtgggcttcttgcctgcttttggagcttagtcaccaaagatctgactgggggatctgggaattctctagtcactgttaatgaatgagtctgcttctttgtctaccagatttcccatcacaatataaacagtgagcccagtactcagcctatcagctgcctaactatggagatttcagatttcaggaacaggtgtgtaagaaatggaggcagaagatccacattccatttctctcccctattccctcctttcacccactgtaagtgggacacacatattcagatatatgaagtcctgggcaataaacacatggttatatttagtttttgtgccatgtcaagttggtattgaccctatgagcgtcttactaaccactttgtatgggacacctatatattctagtctttcccaaactgcttgtgataaaacagtctctgggagatattaatagggctctgtggtacagatttgcagactgctgcccctctacccctctgggagagtcgctgtgcaagtgagctcactaaaggctttggaggcctacagtaagtaaagctagtaaattttgttaaagccagcaatttcctagcttctgtgaccattgatatctttatttataaaatacctgttaggatacaaaatcagtgtgcaaaaagcacaagcattcctttacaccaagaataggcaagcagagagccaaatcatgaatgaactcccattcacaatcactacaaagagaataaaatacttagaatacagctaacaagggatgtgaaggacctcttcagggagaactacaaaccactgctaaaggaaattagagaggacacaaacaaatggaaaaacattccatccttatggataggaagaatcaatatcgtgaaaatggccatactgcctgaagtaacttttttttttttttttgagacggagtgtcgcactatcgcccaggctggagtgcagtggggtgatctcagctcactgcaagctctgcctcccgggtgcacgccattctcctgtctcagcctcccgagtagctgggactacaggtgcctgccaccacgcccggttaattttctgtattttttagtagagacgggatttaactgtgttagccgggatgatctcgatctcctgacctcgtgatccacctgcctcggccttccaaagtgctgggattacaggcatgagccaccatgcccggctgcccaaagtaatttatagattcaatgatattcccatcaaactaccattgacattcttcacagaattagaaaaaactgttttcaatttcatatggaatcaaagaagaccccatataaccaagacaatcctaagccaaaagaacaaagctggaggcatcatgctacctgacttcaaactatactacaaggctacagtaaccaaaagagcatggtactggtatcaaaatagacatatagactagtggagcataacagagacctcagaaataacaccacacatctacaaccatctgatctttgacaaacctgacaaaaacaagcaatggggaaaggatcaaaggtcaaaataaagggctctattttaaagtgaaatcaggttctgataaatttatcatttgccctagataacattgttttaagtttatcaaggttgaatattcaagtggaatgcttgttttgtgtaatgtatttttcctttgttaactttggcagtaccttttactgtatgttccctagttatagaatcggttcatagattgctcagagctactcatatctctggattcatgtattatgaagaaacaattctgtttcagaccagcttgtgttgattgaatctcaagttttggaagttctcttgtgaggatttcttaaatttgaaaactactattctcaagtagttagggaccataggcacacactaccaaacctggctttccaggttttaagtatgtaagaaaaatgagtttgtacatttgcaatatgcatacagagatatataaagattgtttctacatacaccaaaagcatatattcttttatcaaatgagagagatgaagtataggttttcagcataacatgcagtttagctggctcatacttattcaagcaccactgtgatatgaacatctggattaagttatacaaatggggccctggagttaggaaaaggaataagttaaaagaaacatctttttatttttcatactataggtaagatcaagaagaacctagtgactatatacaaaattaagtagtttgtgtttcacattttcctgtggcaagactagagactagggcatggtcttttggctcagctcagaagaggtgacttttttttgaaaaaagacttatttatagcataaataaccaaaaagcaattaaagtaaactatttcatatagagcagtgcattcttttgtttgtttttgttttgttttcttaagacggtctcgctgtgtcacccagactggagtgcagtggcatgttcagggcttactgcagccttgacctcccaggctcaagtgatcttcccacctcagcctaaagtgttggggattacaggcgtgtgctactgtgcccggcctagagcagtgttaaagtgagagttaaatgtattagcccactgtttgtatcattttaataaatccagtaaattgccatctgtagagtttgtgtttattcttttttttttttttgagatggagtttcgctcttgttgcccaggctggagtgcaatggcgcgatcttggctcaccgcaacctccacctccccggttcaagcgattctcctgcctcagccttccgagtagctgggataacaggcatgcaccaccacgcccggctaattctgtatttttagtagagatgggggtttcaccatgttggccaggctggtctcgaactcctgacctcgtgatctgcccacttcagcctcccaaagtgctgggattacaggcatgagccaccgtgcccggcgagtttgtgtttattctgtaggtcagttctctgccaagggactgtttggtacttcagtagctaagtccttttaatagtgttgatctcatgacagttttcttatggcaattgtgatagagccacagcttcagtgtaactataataaagaaaagattttgggggtgcaagacattatcttttaagttttctattagcaccacatttgataaattggggttccctgcagactaatgtgctcagaattttcctatttctgccactaatttctcaccttatatgtaacaaagttttcctcactagcaatgtaatgagtactaaaaatagcactggaaggtgaaagcactgtgggagaagcatttgatgaatacctttaagcttagagagaccaagaagactcatggaaggggtgagatgaccaatgaaattagttttaaagaaacaacagaactttttttttttttttagctggctaaaagatacagagctttactgcagatttaaaaaaaaaaaaaaaacccaaatgcagagaaacaggcttgcaagaggtcctggtatgtttgaggagctgcctgagatttggaaagccagattgtagggaaaatggctgtagtgttctggaagtggccatggggagcaagcctcctgctcacttccagttccagttctggtagggatgtgggagagaaacagcccctaccaaaggagttctgtctggggagcagaaactgacgggaggacagggttttagcctagtggttctcacccttggctgcacagtggaatcatctgggggagctttgaacgtgctgaggcctggagcccctcccagagattttggcatggggtgctgaggtccggccactgggaggtttaaaaacctctccaggtgattctgaagtgcagccagagttgagaagcactgaattagggcaagaggaaggaatgctcagagaagaggttgagaatatagggaattttattgatgagttcttatagggcacaatgaaaggggttctggagttggggaggcatgaggtcagcttaggggatgtactcagaccctatggggacaagaactcagatcacaaggggcctgggagtcaagggattcttgtggtgactgatgtgaacagggctagaggatgtgacaggaaggtcctgctggaagaactagtcactgtgtgcctcaggtcctgtgtgtactactgtgagaggctagccatgaacacagatggcctcaagaggaaaccagaacaactgtggtccattgagttaattcttcatctaacttcataatctggctagaatcaggtcctgaaagtgatattgaacccaataggaatatggcagtcatgctactctttttcaaagactaattttttagacacaactttttataaaatactacatttgttttatttggaagtaaaaactgcagctcacttaaacttaaatggcagttcgtaggccctgaatttgtgaaatattcaacaccattttaaatactctatccttttaattaatatcctgtcatttaaattattctttccacaagttaatacacagttggtgattcaaaatagtaaattcttctgggagaaattaagagttttagaccacacatacttttttggggcaggggaaggaattcctggtgattatgtaagtctcttacagggctatctaatccatttttaagtgttaattttattaaagcataacatacatactgaatctatttttaatacatactaaatcaatttttaagatagtaaaatgaagtataggttgagtaccctttgtctgaagtgcttgggaccagaagtggtttagatttcacttttttttttttttttttgggaatatctacgttacacttacctagttgaccatctcaaatctgaaaatccaaaatcctaaatgctccagtgagcatttcctttgagtgtcatgttggtactcaaaaagttttgggaggccgaggtgggtggatcacctgaggtcagaagttcgagaccagcctggccaacatggtgaaacctcatctctactcaaaaaaaaaaaaacaaaaattagccgggcggggtggcaggcgcctgtagtcccagctactcaggaggctgaggcaggagaatctcttgaacctgcaaggcggaggttgcagtgagccaagaccacgacattgcactccagcctgggcaacaagagtgaaactctgtctcaaacaaacaaacaaacaaacaaacaataaaaaaagaagaggccaggcttagtggctcacgcctgtaatcccaacactttgggaggctgaagtgggcagatcacctaaggtcaggagttcgagaccagcctgaccaacatggtgaaaccccatctctactaaaaatacaaaaattagcctggcgtgatggtacgtgcctgtaatcccagctactcgggaggctgaggcaggagaattgcttgaacccaggaggttgaggttgcagggagccgagattgagccactgcactccagcgtgggtgacagagcaagactctgtctcaacaacaacaacagaagttttgggttttggagcattttggattttgtattttcggattttggatacttaacctgtattatattgttgtcagctttcaaatatctataagaaaatagcaagaaacattatttaatgtgaacaatagagaaatgtcactgcttttaaaattgcatgttttttttatcaaattaaaactccgtgaataaacaccaaacatcatgaaatctcttgctgtaatatattcaaatgacctcatgtaatatataagtcattgaatcaccttaagatactgcctgttaaagcatatttatgaactttcaaaggtatatacaacatcctaatttttactcatcaaaatacgaatttaatatgtatcaagatagtttctattcatgcatgtattagaaaatcagaaattattccaaagtgaatttataaacgtatatcacttaagatgccaccttcattttcttccaaagtgttactttgttctgtcctacagtgtatgctgtagattagctgaaaatcacaacatgttaatgagtatttcagtgattaaggaaagaagatataaaccaaggctgtaccttcatttgtgatgatgaaagaacatactgaaagctgtaccacactgtgctgaatgtagtaatatgaatgtgtctgtctgtggtcttatccttagtcctgctactgtgtagctctctggctttgtgggaattaagtaagttagtctcatggacctatcgccccttctataaagtaagaagattggactagagggatcctactagtgctaagatgtctgattctattttgtattctctgttcaagaattttttttgtaatatagataaaacttcatgaaacacagttgagggacaagataggttggactaattttctctgctcctccctgctaagtacaactaaaacccccagaaatactataatggaaagaggattttttttttttgagacagggtctcgctctgttgtccaggctggagtgcagtggtgtgatcatggcttactgcaccctcaacctcctgggctgaagggactcagcctcctgggtagctgggactataggtccttgctgccacaccgagctaatgtttttattttttgtagagacagggtcttcctatattgcccaggctggtctcaaattcctgagctcaagtaatcctcccacctcagcctcccaaagccttgggattacaggtgtgagccatcatgcctggccagaacagactttgaaaggtttaaagaggaaagaggactggcatgacagtgaactagagacttcaagtagacagaagaccaataaggaaatagaaagcttgaacaataccatggttcaacttgatataacataactatagaacacccagcatcagcacaatagacatttttctcaagtgcacttggaatattcttcaggatagaccatatgttaggccacaaaacaagtctcaataaatttcaaaagattgaaattatattaaacatcttctctgatgtcaatggaatgaaactagaaatcaataacagaagtaaaatggaagattcactaatatgtagaaattaacatactcttaaaaacacaaagaagaaattataagtgaaattagaaaataccttgagatgagcgaaaacaaaatcatatcaaaacctatgggatgcagtgatagcagtactcggcgggaaagttttagctataaacacttaacattaaaaaagaagagatccaaaatcaacagttagctttacaccttaagaaactggaagaaggctgggcacagtggctcacgcctgtaatcccagcactttgggaaaccaagacgggtggatcacgaggtcaggagatcaagaccatcctggctaacacgggaaactccgtctctactaaaaatacaaaaaaaatgttattctgggcatggtggcgggcgcctgtagtcccagttactcgggaggctgaggcaggagaatggtgtgaacccaggaggcggagcttgcagtgagccaagattgcaccactgcactccagcccgggcgacagagcaagactctgtctcaaaaaaaaaaaaaaaaaaaaaaaaagaaactggaagaaaaagagcacactagatccaaagctagcaggacagaaataataaagagtagagtggagataaacaaaatagagaacagaaaaacaacagagaaaatagttgaaaagttgattttttgcaaagatcaacgaaattgacaaaactttagctagactgaccaagagtataattaagcatgtgttaacctctggtcaaaataaagggctctattttaaagtgaaatcaggttctgataaatttatcatttgccctagataacattgttttaaatttatcgaggttgaatattcaagtggaatgcttgttttgtgtaatgtatttttcctttgttaactttggcagtaccttttactgtatgttccctagttgtagaatcggttcatagattgctcagagctactcatatctctagattcatgtatcatgaagaaacaattctgtttcggaccaacctgtgttgattgaatctcaagagttttggaagttctcttatgaggatttcttaaatttgaaaactattctcaaatagttcgcactgaatgacaaattcaaaaggcaaaggaaatggccatagtgataagtgcaaggagaagagagggtgagaattagtaatgaaataccagcattggaatggaggagaaaagtgtaagcctgtcccccttccttctttttgaaagaagtactcagcattttgctctttatcaataagtgtctttagaattaatcctagtaactaattcaaaagaaaggaaaagttctatgatgacatttattttagtattataaaaataagaacaatacagaccaccttaatatctaggaagaaggcactggtcaagggtaatgtatatctgcctgattagaatattaggcatctattaaaatgattacatgacaaaacagtagaaaagaggggtaacagctgaatacagaggtgtttcctgattgtaccacataagtatatggtagacctttgatggtaaggttttctcatctctgaggatgaccttgaaggtccatggtgcatggtaattggcccctttccagtggtcggatttcgaattacttttacattagccactgttccctccccagtagggttttgagattcttagctgcttagtgaatttctactaactctttttaggggtctaaagggatcgcttaggtgactcatttataatttacctatcttgtcttataacttgtttttataagtttttatattttgggagatgatgtatgtgtagtatttatgtgaattgggatatctgtgaaggtctccagatggttcagtcctaaatgtcaagtgcctactgttaaatacttggagaagactgctaagtaattggtagaagtttaaatggctgttttggtggggaagttatgcagtttttcttttaaaaattttgtcttaaaattaaggattggggaaaagaaaaaaaagtcctctgatatgacaactagaataaaaagtcatttgaagatttaccagaataaaatgacctttggaaactacttttagagaccagctctcagaaatagtgataagacatatattgcataattacattgttacgatgactctagcaattgtgaggttcaaagaaatagtgtactgaagtattatcatctagtcattttttaaatctatgttctttggatagtaaactcttattgccctcactcttaaatagtaattctgctgtgtacagaattttagactgaaagtaatttttcctcagtattttgaatgcattacctcctcttctagcatttattgctgccactgctccggattgtactgtcaatctattttttattcctttggtgcagctttgtctttcctctgggattgcttttaaaagtttatttttactttctgaaggggtgggttgcccctccacacctgtgggtgtttctcgttaggtggaacgtgagacttggaaaagaaaaagacacagagacaaagtatagagaaagaaataagggggcccaggggaccagcgttcagcatatggaggatcctgccagcctctgagttcccttagtatttattgatcatttttgggtgtttctcagagagggggatgtggcagggtcataggataatagtggagagaaggtcagcagataaacacgtgaacaaaggtctctgcatcatagacaaggtaaagaattaagtgctgtgctttagatatgcatacacataaacatctcaatgcgttagagagcagtattgttgcccgcatgtcccacctccagccctaaggcggttttcccctatctcagtagatggaacatacaatcgggttttataccgagacattccattgcccagggacgggcaggagacagatgccttcctcttgtctcaattgcaagaggcatgccttcctcttatactaatcctcctcagcacagaccctttacgggtgtcgagctgggggacggtcaggtctttctcttcccacgaggccatatttcagactatcacatggggagaaaccttggacaatacctggctttcctaggcagaggtccctgcggccttccgcagtgtttgtgtccctgggtacttgagattagggagtggtgatgactcttaactagcatgctgccttcaagcatctgtttaacaaagcacatcttgcaccgcccttaatccgtttaaccctgagttgacacagcacgtgtttcagagagcacggggttgggggtaaggttatagattaacagcatctcaaggcagaagaatttttctcagtacagaacaaaatggagtctcctatgtctacttctttcgacacagacacagtaacaatctgatctctcttgcttttccccacactttcagtgttctgttttgatggcgctgcgatgggtttaagcgtagatttaaatttgtttatgccaggtgacacttggcatgcattttccttctggaaaatcatctttaattttaggacatttagtgatatctctgtgggttttgcttctctacttatttcttctgttttcttctggaactaactatatttctgtcaacacatttaaaaaaaactctagtaatgtgtctttcatcttttttttttcttttttgagacagggtcttgctctgtcacccaggctgtgcaatgggatgatccatggctcactgcagcctcaacctcctgggctgaagctgtcctcccacttcagcctcctgagtagctgggactacaggcgcatgccaccacacctggctaattttttgtattttttgtagagatggggttttttcatgttacccaagctggtcttgaactcctgggcccaagcagtcctcccatctcaacctcccaaagtgctgggatgtacagatgtgagcaccgcaccttgtcactttcatctatttatgttgtgatctttctgggcttgctctggatgaaatcttcatcttccaaattaaaaatcctctgcataactatatagcctagaatttttcctattctgttattaagcctctatcactattctttgattctaggttttataatccattcttttttataacaacctgttcttgttttacttttccctatttttgttttatacccatctattcttttttaggatctattctccacttttaactttgaggattctaaaatacttactttaaagttatttttaacttgttctatttttgtttttgtcaggagcgaatttgccttttttatttggctgttctaccatgctttttggaattttgttttgtaggcttattttgagttggagttcaatctcattctcagttctctgagctcctcactttctgccagttcagtggctgtctctaccaactattcctggcatccatggcctccagtcaagagctgattcttatacttgaaatacagtacttccatctggtgcaggtgtcaggggtcttgtagatggcacccaatggtgcttagcccagaaccaggcttcagtgttatatctgcttcagttcctttcctaagtaggcaacccagagcttctccacaggcttcatcttggttttgcagcttcacaggtagcaaagtgataccttagcctctggcatcagggaatgagcttggtaccagtcccctgcctcatgcgggacatttatttatttttattttttattattattatactttaagttttagggtacatgtgcacaacgtgcaggtttgttacatatgtatacatgtgccatgttggtgtgctgcacccattaactcgtcatttagcattaggtatatctcctaatgctatccctcccctcttcccccaccccacaacagtccccagtgtgtgatgttccccttcctgtgtccatgtgttctcattgttcaattcccacctatgagtgagaacatgcagtgtttggttttttgtccttgcgatagtttgctgagaatgatagttaacagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctctgggtatatacccagtaatgggatgactgggtcaactggtatttctagttctagatccctgaggaatcgccacaatgacttccacaatggttgaactagtttacagtcccaccaacagtgtaaaagtgttcctatttctccacatcctctccagcacctgttgtttcctgactttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagacggggtttcaccattttagccgggatggtctcgatctcctgacctcgtgatccgcccgcctcggcctcccaaagtgctgggattacaggcgtgagccaccgcgcccggccgtttcctgactttttaatgattcatgtgggacatttaaatccctgttattaggaactctcagctgcctctgtctgcttctgcaccctctgcctgcttctgcaccctctgcctgacctaccactttgtgatttggccccacagagacctttatcttgcttctgagtgggactgagtcttttaaattttaacagttcatgctaacactctcacatctgtcattgcatatcattttatgtaaggggaagttgagattcagagagcagaagttaactacttgggcctcgcagttggtaagtaagccagcctgctgtagaagaaaagggctggaaaaggtttctggggaagtgctagaaatttaataagcatgtagagagagaaaaatcattcattatacatcacaaaaattaactgtagatctgctaagtaaaagttgattaaatttctacactctgtgcccaccaataattttctaaatgtgaactctttcctacattaatctcaaatgcttatttttaaagtgccttccccagtgcagacttacattcatcttagccaaaatggccttcacatttggtctgtgggacatatttgatgtagcaaaaggccaagggtaacccttattctaccccctaaaagggaacagaaagagaacttttgcataataaataattatttatgcatttcaaaattgattttaagagtacacaaaccatagaggctttgcgattcttcatgtattttattaatttatcaagcacttcaacagagtgcccgatgctcttctagatgctttacaaatattaactcatttaagcctcacaacaaccacgtgcagtgggttctattgctatcctaacattgcagataagtaaacaaggcacagagaacctcagcaacttgcttgaggtcagtgacagaaagaaagagttaaggctatgattcctaccttggctatttagccccagtgtaccagctcctactatactactatgctgtgctgtgaaaccacgtctcacaattattttattaacaatcaaactgacacactatctttgtcagggacacattttatttcatggaactagttaaaaattagctttaactcacttctggtgacttgttttctttcttaggttcttcctcattatattatgcccatgctattgttatataaagctcactctgctggtatcattcttctggaagatgccataaattcatctaatcatttcatcagatgttaacggaatgtgctcactgtaggcccacagtttgctgagaactataggagcacaaagattgtgatgtgatccttatcctgtagttcctttatcctgcgtcaccctctcacagcagtcatgcccaacactatctattctatagtctctcatggttcttacaactgagtcattttctgtgtgtctcatttaaacccatttcttaatgctttattgacacaggttgtaagcaataaactggtcaccatgtttctaataactaccaatatagcccagttttcccctggggggctcagttatggtggttttctaggtttctgagcaatggaatcctcatttctcttctctgctgtcccctatcgcactgtgacttttttttttttttttttttttttttgagaaagagtcttgctccgttgcccaggctagagtgcagtggcgcgattctggctcgctgcaacctccgcctcccaggttcaagcaattctcctgccttagcctcccgagtagctgggattacaggcacatgccaccacgtccggctaatttttgtatttttagtagagatagggtttcaccatgttggccaggctggtctggaactcctgaccttgtgatccacctgccttggcctcccaaagtgttgggattacaggcgtgagccactgtgcacggcccacactgtgactttaaggaagcactcctgagggggtcaggggaggagcagatgtggattgggaggatgcccaaatgtgctactgtgctaatgggaaaggacaatggaggacaaccaggggttgggctcagggaggcagcttgacagaggatttaagagcatgggcttggggtttcaaatcctatctgcctcttactggctttgtgactttgggcaagttagtctctctgtgcctcaatttcatcatctgtaaaatggggatcatggtagtatccattttcatagggttatgatgattaaatgagtgaagatctctaaagcacttagaatgatgcctggtgccatagtcaaccctcaataacatttagctgttataattatcatcaccacaggcctagtgaaacagaggtggggtctagttggcaaacacagaacagactccagatagctagaaattagttgcaaccagcccagaatgagtgctgaagtggctcgctaaagcacttgcagtcaaagcacattgttaccctcatctgtgacctttcatgggctgtctctctgcctatgtcaggggttggcaaactatagcctacaggccaaatccagatggtcacctgtttctataaataatggaaatgtgaaggagaatcaattggcaagaggcacgcatagcgcatcttcaaccttttccatcggggaacatgagtcttgagaatcctgccatagatcaaaagaatggcaatgagaagaaccagtggacaggtggataggcctccccatcagcctttaaccctcctgctcttatctcaaggatcatatgcccgtgtctgtggtttctgatttttccttgaggacctttgaccgagatgatctgtctttcagactttactagcaaaattctgagcagtatcttttatacaactggcagcttcaaaggcttgcagtgggtaggcctccccaactctgtttcgcaagataattaaaagaagccagactccttcatccttgaaggagaggaagaagaaaacaagcctgtccagagaaaatggggtgaaggaatttttctccccaacttcctcctaaataccctgctctgcccatcaaattttgtaagtatcacccagtggtgtgttggtaaaccttctcccctgcggggtgggggaaagccccaatttgcagccgttgttgctgtctgtgttgtgaatgctcccaccatgctgactgcaagtggagctgggaagagatgtgtaccatcggctcactaacactagcatgctctgtggtagacagcttcccttgcctctgaatccttgtgtcaggattctacgtgccaggcaacaagagctttttttctttatgtatcatgccagtgattttagtctagggcactgttttagcccaatcccagaatgtgctattagaaatggggccatatttttgaagttgctaggggcaaaacttccctcttgtttatgtttaacttgtgccactaggtggcactttaaggacattacaggaaatcggctctactggatttttaaaacttttttttttttgagacggagtctcactctgtcgcccaggctggagtgcagtggcatgatctcagctcactgcaacctccgcttcccgggttcaagcaatttagctcactgcaacctccacttcccgggttcaagtaattttcctgcctcagccttccgagtagctgggactacaggcatgtgccaccacacccagataatttttgtattttagtagagatggggttttgccatgttggccaggctggtctcaaactcctgacctgagttgatctgcccacctcggcctcccaaagtgctaggattacaggcgtgagccactgtgcctggcccaaaacactttttattgaagtataattgcatatagaaaagcaagctgcacatttaatgtgcaactcaattttcacaagcagaacacatgcatataatcagcacccaaatcaagaaacagaatattactagcaccccagaagccctccttgtgctgttttccagtcgctatctcttattcttagggttaccactattctgacttctaacagcataaattagtttgacttgtgttctactttatataagtggaattatgcggtatatactctgtgtctggctttttattaaatgatgtttgtgtgatttattcatactgttgtgtgtaattgagatcattgctgtatagtattccattgtatgtgcaaatataacactgttttctactattgatggacatttttgtacttttcagatttgggcaattatgaatagtgctgctgtgaacactcgtatccaagttgttgagtggatgagtgttttcatttctcttggatatatacctaagagtagaatttctaggtcatggtgtaggcatatgttcagctttagtaggtactgccaaacagttttacgaagtgtttgtactgatttacactccattaatggtgttcccactccagttccatgtcctcatcaatgctgaatttattttatggatggttcctaactcttaacataatttttatagctccctttctggccagctatttctaattgaaaaattttaaagccacattattctgatggacatggctcatgcaggaagggctatgtcaacccaaaaggggacatttatcacagtctaagtgtgaactatcagtaagtcggaaaggatgttactctaatactccatcacactgatacacagagcaaagaaaccaggaaaggaattcagattgtaagtgtgataaaatatcggttcataggccagggctctgaggcattttgaaatttgtatatacatttgttattattgccaggcctatatatgtcagagattggggcccaacagaaagaatttctaaaggcctcataatgaagtgcctttcaattgtgctgctggtgggtgcctgttttactaagggtctctttggtttggcaagaggcatgcatggggcatctttcttcaacctcatccctggggagcgtgagtctctagagaatcctgctttagatcaccttacctgtgaggctcatgttgttgactctgcagatggtgttataatatggctttaggtatgtgatatagagagtacagttcagacttgactcagatttctgttccattactagaaattggacatagaagaacaaaacccaggtcatggtcaaaatatttgtcttttagaccaaaataaagtgctcatagtcctttagttgtaacagtaagtctgtctcatggatgttgtccataatctaatgggttccaagaatccccaaggcattctgccatgtgactcttgaatccagcaactagttgcccattatagtcactggtacccactttcaccaaagttgttcctgagcccctctgtcagtgttttcctgagtgtctccagtgttggattggtctaccgaggggggtgcccaccagagatgttcactgcacactgcctgagatatccatgttaaagcagccgtgaaacatgaaagtctgaccgggcttttatttttaaaattttctccccccaatattagtagcggtaatatccagtggcacagatttagactgtggatagcctgctttgtgggatctgcttatattctaaattggagccagcattttctcagcctaggttttcatctgtttggcaaggaggaaaatgcccttatgttggattggctgctgcttgcagtaggaggaactatgcctgggaaaccaatcataattttaatcctaatgataatagtagctgctgttgtcaaacagttactgtgtaattgtgcttagcacactagacagatattttgcttaatcttcacaatattgtgagttaggtgaattatcccactttgcagatgaagaaattgcagctcagagagactaagcatgtgaccagctcacacaatgagcaactgcaaagcctgggtttgactccagagcctatatcctgtaactgttctgtgctctgtgggtgcagttaccaaggaatgaattactgacctcttctccagtggaacatgaaacagtattgggttcattgctggcttattccacacattgattagaggacctgttgtttgctggcatgcagcttaggtatcaagaaaatgatagggaagcaagacagatcctgccctccaggtgcttaccattcgtttatcatgttctgtctctcacaggtgacttgagtcatggattttggtaatcattcttgctgagaattcagtctcttggaccttcttgaggctctatttacccctctctctgagcctggttggggaatgatggggtggaacagtggtgtgctgggccattggttctacatcttctgtgactgggtttagcaaatggctttctgttgtgttcttgcctagcggagatgggggacaggtgaaaactaggcaccaaatgacatttagaatactgacagaatgctggaaaggccctggaggcagcagcaggattgtcttcttgtctgcctagaatttagctgctgcctttgtgatccccattcttggaatccacctggatccttggatgataaagcctgagttcgtttttctgacctgccaatattgcaaacctaaaaaaaaaaaagttacctattatccacaccttggcaaagttctacagatggacttcttttttttttttttttttgagacagagtcttgctctgtcacccaggctggaatgtggagtgcagtagcgagatttcagctcactgcaacctccgcctcccgggttcaagtgattttcgtgcctcagcctcctgaatagctgggattacaggagcgtgtcactacgcccagctaatttttgtatttttagtagagacggggtttcatcatgttggtaggctggtctcaaactcctggtgtcaagtgatccacctcccaaagtgctgggattactagcgtgagccaccatgcccggccagactattttttaagtgggatttgactttttttttggttgcaaatttgacttttaaacaaaatcttactgctgaagattttgcccagctgcaaatatttatctatagaaccatgtggcatatacccccattccctctatgatgaatggatgagaaaacaattaagaagcctagttagttttgcaagagcacctgtggccttgcccagactagggccttggagacttggttttctcatctcttaaatgaagagtttggaccatcagtggttcccagttgatctgggctggctacataaaaatcacttagggtgcttgttaaaatataagtttctaatgccccatccctaagggattctgatgagggaagtctggaatagcatctacaaatctgaatttataaaaagttccccagataattatcctgctctggttatatttgggagccactgggctagagggtctagaacaaacataattaagttagggagaaacttctgatgtgcttgaagatttggggaatacctatatgcctggagcaggttccatatgggcgaactaacccagttatgttgcagaggtaaattggagccagaggatggaagacctttaactggctgagggattgtgttgtgtgccataggctttggggagccagtgaagggctttgagaaaaagcattttgattagatggtgctttaccagattaatttctcagtggtgtgcagggtggatcagagtgcactagaactgaaggctggaaaaagacccagtgaagtctttgcagtggcccaggtgataagtgtgacgagtacctggactcagatgggaccagtgggacctttgtaaagctaacctgcctcagtggaactggaatctgagacatactgttttaaactccttaaaaaatgcataatttattaatgtcatgttcatctgcctaaactattataattaactatttttattgtgtttttgtccaagaggttttaaaggagccctgtaaataaattcatgcaaagaagtagttggcagcagcaacagctgctaccgcagggagaagggacccccttctggccaggcagcaacctcattctcaccctgtctccatactctaagccaaagcgagaggggaggggagtgcaacaggggcccctggagttggatctgccaaccacagtggagaatgcacctccccaagggttaggtgtggaatatggcgtttggcattaagtcaaatagaatattcttcctttgttcctctaaaatccagtctatagtcaatgtttctcaaagtatgttccacagaacattagttcttcaggatgttaatagaagttacatgagaataaggagatgaaaccaaataaatttgggaactgatgggctacgcaaaggcaagtgacttcctttcagaatttcagagtgtgtaatgttctgtgtgctcagtgaatctccaagagggagatagaccaggcagtgtttcctaagcttatctgtagattcttcttccccctaggccaggggctgacaaattatggctcataggcctcatctatcccaccactttttttttgtaaataaagtttattggaacacagttgtgcccattcatcgtattgtctgtagctgctttagcacaacaggagagttgcagagtggctacagaggtagtctggccctcaaagcctaagatatttactatctgcccattacagaaaggtttgctaatccctgctctagacaattcatggaactggtgcttcctggtaccccctttcagagatgctactagaagaagatatacatgggttgttctagcactgctttatgataaatctgcctcattttattctgtttccatactgccatcattcctgcctcttgctttaaactactttatctctcaaccatttacccattatccaggatccaaacctgggttccatgtgtccttatcttttcttgcactcacaacattccaaaaatggccaagggtgtcttcaatttccagtctgggtagctcttaagtcagcccgaacccattcctaccaacctggcctacatgaccgtcatcttttctttttcagcattcgaattaggttccttttccccagatatgagttacctctagtcctttttactcactgaatctagaataacctttgtaaaatacaaatctagtcagattgattccttacttaaaatccttcagtggtccctgtggccctcaggataagctcagatcctcaggatggatgtgtgtcagtctggttgggcaaacagaaactactcctggtatttcgtactggaagagatttaatttaaggaattagttacttaagaaaaggagtagatatttccaggcttctgcctgctgtggcatagagaagggcatggaaatgggggatggtgttgagtgtttagcaaatgacccagaacaaaccaggtctgggaaaccatgtgttatcccctgctgcccttctccagcttcagctctcccatttttctcctgactcctcacccttcctccaccctgcaagtccccaaattctagatatatcaggatgcctttttgtccccccagaaacttaaaacaactgacatttacgaactcacagtctctttgggtcaggaacttgggagtgacttagctgggtggttcggggttacatcctctcatgaggcttctgtcaagatgtcttccagggctgcagtcatctgaaggcttaactggagctgatgatccacctctaagatggctcactcacagggctgttggcaggaggcctcacttctttgctgtatggaccccttgttaggactgcttgggtgtcctcacaatgtggcagctgactgtctccagaacaagtgatatgagagtgagagatagagatagaaacagagacaacaaggaggagcatactagagtgctttcagtcccctctcctgggagtacgttgcatagtgtctcaggtcagcttccctagaagcagaaccctgagatgaggattcttcaaaagtgatttgttgaaggagtgctctttaggaaaaaacctagaaggaggagagggaagaaaagtagggaaggggaaggagccaagcaatgatatagtctcagataaaatctgaccttggcctgatccacacaggcaggattctggtacataattgcataatagagttaaccctgtttgagacaggggactggccttttatatccttctctaagtcagtcattataggctgctggaggtgggggtgggaggtaggctcccattagttgagaataagtctctagagaagagggtggctgtgagtcctcagtagctaacactcagagcagctgggggatggtgtgccagccagggaaaggtgacccaggtggggccaacacagcacctactacagtgggcctccccgtacccatgtcccaagcacctaccatggtccctgacataccagaggtacgaaaaaaatatctgtgtaattgaataaatgaatgcatagaaatgcttagcctctctggacctgtgtccatttctgggaagtcagctcagcagggatcatattgtcccatcaaccatgggaatggtcgaagacccaggacagtttgccacatcatgagtggcagcactgtctaagtccaggattttcattgcaaaattagagtgaaagtatatttgccatttgtgaataaggaagtattaatattacaatattatatatttttaaaaggaactttagctcacatttcagtgagctctttgctaaaagtacattttcctggtttgtcacatcctgactgggtacatgttgttacacatggaaccgtgagggcagaactgccatttgttatattaattgtaatccatatatctgtttttttcccacaagaatcagtcactggatttcagttcagaaaaccaaaactgtcggacaaagccatattatcgtgttggcagagttgttccccatgaccccaaatacacagaggaggaagagaaccactgaggccccttgttttcttggattatcattcttccaaagttggtaactaagaaaagtctcaagaaatagcaaagaaacctccccaccttattctgctttccacatcccaagcctaacataagcctcaaactatttttatgaaggaaagcttattgtgaagagggtcttttacatgcctaaatctcatctttagtttttcttatcacacagccggttatctttgcccatctcttttcctgggataatgtctggctctgtcaaggctgtgccttattctgggaccttcctaatgcctgtgttccaggtccctcctgagattcgctcctccgaatgcttgatagatggatcaatttaggggattgatggtcagatttagcctgacataacaccatgcagtggtctgttaccagacatagagctggaaaacccaggcccttgcatacaagttcaggaaggtaaatttgcaaatgaaaaacattttaagacacatctcacagctgcttcctcatcccccaccctattgtttgtgtttttagagatgtttaagagaaaaggaggcaataacaaagacgctctgctgtgctttggaatcctcatttatgttgaaaaagggtccatttatcatctccttggatatttccacaaggagactttgctcatctcaccagggaatggagtggtagagcaaacacttctctgtccacctgatgatggaggagaaccaactaactgaaaggcagagagcctgaaattattatcctctctctgcctgcctgctgcaagatattgctgcatacctgtggtccctgcaggaggctgcatgcgtagacttgggccagaacatatattaccttccaagcaatagatttctaggtaaaaggcaagaaggggcctcaggttcaagttgcattcttcagtggggttcacaggaggccctgcattcagggggttactgggccctccttcagctgttaataaaactgacttttggctcatagagcttggagtatgcgtccatttgtatgaacctccagggaaagcagggtgagggcttgtgttccctagactcctggcagtgaatggctcctggacagctttgcttggttgtttcccaggtacttcaaactcaatctgcctaaagatgagttccccctcactcctgcttctcctgtgtttcccatcttggggattgaccttagtgttcttgtggtagccctggctgaaattatggatgttggagcatgggaggccctttgtgaacttacttttgggtctttctcaccattcccacacattgctcttttagcccaggcctcagctgagacatcacctgctcctgagtctttgccgacccatgagactgggtgcttctgtattccccatacttgccctccacagtccactgaagcaagttggctttgtcacttccctgttgctcccactagacttcaagcttctcttaagcaggatctgtatcttgttcatccttgagtgccagtgctagcacagggcctgcctgtagtagctgcttaataaatatgtcttgaatgagtaacactcaggcctgagaatacctgagactgtatggcatagtggttataagcttagctttggaaatcaaggcctgtgttcagactctgctatttgtgtgattttgggtgagttccttaacttcttgatcttcaatttcttcaccaataagatggggataataactacttcctagggctgtgatgatgaattgcaatgatccatgcaaagccctttgatcaatgtatgacacatagtaagtgttgtgtgcatcatagtacctattagtaacaacaacaacaatatagttatcgttaatggaagggagaaagctataagaactagttggaactagaagtcaggaatattgagtgcttgcatagtggatttagaggagatggggaattgcttgggataaaatgtaggaacagatgggattaccctgggagagaatgaacagggagggaaaaatgggtggagcaactaaagacagaaccttgagaaatcctacatttgagggataagaggagtcaaaacaggaaaaagagtgaatgactacagttaggagattgcagcttctcagatgccaggggcaggagtttaaaaaagatagtcaaaggtgctatactgggcagaagatcaatgaggagaagacgagaagaggtagccataacgtgttaaatgggggtatgttagcgcccttgggaactagccatttcagtggagtcagaggaagaagccatgctctgaaggaggttagagaaggccacgttagggatgaagtgggcatactaagtcagtttgttgtgctacaatgtgtgtttctgtaatgaggattatctgtgggtcagtagatgactggtgtcagtatgatgtagaagtcacattggttcatatgtagggttcattctcagcacatgaatgttttggcatcactggctactagtggctgaaagcagactaacacacctgaaggcagaagactgggggaaatgggggacatagagagctgctcatgaggcgcagtcaccctgtgttcttccacttgactgattggcacccactctgtcttgaagtgctttggggacattccttgccaatcttggtgagtttagtcactgattccattccactcagcacccttgacccttctgataactccttcgaccacagtcccccttccttttttaagaagggccatatttactagagtttttttttttttttttcccaaactgtgtccaggtttattaaagatactttttgtgaacagtcatggtatttcaggcaggacatgagcgacaatcattaacagtatacaactttcagactccctccttcaatggacttccaaaatcagaaagccatggtaaaacccaatgaagtcttcatttggtaccctgaagagggaaagttcagagtgagggttgacatttcacattcaacgtgctgtttaacaacttttcatgagctgaccctgactttcaggaaatgaaatgaaaatggcagaatttatctgaagatccacaatctagaaacagagcacgtgtctttcaagggttctcgctggaaagtccagattgccagcctgactggtaaccagttattgggggccagaccccaacaggtatctgggtttgagggagttaagtgtatactgaaggcagagagggagagggggaaataaagaggaatttgtttctccacaccacaaggcctttgtgcgaaggtgactgtgtgtgtcaacgtcagacagtccctctttctgggagccaagaagatgtctttaaaactagaagggaaaggtgttttctccacatcagtccagcttcatagacattctttttcttttttttctttcctgagacgaagtcttgctcttgttgcccaggttggagtgcagtggcacgatcttggctcactgcagcctccgcctcccggcttcaagtgattctcttgcctcagcctcctgagtagctgggattacaggaacccatcatcacgcctggctagtttttgtacttttagtagagacggggtttcgccatgttggtcgggctggtctcaaactcctgacctcaggtgatccgcctgcttcggcctcccaaagtgctgggattacaggcatgagccacggtgcctggcctcagagacattctattagtgacatataccccttctccataaaacaacaatgacgtgttccgtgtgctaacaacatggcttaaaataaaggcataaaaacaattctgcatttttataaaacttaataaaaaaataatacttcaaactgcacagtcaccagaaatacacagttatcaaaaatgcacacacttcccttggcatccccagcgccttcaactttctgtgcctgctctgttttggcctctgcattttctgcagagttattcccctccttgccagcatgggctttttcctttttcccctttaccttctctcccttctttgcaggggcctctttaggcttgggcttcggaggagcaggtttggcagacaaccttgcagatcttctctgtggtttgtccttactttggttttatctcctttagcgtccccttcagcctttctcttgggcatggtggaggcgactgcagtggaatgtaggtgctggatctggggatgcagcagtgcgtgggctttggttggcctgggggatagttcttacctcttcttcttcacactgctcatagagtatttctttattagaaatttaacatttaaaaaattcagtgtttttaatgatgttgattgtttttgttggtgctcaagttaaaatctttgttttcaaccctgtttttccgataagccttgttacttttagagtttgttgttgcgaagcattagttttttagcaatacatatgttcaattacagaagaaattcccatgattccttttcctaaggttgaacaatctgggaaggagggatgggaaggttaatagcagcatctatgggaggtttttcccaaggatcagcagacttaagcattcttggctgcaacttggcctaaatcagttttcccttggtgactatcttcctaagtgctctttattgtatatttaggtgattgtggttttgcatttctgtcctctctctgatctcttgctacagtctgaacaagtgtcggaggccgagttactcccacagctgagcagagccccatcccaggctgcagaaagtagtccagcaaagaaggtaaggtcagcctgaggatgctgtcagatggcgttgcgagtcccaccccgggcttcttatctctattagctgatctattgttttaaggtttctgtgtcctgaaatgaatgtcaatgatccagatttcctagaatgtgggttctttgtgaagattggggtcctgaagattcctgggcttgacccttgatgcattttgtacatgacagtacatactcaacctccttagccccccagctaaacatggtggccttgtttatggcaagagctaaaagggctgtggggagggacagatgtctttagcaaaaccccatccacctgctaagcctctgtgaatacctcttggggtggggtagtctctcctttttggtctttgtaccatggtttcctcttgcatcgtggcattttcacctggcatctgcccagccatgccattgggtcacctgtaatttgctcagtaagtacccctcactcatcatgctctccattcatctcctcaccctcttcttgtccttctcccaggctcttctttcagagagagtgggccttgggctcaggagcacaggtgaggtagagtcctccaaagaagcagaccaactgtgtccttccagaatacactgtggctctttttcttgactttatgtaggaattggggataggagaatgatgagcatatgactaagacctttaaaaacttccaaagcttaggtttttttttgtttttgtttttgtttttttttcctgagacagagtctcgctttgttgcccaggctggagtgcagtggcgcgatctcggctcactgcaagctcccaggttcacgccattctcctgcctcagccttccgagtagctgggactacaggcatcttccagcaggccggctaattttttgtatttttagtagagacggggtttcaccgtgttagccaggatggtctcgatctcctgacctcgtgatccgaccgtctcggcctcccaaagtgctgggattacaggcatgagccactgcgcccggccaaaatttaggtttaaaaggcttcaaagtgaggcaggagcctatcttgtcttcagttaggaaaggccccatggtgtgagatgcacacagggtctgtgtgagtttcaggtgacaagaagtaatagacttcttgaaacatttaaaaagaaaaagaaaaaagggaagaccactggactctgatgcctgtgtccccccagttcttgctgagccatgggtcagtaaatagagtaccctcctgatcttggggttggggctaaaggcatgtgggacactggaaggaagagtggagggaacattgaaatgtttaactttttaatttttattttgttttaaatccacaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagtaagtagaccacataaacaagagtgaggtaggaatctcgctctgagatgtcgacggatatgtaaatgtgttgacatttacgtgcgcaccaacagaaggatttcatggttgtaagtttatcttgctcatctctgtgatgggattcaagtctcccagtcacatagaaggctttataagctataggacttaacctgacctaaaggggcaggcgagtcctaggctgtggtgtttggtttggtttgatttctttcccttcctctcaccttctgttgtttcctactcctcttccttgtgagggcccaaattttcctggcaagatgaaagtattgtaagtggcaattttgcctctctgcctgtgttatctccttttccttcagggcaaatggctagctccttcacccacagacacactttcagtaggtgtggtatgtgattcttttaaaatctccgtaaagagtttctgttgttggtcgcctcagcacagaatggatacatgcagaacttccattatatttatctaaccagctggaacaggtattggagggagggtgaagacacctgtggacatggccagggactgagacaatgatgctctggacaaactatccttctctgtaaaactttggctttgagaagagccatcacttgcttcaatttctttgtagtgaaattgagggaggtgttgaggacagaaacctgctcctgtcacttgactgcaagtgagcctgaccggtcactaacataaatgctcaagacccatcatgaccctgcttttggggtcttgcaggtctcagatgctgctgcagattttcttctgcttacacgttgtagaatgaaaagcagcaggttctgtgggagatgttagcaacttgtctttgaagccaaagtcccattctgaatctctgcagccctctccttcagaagattttctttttttcaaatggacaggtccctggtggtatcagtccataaaggaagtatattttgttcatcacattcaccgagaactttgaccatcttccagcccctgttaagcctggaaggtgaagaatccctatcagggacaaagatggctcaattttcttccatgttctaccccagcactccactttaatttcagctttatgttcattttagtcagcagtggcttaacagtctccagagtagatgtcagggcatctggtggagttcatacagagatcttttctttttctcttttttataacagctttattgcaatataattcacatagcatacagttcatgtttttaaatgtacaattcagtggttcttagtttattcacaaagtcatgcaaccatcaccacaatctaacttttgtcatgcctaaaataatatatatccacgcccattagcaatcactccccattctctccttccccctcagcccctggcaaccacgaatctcctttctgtctccatggctttgcatattcttgtcatttcacataaatggaataatgaaacgtggtcttttgtgactggcttctttcacttagcataatattttcaaggtttatccaagttgtagcataaatctgaacttatctttttatggctgaataatattccattgtatggatagaccacattttattcatccattcatcagtcaatggacattttggttatttctgcttttttggctcttaagagtaatgccactatactgtttgtgtacatgtttttgtgtggacttacattttcatttctcttgggtctgtacctaggagtggaattgctaggtcatgtggtaactctgtctttaatatttcgaagaactaccacacttttcatagtggctgcaccattttatgttcccgttggcaacgtatgagggttccaatttctccattttgtcaacacttatcttttttttttattatagccatcctagtgagtgtgaagtgtgatctcatggttttgatttgcatttcttttgtggctaacgacattgatcatcttttcatgtgcctattggccatttgtttatcttctttggagaaatgtgtattcacaccctttgcccacttttaattggattattaatctttttacttttgagttatgaattctttatatattctggatacaactcccttgttagatatatgagaaaattgagccctctttgtaaatattttctctcattctgtgggctgtcttttcactttctattttttatttttattttttagagacaaagtctcactctgtcacccaggctggggtgcagtagcatgatcatggctcattgtagcctcgaattcctgggctcaagtgatcctttccccctcagcctcctgagtagctggaactacaggcatgagccaccattcccagccaatttcattttattttttatagtgatggagtcttactatgttgcccagtctggtctcaaactcctggcctcaagtgatcatcctgcctcaacctctcaaagtgctgggattacaggcctgagccactgcacccagccaattatcaatattaatcagatctgtacagtggtcacagtccattctagttcagttgctcttttctagaacctatctcccagtaatggcacatatggctgtttttctaggagaacatcagttgctcttttgctctaagaattcggtgtttcttgctgtgggatgaaaggttgtagattatccctgtggtaactgcactgatttatcatcccaaccatggacggttttgaaaagtaaagagagtgctaatgtacttatgctggacagacagttttaaatggagactgtaatgggcgcagtaggatgcgtggtcactctggttatgcgtgttctgtgaatttgttgttaattgggaaatactggtattaaaacgttctgtatttttctcaagagccacagatatatgctggtccatgcacatacacgagtgcacatttatgcacacacacacatatacttaggcattcatgcctaataatacataaggtagaggtaggtagtctggctaagttaatgtagaatttttgctaaaaataatgttcttgtattattttccttcagacttgttcacaggggacacctgcaggtcttctaagtgctattaattcttacacaaaaagggcattccagttaatatggtttgtcaggaagaaatacttattaaaatgtcttggaataaatggaacacaaatgtttgaaaaggcccatttcacagcttttattcaagttataaaatgggaattacttcaggtgtaaataattcatcccaataaatttgtttcatttggtgtctatcttcctgaccgcctgtgaatatgagattttatttttggagccctgtgttgttaaccacttgttagtttaacacctctcatgaatcagagttctgaccctcaagggtccagacctctaagtcctttttcactgaagtgtttgtgcttttctataggcagtcttccaaacagaagaaggccattcaaactgctatccgcaaaaataaagaggcaaacgcagtgctggctcggctgaacagtgagctccagcagcagctcaaggtaaggaatgagtcccagatttggatgaccaggcttttccctggcttttaaaaagcttttttttaatttaataggcatataataattgtacatatttatagggtggggtacatagtgatgtctccatacctatcatgtacagtgatctgatgtgtccattggctgaccatttagttccatccctgttgataagacttgcctcttcgttctcaaaccctttttggaaggtggagaattactgtatttaagtttcatgggttggttcttgcatagtcagaggaagactagtgactttaatatgtaggcttcatattgtgtatgagttaaaaggaaagacaatctattacgaaggctgtttgaagcattctttattatccaaagcttctgggtaagcccttaattatttacatcctctctgaaagaggatgtaaatacttatttcagtagaaggaagtcaccttggtactatcaaagcccagcccctcctctggtgccttgcaaatggttccatttcaccttctcaatgacatcacccctgtttctcttcatcgttactctcccctgtgttagtttctcggggctgctataacaaaatactacaaatgtggtggcttaagataaccaaaaatgattctctcacagctctggaggctagaactctgaaatcaagatattggcagagctatgatctctttgaaggctctagaagatgatccttccttacctcttcccagcttctgatgttgctggcagccctgggcattccttggcttgtagctgcgtcactccaatctctgcctctgttgtcacatggccttcttcctgtatctctctgtgtctgtgtccaaatttctcttcttattgtatcctcttataaggacaccaatcattggattaggacccaccctaatctagcatgacctcatcttaacttgattacatctgcaaagaacctatttgcatataaggtcacatttacagatactgggggttaggacttaaacatatattttgagaggacatgattctacccactatatcccccagttctctactggatcattcgccatccacatgtaaatatgctccagtattgtccattacacttggccaattactgcctcatttctttggtccccttcacagcaaagtttcttaggagtggttttattcattatctttactttcaaaccagtaattttctcttccttccacttcagttggcttcgtcctcctccactcacacccgtcttgtggctaaatccaatagggctgttttaatattattatttttttttcagaagaattctacacaattgatcatttcctcctctgaaatggcttttataactggtttttgacataccatactctcctggttttccttctgcttcactggtgcttcccattttcattctctgctgtctcttccttccctgacttaacttttataccccaaccccatttgccccaatattttagtatgaaaattttcaaacatacaggaaagttgaaagaatcataagtgactgcttgtatagacatcacttcagttctacaataacattttactatacttatttttaatcacatatctacccatttatccttgtgtccatcagttcatcttatttttgacatattttcaaataaattgcagatatctgtatactttccctgaatattttagcatgcgtataattagctagagttcaatatatttttacagttttttcttatgatgtaaaatgtttatacaaaatgcatgcacaaatattattattattattattattattattattattattattattattattatttgagatggagtctcgctctgtcgcccacgctggagtgcggtggcgtgatctctgctcactgcaagctccgcctcctgggttcacaccattcttctggcttagcctcctgagtagctgggactacaggcgcctgccaccacgcccggccaactttttgtatttttagtagaggtggggtttcactgtgttagccaggttggtctcgatttcctgaccttgtgatctgcccgcctaggtctcccagagtgctgggattacaggcgtgagccaccgcgccagcgcacgcacaaaccttaagtgtacatttgctgagtttgtaacaagtacatgtacttacggaatccaaacccccaaaaagatagagaatattaccatcaccccaggaagctccctcatgctttttcctagtcaattcctgccctacccacacagaggcaatcactattctaatttttataccatagttttgcctgttctataactttatataagcggtgtcttacaacttatacttcttgtaaagcttctttcactaagtattatgtttttgagattcatttatattgttgtgtgtatcagtaattcattcatttttattgatgagtagtatcccattgggtgaatatgttacagtttggttatcaattctattgacagacacctgagcggtttccagtttttggcaatttggaataaaactgcattttttaataagtctctgtatggaaatatgttctcatttctcttggattgggattcgtaggtatcatggtaagtgtatgtgattagtttctgagaaactgctagatcattttccaaggtggttgtagcaatctgtactcctaccactaatgtatgagagttccaattgttccgcgtctttgccaacatttggtgttatgattcttattaattttagctagccctgtagtgatatagtttttatcatctccttgctgactaattatgttgtccacttttctttgtgattatttacctttcatatcttactttatgaaatatcttttcaaatgttatttttctccaaagtagtctatagatttattacaaaaccaataaaaatcccagcaggattttttgtgagtatagacaagctaatcccaaaacttatatgtaaaggccaaggagctggaattgcttaaacaaatttgaaaaggaagaacaaagttggaggaatcactttactgtcaagctccagtaatcaagatgctgatgcacaggtcagtggaataggatacagagtcctgaaatagaccacatgaaaacagccatttgatctttgacaaaggtgcaaaatcgattcaatgagaaataatagttttcaacaaattgttttataacaatttgtcatttgcatttaaaaaaataaccttgatctaagcctcacatctatacagagattaacttgaaatgagtcatagatgtaaatgtaaaacatagagctataaaatttttagaagaaaacagaaaaatcttcatgatctggagttagaaataacaccaaaagcacaatctataacagagaaaaactaaaaaaattggacttcatcaaaattaaaaccttttattttgccaagcacagttaagaaaattaagagacaagctgctgagtgggagaaagtatttgcaaaacacgtatttgataaaagacttatatctcaattatataaagaactcttaaaactcaataataagaactctcaaaaccaaagcatctcaatttaaaaatgggcaaaggatttgaacagacacttcactaaagaatatataaagatggcaaataagtacatgagaagatattcaacatcattagccatttgggaaatgcaaatttaaaccacaattacataccactatacacatactagaattgctaaaacaaaaaatgtgacatcaccaagtgctggcaattagaactctcatttattggtggtgggaatgcagaatggtaccaccactctgaaaaatcgttcagcagtttcctatgaagttatacatacactaaccatgtgacccagctgtctctctaccttagtgaaatgaaaatttatgttcgctcaaaaatctatatatgaacttacatagcagttttattcatgatagcccaaacctggaaacaacacaaatgtccttcaaaagatgaatgaataaattgggatacattcatacaatggaatagtactcaacagagaaaagaaatgatacacaacttggatgaaactcagacattatgcagagtgagacaagccagtatcaaaaggttgtgtactgtatgattccttttatttgacattcttgaaaaggtaaaactatagtgatgtgaaacaaatcagtggctatcaggggttatgcatgagatgagagtttgtatgagtagtcccagggaacttttggggttggttgaactgtaatgtgtcttctttgtggtggtggttacacaaatctgtacactaaaagaaaaaaattgttttaccctatgataattttaaaaagttattttttaaatttcaaagttcattctgttttctaaaactttgtatgtgaacttgttttgttttgcattttgtttggttttggttttctcctctctccctctgctttggggtaggccagtttcatccattgttctctacatttggtgggcccttttggaaactgatattccccagttctgaagggttttttattttcatttttgttgtcgttgattatttcctcccccctgccctcacccccatttttttctcattctcccttactgatattcagacattggacttcttagcttagttctctaattttctcatattttctcttctgttttctttcttttctcttcctacattttcttctttatttttgtctatttctggaaacttaattatatattctaaatcttctgttgtttaataaccaataattttttgttctctgtttatttttgacggtatcctattcttgtttcattgttgtgatcttttttttaattatactttaagttctgggaaacatgtgcagaactcgttgtgatctttttttatggtcatttttctttcttcttcctgaatagtttgtgtttgttgtgttgtgttgtatgtgctttatcttagatgctttcctttgatatctgatggcccttctttgctcatatttaaaaggaagatgaaaacactgattagaagttcattgtacgttgtaaggcttgtcaactctgagcttcactgtctggcaatttggctcggctgtatagttggggaacccccaaagggagtatgattagctctttcctcttggtctggttggagtgtccagagtggagactgttttggtcacctacatggagggatagagttggttcagtggagcaagagggctgtaggtctcagcattccaggatattcattcactctccctatttctggcccagtatcttgtcctcaactgtgcttgtttcttgctaatccagatgctctctgttgtaccttttcaagaaataaaccttcagcattctgccctggtggcaggaatgatctggggatctaattgcttctgaaacagattttcagccaacacttattttagccaactcccatctccccttatgtactcccactttaataggtatctggtgttgccaatttgagtctttcaggaattctcctacgtaaaatcaagttggttcttatttttcttcatgttagcctgggactcagctttctttacttgatctgtatgagtggaaaagttctaagtctagtgaacagaagtctgaagaatcattgaaacagaactatagtcatagcccctcaattaattcccaggctaagccagtttatagatccagaacctcttgaatgatgaaggggcatctatgtctccttaaggaaggaccccactgtgcagccaaaaatttacactgcaaatctttctcctagcctttcctaagggggaccctgctgccatttaccagggtgactgtgcattagaggaagggaaataattagacttttggggaattaccagacactggctctgaactcacactaattccaggagatgcaaagtgtcactgtggcccatcagagttggggcttagggagatcaggtgatcaatggagttttagcttatgttcgtctcacagtggacccagtggactcccaaactcaccctatggttatttccctagctctggaatggcatgcttggaatagacatactcagcagctggcagaattcccacatttattttcctggatttcctaagtcatttaccattcaccagtttgccactcagctttcaaattttattgctatcatcttgtcccttttgttttccctgtcttgtgggtccgtgactttgaaaagttgctgtattgttttagtggtgctccaggagggagagagtgtggtacccctggtcagtcttccatctttacctgaaacctctatctatactgttttgctagatgatgttatatggtctcatggctttgaagaccatccataaactaatgaaacctaatttatgtctcaagccctacttctcctttcctctgtgctctagacttgcatatataacttcttactcaatgttttctccttagatatccaatacacatctcagataattaattgccaaccctctccttgaaatactcatttcttatctaatcttctcattctcaatatcactaccagccagctactttcttcatacaaaaatcccaggagtcatcctcagatttttcttctctcctacatcaactttatcagcaagtcctaccagttctagattcaagatttatctagaattcatccacttctcttcatcttcatggcttctaccctgacggaagccattttcatttctcacctgggtccctgcagtaacctcccagttgctcccctgcttccactctcatcctgctataatctactgtctacacagtagccagagtgaaaattttgaattttaagttgggtcatgttccttccctgattagaaacactcaatgccaggccgggtgcagtggcccacgcctgtaatcccagcactttgggaggccgaggtgggcagatcacgaggtcaggagatcgagaccatcctggctaacgtggtgaaaccccgtttctactaaaaatacagaaaattagccgggcgtggtggcgggcgcctgtagtcccagctacttgggaggctgaggcaggagaatggcgtgaacctgggaggcggagcttgcagtgagccgagatcgcgccattgcactccagcctgggcgacagagtgagactctgtctcagaaaaaaaaaaaaaaagaaagaaagaaaccctcaatgccatccccgctacatttccatactatttcctctgcccacaaggccctgtacgatctggctccttgcttaaatctctgacttcatttcctgccaatgtcttccttgttccatctactctggtcacacaggctttttgttcatcaaattcaccaaactcactcgctcctcagggcctttgcagttgcccttttgtctctgtgaatatccttccccccatatcttcatatggctcactcctcatttcattcaagtctttgctcaagtattgctaactctgagaagccttcccagggcactctctctcctttctcccatatccccctctgttactctctattatgttatcttatttccttctggaagtatcttgttcattaactttattatctttctcaagtcatttgaatataagccctattgctctgatctggcatattctttgctgataccatcacagctacagcattacctcacctgtaggagatagaaaccaagagacttccggctgggtggctaggagagcatgtgaataaatacttgtgaagttgtatactgactattagtatgctgattcttctgaatctcacaattcagcctttctacaggattctttcccaccttgactgattctacttgaatacctttatgtgtcccctctcttcctgccaaaaaaatccgttttaggcccgaaagtttgaattcccaaagagcagattgctcagcctcttttctgcctttcacccagatgttgtaccttacaccatatgttgtgcagaaacttggatgagactttggtggaggggcaactagcgtacctttttggccctcagacctaactgagtatggtgcgggattacgagccagagattgcaactagaaatttaagtcctgttggctcactgctcagtattgggagtctgtttttgctttctgctttctcctagtcttttaatttttaatgactctgtctaccagctactgatcttgtcaaaacaggctaaaactagggcagggtggtagaggggagtaggtcagtttcatttcatcacgttcagaaaggagttgagagattacaaattgtgaagccccttttgtctggtcaccagcattaaatctgatacctcccagtcctcctgttcttgagttatacagcacttgtatttgtgggtccagttataagtttccttttaaatctgatgaagtagggatgaattcaagaaatgacccctttgcttttttgtttttcttgtgttttgtacaactcaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccata

SEQ ID NO: 36785 - DNA, 46062 bp, Homo sapiens
agcagagcggacggggcgcgcgggaggcgcgcagagctttcgggctgcaggcgctcgctgcgcctggggaattgggctgtgggcgaggcggtccgggctggcctttatcgctcgctgggcccatcgtttgaaactttatcagcgagtctcgccactcgtcgcagacgcgagcggggggcgggggcgcggcgaggcgccggcggccgtgacgaggcgctcccggagctgagcgcttctgctctgggcacgcatggcgcccgcacacggagtctgacctgatgcagacgcaagggggttaatatgaacgcccctctcggtggaatctggctctggctccctctgctcttgacctggctcacccccgaggtcaactcttcatggtggtaagtccacgcgcacgggcgcgggggattttggagatcggaatggggaccgcattggccacatagacccttcctggctgcgttcccccgcggccgcagcagtctcggattctggcccgaaccctggctactgccctcttatcgccccatggtgagccccttctcttttcccagaagatcatttcagctttgacaactccataaaaccacattccccctcaaatgagagctccgatgtttggtttatttggatccagctgagcgacagcaaaatcagccaatttcttatcctgttgagagacgtgctagcctggtctccagctctagcacagacgtgtgtgtgtgtgtgtgtgtgtgtgtgtgtgtgtgtaaattcaccttgaaaactacaaccgcctcccccatcccagcccccaccccgccaaaactgcctcaaggtaaatcgacgggccaattcagccagtcaggagttgtagaacctaaagcgtgtgactttgtattatttcccgtccttccacattccaggttcaccccagtggggcggaagaacattttgctgcctccagttagagactatggctttaatgcaaagctacagaccccggggtctgtctctaagatgttaccttgttcacaaccgtccccgcgaagagtaactttgctgctttcctttgtacgttggtctgcaatttatttatttatttttgcatagtgatggaatgttgaaccataccaggtcgctaaaagttccaaaggcagattccctccccatctagaaaccgttctccatctgccgactttctggtcttggaaagagatagagttgatagccctgtaatttccttgcacctaaaagtttcagaacagatattaaaatattgattcagagacacccgttatcgtgggctaatttttaaagaatctggtaaggggtctcagctaaattacagactagagcagggaaatttttaggaagacactggagctcttcaaaggagcaaggcaatgcgctgatgggaagaggggttcaattccttcctaagccggctttgaacagggaggcgtttagccttgacattgctgacacaggatcaaagattgatttatcagactgaccatttttcaataaaatgactatttctgtttccatgggtgtataaacattatttattgctcaggctttttgtcacattgtctctcagctgtcacttaaatatattttttggaagtcacagctgtaacgattttatgatcatataaaataatgaaaatacaagaaaaagacattctccttgtttgatcgcttcaaaagacacctatggcagcttgggttatataaaaggtacctttctaaacatttcacgactaatagagaacatctgggtagagatgatgatgtaattttttgttaaagtttcttttcaaaaagtactttatggagttatagcactgtttgattcttccaaacatttagtgtccttaataacaatagaaagaattttttccaaaggatctttataaaagccaaaaagagctacaaaatggaaatatttaaaaggctcttcagtaaggaaagaacagcctgtctgtgaggagagtgtaacatcagataccagcgggtgttgattagacagatacagacagtttttaagacattctgtcaaataatgggaacgaagagcttctaaggtcagcttcccccaaagccaagtccagacacattgtgtcactgagatctgagccttcttgagaacagtcttccacacattctccccaagacacgttgcttcttacccgtcattcacttccccaaatgccgactttgcctctgtgcccctgcccagagcatcatctggtagacctagcttcatgtccaacagacagtcatcacagcattttggggatgacttctgcaagatcactcactacgcctgcctgccttgccggtttctccactaaattaaaaagtaaatacccttgctttctaatatcaccagaaggataaggaattcatatttgaaaagtgctttgaactccttagtctcccaggaacactgagccaggcctccctgttcacgttgccctcacctctgtgttggttggtcccttataggtacatgagagctacaggtggctcctccagggtgatgtgcgataatgtgccaggcctggtgagcagccagcggcagctgtgtcaccgacatccagatgtgatgcgtgccattagccagggcgtggccgagtggacagcagaatgccagcaccagttccgccagcaccgctggaattgcaacaccctggacagggatcacagcctttttggcagggtcctactccgaagtaagtctcctgccttcacccagccctatggctctccactcatgcacagctccctcactccatcttcaaagaccctgcttatcttctattgcattttattccatcagaagtttgttcagttgggcgtcattgtccctgttctacaggtgaggactagagaaatcaaggaacatgtctagaggtttgtaagaggtgaatcaaaaggaagaagtagaaccccaggctgttgtcttttcactctttgctctgtccatcactccaatatggcacatcctccaggttcagacttcgtctctaagagacgagagggaggagccacaagtctcttttgactttttccttggctttctggggcttcctccagaagaatttgagcagatcatcagcatagaatcttcaaatcttttctcagcaaaggattatcagtattgcaaaaacaccacttaagtgatattaagaagcagagacaaatctctactcaccacttttcaccttccatttagctactcagccttggtgcctctgtgtctaaattcaacatttttcctcccaacagattgtaaattctgtaagggcagaaactaacctatattccctgcaccttgcttggtgccttgtgtattgcaggccctgttcattcattatgatgaatgagtggataaacttgtagtggctacctattattttccagctacattttaagcaataaggatagctatggaggatagaggtgggaaacatgaatacatagaggttttttcttccttagcaggaaccttaaacattttctaattacgtagtaaacttcttaaaagttctgaatatggaaagtagctcactagctaggacacaatcaaagaaaattaattgaaaatcatatttcattttcaaataatacccatctgctaacctggcattattagcattctccaggaaacaccacagtccatttgctattagaaaatctgacagaaaacacagcagtttatgtgcaaacccccaaaataggaaactttttacttgtttttgcctacccccccccccaattcctaagaaaatcatccagactgtgcacttggtaatgcttaacagagggtgtttctatcatgtaatcatcacagccctagggttttatgaggccaaatgcataactgaatgtctctaaaatcccccaagggcgtagtactctcattcttagagtatccctaaagttaatttactgcgatattctgcaattttattctctagtttaagaactatattcttctgcattccttttggagtttcaatatgacatcgcaaatttttgaaaggttaataataaatttcagcttcatggaattttaagacttcacctagattatcttgccagtgaatcaattaaagaaactggaccttgttaaagagagtttgcaaatatctagcacgagtaatctttggatatattatgcatggctctcagtgtttaaaacatatcaggattttttttcaaagtgcttacaaccattttgcaatgatttcaaattagatgtacatctcatttatgaaatgatcatctctggatctattaagatatctacatatttgaataaaacctttagatcacatatcaaaggaagcaatattgaccagtgatcctaaagaaaatatatccatcaaagctggggattcatttataaaatactgtaacttaatcttgacactattattttcttcagagctgtagaattgctgagatgaaggaggttcgaactagaggtaacagccaggctcactcctataatcccagcactttgggagactgaggtgggcagatcacttgaggccaggagttcgagatcagcctggccaacatggcgaaaccccatgggtgtggtggtacatgcccttaatcccagctacttgggaggctgaggaatgaaaatcacttgaacctgggaggaggaggttgcagtgagccaacatattgccactgcactccagcctgggtgacaggactggaggaaacagaactagtttaaattagtctagacctcaggtaaataagagattctaacttgtacttccttcagatttttttcagatgaagcagaatactttgccacagtactcagaacttaaaccactcatgctacacaatttctttccattcttcacagaaggccaggttccctctcagacatttatgcaaactcttgtgactgtcagtgatgattttgtgttggttatgggagggctgaatttggcctaaagcagcttatcctggaaataatcaagaaattccaatgaagctatccaaagatttctacaattagttgcttggagaaaaagttacgtcttagagttgtggacacctaaatatgctcatagatgaataggaaaggcaaagggcaagaccatttataagaagaacataaaattaccaaaatgtcccgtggtcatagagaaatggagaacatttgcctgtttgactttagagagtcagaataagacagtacaatttttagaaacatttgtaatttactcattcaacagatagttaccagtcacaggcagagaaacaaggacagaactagcaaaactaaaaatattcctgcaagaatacacctccaaaattctagaattagccttagaaaacacaaaggtaattagttctcatccttataaatattttcttataaagcaaatactttaaagagaattgaacaatccataaccttcaagaaaccctagcttctagagttttgccttcctaggtaacaatctctctaccccaaataaaaactgtgcctatgtacttaataggcattgcttgatttatctccatacaaaaattagagaaacttcaatagcaacacattaggaaatacagatgtcaccacttagatttggattttgtttcattttgtgatagctgtaaaaaggatctttctaagaaaaggcccaagatcaaaatttgttttgttacaaagccagctcttgaaatgtgctactacttcacacataacattttagtgattcatctaaacacgtaactgaaaacattttagggctattatctacatggtaccaaaccatctggaggtaaaatgaaaaaccagtcaatgtgctaaatttttaatttaaataaaggaacatctagctatttagtaatgtgtttgaataatacatgacaaatatttagaaaagtcatatttttgctttggaaattatttctgaaatgaagcagattgtgatttgttttctttcagtcaacaagttaatgtaattgtttccaagttataccaggatgaattctgcacctagacaatttatttctcttgttgctttcgaaatactgtctggttacctgatatagtatcatccccgtcttccatgtctttcccgtaatagaccacttcataaaatgtctcttctttctccttaaaaaataagactagtgctacatacttaagcttttgggaatttcctcctctatgtgatctctctaaacatgggcgccggcttctaaatcccaaaccaagctttagaagataaatggggtaactatggaaaaggtattttcctaaactgtaaaatggatataataaaagtttaatttatctgaaagccactatctgagattaagtcacattagcatgtattagtcgccttcttttacaaaacatctcaattccacttagaatatctgtggtctatatagtataagctgggactctttaaaacagctctcgtaaccatcatatttccctctggagagcactacctgctacctatggcgaatagtcatataattgattttacctaactacagggcatgattgattccttttttgatggttagaggtttggggggtaaatattttctgaaagctgaggtaagtgccatttaatatggtgtagatatgttttcctgatttttaataatgagactagcagagcaaatattgcaagggatgtataataaattttagcactgaatgacaaacggaaacaagcagggcttcaatgtgaaaaggtggtttgctctcccagctgtgtggttcaaaaagtcacactcctcttgacatattgaatcaccaaatggttctctgttttctgccttgcattggcattaggttatccagcttctatttggattgttaatatatttgccgcagcaaccattaataaaagggcatgctaataacaatgaaatacagctccacttgaaaaatgaggtgcacacggaccctaaagagccttatatctgtcactataccacaacaccgtgttatgagttactacagattattaaaataatttaatgtagttattgcactgaaatatgtacctttcagcctgtaagtgaaagtagcctgtgctctaataaagaacaattctaagaaagcaccccaaagggttcttgcccaagtctaattataggcggtaaatttgtttccttccagaaaaaccaaagaaaaacttttcactgtcttttacccaataccagtgattagtgcaggtgttccagaagaaagtaaattcaccttaatagttagacatatagtatgtaactcaaggatattgcatactgccttcagcaatctctcaattacttatgaaagtcaatgccaagcccaagctctccagtgttaatgcaaggggctggttactgccagaattctcttcccaccttagtccctagatttctttgaattcagtatttcattctcaataatttaagtgcatatgagtatcttcagtaagtcctggaggtttggaaggatattttgaggaaagctgtggtgtcatgagtacccaactatattgtggaatgatagaattgtagcattcagactgtaaagaaaaaggcctagagatgctatgctcctctcttctaggacatctagagctctctgttgaaacagggcaagcctgtgtttgagactaatgtgaagccaggagctgggcaaggccatctttttctttgatactgcttatttaagaagagctgccacacagatacctaaattgacaaaaacctatattagatggagatggttcatattaaagaaagagcctgggctctagaaaagaacccttcaagaatatcagtaccttgttgtctagtggcaaaggttgtctgaaacagagcaaatattaaacaattgtcatatgaaagttattcagaaatagtgctaccggaccacttttaagaaaagcatttttgtttcaggtagtcgggaatctgcctttgtttatgccatctcctcagctggagttgtatttgccatcaccagggcctgtagccaaggagaagtaaaatcctgttcctgtgatccaaagaagatgggaagcgccaaggacagcaaaggcatttttgattggggtggctgcagtgataacattgactatgggatcaaatttgcccgcgcatttgtggatgcaaaggaaaggaaaggaaaggatgccagagccctgatgaatcttcacaacaacagagctggcaggaaggtatggaaatgcaacggtgctcattttgtaggctgcatggctttataaaccacttaggcagagcttatcttaaacttccctagaattgataaaatgctgtgtagtcacaacttcctactgtcccccagccattagctgtttgttcggaagaataccaacaactaggttgaaatattcccacccacactccaccttccttcctatagctagttgaaggagtccacccattgtgtttggcattgtgttgattcaagtcttttatggtctctctggacactgtcatttaagcagaagatatgaactgtgggttaggatagtgcttcatcccacatagcaatgttacactgaatgcttatatctaagggatataaagattagacccagagcatcttttcttacatgtatcatgaaaacaactcatcaagcatggtttgttggcttcttctagatttagggatgccctctttgggaacctgacccaagtctcactcataaaagccccaccttgttgtttctggtgctggataagtaagtggaccaggagaagacatgatcctcagagggtattctggccccttctcctctagacctgactaacttcctgggctccagtcagtgtacaccctttaaccatcatttgttaaatgaggaaactgaagccctcaaggtactcaaggtcacaaggaagttagtagaaaggactagaaagttaggtttcaacacgtagtccaggggtgctttaccctaggattaaaccatttcaatgccaatgttcagacccactgatgacccatgtcttttggtatggtggtatgaccagaataactagagaatttaatgctgtacttgatgcttttgtgtggaaagcattaactggctgggtgaatcaaatatttgttcagaactattctagaataatctaattgccaataggaagaggtaacgataatttgtcttttatcaacacaacataaaaatgtgtttgatattaatatataaagaaagataagcataaaattgaaaggtccctgggggggctttaataggaaaaataatagaaaagaatggatgaaaacccctttactaggctcctggagagaacaaatctcatttaaaggaagttagaaggaaagaactcttgcttagcacatggtataacatgagtgtgacctgaactgtttacaaatagtacctttcttgaactttaaaaatcaacattcctaattttcatgaatttatgaacttacagtcactactgccaagaaaatagactatggttgtgcaatcctacaactattggtaattactgtttgtgcaatgatttggataaaaaaatttacactgacctttgtcctaacattgatagtacatgtataagttataaagtgtggtgactttgataggagtgtgctgcttaattgttcaaacagggtatatagttagatttctctatttggaaagataaaagatattgtatccaaaagaacattgacttatcaaaataaatgttaatttcactaaataggtcattagatattgaatgtttcaactcttcaagacaatagatcatagctattatattttaggccctgaataaacacaacttttaatgtaaatcacatgattcttcaccgtgtagaggtgaacagctgtcaggcctcagatattctcctgcctgctctgcaaaacttaggaggctacttttgattggaataaaagtgcacacactgactttttaaaatgtggctttaattaatggtgggtgggcagactttttcaaggagatgcatgatgtcagtgaatatgaactttaatgagagtaaatgtattgagataaacatgcgtctctaattctcttcttgcggtcattagacccccagtctctactccccctttgtactagcagaaggtctgtggaatcaaaatgagaacagcctgggcttgtttgaaggcaggcctcctgagctaagcctccaactggcttggctctaaggctctagaaagcccccacctcccagggctgacggtaacatcagtccactttttttcttcttctttgtgcttttcagcattttccaaattggccaatatgaacatctactttttaaactgggaggggtaggggagagcaatatatttcatttttttaaaaaccatctattctaagattgctctgtttagctaatgttaaaagtcagaattcatcactgccattcataacgggccttaatttttccccaatatttgaacaatttatttattatagcagttggttagagcaccctcatgtgtctctgtactgtaatgtcattttagatcctctgtgctatatcatttaatcatagtttcagcagaattcataatgatttctttctttcatgtttacttaaatgctcatccttgattgagtctagttttccacctccaattaggactatgaataagtactaaaaagataagcctgtcttgttcaaaacaaatattctatcaggaaggaaattctatagcatccttcagcagctctgtttaggtctaaagaaaccatgctataaaaacttccaaattacattttaagatagttttaggtaaattacatgcaaaaggtcaatatctgccatttatttcctttgatgagcttgcaaacaagcaccttttaaatttgtccactcttccagcctgggcaacatgatgaaaccctgtctctacagaaaaatataaaaaattagccaggtgtggcagttctactaccacagctattcagctactattcccagctatactcaagaggctgaggtgggaggatcatgtgagccagggaggctgaggctgcagtgagtcttgatcacaccacagcattccagcctgggtgacagcacgagaccctgtctcaaaaaaaacaaaacaaacaaacaaacaaacaaaaaagttagttcactctttcttctaagatgaaataatgaaataatcacaacttctttaaatgttcctaagggaatctgtatgaaaataactcatgtttccagtcttactgcccttccatcactctgaaagtttctataagagtaggaatttccataagaataagaggaattccatgaaaatactttccctaaaaggtgcctctaacttaaaaatagaaaagaacatgggacttcaaatcagatgcacctttgttttaatcttacaataccagtggctttgctcattgaatctcggtttttctcatgtatggaagggcattttgtggtgctacgggaagacaagtgtaaggcagatagcacagaacctggcatgtaatagatgcttaataaaagttcctttcccttttgtgaagttaagattatttgtaactcaggtaacagagctaggcagaagtccatccagctggaattattatttaggattcaatctgatcactccatctatctatagagtcatcttctattcagttaacatactaataaaaccaagcatatagtattttttaattgataaaatactgtcaaatgttttataatttgatatttccaaaacccctgtaggaataaaaaatagtattcatatttctacttttcagatgagcaactgggcctgagagggatggagagactaaagcagggtcatagaatcatgaagtactagatcctgggagttcacatccgctcctgttctcccatgtgcccttgtctacatttccatattgcttttgttgagaatttctgagaaaagaaacaatatttctatatgtacgggggaaaaaccagcagctactacctttggaaggtagtttactgatgattttttttctttgtgtgtgtcttcacacattttctaaaatgaatgtgtatcggtttttaacgacaaggaaaagtggttttaagtgctgaaaacctaactgccagtcatcgtgagcacacccaaaccaatttagccttctttttggaggattcgcagaatttcaacaaacagcactgcaactttcagagctctgttcttgtattttgggactaactttggttcaacagttattttattaaggaattactttgggaaaggcatcagttttggtactaaatcaatgtggaaaagaataaaacaaagcagcccctgaccataagaaactaaattttagtcaaggagaaaagagtaatacaattgcaaggcaggcaatgctatgtggtataataacataatcagccacagggccagttagctgaggagataatggttgtatcataaaaagaactgggtgtttgagctggagataaaagatttcccatggttgagatatggaaagcactttccaggatgaagggacttcaagacaaagacagatattggagcaggaagtgtatcataaagttgagggatacaagaactctagggtggagttcaagactgagatttaataggaactgaggctgaaaatttgaaatttgagtcccagccagatctggagagcccttttttttttttttttttttttttgagacagggtctcgctttgttacccaggctggagtgcggtggcacaatctcggctcactagagcctggacctcctgggctcaagcaatcctcccacctcagtctcagtagccgggactacaggcacttgccaccatgcctgactaatttggggtgtttcttatttgtttgtttgttttttggtagagatgaggtttcgccatgttgcccaggctggtcttgaactcctgggctcaagaatctgcccaacttgtcctctcaaagtgctaggattacaggccttgagccacggcacccagcctggagagtctcaaatactgtgcagagacatttggctgccactgggaaggcaagaggaaggcattgaacagtgggagagaaagttaaatacttaagtttaattttcatgcatttgttaatttctctagagtccactttgaaagagtgatagctatcaaagtttgacccttctgtaatatgcttgagttcatgacttaaaaaattaactgggcaaggtggcatgcaactgtaatcccagctactggggaggctgaggtgggaggatcacttgagctcaggagtttgagaccagcttgggcaacatagtgagatcccatatcaaaaaaaaatagatttactaggaaaattgtgagaaatttgcctctctttgaattttattttttgccttaaatatacatataagtactgatatagaaagcttctgggtgtttattaatattaaaaaatcagcatatggcaactgttgatatttacattttcaacatgatagttaatgttattattggctactctactcattgggagctcttagtttaggagttcttgactgaggcattatggaggataaggccctggcatcagaaaactggctctaatacttgagcaaaaccttgcataagttaccaaactagggttgccatataaaataaaatacttatgcatatacaccaggtggtaagcaagcctcaggggtaggtaccattattatacagtttgcatatgaggagactgaggtttagcagggtggccagaatcagcaaataaattgaatatatttgctcattgaaatcatctgaaattcaaacttaacttggcatcctgtattttctatggagaagctcagagggtgagggggtccaaaatttctagttccactcactatccaaacaagcaccaccgaagatcagtgctgcagagcactagggcctgcccctgagcatggcctacctgggcgctgggacagacaagatacttctaagttccacctacagaaagtgcttcaaagtaaacagaagtggatgttgtactacatgtaagtaaaactttacaagcaagcaaatctaaattctaataaagacttaaaaaattttttttttttggagacagggtctcaccctgtcacccaggctggagtgtgcggtagtgcaatcatgactcactgcacagggctcaagtgatcctcccacctcagcctcccaaggagctcaaaccacaggcatatgccactgtgctcaactaattttttttttttttttatgtttcatagagacagggtcttactatgttgcccagggtggtctgaaactcctgggcccaagtgatcctcctgccatggcctcccaaagtactaggattacaggcatgagccactgtgcctggccaagactttaaaaaattgatcccttgatgccacttaaaatgaataataataaacaaataatgggtctgacctaagagaactggggcatgatgacaaagaaatcacactcttagaaagtagggaatatcaataggaaagaaaatgccaaagccatactgaactgcagagccacgttgctttcacctcctattcatcctgaccctcccttcaacaatcttgagcatctttgtggggcataaatttcacttagtaggtatttgtttacttactggtctccttagttcataaaatgaaaagcatttttaaaagttagatcagttctgccaggctcacttctgtcttgttggaccccaaaataatatgtgcttgatattagagatctttatttatcatatgaaccaaaaactaaccagaagtcaagtcccaagacagggaataactcttaacaaaattgttgcagttccatgtaaagttctattgttagtggaaaatgttttttagacttgcctcattagtcaataagaattattatatatatggttagtcaacggtaatgttcttgaattccacaaatgtaaattccacaccttatattttctagctaagcccacccacagtcactgtttttaaagaatgacagtgctcaagaaatcacaatgtcttaagttaataaatgtttgcataagcaaatcagctgcacaatttttaataaatttttcttcttagttccagagtgtgtatgtttaaaaggtatgagttggcccaattttcagtaacttctatctgagagatgtggacctgtcaaaaggattcaattgtgaataaatgtacttggcttcaagccagcaggtgaaaattaaataatatgtttttaatgagagtttccctcaggaaaactgatatagaaccagaaatatattagtgactttgtagaatatacccaactaaaaagtgaagtactaacacttcttcaaatgctcaagtttaactaaataatttagtgaaaacacagtatatggggacctaaaataaattctaactaggatttctaagacaagttgttaagttggcaaatatttcacacagcatacaatggactgccttctttctgataggaagaaaatcagtatgacatgacacagggttcataaactttgcaaaatgcaggtacctacaagaaaaaaattctcatgttctgcaaagaagttttacaaagacactgtaagggctgcttgggctcagtcttcagaagaactgacttaagaaaccaaaacttccttaggagaagtttgtctttataactggcaatataattccttttagactataattagatacgcaaacactaagtgtaaaagcttatagaactcactgaatccaaggaacatgagccccagagactggcaaaccctaatatgaaaaacaccagcagagtgatgtcgactttggtgtcagacaggcttggcttatatcctgcctccctgggttatctcacttactgcctgtgagatctagggcaagctcctctactcctgggtgtttcaatattcttatctataaaatgggataataatagtatataccttacgtggtagtgtggactaaataaaatagtgaatataaagtgcttagcatggtttgatatatggtaagaaattaaagaatgtgatgcctcagtattatactgacacaaagttagagcagagaaatataaaatagaattgttctagcctacacaatgcatgtattttcttcttccatagctcttttttttaaacagacttctgcgtctggtatagaatgctaatatctagaagtttgtttaaaagaaaaaaagaacactaaaaaatggaagtttcttaaattttaaaattagaaaatagcctctgcaggtcaaaggcttaaaatgctcaaaataaataaaaaatgaagggccacataaaaaaatctgctaagattttagcactgaagcagttatgagcctattgaagagcttttgttgagaatagttatatattaagctaaaaatggtttctatgaagctaaacaccaaaagagtcctgctgtccttagaagtcatcaaaaaactacttttttagcatagctatgtcacatgaacaagtatttattgacaggatgccacgtagtaaaacttagatgggattaaggcacatggggaggagtggggactgattaagaattgtgctggccagttggtgatattaagaaccatgggggctgggagaattgagaacaggagcatacgagaaggctgaaaatggaatcttgacagcgacctgcattaagaatcaaagaagaaggaagtagaacaagagacttttcaggaaagattcaagagacaaaatagaaaccaggatgtgactgtgtcatgggctatggccttgaggttctgaaggaagctttcggtatcccacattagcaagaggcagcaagtcattgtaattgattcttattctaattctttctcttcccattgtaaaaacagtgcttgcacatagtatcaaaagcaacagcttgagcagtgcagaaatgtataaattggtaccgttttctcccctcacagtccttgtctccttccagaacatttcaaagtgcaaactgactcaagaatgtgaatgggacatgtaatgtttcccctcttcctcccaaacttcattaaaattgtagtaatagaaaaaaaagggtttaaattgacaataagaagaatagtaaaagaaatgaaagagctaaatgaatttctggaaaatggaaagcaaatgaataaattgtagctcacaaagaaggatggagaagccacagtctagaagaataaaagcaaatggggcaactgccaacatgggagggaagaagccctgagaatgcctcagatataaataagccctggagagaaacataggcctgaaaattgggaataactgaaaattccattgatggaatagggaaccccaacccctcccttctccccatgagcagaactccgcggaagtcggtcatttaacatcccaggctttctggagtaagagtcttcagcataagagccagtgtcctgggtgcagtggcacctgtgtgtagtcccaactatttgggaggctgaggtaggaggatcactcgagcccaggagttcaaagctgtagtgccctattatggtgcctatgaatagtcactgcactctagcctgggcaacacagcaagagctcatctcaaaaacatagtcattgccctgccaactcaccagaaagcaatattttttggtccacaagccccacctctacaaccagagttcctaaatgcctttttactacttcattcttaaatatgaagagactgtccaaggattatcatatattagattcaatacagcagcgtgaaagaaaaagacaaataaattgcaggaaaattactcctgcaattactgcaggagaaaatgcagtaattcaaggataaaagaacttttttatagcctaatcagtttcctcacagaaacataatattgacacccacaaataagaacggaagctttgaaaaagtgacgattagagaaaaagaaagaatttggaagagaaagccaaataaacctctcagaaagtacatcaaaaagcccaaaagataaatgtttaaggaggtccataaacatcccctgctcttttccacttgagtttgaaaccaactgaaaaatggacaaatggatggactaaaagtatcagttttgtgattgaagaaaatgctgccctagaggacgcgggctggaagcacggtgctcccgagcagtccaaccctgagccaggcagattcacctaccacaggctggcccttggagcccctgcagcaagggagccacatgctagatggtaggagctgatcacaactcatttccacaggctaccagatccccaaagagaaagaacccaggcacacaagccctgctccttcctctaaacttaccagttggatgaatcacttatcttcctctgggtagacatgagtaagggggtggaaagagccaggactgttactctgatggaatttcttcctcaagaaatcgggaagaaagtattgaaaagatgagagaaaacataagtgacatagaggaccaattccaaaatttggcaaccggctaattagaatgccattaaaaaagaaaaaaatgaccagatgcggtggctcacgcctgtaatcccagcactttgggaggccaaggcgggtggatcatctgaggtcaggagttcaagatcagcctggacaacatggtgaaaccccgtctctactgaaaatacaaaaattagctgggcgtggtggcggatgcctgtaatcccagctagttgggaggctgaggcaggagagttgtttgaacctgggaggcggagttgcagtgagcagagacctcgccattgcactccagcctggccaacaagagtgaaactctgtctcaaaaaaaaaaaaaaaaaaaaatgtggaggagaggattgaaaggggctgctgagtgctgaacaagattaatggggaataatattgtgatatttcagaacccaagaataagggaatgattctgggagctttcataggggaaaaaatacaaagtaaagtgaaaataagaacaaatccattttcaaagaatccaccagacttcccatatcagacttcccatctgcaacattagaagccaaaagcctgtggaggtatactttcaaagttttaaatccagaattctatacccagccaagctattaatcaagtgtgaaggctgactgaagacatgtcagacatgcaagaattcagaaaatgcgtccacgttaaaggagttattcaacactgtactgcagcaaaaaggaggaatacatcaaaagagaaaacatggcatctaggatacagcgtgtccaggctagcagggcataacgttaggtctgagctgtggagccagtcctggttggcacaagaggacggaagactgtggctgcccccagtaaatgaggagaagtgacgagcaggtggaacaattgtgaggtggaaaacgtgaggtgatagccaatgcaactggtagcaaatagaacgagaaaacacccaacttcactttaagaacatccttcattgatacaaaggtttgtgatcttggatcagagataatgaactgcaatcctggcacagttcttggctgtgcagttaataatattatgtagatgtttattgtttttaaattttagaatcaaaatttacttatagttacagaacagaggtcctcgactttagtcactcattcttttatcatccaaataaaatgtctccagtccctccatcagcggctgtgcatgggaaaccaccctcccaccccaaccaagctccttgcccagtgcctctgaagaccccagggggagtatcctgccgctatagcctgttgctctggtgtggcccacttatccattgatccattggtatttggcttggacactggccaccacccatctttcattccctccaaagcagcactagcagagattgtcactggtgacacattttccttgagattctgatgtcttggaggcatagggtaggaaacaatctctaattgaataacgatttccccgttcttagaaatgtaatgccagcttctgccgcaggaattcttcaccgctgtaaccctccataggccccagactcccgccacggtgcaggggtttctcaccttctcctctgcatccctgggtctggatgattctgaaccctgactgcatattagaatcaatcaactgaggaaccacaagtaccttcaaggcccaggcctcacgtccaccctaggttctaatttgcccagtctggggagaggctggaaatgatccccaggtgattttaatatgtagccaggagtgacacctactgacctgccctctccagttgccaggaagaaagcctcaaattcctgttattttactatgtggagtaatttcaccctttttgtttcccctctctttcaagaccatgaaatccctcaaactgtagccagattgtaaaagaacatttttccctttttccgccagctatacacacatatgcaggcctttaaaaactggatcataccacatatattgttctacattttgcttttatcgcttgactttctttcctgcctgtaagactgacctacttcattgttcagagaccacataatattccattattaagcatataccgtaatttgcttagccattttcctactgatgtcatttgggtttttcctcatattttgctgttactaattatgcaatagctgcatgaagatccatgtgggtgtgtatccttccaagcttgtgcagatgtttccagagtggaatcaccaggtcaaggatacgtacatttaacatttttgcaggtattgcaaaaacactcttcatttaaatgatggatcgctatactcccccaccaatggtttgttaaagcatctcttcccctggactgttactaacaccaaacattatcagtctttttactattttactatatttttattcttcaagttaaaaaaattgacatttttacaatttttgctaggcaaaaaaggtgtattatttcagtttgcatttctccagttactaatgaagtcgaacacctttttgtccttttgttagtactttgtatttcttctgtgaattgtctaataaatttttaatgattagtttggaagatgtaatgtaatcccccattatttctctctctacctcttcttcctcctctgccccattataacaggtatgtaatattttaagtcaattcttgattattcaaaagaatggagggggttgggcacagtggctcacacctgtaatcctagcactttgggaggctgaggcagatggatcacctgaggaccagcctgaccaacatggagaaaccccgtctctactaaaaatacaaaaaaatagcaaggcgtggtggcatgcacctgtaatcccagctactcaggaggctgaggcaggagaatcgcttgaacctgggaggtggaggtggcagtgagccgagatcacaccattgcactccagcctgggtgacaagagcaagactctgtctcaaaaaaaaaaaaaaaaaaaaaagaatggagggaaacagaatgcataattcaaaatcacaattcaaatcataattcaaaatcacaatgtgatttatagtagaattttaagtgtgttttcagaaatagcacacatctgagattcacatctttgttctacctttaaatagctgggtgaccagggattttcctttcctcgcagagcgcaggttttcataagcatagaatgggaacgataacttactttgcctgacggtgataattagataatatgtgtaaaccacctggtgtggagcctggcacatagttaagcactcactcaatacatggttgttattgttatcatgttataacatttgaatactggagttgctctaaactaggaatcctcattgtaagtttcttgccctcatatccttactctcacctcagttactcttgaaaacaggctgcctcagcttacatccccttctctctgcctctctgattgagtacagttttgtccacttcaaggttaagggtttgaatttcaagtctgcaaacccagtacatagaagagatgaaggtagccccaaactgcaattgagcactgaacatgctgtgcgttaacagtgggtgctggagacgtgagcaagcccaatactagagatgctgtctcaatttcctcccaggttaattgtcagataaagcctgtcattaatccacaaccaagaagtgaccatggtacctgttgaaatactttctgctacaagtaacagatcccaaaggcactaaaaaaaggaggaaagtttactaacttggatcacaaaaagtctggcggtagggcaggtccaaagtgggctcatcgagcagctcaacagcatccccagaacccagatcttcacatctgtcaagtgtgcctgcagcttgctgcctgtcggcattgctgccctcaggttgcagagaggctgctgcagaaaccagcatctagagacagagacaaggtatttcttcttatgtgactcttttattttattatatgttatttttgagacaaggtctcactctgtcacccaggctggagtacagtgatgcaatcatagctcactgcagcctcaaacaccagactcaagcgatcctcccacctcagcctcctgagtagctgagaccataggcacgtgccaccacctccggctagttttttctttttttgtagaaacagggtctcactgtgatgcccaggctgttcttgaactcctgggatcaagtgatccttttgcctcagcctcccaaagtgctgggattacaggcataagccaccgtgcccccacctcacgtgtctcttttaaagagtgaagaaacatggccaggtacgatggctcacgcctgtaatcccaacactttgggaggctgaggcaggtggatcaaaaggtcaagagatcaagaccatcctggccaacatggtgaaaccccatctctactaaaaatacaaaacttagccaggcgtggtgacccgcgcctgtagtcccagctattcgggaggctgaggcagtagaatcgcttgaaccagggaggcataggttgcagtgagctgagatcgcgccactgcactccaccctggcaacagagcaagacacagtctcaaaaacacaataaataaataaaaaataaagagtgaagaaactttttttttacaagactcctaagagatttctcctatcataggattggcccaaactgaatcagcacatgctccaagctggaaaaaagttagtggcaagacagtgaaattactattagcgatttagactactctggggtcagaagtcatttgtaacacaaggctgcccaacatctgaacaaaaactgttagcaaggaagggaggaggttgcacagatgatcctgtcaccaccacatgtttttttaaggatttataatgttatttttaagatccaattttaaattaatatgcaaattcttcaattaattgtataaaaatatcagttttgaagtttatgatctggaaattcaatactagaaagggagggcagaccagatgcattggctcacacctataatccctcaccattttgggaggctgagatgggaagattacctgaactcaagacttagggaccagcctcagcaacacagtgagacccccatctctacaaaatattttttaaaattagctgggcatggtggcatgcacctgtagtcctagctatgcaggagcctgaggcaggaggatcgcttgagcccaggagttcaaggccgcagtgagctacagtcacaccactccactccagcctgggcagcagggtgagattctgtctcaaaaaaaaaaaaaaaagaaagaaagaaagaagaggaggagcagtaatatttcctgtcatttttaaagctagggatattacttatgattaaataacctagatttaaaaagaataaacttggaagaatgagcattcatatttaattcctaagtacttgatgtggagtgagttttgtgtggtgctctccaagatcttaggagggacagctcctggacaggtgagagccacatggggaagagtggtggagcccagatggcactcccagggttgtgtctgtggcagaggcctgccatccaggccatcctgtgagcttcctaccaaacactcataatataaagatgggggtggggcacatggggcagtgtaattccgaagaggaatttcattctaagacatcctttaaagatgcccaggtccctgtaactgggagagccaagctaagcacatgcttcctgctcacttctccatccttgccctccaggggtggctcgtgctgaggaggataaatttcaaatgtagtgggtaccccatccacaacggaggtgggggtaaagtgggaaaaacacctagtgccaaggcccgacctggggagagtgggagtgaattcttattactgagcttgggcaagtcacctgccttccccatccctggttcctcatctataaaatgggaagagcagtagatcaaagttgttgtgaggaccaggagtgctaataatctcttcacttgagtgagcaaaggagaaaatgggccagggcaggataactctcaccaaattgctttggggaaagtgctgctctgctggctcatgaaaacaaagcagaagcttccctggaagtttcaggcccacctgtcccctctcctctccacaggcctcgcacccacagaaaaggggtctctatattgggagccagccgagatgagcttgtcccagtttcctttgcttcctgtctaagaaagatcaaagcaaacccacccctgtcatctaagctgaatctccccaagttactgtcagcctcagggtcactaactgactttgcagtacagcctggctctgtcttttcctggctgtgtaactttgggtgagtgcttccacctctctcagccttgcttctcggtcatctgcaaaataaatacagtagcatagaattgctatagtacaattaccctgattggtttattgcaggattcggacttagcagttattttgttaatttaatttgcataatacatacatttttatattattttattttaaactggacagcattaattggatagtatacatttttaatataataaagctctatttatttagaaaataattcaatccctcactcttctaactggccacatgccctgttaaattgtgaggtttctgttatactgatagccagtggggtacacagttaggtgctatccctcccctctccacccactgcccctgcctgctgcagtcagggcaggtggctaatgtggctaacaagtgacaagcaatgcttcaacatttcccagtcacttgccccaggatccagcatcctgagaatcacttctggattgctgggaggtaaggagagttggagcatgtgtcacctgctcgaacctcactgaacttgcccctgtctttttcggcaggctgtaaagcggttcttgaaacaagagtgcaagtgccacggggtgagcggctcatgtactctcaggacatgctggctggccatggccgacttcaggaaaacgggcgattatctctggaggaagtacaatggggccatccaggtggtcatgaaccaggatggcacaggtttcactgtggctaacgagaggtttaagaagccaacgaaaaatgacctcgtgtattttgagaattctccagactactgtatcagggaccgagaggcaggtaagttcaaaagactttctttatagtacctaattctttcaacaattgatactccacaatttaaatgaggttctgtattttcagcctgctctctttaggttcaaagctcacgatccttatcattcttattgaaactgtacagggctgggcgcggtggctcatgcctgtaatcccagcactttgggaggccgaaatgggcagattgcttgagctcaggagttcaagaaaagcctgggcaactccatctctaccaaaaatgcaaaaaattagctgggcatggtggtgcgcatctgtggtccagctactcaggaggctgaggtgcactccagcctgggtgacagagtgaactccatctcaaaaaaagaataaagaaaagaaaagaaactgcacagagagctctcctaagcaactggagaaatggattgacagtgcacagattctggagaaattgaaaccccacaatgtccagggcaaaaagtcaagatacgcagattagcaaaattcttcagcctgggcagatttctagttagtggactatgcacactagggagagcagcccagcatctttcatgtgatcctgaagctgagagcaggatacattaaatcccaccactgtgactatggaaaatggtcccagggctttaaatttagactcttctgaaatctgccctacttcaccttccctgctcttttcaatatgcttagaaattgccaaagataaaaagcaagaatgtatccccactctcttggctataggtgggcagtgtataataaaggctgtgtcagaggcccttcatttattaaagccacaccattcccttccagatggtaccttctccatccctcaaagaacagctctgtcagcctcaacaccgcagctgtcccacctatcaggtttacacatgttcatgctctacctctcactcctcttgatcaaccctgagctccaggtttagctcattctttgtaaagattctagtgcaaaataagaatgagtacaagtctaaattcataggaggtgatgggagtccacagcccaagtcaatttctaagacttggtagaaagcaaaggaattcattatcagaaaaaaaaatcctcttagagtctgatttttttttatttcaaaataattgcagaggcaccaataaaatggtatggatggcagccagctgtcagttagattgaccaagaggcaaagttaccagggaatgtcacaaggaagccaaagcctttttttgcccctgagtggttgaattgccttcatggtttgatgagctagttctccgcagcatttgagcaggttgctacatgcagcccagggattaatgacaacggagcagaggaccagatgctgtgccccgctgcattcctgacatgctttgggacctctaacaagtcatcctacctgtcaggccaaagttatagccaaatcaccatgaaacctgtgcttggatacaggattgtcccaggggtctgacccccctctaccagtcactagctgtttaacctcagcctcctcacactgagcatggagatgctgctgtcttgatcatttaagtcctatgcattgactcctgtgcactgggtactgggctgagatcattgcacacatggtcttattttatccttacagtaggatccttacagcagccctatgacagcaatacattgaaacttgttactaaccagaaaaaattgaataagaggtggctcctagatgatcaacaccaaccaagaaccacgttcacatcttactttttaagtcagataagcaaccctagatatcaccttctccattgtacagataagaaaagtgaatgacctgctcacgatctcaccggtaggagagggtggatgtctgatcccttggcctgtgctttgacccattagacagttgctcctgcctgcctccaaggacacatatgtgaaaaggccttggggagcaaaaaccttatttcaaatataagaggaccctcttccccagcatgtcttttctggttctttggattgaagcagtttgcacagggaagcaggctggtgtacctgaggaatatgtactgccttaggtataacaggtatgacatttattgtcaatgaaatatagaccatatttttttttaccccacagaggtgattctgaatctaatccctgctgcctcttcaagttactaagttattcttgcgtactccgctttttcaactctttgtattagaaagaaattctctttcttaatcctaaaatagcagatatatctgtagtacccatcacatgccagagctgcagctacattctctcattgactctcacagaaagtctataaggtgagtatgttattatcccattttatgggaggacactgaagctctaagaggttaaagattttccctacccacttgtggttagtaagaggcagatcagggacttaaacctgagcctggctgtctcgtctcatctcatcttgtctcgtctcatctcatctcgtctcgtctcgtctctcttctcttctcttttctttttttgagacagagtctcgctctgttggccaggctggagtgcagtggcacaattttggctcactgcaacctccgcctcctgggctcaagcaattctcctgcctcagcctcccaagtagctgtgattacaggcatgtgtcaccacgactgggtaatttttgtatttttagtagagacggggtttcaccatgttggccaggctggtctcaaactcctgacctcaagtgatccacctgcctcagcctcccaaagtgctgggattacaggcgtgagccactgcacctggctgtggctgtcttttcaacaacgattttactctgcctctcgctgcacacagccgcaggtgctggctttctgaagaaagctatataacttactttctctcttatctgtcttctgtcttagacaaattttagcttatctgactttaaaaaatttgaaattggttctcagttggtgttgattaaccaagatctaccctattcttttttttttttttttttagttgccagttccaatatattggatcagatttccagtaagattcctagattatttataaattatttgaactgtacttagttaatgtcctttttggctgagcctaagaaaatgccaaagtggttggtgcaaaccttgcaatatttctttttaattctgttgaccatcagatgattattttagtaaaaatatgatttaggatatttgatattatgcaagcacaagtccagatagttaaaatttttttattgtatatatttggagtcatatgcaattagccacatgtatgagatgtatgagatgcaagttttatctgagaaaacctgcttccatccatatggctgctgagggccttgctcttggttatgtgaccaatggccttttaaggatgaggcttggccaggcacagtggctcatgcctataatcccagcaccttgggagactgaggcgggaggatcacttgaggccaggagttcaaactcagcctgggtaacatagtgagagaccccatctctaaaaaataaaaaataaataaagttgaggttttatcctggccactttctactagaaatttctgtagcatgtgctctagcaagtcagtcatcctggagagaacagagtcatcctggagtgtcctctaacctctggttagtagaggcagggggtgtaacagagaatctgagacctgtaagaaggggccttaaagctgcctttcactcagtgggatctgggagcctctctcttctcaaaatgaaggtgttgggtcagtgtatcatcttctcagtctgcactggagagctaccagcatgcacacattattgagtaagcacaccaccgaggcccccaaccccaccgtgctaaaatcctattgcattaggaaaggcctattttctggtgaacggaactctcacgtgttcaaaatgggctatcatcctgggatagccaggctccaaaacaagtcaaaagtttgcagtcaaatttaaatcaagtaattaatatagaatttcttgtttttcattttctcttttaaaatcagcattaacccttcctgacattgcatctcatactgctcactctacttcgttgtggttattttgtttggttttgcttctttctttgctttccatcattgcttttgtttttaaatcgtgcacacttaatattcaacttagtgggcgccttctacttgccagcactggggaagcgatggtggtgagcaggttgaacattattagggaatcagtatttggaactgactggctttactcttgctggtcagcaactgcttcctgtccaaggtagcttgttgactgatgtgagctggcttgttttatcaattaggtttgtgcaactgatgcagtctacaggtctggtctacttttttccaaaggaagtggctcttcagaaacctattgaaccagcatcttagggagctgttcccgaaattatataagtttctctgtttttcatcattttaattttttttttattgctctgttgcccagactgcagtagcaccatcgtggcttaccgcaggctccgactcctgagctcaagtgatcctctcacctgagcttcccaagtggctgagtccactggcactgcctctgcaaacttttcaaacttaaacacctcaaagtttgaaaaatcagtgatttaggcagtgtatgattcctaattttccctaattattaggcaagaagaaattcagggagacatgagtttcatatatatatgttttttcagtacctgatttcttgctaaggaaaactagataactctaaataaacatctcccaaaaaacatctcccaccatgtcttgcccagtataagagagtcattctttcactcctaggccagcatcctcaggaaccctctttgactgcaaataaacaaaattatttcagccatcaaagcttttactgacagcagttaccaagtcagcctctagagaagtcctgaagtaacgctactaggctagtgaactttgatgcgaaaaattgcagagtcgagaccccaggttattcctggatggggacagacctagctggagaaggatgcgagaacatttgttgatttcctgctgcgagtcaggccctgcgctacacaccttatgtacatatgctctgactcttcaaggcaattacctccatttatagagaaggaaagtgaggttccgcaaagttacttaacttgcccaagatggcatggcctgtgagaataaaaaaaataaaaacaaaaacccatacctttctcactgtgccacttacgtcccagtgtgtgtgtgtgtgtgtgtgtgtgagtgtggttgggagtaggtcctgtgtgatgaagaggcagcatgaggacatgggaactttatggggtgaggtgcccacaaagaggggaggtcaaaagtaatcagaatcaagcttcacccacattttggttaggttgccttgaagcccttttcaattacaagcccctcagattttcaaaagcgtcaatgcctttgattgctcctaagaaatagaaagctggccaggggcagtggctcatgcctgtaatcccagcactctgggaggccgaggagggcggctcacctgagtttgggagttcgagaccagcctgaccaacatgaacaaaccccatctctactaaaaatacaaaattagccaggcgtggtggtgcatgcctgtaatcccagctactcgggaggctgagtcaggagaattgcttgaacctgggaggtggaggttgtggtgagccgagatcacaccattgcactccagcctgggcagcaagagtgaaactctgtctcaaaaaaaaagagaaaagaaatagtaagcttaaaaaccaattaaggaagatattattatggcaagaacaacagcaaaagacattttcctctagtcttcaactgaagaaagtgagtgctctgaggttcaactataattactcgccccatgcagctcagatctgaagagtacgtacaaccgtgtgatgttgtgcatgtgacattttgcaggccaaattggaggctagatcttggaagctggactgtctgggatgagtatcctggtggctctatagttatctactctggttactgctccaggcatctgtaaatcaaagaagcccttaaggtacagataggttcatctctaactgaggaatgctgctgctctcccctccagagaatgcgtctgcacctaatcacaggccactttcactagttatgatgtaaaaaccctgacctgggccagaggtcaccctgaggtctcctctccaactgcaggaaacaagccacactccacctcttctccagtcaagttcaaaaaacaaacggagctcagtcattgtttaatttgttgcctgcgaaaaacccaaaagcctggttgacaactccaggctgtgaatggtgtaagcaccgaggtatcacatttttcccccacataaatcatatttggcaaacagaactcagaacccatgggtacacaatcccaatcatggttttcagagactggtgttctctcatgcccagtggtgtggcctactttgcagaagctcatgaatgccgggattgtgtcccaccagctgattaaaaacaagggaacatgtttttaatgattaaacatgattaaaaatatgtcagccaatagcaatgggtggatcttacttagatactaatatgtgaagttctaacctgtacaccttaagtccctcatttcttcattgcacaaatattgattgagatcctcctatgtgccagacactcttataatcactgggaacgcaggattgaggaaaacagactcagtccttatcctcgtggtgtcatcgacttcatggtccttgaagcagtagccaggcactgggacacagtctaggtgctggagaaccctcacactggggcaggaaagtggtggtgtttaggtttcagtccttgttgcattgctctgttataaggtcttatcttatatatgtcattttgacaaggtaaagaataagttattcatctccttctgctttgacacttatagaaattcatggattgatatctaaaaggtgctaagatagctagaccagaagagaattgtagaaaaaaatgtttcactgaggcttataagtcaccattttcatgggtagttattgattatactctagaattagtagtaattactatccattgagccttcttttcaaactctttagtggcatatagtataattagcctttccctccttcccaaaacagtcttatttccttgactttataactacactcctctgcttttcctcctgctccaataactagtcctttctgatttcagttgctagtttctccttctccaaattttgaagatcttccaggctgtctgaactctctttgctctctctctgtactttctccctggtttggtctctccattcctatggttttaaatgctgtccctgtccttgtctgccttctgtaccatcatcctgtatccaattccctgcttgacagcttcacccagatttcatacaattatatcaacctgcttctgcttaaaactggactccttatttgccctgtcccctgaaacttgttttcccccagccctcctcatctcagaaaatggtactgcctgccacccacttccatggtcaagcataaacctgcgagtcattccttacactccttccttgtcacctccatcatcccgggtaccactgggacctcttaaatgtgtcaaggacctatctgcttctccatccttactaccaacccctaggtccaaacagagctatgttcttttgagcatagcatgtgccacagtgtgtatagcgaatttgtataaacatgtgtttgtgacctgcctgtaccaatggagtccactgaggatcctgtgacggcaggaactgtatctgccttgctcactagttccccaactcctagtacacaaacatgtgttgaagtgaattgaatggcaaattataaaaaaacataaaacagtttcattagattagctgcattcttctgtgtgttagcgctgcttcatagcttaaagataacttggttcctttgaaggggattactaggcacatctccacccagcactgcttagcttttaactcacagcctatgaaaattcccatttaagcttaagtgttcaatggaatttttcctcatattcaggcgcattcatgaggcatttatggagtttcagatgttgcttgcctggctattcccctggagataaaaagtctcaagtgggccgggcgcagtggctcacgcctgtaatactagcactttgggaggccgaggcaggaggatcatgaggtcaggagatcaagaccatcctggctaacacggggaaaccccgtctctactaaaaatacaaaaaaattagccgggcgttgtggtgggcgcctgtagtcccagctactcaggaggctgacaggagaatagcgtgaacctgggaggcagagcttgcagtgagccgagattgtgccactgaactccagcctgagcaacagagcaagactctgtctcaaaaaaaaaaaaaaaaaaaaaaaaaagtctaacgtgaactaatgcatcagcagactatatctatcgcttttaactggcagcagagactcagttcttttactcttggaggggcatttttcactcactactatcagtggcctccctgagtagttcctaattctcatattaacagcaaaaatacttttcacatccaatgctctttgatgttgtaggcagaatctataaatctgtgttatttttaaaatacaaacttagtagaattactatatttttaggatacactaaaatgtgccttaatttgaattgacagtggtaatcagattgaattgtgaatactgaaaaaaggattttttttctaaaaaaaaagatacttttcaggaaaaaaatgtttattttcttatttctaattctttgacatagtttgaactactgacaaatactttaccaaatagatgcccttttatctttgtattttggaaatagaaactactcatttcgaattaccaattaaatgtgttgcaaacaaaaggatgacgttaaaatactttaaaataacaaatttgcttacttcatttaagctttccccatgacacctattttgtactggtaaatatcttttttaaagatatgcaaatttcatattattagggaaagagccctgtgtgatctataaggagactttggtgctacagattgctgcatatcactatttctccaattggactaatgggcaaattaacttctctgggtctcttaagaaatggctgtttcatctagcaatttctaaggttcctttgattcagtaagtgaatgaattaattattaagtttaattaagtttgcaataacagaaccttaaattgataccacaaactttcttaagttgtcatttttaatttctatcatttaaaaatgtgccacgtttttggtatgtgttttccatataccaagcaagatcattttaacagagccaaggtttagctggtctgctgccaccatggtgcctgaagactgggtgaccagtccctggagaaatgtgccctcatcaggcaaaaggaaagctgatcttaatttttttttttcttttccctgagacggagtcttgctctgtcacctaggctggagtacaatggcccaatctcagctcactgcaacctctgccttctgggttcaaacgattctcctgcctcagcctcccgagtagctgggattacaggtgtccaccaccatggccagctaatttttgtatttttagtagagatggggtttcaccatgttggccaggctggtcttgaactcctgacctcaagtgatctgcccaccttgacctcccaaagtgctgatattacaagcatgagccaccacacccagccttgatctaaatttttaagacactatttttaatgtaatatttaataaatcagcacatatgtgttgaccacacagtatatagaagaaagcataagaagaaagcataagacccaacccctgtccctggggagacaagatgcatgaaaaaatgatcaaatatttccaaacagtgcatgaaccctgtggcgtgatgtgcattacaggcctaatgaaggaggttagctgggcttgcagaccgaaagtgctgtatagaaaatgctgaagtaggcctgaatctggaaggatgggaagacttctgatggaaggagttacaggaaaggccaatgcagcagatgagagtaactttttgtttttgtttttgttttgagacagtctcgctctgtcgcccaggctggagtagagtggcacgaccttggctcactgcaacctccacctcctgggttcaagcgattctcctgcctcagcctcctgagtagctgggactacaggcacgccaccatgcccagctaatttttgtatttttaatagggacagggtctcaccatgttggccaagatggtctcgatctcatgaacttgtgatccgcctgccttggcctcccaaagtgctgggattacaggtgtgagccaccgtgcccggccgagagtaactcttatgaggaaacagtctacatgactgtgacatcagaaagtcacctcagtgggacagtgaagagataccctggttagcaggtataggtggactacagtgggaaatagctttgagtaggctatgtagtgccagatatggaaagcctcacagagtctgaccagaacaactttaattccattacaagatttgctaatttaatgggacatgctttcctgtgccagtcaaacttttccaacttacgaaaacactgaataaaatcatctgagataagtgaagatattgtctttcctatgtagcttaagctgtgcagtccaaatgtgaggaaggggtgagcctgaccagtggatgaatgtgcggtctctaacatttgctctttaacatactttagttccctcaataaatctgtgtcattaatgacaacatgtaagacaaccagaggagaaacagcctattggatgacaggcttaagtgaatcttggtttatgccctaatagtcaacatatgggcctctgtcatcctagagtggcaggaatttccagacacaggtctatccagagagaggggatggggggagaaggaggtgaggaggagagggagagatagagacagagagagaatagggagagaagggcggggagagagagagaaagagagattgagagaggagggaccccttcctccgggtcccagaggtatgggtctgggaactattagcaaaaacccctctgttcctcctctgctgtcagcaagatgcatgttagtggagacagaaatgtttttacactgggaaccctgactccattattaattttatagctctagaaatgggatgctcaattccatcaagttccctcggcattgctccaccaaaagtgttacatggtcccaaacttatgtgatttagaaactccaattctttgtccttttttttaatcttatgcatttgtgagctcttgtgcgagtcaggatgacaacacatatgggcaagcaaaaggtccatctggctggaagcagctccttcccacagcacagacattgccaaaccttaacgactttgcctggatcttatagacactgggtttaggacgatgatctcacaattgtttggtataaagatgacaagaagtttcgagtctgcaaccttctgtgtctgggagttgggctctggactcaggcaggccacacatcctgggaatacttcacaaatataaagcaaaaggaagtcagggaaaatgaatttccaacttgtcactttcctcttaggtgaactatgtaaatcaaactgcaataagaaataacattataaaccaacatgaatgattttgtagaacaaacatgttaaatgtgaagcatccaaatatatgtttatccttttaaagtatcaatttgggagactctaatgataggaccggtaattgaaactatttttaaaatgtctcttctggagtatttttaagagccagctacacttgttttgtagatacagtgtagtacaaatatttgtcctataaagatcaagatggctgttggaaatggctcagagaatcttcaaatgaagtatgaagagttaggtagatgatcagactgagtaattatattcttgatgagatacaaattgatgctattggcttctctgaaccagaaggttctgcctagagagggctcaatgtcctcagcattggccacatcagtgacatattaaaaccaccttgagggcacacataatttggagacatgcatcctggcattacaaacaaattattctcatttctcttaaaggttacaggcatccagtaggaatatcagtataggaaaaatgcagcatgagcaactgacaccatgttaacccagtctttttttcagtttcttacataactttatgtgttgtaattgtctacagcatatcatgagctgaagaaaaaggccctctccccaaaaagttacatgtcaggatctttgcacgttactcatttgataaaagaattagaagagagtacgggaaagacgctgctgcactggtcacataatgttataaagcaggctgctttctggtgcctggccgggcaccaggactgggcactcggcaaagggtcagaatgtcacgactgtcaagagcttgagctctacagtcaggcaagcctgcttgcaaatcttgtccttgccaccagctgcctgtgtgatcttgggcaagttacttaatcttcctgaatctccatttcctcatttccaaaatggtgataataatagtaccttccttataagcttatgagaattaaattagacaatgcaggcaaaatgcttagcatggggcctagctcacataagtgctccataaatattggctccagttgtgaacagaaagaaaagaaagagagtgaaaagaagatagagggaaaggaagaaagaagaagaaggaatgggaaaaaaaagtgagaaaggatgaatgaactttcactccattcagcttggaaaatgtgaaaactcacccttatgggattaaggctgatagatgtagctgggtttgtctccccagtggttcctgttgtggcccaagcaagggtgagtgactcagttaacaagtttgtatattatttgagaaaaaacatctaaaagtatgtgtcccaaagatttagaactaaacaaataggcagttggtaaaagtcagtggctccttttcattaaaacacacacacatacacacatactcttggttcttatattttattggaaacataatggtgatgctttctgttttggaaagaccaatggaacagtatggccctactgctattgataataatgagtctttattgtaattcattaaggggaaagtaatgccagcgattttgtatagattctgcactctggaaatgttcttttcagggtttctatgaaatggctgtatgttctgctaaaatgacagcaagtgtcaaaactgcccttctgccctacagcctgtcattagatctaattagatccaaacccccaaacagggccaatttgtcatccatcactaggcagcctcatcctcccttccagctgcagggactgccctttcccgcccagttggcccattccttggtgccccgatgcctcatgggggcccgtcacagctccaggctgcgacctcactgctgttctctcatcagtggctctcaatcctcaaaaaccctctctcattttccatcttctgggccctcattatgccgtttgggcagccggtggagagtggcatgttcagattgtgttttccagcattttataactgaacattgaactactgagacatattgccagaggctttgttccctttactgaaaccacttctgagttaagcttttgtcaatggtcatagctttgtctgctcctctctctgagttctgatggtgttgaggtcactacactgagcaatccttctgttcagacagtctggttcagttttctgcatctgggggacaaaagacaccatgaccattacagaaggctgagtcagaccacaagctcaaaccttcttaggctggaagccactcaggaaagaaagactaccaagttagatttcagtgaaaggccaacagtctgagtcaggaacgagacacttcacctccttatcctggcccccttaagcccaaagccctacggcagataaagaattctaatgcatggtacggtattcccattttgataaatacagatcagtagaagggaagaatgtttactgctgctcagcgcatgtgaacaataacaaaaaagtaaaaattaagagtcacttctgggataccaagtgagagcacttttcacacccactgggggtctcattcacacccgtggcttcagttaccaccactgcacaaaagatttctaaacctgagtcttcatgcccacctctctcctgagtcccagagagtattttcagcaaacatttctacctgaatgccccacagtcacagcaaactcaacctgttgaaaactgaattcattatcttttctctaagctgacccctaaccaagtgtcccccatgtcagggaattaacagcaccaacagtcactcaggccagaacctgagaaaccttgacttttctcatcctcccccagtctccactcagtcaccatgtcccacaggtcctgcctcctcaccttctcttgactctagtaaccgctccagttcccactaccactgtcttaatccaggccactcatgtcctgcccagagtctgtattggtctctaacttgtcttcttgtcctcactccagccccctccacttcattccagccccacacccttggagatccttctgaaacacaaatgagaacatgttgcccttttgtgtgaaggcccttaatagcattctgttgccctcaaggtcaagttgaaaccccttgaccattcccagtgcagcttcccctcaccactccagcctcatctcctgacactctcccctttgagtactgtataccagccacagggaacactttcctgctcctcacacgttgcagagctttgctcatttcctggccttggcacatgccaccattgctttctccttctcttcctcctcctcttcctttttcttctttctcctcctccccctcctccttcctctcctcctctttctcctcttcctcttctcttcctcctccttgtcttcctcctcctcttcctctttcccttcttcctcttccccttctttctcctccctccccttctcctcttcctctaccaccttcttcttgttattgaaatatgaaatgcagaagagtgcccacattccatgtgtacagcacaatgaattttcacaaatggacacacccacatgacctgtgcccagataaaaaacctgaaggggcccagtattccagaggcatgtctcatgctctttttctctattccccaaggaaaatcacctccttttaatagcaatgactagtttttcccatttttgtactttaggtacatgaaaacctaatctgaaatgaaaaccttgtgcagatatctactgctgcaaaacataccactggaaaatgtaatggcctaaaataatcttaaagtcccacccttgcttttatcaccactcttggccctactctctttcatcctcttcatcaccaagcctcttgaaaactttacctacactcactgtccccatgtcctctcctccaccacattcatctatgtcatccactgaaactgctctcatcgagggcgccagttacctccttggtgtgcagccaaattaacttttttttagtcttttcctacttgacactccctctactccttaattcaatgagtcatcaagttctagtggttcaccctcttcagccaatcatgtatttgttctgcttgtttcttcacgcaatatctcttgtctgaagtattccaacagccctcctccctgccctaagctgctcttccagacttaccttcgcgacctagttttcagaattaaaggtctagacaggtccaccacccaccttgtaataaaaatcaaactgtggcatggcataaagaccctttaggccaggcgtgtgagtcacgcctgtaatcccagcactttggtgggggtcaaagcaggaggatcgcttgagcccaggagtttgagaccagcctgggcaacatggcaagaccctgtctccacagaagatacaaaaattagctggatggggtggtgtgtgcctgtagtcccagccacttgagaggctgagatgggagaattccttgagcccaggaggtcgaggctctagtgagccatgttcgtgccactgccctcaagcctgggtgacagagtgagaccctgtctcaaacaacaataacaacaacaacaacagaccctttaacctgttgctccagcctccctttctatgctcattgtccctaatagcctccctgaatcagcagtctgttgtgaacttgccctcagaatttctgccagaaggttctatcttgcccaggttgctgtttaccccattctttacctgcaaatcttctagtcatcctttacacctatctctaatgctacctcctctgtaaaactgtgcagttgatggatctatttgctactattaataccaagaaatatcactattataatatgcttggctcatgcccttagaacataagctcctgagggcaggatcttcattttttttctctgatatatcccatgttcccagaactgtgcctagcacatagtagtcactcaataaacacttgctagatgaagatatggatagttaacatttattgagcacttattttatgccaggcactttcatgcactatctcattatgttctcaccaaaagctctatgatgaaagaactatttttattccagttttgcacaggaggaaactgaagcttaacaagtttaagtaacttgcccaaggccacacagttgatacatggcaaatctgggatttgaacgctgattgtccaagctctaaataacctcatttgactgtctttgagctctgtttgctgtggtgctttgcacatgactgtactgtgggttacagtaggtccttagcaaatcaaacaacccaaagtagtggaagtatctctttacatatttaactctgcgccatatagagggttcactgagaataggaacttggtcctatttattttattctcccttgtgccccaagccccaagcagctggcacagtgtcttacatatgtttatgttcactaaatgtttactgaatgaaataatgggtgtgctgtgaagaggcagcatttggcagtgagtcctttctgcataatcagtaaattttgaggactgtcctgatggctgcctggaatccaagctgagctgctgcctcttctaaccccatgcttcttcagcacgatgcaggctcggagccatccctggctgacccaccctccaccctgaccccggccttttgccatccttcctgtcctcatgaagttccccggccagtcttcctgctctccgccgccaatcattctgaccaaacgctgccccaccctctcctcttcttgaccccgtgccctgcttgaaccttgctgcttccctggtcatcccgaacaggcagggcaacatgacatttctgtagataattccaacacagagcggactgtgataaacagagagacagtcacgaggcatcgtcagagatatcaaaaggaagacattcctagttaaatgatggagaaactgaaaatgaattaagtcactgtctttttcatcctgatataagtcgttttgttttgttttttaaataagagtttagcttctctaggtttatcaattaggtgggattgttgatagcaagcaatagaaactgggacagtttaagccacaaggggaagcttcttataaggatacagagtctctaggaactcaaacgttcgaatgcagtcaggcctcagggagaaatggaagcagaaccagaaaatagtccaggatctgggcagcatttctttccatgtcttgtcttcactgtcactgtatatttgcttcatttctgtttttctgtggacctcctcgagtccacagacctcaccatggtgtacagctgccaacagcaactaagtggcaatagtgatcatctgtgtcaaaatcacaaatcaacagagaatttacctgattggcccagcacaagtcagttgattgcccctggtccaatcattgttcaccagtgagcagggtgatgttatacaacatggctgccaggtgcccatctctgtgggggaggaagtagaaaggatcatggtaagcccagcatactctcccaaaatgtctacaatgctttgttctgttgtctgataatgtgcttataaaagaattctgagtgcgtccccaagaatagagtaaatgaataaaaggctttctagctttaaaattatttttcagaaacaaatacttaaatatggattgccatttagcaaacatcaccctgattaactaagacaatattccattggtaattcctggcagattttctatgccaattttgtttattgaaggccttgaatcctggcttcgcctgggacctcacacacatctatatgtcctgctagactgcagcaggagagacagttaatatgataaacctggtggggcctttctccttcctcagggtctcacacaaatgatgcccatgtctcctcttcagaaccagagttctattccctttctcataagccagtgtaatcaggtctatggagataaaattccctccctttgagggctccatgccctgacaaatttgaagagagctaaccttggtcactgcttccttaatgtggtttgaggtagggagaaggagccaggatggatccttcttttattctgatctggctctgctcgatcaaggatccttaaattcaaggctgggtaaggataatctgaaaagtcgatccaactcagaagtgggagagctggattcagggtgtccaaggaaatccaaagtttcatgttcacctttttgggactcggccctctcagcaccactgcactctctgcagctggcataatgggatttgcacacatggcatgggcccacagaacgagtataacagccccaggctgtaggaagagagggtcagggctctgtcctggaggatggacctcgtgactcctcctctggaggcatattggattccacccagaccttttcagtaacactccctggcttgtcttccaggctccctgggtacagcaggccgtgtgtgcaacctgacttcccggggcatggacagctgtgaagtcatgtgctgtgggagaggctacgacacctcccatgtcacccggatgaccaagtgtgggtgtaagttccactggtgctgcgccgtgcgctgtcaggactgcctggaagctctggatgtgcacacatgcaaggcccccaagaacgctgactggacaaccgctacatgaccccagcaggcgtcaccatccaccttcccttctacaaggactccattggatctgcaagaacactggacctttgggttctttctggggggatatttcctaaggcatgtggcctttatctcaacggaagccccctcttcctccctgggggccccaggatgggggggccacacgctgcacctaaagcctaccctattctatccatctcctggtgttctgcagtcatctcccctcctggcgagttctctttggaaatagcatgacaggctgttcagccgggagggtggtgggcccagaccactgtctccacccaccttgacgtttcttctttctagagcagttggccaagcagaaaaaaaagtgtctcaaaggagctttctcaatgtcttcccacaaatggtcccaattaagaaattccatacttctctcagatgggaacagtaaagaaagcagaatcaactgcccctgacttaactttaacttttgaaaagaccaagacttttgtctgatcaagtggttttacagctaccacccttaggggtaattggtaattacctggagaagaatggctttcaatacccttttaagtttaaaatgtgtatttttcaaggcatttattgccatattaaaatctgatgtaacaaggtggggacgtgtgtcctttggtactatggtgtgttgtatctttgtaagagcaaaagcctcagaaagggattgctttgcattactgtccccttgatataaaaaatctttagggaatgagagttccttctcacttagaatccgaagggaattaaaaagaagatgaatggtctggcaatattctgtaactattgggtgaatatggtggaaaataatttagtggatggaatatcagaagtatatctgtacagatcaagaaaaaaagggagaataaaattcctatctcat

SEQ ID NO: 36786 - DNA, 25505 bp, Homo sapiens
gagctgcgggcctccgacggcgggaggacagcgctgcgaggaggcgcccgggacagtcatggagcgccgcctgggagtgagggcctgggtgaaggagaaccggggctccttccagcccccggtctgcaacaagctcatgtgagtccagcacccccatggccgccccctgccctcgcctcctccccctcctccatctgcgccctcaccttccagctccgagttcctggacccagaagcttgcagaaggaccgctttaatctcttggttcttgggggaagatggagacaggctgttccggttccaccacatcggtctgttcctctttcttgtgactgtggccttgacttctgaagaaggctgagctggttctcaggctgtaggagatgacatgacagggtgcacctctccttccagggctgagaaacaattctccaaccccaagtgacactgtgcattttgggaaaactcaaaagtgtggggagggtggttttcaaggcagaaatgcactagaatgtaggcctgggggcagccaaatcatacaccccaaccctgtcccagaagccacaggcaaagggggaggcagagaatccgctcctttgggaagatcttgatgtcttgcttttttcagggcccctctatgcaggtgtgcacgaacacacacacacacacaccacaccagaccctccctaggccacctctgccagtagcctctgcctgcagcacccaacagggttggccatccagctgccatctttctcaggcagacctctcaggccctcccctgtggtatggtcacctccctcatccccccagttccatggcggggccccacatgccagctagatcaaggtttacattccccatttttgctgtgtccacaggacatggtcagtagggtggcacctcaaggcaaacagcaggcccaggactatgccaagtgtttttacatcatctcatctcattctcacagtagcaccgtgaggggggattttcataagtaacttttctagtgtcacggagcgcctgtgcgataggctccagactcaacccacggagcagttcgactccagagtccacgcacactcttggttaccatgcaataccacatggccaacagtcaatatctccccaaagatctcttctatcactgttgttgcccacccccaattaaagatgtagcatcatctttgcctccttccaacacttcatccccatctgcagtcgctccttctcagtcctcccttcgctccccctgaggtctcgcgtccatctgcccgggcctctccctagcatttggtggtttgctggcatcattggtattcttgcttctgctgtaccacgcccacctccaccttcgtcttcacaaggcagtctccttgtgtgtgtgtctgtgtccaaatttccctcttttaaaagaacaccagacatattggatcaggggctcaccctactccaggatgacctcatcctaacctaactacatctcaaggaccctattccaaataaggtcacattctgcagtactgggcgttaggacttcaacatataaattttacaggaggggttactattcagcaaggtgagaagctgctgaagcaagcaaggtgagaagctgctgaagagttctgggcagaggaggggcaggtctggtttatgcattctgactgatgggttgaaagaattcttgagtggagttgtttaagaattgtctgtatgtacctaaattacatctcagtgaagttgattttaaaaaacaactttcaagccgggcgcagtggctcatgcctgtaatcccagcactttgggaggctgaggtgggtggatcatttggggtcaggagttcaagaccagactggccaacatggtgaaaccccgtctctgctaaaaatacaaaaattacctgggcgtggtggcacgcgcctgtagtcccagctactcaggaggccgaggcaggagaattgcttgaacccgggaggtggaggctgcactgagccgaagttgtgccactgcattccagcctgggtggcaagcaagactctatctgaaaaaaaaaaaaaaaaaacaaactttccaggttccccagcaccccttaggccaagaccagactccatggctggtccaccctcctggaccagccttctcaatcgttccccaagctcacccccagtgcttctaatctcagagcctctgcacccagctctcctgtgcacactcttccccagtcaagttccttgcggcttccctcccctccttgaagctctatgcagctttaagttctttaagcatggactgttcatgacagccttctcctgccctgcaacctcatccacctttccaaacatcaggtccacacgtgtgtttccggtttattgggcccagcctcccaaaagggaaggaaaaggaaagagactggctcttccgtcttgcctccatgcctcccagctgggctggaaagcagcccacaggacaggacactcagaaaggacctgccagtctagtttgggggctcagacctcccccatagcccctcccctgccatccacaccatcgtcatccatgcaggcagcctctaggctgctgtgccctgtgtgtacaaatggtcccagacccagcgcctccccttcccagaggaaagcccttgcccctgccctctgtggcagggccacctgagaacaccctgaagccctacacagacacattctgctgcttattcaccccagtgtctgcaccctgaaaggggaccctgctgtggggatggggcaggctgttctcaggaggtgctgaggtattttttgcataaaaaggtaacaccacaccaacagcagaaagactgaggagtttgggaacccttttgttccaaacagctgactagatgccccacagacccaacgccagcgtgggagtcaaggagcctgagacctggctcaggttcagtcattccctggctttgtgaccctctcttggctggctaaatcggctgtaaaatgagagggttgtattgagtttatttatttatttatttatttaagacagagtctccccctgttacccaggctggagtgcagtagcgcaatctcagctcactgcaacctcacctctcaggttcaagcgattctcgtgcttcagcctcccaggtagctgggattacaggtgcccaccaccaggcctggctaatttttgtatttttagtagagacagggtttcaccatgttggccaggctagtggcctcaagcaatacatccgcctctgcctctcaaagtgctgggattacaggcatgagccaccacgcccggccgggtttatttattttatcaaatacttaaatagtgcttactatatgctaggcaccattctgagagcttccaaatattaattcatgtattctgtttaaactctgtgaggtaagaactgttcctctattttacagataaggttagtaacatgccccagggcctgtgcttataaacacatgccacactgacttgacaccgcctgaggcccctgctagatgtcacggtctcctgcatccactgagccatgcctccagccaggggagagtgcagggtcctatagtcagacagcatgggtgagtggcaggtcaaggtcgttttgcccctacactgccccatcctgggaaggggtcttcaatttgctactctcctgtaattcgagatcttgatcctgtgatcctggttgatgaagccatagattcaccaccacatcatttcccttgttgggtcagacgatgtggggggacacacaaacaatgacagacagacacacagacacgatcccagacacatagacacttagatgcacgcaggcatgaaccggggatgagagttggggaacagggacagtgaggccaaaacagccctgctcctctcccaggggccctcaggctccctcctggcccccacgggacccgtgctctcttcactcctaggagatggtttagaacgtctcccccactttgcgcattgcaggcaccaggagcagctcaaagtcatgttcatcggaggccccaacaccaggaaggactatcacatcgaagagggtgaagaggtaggtttgactggtctccctggatctaggcctgcgggcaaggagcctggccctagcgggagggggcgcttcccactcgaggcccagagatgatggactggagaggggtggacatgtggctgatgagtggagggggcacagctgaaatcacagggcacgactgctgcctccaagctggtggtcaggcagtgacgcctccacagctagcacctctgctgggggagccccaggaaacaacccatgccctgcgggtgagaggttttagccatggggcatcctccccctggatataggggctggccatgtgaagggggacgtcctggtcccctccccacaaacttgacagattcaattggtctccaaaatgagatcctcccccgcagacgggggcaaagtgcaaaaacaccgtgggtgagggctgggctgagtgggtggcagagggagttcgaggggctgagggaggaggagctagtggctgaggggtaggcatggtagggaggtgcctggagctgaaggaggagttggggcagggtggcccttccttaactagaggctgcaaaacccattcgtggcttgtggctggggcaggtgggagggggaatttgccttgaatcaccttttgcaccttgaagtttggactgtgcttctctactacctaccccaaaataaataaacaaaagcaaaatttaaagagaaaggtgtgtccccttaaggagagacacagaatctcctctggtggaaaaggatcagtagaggggctccccatcctctcagggagcctcattctgggggttcaggatccagagtccagcttgatcaacagcctctgtccccactgagggcatccaggccacagccagggactgtggtgagcatgggagaatcacttgttcaataaatatttgctgagcacctcatgtgtgcactgggacacccaaggctgtgtggaggaacgatgggccctgggccagcagaaccagccaactcctcacctctcacgctccaggggccctgcacctcccctggccacccccttctcacaaacacacctcactggagaccgtttccttggtggaaaaagtcaataggaaaatctaaaactatactgaggaggtgggtagacctggcatggctatggcatgggaggcacagctggctgcggagtcttccagaggcttctgccttctctgttggccctggtctcagcacccgcctctcctgtctccctctgtctttgcttcccttctcgccccctgctgcctctgctccatgccccatcccatggtttctccaagctcaggtgcctgagtgtcccctgaggggcctggccagcagctcacgtcctgactcagatggcagctgagggattgagtgataaggagagctggccagcacaggtgtcctcactctggagggacgcccaggtgtctgggaggaatctggctggaggtgggcttgtgacagggcttggtcccaccctgctgaggttttggtggcggggtggtgcagcacttgggcagcctcagggctgagggtcggcctcctctctgtccctgcctatcctcacccagctggagcctggggagactccaggatgcgctgtggaagtggcgtaactcagggtccgggctcctcctgaatagtgagaaaaggggagttgctcagacctgggttcaaatcacacctcttaccaaaccacactttcctcctcactgagctctgcctctgcaatagcggtcagggtacctccagctccctggcccggctccccactccccagcgccacctaccacctatactccacctacctcactcctttcttggagcgtgcaggtgcaggggggccagaggcagatgaacttgcattgggggaattctctgccgcttactaaccccgggatcttggacagggcacatcatgtcacctctccaagcctgtttccataagcacatggggacaacagcccctgtctggtggaagaattcaatgtgcatagagtatgtgcacacagcctggtgcagagttggtgcttgatatgcattgttcctctacacctctcgccctttctgcctggactgcctgaaaggcctttccaggtcagaaagccagattctattcattatctgcctgagccagtacagttaatcttctagccagccccaggctcccaaacatcatttacttccaaactgagcataattcctttaggattgcccacagctgttcaggattttctgctgttcagtgatctgtacctctgccccaggccaggcctgcccctcatcacagggaagacctctgagcaggggacaagagcgagaaaatagagacaatatcgtatagcctgcccagtaaggcagtaagggtttaaatctggcccagagggtcactccggactcccctctcccaacttttcctttgtccctcctcccttccctcactgtgaaaggtccctagacacacacacacacacacacacacacacacacacacacacacacacacacacacacacacagaggcttcctcccagcttggagagtgggggaggagagcatactgaaatgctccctataagagaacctggtaggtttcttattatttgtattaaataatgcttatggggtttttgtttgttcatgtttgtgtttgtttttgttttttagagatgggggtctcactctgtcacccaggctggagtacagtggtgcaatcatagctcagtgcagcctcaacttctggggctcaagtgatcctcccacctcaggctcccagatagttaggactacaggcacacatcaccatactcagctaatttcttctagtttttgtagagatggggtctcaccatgttgcccagaatggtctccactcctggcctcaagtgatcctcccatctcccaaagtgctaggattacaggcataagcctccacatccggcctatgggtttttttttaataaggaaagtaaacattgttccttgtagaaaatatgagaaatatagaaagaaaaatccttacctcattcataatcccaccacgcagagggccgctgtgaacaggctgcctctgttatatttgtattgctacaaactaaagccctgctgggtatagttttgaatctttaacgtaactttagcattttccattttcccattttattaacagctattcaaaaacgtagtttttaatggctgcataatgttccatattttgaatctaccatcaaatatttacatttctcctataattatattagcattacttttgtcattcttaccatcatcaatactaatagctagaggcttactgagggcttactatgcgctgagcacatatgtgtaaagcatccctggcatcttcacagctacattttgagtagataactgtcattatgtagatgaggaaactgaggtacagaaaggctaactgaattgaccaagggcacacagcaccctggcagagctgagggcttttaactatgcactgcattgaaaacagccttgaatgtacaccactaggcaggtatgtctctgatgaactgaggtctcattcctgaggtagaattactgaggtcaaggttgtgtggtgaccagctatctggattcacctagaactttcccagttttagcactaagggtcctgcatcccaataaaccccacagtccctccaggggtgtgaactgccaaggcacttcacgcccatggccaagttgcccttcagaagggtggtgactatttgtgcctagtggcagactgcagagccacatctctctaggtccctcgaggtcagcttggtttctcttagtagatgctgttgataacattccttcaagtatttggctggggcttttaacacccaggcaatgtgtgactggtggagagaaaaccggtctgcctcctcctcttcctcccagttccatggggtgatctcagtaaattagggacttaggatggaatcggaaaaatgcagtaggaacccccccccccgccccccccacctccccccacccccaggagagcacaagaggcatatgctcccatcccccacagcccctaacccatcccaggctgccagcaacctccacagccccaccccttgccaaggtgtcactctggccagtggctccagagccacatacggccttggatccaagctgcggctccagctggagactaaccagctatgtgaccttaggccagctgttttaccctctgagccttgtttttctttctttgttttctgctgattggggttaatgatacctttggaggttgctgtgaaggtttctggtggaaaagtgcctggcacagcccctggcacccagtaaatgggtgggttccctacctgactgctgggtcattcagttccccagtgagcatttcatccagttcctgcccgccagccaggcaaccactgttgcatcctgggtactctggtcatcacttgcatgtccaagacatgatcccatgtgtccccggcactccatggcatgcaccggggagacaggcctcaggacagaagtgacggagctgcccatcaactccaaggccttcagaaagtttctcaggtttcccggtcagaattcagggcctgggcagtggccaaggacctggaagagaaagtgcggagggtccaagcctctctcctgtcccacaggtattttaccagctggagggagacatggttctccgagtcctggagcaagggaaacaccgggatgtggtcattcggcagggagaggtgaggccggatcccagcagggtggggaagagaaaggcggccacagctggaatccgccctgtccactcatcctggccctggctgaggtcttgtcctccctaccttttcctgctctcccacaccttcccctgccaacctgccccttccccatccttcctcttccaggctgccccatcctcagcacggtccaacattccctctggttccctggtgtagaggctgggcagagaagagggcccagggtagacaagcagtacccctttgctgcccgggggtcagctggggatgcccaggatgttgggggcgctaaggtctccatgagggattgcagcctcactgtgcaccttatctctaccactgcagatattcctcctgcctgccagggtgccccactcaccacagaggtttgccaacaccgtggggctggtggttgagcgaaggcggctggagaccgagctagatgggctcaggtaaattctgtctggagggctggggcagagaaagggcaaacagcagaggagcacagctccaaactgcagctgaagggatcctagatagactcaagaaagcacgtcctggccactgagtgggcaggagggcctcacagcagaggcagtggagatcctgtctttgttggctgatggtggaggggtagagtggggtggattctgttctctgtgaccccctggaagctcactcagcctgatgaactttggctggaatcagaatctgtgctttctgcgtgaggttgtgaaccttgaaaattcgagacaggtctcagttaatttaaaagtttgttttgccaaggttgaggacgtgtgcccgtgacacagcctcaggaggtcctgatgacatgtgcccaaagtcgtaagagcacagctcggctttatacattttagggagacatgagacaccgatcaatatatgtaagataaacattggttctgtctggaaaggtgagacaactccaagcaaaggtgggaagactcaaagtgggaagggggcttccaggtcacaggtagataagagacaaatggttacattcttttgagtttctgattagcctctccaaaggaggcaatcagatatgcatttatgccagtgagcagaggggtaactttgcatcgaatggggggcaggcttgccctaagcagttcctaccttgatttttccctttagcctagtgattttgggggcccaagatattttcctttcacatttcccccttttcttttttaaaatcttttggagaaagcattttagaagaaattgagtctctggtcccaggttttgtctgatgtctcatggctaggatggtttattcctagacgggtagatcccaagttattagggaagttcagttttagaaagctgtgaagtctcatgtctcacaaagagaaaatagggggaggaagggagaaaaacaacaaccaacagaagagcaatcctggaaaatcgatatagaccacattactctgaagttcacacatcagtaggcaagtatgaaagtggcttaggtacgtaaattggttgctgacattttcttctgaagtttaagttgtcaggcttcagttttcagggctttaagaaagcacagctcagctttcagtgactccaagttaggaaaaacaaacaaaaaaagaagtaaaaaaattgaaaacattattttgaagacttgtagtcaagaaaaattagaattcagtccaaatcacagaaaaataataaaaattgaaaaacattaggcaagactagaatctaacatcaggtatactatagttttcaaaacataatttttctctctccagtttcccctttttactaaagacaaatcatggtaagactgatttgctttattatacttggcctaattatttgtatacagtgcagcaagaataatttttttttttttgagacaaagtttcactcttgttgcccaggctggagtgcaatggcacgatctcggctcactgcaacctccgccccctgggttcaagtgattctcctgccttaacttcttgagtagttgggattacaggcacccgccaccacacccggctaattttttgaatttttagtagaaattgggtttcaccatgttggccaggctagtctcgaactcctgacctcaggtgacccatctgcctcggccttccaaagtgctaggattacaggcatgagccaccacacctggccaagaataattattttttacataggcttttaaattggctttgatggaactttgttccatagaaggaatctcagataagacctttttttaaagccaagcctagccatggatatgtgctattgaatacctatgagttgggtgatcttcttgaggttccaaggtaaacttgaggcctttgggcgtgtcagagacagggtctttacttaccaaaggtcagaaaccctatacagggaagatatgaggccagtttccctaaagggtttttattggctccataaaccaataaaggaaagcacaccattccagtcaaatccttgataaaataaccagtttctccaattgtgtcctgttgcaaaatgaaaacagattcttattgcacttatgcatataactgtattgccataagttaagaatactcacaaatagcttccaaattctggagaaatcaggtagagagaaaaaaatatgctccaaattttgttcatgggagtatactaaattgttgtgtttttttttgagacagagtcttgctctgtcgcccaggctggagtgcagtggcatgatctcggctcactgcaagctccgcctcccaggttcacaccattctcctgcctcagcctcctgagtagctgggactacaggcgcctgccaccacgcccagcaaattttttttttttttttgtatttttagtagagacagggtttcaccatgttagccaggatggtctcgctctcctgacctcgtaatccacccgccttggcctcccaaagtgctgggattataggcatgagccaccacgcccggccgggagtattaaattgttaaaagctgtcaatagcacacacaaaaaagtttccttgactctgaaaaaaaacaaaataaaacaaaggatcagcaacatttaaagcaaaagtaaaaaagattactttagtcttctatgagttcagtttacttagtttactcctgttctgcttgatactcatgaacatttcagctctccatgagagtcctgaaagtttttcttctctattctaatgtcacaatctccaaagttatcagaaacctgcacttaagaacacctgtgttcgccgggcgcggtggctcacgcctgtaatcccagcactttgggaagccgaggcgggtggatcacgaggtcaagagatcgagaccattctggccaacatgttgaaaccccatctctactaaaagtacaaaaattagctgggcatggtggcatgtgcctgtactctgagctactcaggaggctgaggcaggagaatcacttgaacctgggaggcggaggttgcagtgagccgagattgcaccgctgcactccagcctggcaacagagcgagactccatcttaaaaaaaaaaaaaaattaaaaaaaaagaacacctgtgttctagagctgattataaagccacctcctaaagagaaccaaaacaggacaattttctgtgaatgacaaaaagttttaaggcagccatagtcaaagacgcagttggcaaggaaatttgttacctctgtggcacacaataatttaatataattatgattattactgatgatgtacactaagttttatcaggattataggagtttcccataattttggaatacataccaataatatatttatacaaatacagcctaaagaaaaccaaacaccatttcatatttggcaatgcttcctgtataatttttataccaagtaagccaaactatgtcattttgggactttagggaacccaatatcttaacagattaattaggtcagaaaaagacataatttatcatttgattttggaaagtttgtcaaatatcaaaggtttaaaactcttgatatcacaatataggatcattcatttaaccaaagtaataactcaaggatttcaaaaaaggtgaaaaccttcattctttgagaagagacttaatgttccaaacaataagctctaataaaaatagcatgaagctgggcgcggtggctcacgcctgaaatcccagcactttggaaggccgaggtggggggatcacgaggtcaagagttcaagaccagcctgaccaacatggtgaaaccccgcctctaccaaaaatacaaaaattagctgggtgtggtggtgtgcacctgtaatcccagctactcaggaggctgaggcaggagaactgcttgaacccgggaggcggaggttgcaatgagccaagatcgcaccactgcactccagactcggcaacagtgagactctgtctcaaaaaaaaaaatagcatgaacccaattaactatagttttcaaaattatatcttgaccataagatataatttccataaacctttcataacctatatttaggagtcagttaatgcttcaataaaacctttttaatctgacacaggggcccatatgctggtcttgcatcagtgtacctttgacattaatgactaatttatagagaaactgaacttatttatttatttatttgagatggaattttgctcttgttgcgcaggctggagtgcaatggtgtgatctcagctcactgcaatctccacctcccgggtccaggtgattctcctgcctcagcctcccaagtagctgggattacagacatgtgccaccatgcctggctaattttgtatttctagtagagacaaggtttcaccatgttagtcaagctggtctcgaactcctgaccttacatgatccacccaccccagcctcccaaagtgctggaattagaggcgtgagccaccaccacacccagcgagaaactgaacttattttatctctcaaaattggtccttacagtctcccatgcccatctcttacatgatagtccctgggccttgaggagctttaatttctgtccctgtgtttcaggaatgcagtttattttgattggcatcttctactgggcctgaagatggggctttaattgctgtcagtgtttaaagtttagcaggacttggtcaggcacagtgactcacgcctgtaattccagcactttgggaggccgagacaggcaaatcatgaggtcagagtttcagaccagcctggccaacatggtgaaacctcatctctactaaaaatacaaaaaattagctgggcatggtgacaggcacctgtaatcccagctactcaggaggctgaggcagaagaattgtttgaacctgggaggtggagggttgcagtgagccaagatcatgccactgtgctccagcccaggcaacagtgcaagactccatgtcaaaaaaaaaaattagcaggacctggtgtcctttttagacccaggagtcaaagccctgtaacttaatgtcacaaggacattaaaagcacatacagagagatacacagatgtaataaccttaacttttgaaaaaatttaatctcagtttttttcctaagcaaccgaaaacttaataataatgtgataacttgatcatataaaagtttttgggttttttttttaaataaatcctcttattgtgacttacacagaccattcatgctatgcttagactttctggtttgtcctgaacatccctccttcttcaacaaccagtcattttactctacaactaaatttaccatacaagagtctttctcatatgaaattatgtctctttaagctttcttaccacaaaaaacctctttgtttttatgactttctttacatgtcttttatttcctgcttccttttaccttgttttatacatgacctttaaataagccttaaattagataaaatggttcactttttttaaaaggacacacctttttttttagaaagaatgttttcctacaaatatatttttattggaaagtacccaaataatgaaatatctattatttaatttaactttagattctaaattatgacaagtttgtctacaagtatttatcctattgcatttacataattattttaatcatttacttagattatttctaaaaattgtgattgtcattatttaaagttatggaaccaccattgcaaaattataactgagacagtgaaaatgatttgacctaactgattccatcttgcttctaacctccaagctctccttgttcataggctgaactaactttgagaggcacttagtttagttaattagagcccctttttatattttcagcagtgaaacattgtgtacacaacacatagatagacgtcttaggcatgctaatagaagtgcatcttatagattcatagcaacttttttttcctatcttagactttcacattctttttcttcttttctttcttcttttttttttttttttttttgcgataagagtcttgctctgtcacctgagctggagtgcagtggcacaatcttggctcactgcgacttctgcctctcaggttcaagcgatcctcctgcctcagcctcccaagtagctgggattgcaggcgcccacaaccacacccagctaattttttgtatttttagtagagacaggatttcaccatgttggccaggctggtctcaaacccctgatctcaggtgatcaacccacctcggcctcccaaagtgctgggattacaggtgtgagccaccatgcccggtcagactttcagattcttgataacctgttttacaaccacaggcagttgtcagctaaatagccttaaagttgcatattaaaggaaacaactcgccggacacggtggctcaggcctgtaatcccagcactttgggaggctgaggtaggcggatcatgaggtcaggagttcaatagccacctggccaagatagtgaaaccccgtctctactaaaaatacaaaaaaattagctgggcgtggtggcaggcgcctgcaatcccagctattcaggaggctgaggcagagaattgcttgaacccaagaggcggaagttgcagtgagccaagatcacgccactgcactccagcctgagtgacagagtgagactccatctcaaaaaaaaaaaaaaaaaggaaacaactcaggtgaaaaatcaaataacaaaatttccatcataaggtacagagagaagtcggatggtgctagagggagattaaagatggatgctggctgggcatggtggctcatgcctataatcccagcactttgggaggcagaggcaggcggatcatctgaggtcaggagtttgagaccagcgtgaccaacgtggagaaaccccatctctactaaaaatgcaaaattagccaggtgtggtggcacatacctgtaatctcagctactagggaagctgagcaggagaatctcttgaacccaggaggcagaggttgcagtgagtcgagatcataccattgcattccagcctgggcaacaagagtgaaactctgtctcaaaaaaaaaaaaaaaaaaaaaaaaagatggatgccaagtcaaacataaaattacagaaatctatcacaggattgtataaggataccaattttatttagatagggaccacctatcttttaactagatctctgagctctgggcaaagtccacaccgaatcctgggtctccaaaaagggagaattattatgagcttagaccacgtgatgcttttacagtgcactttaaaaaaagttttttttaaacaaagacatttctaagtatctaaaccacactcttccacatttgatcttagccaaaggcccagaagcgataaaaccacactcttccttaaaaactcaagagtaagagtaacctcagttacaataactattttagtaaaaaaaaaaaaaaaaaaaggataacacaatataaaagtaagcagtttaacagctgagaccatttatctttttacattcttggggttccacaaggaaaaacagatttctcccccaaaaggagtctagtgccttcttcattttctttaagaaaccccaggctactataaactattttaggtccctcatgcagcagagggtgcaggagaaaggagagacagcagaagtaaatgaagaaaacagaattcagtcaactgagaagaaaaaaacttttgctcaaaaaaaaaagacaaggtcctaggagaaaaacaaaaacaaaaacatgaaagttaaatacacacacacacacacaccccttggatgttagcttttaattaagctgacttttaaccattgagctcctttaaaaaaatctttttaaatctcattaccgtatttcagctggaaaaaaatgctgctgtttcagaagtacagccattgctctttcagttttgcctggctagcaaaagtggccttgtttatgtaaatcaagccccttagcagtcaaaatacaaaatctttcatctttcttttctccttttactggccttttttctccccccaccagacaacctttttttttttttttttttttttccatgacagtcttactctgtcacccaggctgaagtgtagtggtgcaatctcggctcactgcaacctctgcctcctgggttcaagcaattctcctgcctcagcctcctgaatagctggaattacaggtgcgcgccactgcgcccagctaatttttgtatttttagtagagacggggtttcaccacgttggtcaggctagtctggaactcctgacttcatgatctgcccacctcggcctcccaaagtgctgggattacaggtgtgagccactgtgcccggcccttttcgtgtgtgtgtgtgttggtggggagggacgggaaatttagccactctagaggccttgtttcccataatttggaacttctttaggattttatcaagtcaggtagagctgatcaaacccaatgggaaaaagaatgaaacaacaacaaaacagaaacaaacagcaacaacaacaacaaacagtgaagcaaaacaaacaatcgcgcagcttctatgatcactgagcgctctaatgggaaggagaaattaagagcacctgattgttaactttagccaaaacaaacccccagttcagctacttacctagggatgggtctcaggctcaagacaactctctaccatcctagaagcaggaaaaaaacctccttttccctattggatgcaagctcaaattccataaaggagttacctgccttccattgtcatggaagcaggaaaacttgccttccttgttggaaacaagtaaaactccaaaaaaaagggagttgtacagcaaaataaactttagatctcaaccaaatttggggagatcagggattctctagagggggtgctcccacacctcagcaaattgtcctattggtttgagccataaagttagctcacgcgggtaccaagcacccttaggagatttgtctaaggtcaggggcacctccactcagaatgcctctgtggttatcaaaatgtcaactccaaaaatttgagacaggtctcagttaatttagcaagtttattttgccaaggttgaggatgcacgctcgtgacacagcctcaggaggtcctgttgacgtgtgcccaagagagtcagagcacagcttggttttatacattttagggggacaagagacatcaattaacatatgtaagatgaacattggttcagtctggaaaggcaggacaactcaaagcaaaagcaggatgactcaaagcagggagggggcttctaggtcataggtagaaaagagacaaatggttgcattcttttgagtttccgattagtctctccagaggaggcaatcagatatgcatttatctcagtgagcagaggggcactttgaatacaatggggggcaggtagccgggcgcagtggcacacgcttgtaatcccagcacttcgggaggccgaggcgggtggatcacgaggtcaggagatcgagagagaccatcctggctaacatggtgaaaccccatttctactaaaaatacaaaaaattagtcgggcgtggtggcgggcgcctgtattcccagctacttgggaggctggggcaggagaatggcatgaacccaggagacagagcttgcagtgagccaagatcgcgccagtgcgctccagcctgggtgacagagtgagactccgtctcaaaaaaaaaaaaaaaaaaaaatagggggtaggtttgccctaagcagttctcagcttgacatttcccttaatttagtgatttcggggcccaagatattttcctttcacaaggtcttctgggaggggtgagatgtggaaagcgggccagaggggttccaaagtcacacccacctcccccagtgcagccagaactgctgcttccccccagaatttagaatcacggccagtgcctccctcggcttgtttctctaccccagctcattccacaacacacactgacatctggatggcacttgctatgtgccagatgcctggctaaggtctttgcatgtatttattcattgaatcttcccagcgatcctatgggggaggtgctgttatcattacaaagaagttaaagttgctaaagtgttacttgctagatctggcattatagagaaatatggagttagggccaggacagtatagagaggagtgggagtcaacaccaaagaggggaagaaaataggccccgctgtcagcattctgattccatggccggggttctcatttggttctgatcagtcacccaattcttttcctctgaaaggaggaagcaacctattgctcagggaaatagattttccaaaagctcaacagtgtttggttgggtttttttttttttttttttttgatatgggggctcactctatctatcacccacgctggaatgcagtggcgtgatcattatttgttgtattttttaactaaaaaaaattcaagtttcccatcaggtcaccaggaacaggatactttggcctacatcttttgttataataggcatttttaaaatacgtgttgtttttctgattatcaaagtcatacacattcattctcaaaatctggaaaagtacaggaatgcaaagtgaacaaaattaaaattacttgttactaaaaggataaatttgatggtatgtgaattatatctcaagaaaacaaaataataaaaaagggaaaacaaaaaaaattgtcctgtcaccaatgaaacctaatgaaacctaaacttccatcttgtcttatttctatgcttacctatatctttttttacttaaaagaaactcatgagtattctttttttttttttttgagatggagtcttgctctgtcacccaggctggagtgcagtggtacaatctcggctcactgcaacctctgcctcccgggttcaagcaatcctcctgcctcagcctcctgagtagctgggattacagacatgcaccaccatgtctggctaatttttgtatttttagtagagacgaggtttcaccatgttggccaggctggtctcgaactgccaacctcaggtgatccacccacctcggcctcccaaagtgctgggattacagttgtgagccaccacattcggccgagtatttcttacactattaaatcttttcaaaaaacacaatggctgcataatcatttactgtgtaacagtctgttgtagagacagacacgtggtcttatcttctagaaaaaatttgtcacaagggactttaatatagtgagtctgatggagaggatggtgtcctcaatatcattttacagcaaattcaataacacatttcatctggctgcttttgacctttaataaaagccagggactcaacattaaaatgccactccaaaggcagttcccggagggcactgccatccagttatgaagctttctggtggccagctccatcccaggataggatttaggctgccaagtgggtggatgcactgtgtgtctgtaaagcatctcccaccagcgggaccacatctcttttaagagcagacagagctggcctgggcccaggagctgggcttgggcattaggcattcagttaacaggcgttcctggcacccaccatgtgcagcacccacaggggcctggggcccatcccagcctgccaggtgctcctcaggccgggggaggagctcactgagccaggctgggggctggggtgggctttaggggtctactgaaggctatatgtacatgtacatgggccttaccccagaaaagaggtccaaaactttgctccaactctcaaaggcaatcatgaccctgaaagaagaagaacccctaaactgggggacatcttctgcgtgttggcttctttttttttttttttttacttatttatttacttttgagacagagtcttgttctgtcacccaggctggaatgcggcggtgcaatcttggctcactgcaacctccgcttcccggttcaagcaattctcctgcctcggcctcccaagtagctgggattacagtcccctgccagcatgcctggctattttttttctatcttttgttatgcctggctattttttgtatttatttattattattattatttttagtagagacagggtttcaccatgttggccaggctggtcttgaactcctgacctcaagtaatctacccgtctcagcctcccaaagtgctgggattacaggcgtgagccactgcgcccggccatgttggtttcttaagtgtccgtgcactcaggcctagagcactgcaggccagcagagcgtccagccactggccctggtttcaggctcagcctcagcttcctctttgcgaaaaacaaaagaactgcgattagatgctctctaagtttttaagattgtcttgagactggcctgcttccgccacttacaggctgtgtaatccttggcaaattgctcagcttctgtgagtctcagagttctatctgctttgtctagttttgggaaccagtttgggtctagttttgggaaccggagagagccgtgtgaattctcgggatagtagccctctcagggggcgcacgtgtgcttctgaagagcaaggtgttaagtgaccagtgaccactagggtgtgtaacaggggtgagcagacagcagggctctgcagggacttctacaagcagagccaggcctgagtggggctgccctgaagccacccagatggggacagcagggttgcctgtcctctgctctggcaggtactatgtgggcgacaccatggacgttctgtttgagaagtggttctactgcaaggacctcggcacgcagttggcccccatcatccaggagtgagcccccagcccagcccctgcctcttgctttcctggggctctgcatcagcacctgatgccctgggagaaagtctcccctcccagggtggagatcctggcccagagagcccactgccaggccggggggaggggggagcagcagccccgctgggagggaaaggatggcagacacacagctgtgtgagagccccatgagtgtgtgtgggcacctgcacctgaccgtgagtgtggtgtatgtgtgtgtcgctggccactccgatgggagtgctcgccactcctgctcctccctgttcgtccttgcaggttcttcagctctgagcagtacagaacaggaaagcccatccctggtgaggccgctgggaactgcccttctccttccctccctccccttccaaaataggatgggttttggtccaggggaccggggagtctctttttgaatactctgcccagtcctcaaggtactaagaagatggcagccaatggtacctcccacatggctgcttgatcattgagctggatacagagcctgttctggcaattgagacctggggcccctgggaactgggcccactggggctgggtgggctgggtcctgaggacaccgactatagtcatgctgtgggtgcagaccagctgctcaaggagccaccattccctctgagcacacgatccatcatggagcccatgtccctggatgcctggctggacagccaccacagggagctgcaggcaggcacaccactcagcctgtttggggacacctatgagacccaggtaatgtagtcctggggcatccggggcatcctcccacagcagccctggaaaatgggaaccagtctctctctcactgcctctctctctctctctttcacacacacactcacacacacacacacacacacacacacacacacacatttcagaggttgtagacatgagcataggcctttgtgctccctccctgacgcagaaggcgatggctctgctccgagtgaagtctgtggaggctacatggtcccaagcaattttatgatctgaattcactttcagagttggaggttcccccactcactggcagcttcctgagggtctgcagttttcccctcgctaggaattcctgaaccttcagccagtcacacccttggaagccaaaagggagagagttgtttgggagtgagggttgggtggagagagggattcaaacaaggctgactttctttcattccacatttattaaatgcctgttatgtttcaggctttagtgggagagtaggatagagttgctaccttaaagaatgtatagtttgttaaagagatggacaagttaatcaacaattgccacaatcatgtgataaagtatcagatagaaaagctataggaagctatagaaggataaaggaggaacccactctgaaagggaagtcaaggaaggcttcctggaggaggtgacatgcacattgcattttaaagctagtgtaggagtttgtaaaagaaagaaagggaggtggagagagcattctaggtgagggagaagcatgagcatgagctgtttcaggcttgaaacagcctggcactgggagcagccgaagttggccagaggcggggcttgggggtgggggtacaagtgtgactggtggactgtggagcagcaggcagggcccaggtcctggtaggtctgctgggctaggcaaggtgggaggacttgtcctaaagacaacagccctccaccaaagtattgaagcaggggagtgacaggccagagtggtgtttctgtaccacgtgtgggaacaaggctgggagggcaagagtggtgcagggagacctgtgttcacttgtgctttacggcttgccactggcacatcccatgggctttgaatgagtcaatctgtgcagggatgctcatggccacaggcttcccgtagaggcctggcctgctgctcttgggtaccagggacgtcctgagcttacacagggctgcgagaacatgcgcacatgtcacagcagtaccactcagccctgcaccccacctctgcaataccctgctcttacctgcttcagtttacattaatgaatatgcaccctctccagggcatcagcagcacggccctgcacagtagctgtgtgcttccaggctggtgcatgtcagagagccctcagcctcaccttccttgtcccctcctcctcctgaggccagactcataacctctctcagagaaagggaggtggcaccctctgggaagctgatggaaatgcgtccctcatgtgccctggtgagcatgccttcgcatgagcacacatcagagggaccacgggtgcactgcacgtgaaaggcaggcatgtgtgatcccaaatacctgttgcagcggcgggcacagggaggcctgcagcccaggcagccctcctctccaagtcctggtctctgctcagcacatggtgatggggctgtttcatgggccccaaccctgctccaagcaggcctggtgtctgggggccaggttcaagaccatctcccatgtggggcaagaagcaccagaagtttctgtttcacctcccaccaggtgatcgcctatgggcaaggcagcagcgaaggcctgagacagaatgtggacgtgtggctgtggcagctggcaagtggggcccagggacagggttgcagaaccccctgccagagggcatcagcccgctcctcggccctgggctcccacacggggcccactcttggggccttggggcccaggcagactcagacattcacccaggtgatgaggcccaacagtctccatttgattctcctgctcctcttctccaggagggctcctcggtggtgacaatggggggacggcgcctgagcctggcccctgatgacagcctcctggtgctagctgggacctcgtgagtacgcagggagggctttccctgggatcctcagggtccaactctgtgtgatccctgctcatctgtgtgtccacaggtatgcctgggagcgaacacaaggctctgtggccctgtctgtgacccaggaccctgcctgcaagaagcccctggggtgaccctcttgccatggcctgaagcagccacaggtgtgccaagcaccctcgagtgccatccctgccaaacaactctcccagcccccactacctctctgtgtactgccgctgtgtcccccacagacctgcacattgttgtcacccaccctcctgcccttctcagcccagatgccatgcccctgggcgggcagcagctccccatcttctctggcagactcagcccactgccttgccagtcttgccaggtggtctacccccggccccgctcctgcccattcctctgtccctgcagactcagtgcagcacttccacaccaagaaggccctcaataaaggcttcctgaggaacgc

SEQ ID NO: 36787 - DNA, 9771 bp, Homo sapiens
cccgggacatgaggaaaggaacaagggaaagagccggtgaaggggcagaacaggcaggtgagagtctaagagggctcagtaatctgaagcttggtgggaagaagggattctgggctagaaagggtgcagaagcctgaagtagaaagagacgggattttggtccggggtggagagcgaatgcattgaaaagggccaaggcccaggataaggtagacatttaaaggggtacggatgcccaaggtagagcagacacttgaggagaccagctcagcaaacggaagacacttaaagtggtaggttctcaagagagaagaagtttttaagactagagctaagcaagacatttaaaaggacatgggttgggatttgggaacacgtttattccagaggcaggaacaaaggagtcgcttgtcaaggatctggttagagaagactagggtcttcctcgaaggaagcacgcgcacgcctgctctcccccattgtcttttctggcttctccaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaaggtgtgtctgggacagaaaaggggggagggcgctgcgttctcctgtccttaagggcctgctgcacatccctccatggaaggaggtgaaacagggtgggagcctctttgctgcagtaggatcctggagtgaatccagcatattggaggaaaattaaccctcattctttcaattactctactgaaaaacttgtagcaaagtccctacaatttttcaacctgagagagctgattgaaaaaaagaaaaataaaaaggtcattgcaatttaccaagcagtatggtagagggcagaggagctacacaacaatgacaggaagcccctcgagtagaggaggtacaggtgtgtgtattgtatatttaagagttttggccgggtgcggtggctcacgcatgtaatcccagcactttgggaggccgaggcgggtggatcacgagttcaggagttcgagaccagcctcaacatggagaaaccccatctctactaaaaatacaaaattagccaggcgtggtggtgcatgcctgtaatcccagctacttggcaggctgaggcaggagaattgcttgaacgtgggaggcggaggttgcagtgagctgagatcgtgccattgcactccagcctgggcaacaagagcgaaactccgtctcaaaaaaaaaaaaaaaaaaaagagttttacccagcctttttggaaatgactcaaggtactcagcgtagtggataagtgagctagaaggaaggtactagaagggatgaatcccctccgaatgatcaggaaagtcttactagaggacataacagatgacacgggtttttttgtttttgagacaagattttgctctgtcacctaggctggagtgcagtggcacagtcacagctcactgaagcctccatcttccaggctcaagcagtcctcctgcctcagcatctggagttgctgtgactacaggtgttagccgccacacctggctaatttttttttttttttttttttttttttttttttcagaaacggtctcactatgttgcccaggctggtctcaaactcctgggctcaagcaatcctcccacaccttgctgggattataggcatgaaccactgagcttggccaaatgtcaagttttaataataatcttttttaatattctttgtaaatttgtgttttttttgttttttttgttttttttttttagatagtctcactctgttgcccaggctggagtgcattggtgggatctcagctgactgcacctccacctctcgcgttcaagcagttctcatgcctcagccacccgagtagttgggattacaggcatgagccactgcactcagccttaatagaccctttttttttttttagacagagtcttgttctgttgcccaggttggagtgcagtggcgtgatcaattttggctcactgcaacctccacctcccaggttcaagcaattctcctgtctcagcctcccaagtggctgggactacaggcatgtgccaccacacctggctaatttttgtatttttagtagggacggatggggtttcgccatgttggccaggctggtctcgaactcctgacctcaagtgatccacccacctcagcctcccaaaatgttgggattacaggcgtgagccacctcacctggccctgaccccaattttttttttttttttttttttttttgagacagagtttcacttttgttgcccaggctggagtgcaatggctcgatcttggctcaccgtaacctccgcctcctgggttcaagcgactctcctgcctcagcttcccgagtagctgggattacaagcatgggccaccacgcccggttaatttttgtatttttagtagagacggggtttctccatgttggtcaggctggtctcgaactcctgacctcaggtgatccacccgcttcagcctcccaaagtgctgggaggcatgagccactgcgcccggctgtgtgtgtgtgtgtgtgtgtgtgtgtgtgtgtgtgtgacggagtttcgctcctgctgctcacgctggagcgcaaatggcgcaatctcagctcactgcaacctctgcctcctaggttcaggcaattatctcacctcagtctcccgagtagctgagattacaggcacccgccaccacgcctggctaatttttgtggggtttttgtttgtttgttttgagacggagtctcgctctgtcacccaggctggagtgcagtggcgcggtctcggctcactgcaagctccgcctcccgggttcacgccattctcctgcctcagcctcccgagtagctgggactacaggcgcccgccaccacgactggctaattttttgtatttttagtagagacagagtttcaccattttggccaggctggtgacccctatattttaagtgcctactagagtctggtagtgtcctatacatcacatatatgtgattttactaatcttcacaacaaccccacacaaaaatcccacgaagttggcactttttttcttctttaaaattttatttttctgtgtgcatttgttttataaacggggttctcgctatgttaaacaggccagcctcaagcaattctcccacatcagcctcccaaagtgatgggattacaggcatgagcaaccttgcccagccccccacccttttttttttttttttttttttgagacaaagtctcactgtcgcctaggctagagctaattttttgtatttttttgtagagacagggtttcaccatgttgcccaggctggtctcaaactcctaggctcaagcaatcctcccacctcagcctccaaaaatgctgggattacaggcgtgagccaccacacctggtcggcaaaaaatcccaattgatgaaactgggggtcagagaggttgagaaacctgcccagggttacatacctaggaagttgtagagatgggattccagcctaatgcctgatgctcccttactccaaaacacagacccttttttttttttcctttggtgacagggtccctgtcacccaggctggagtacagtggcatgatctcggctcactgcagtctctgcctcccaggctcaagcagcccacccacttcagcctcccaagtagctgggactacaggcatgcgccaccacgccccgctaatttttgtatttttttgtagagatggggttttaccatactgtgccggttggtctcgaacttctgagctcaagcgagccaccccactccacctcccaaagggctggaattacaggcatgagccaccatgcccggccatcagaacacagacccttaaccactaaaccctttgtagacaattagagggagatggggctggaaaagaagatagggtatacgccacagacagccccaaatactctgcaaaggaatttgaactttcttctgtatacagttggaaacaacaaatggcttttgagtccaagagtgatgcaatcacagtgacgcattaaaacggttactccggagacatcagagcactgtggctggaggctgggagcctggccaggaagctgtcgccattgtccaggtgaaaggtgctaaggacctgcttggtggcagtggggacagaaagaagaaagcaggccaggcgtggtggctcacacctataattccagcactttgggaggctgaggcaggaggatcacttgagaccaggaattcaacaccagcctgggcaacatggcaagaccccatttctacaaaaaaaatttaaaatgagctgaatgtggtggcacgcgcctgtagtcccagctactcggaaggctggggtggcccttgaagccaggaggttgaggctgcagtgaactgtgactgagccactatactccagcctgggtgacagagacccagctttaaaaccaaacaaatggattttcccactcttgtgtccagtccaggcccctcagcagcctgaggtggtgtccttcaaagagcagagcactgcatcatcaggtggatgcagccatcatcttcaacccctccccttcatccctacagtactgatggcctcatcttccccttcaacccccagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcaggtagggaccttatggaggaggggcattatgcccaaagccattggtggcaccccagatctcagtaatgcaggggctgttgggtgcttcctgcaaatccctgagagggcagaagatagcttctgttaattcattattcttccaataaatgttgattgagtacctattttcatcagcactgtgctaggtgttggggatatggctcaataggataatgtatgccctgctcttatggaccagtgttttaacaaaaaaagatggacattaaacaggtgatcctgcatggggtgatgaaaggagtgatctcccacagcagggagatcagccttgatctggggtcagagaaggccaaatgacataaactgagtgataaggaggatttgatcagttcagtaggtgggcaagagccaacagtatgaatgagggcctgcaaggaagcagcatggggttagggaatggaaggaagcccacaccccacaccccctgctacagaggaatgacactgaggctactgtgaggtgtggctgggtggcagatggcagggcaggtcaggggcagactgcagggcctagcgggcagcatgaaggagtttggactttatcctcagaacactgggaagatattgaagggtttaagcaagggcagcatgccttcactcccctttgatagccatatgtgtccatctgatgccctcttccctgcctgcttggcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggtgagcctgcccccgggagacaagacccctgatctgtttctccagttccacatcccagaaagcaaggagaaagggggtgtacaggtggagttcaagagggagatagtcatggtgacctctcagttccattctcccaccatattgagtatatgatatgtgcctggccttgtgtatggatgtgcaggccactatccctgacgacagggaggtcacagtcctgctggggagatgagagatttacatacctgaaccagggatgcgtgcttagatttgagaggtgaaaggtcagagtgggcttcccagaggaagtgggtctaatggatggaaaggacaaggaaaagggagaaggggtgagagtctgtcctaggggccaacgagaacagtgagctgtttcaggggagccatttccttgtccatgctcacaagcctgtggattcttccccctctgcaggaaattacctgatgttccaaaccccctccagatcctgtatatccgcagcatctcccctttccctgagctggaacagtttctacaggacactatcaagaggtactaggggcctggaggtttgggctccaagagaagcttgacagagcccacgcccgacccctacttctgtttcttcctaaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggtaatggggaagagggtttatcaccttcagtctcacgtgccccagcagtcactgcaccctagctcacctgcagtagtggggaggctagagcctggaacctggatgaaggggcctcatcatccaagggaggcagtgctatctgttcattcatccttttgaccaatatttattgagcccaaattcaatagcaggcattgcacttcctactgtggatagaatagtgacttagacttgtgctgtccaatatagccattaattatttatttatacttaaattttaattaattagaatgaaatacatatgactaaaaaccactgaattatatactttaaaaggatgaatttgatggtatgtggatacctcaatttttaaaattaagtacaattaaaaattcagttctggctgggcgcagtggctcacgcctgtaatcccagcactttgggaggccatggtgggcagatcacttgaggccaggagttcgagaccagcctggccaacatggcgaaaccctgtctctactaaaaatacaaaaaattagccaggcgtggtggcctgtagtcctagttactcgagaggctgaggcaggagaattgcttgaacccaggagacggaggttgcagtgagctgagatggcaccactgtactccagcctgggcaacagaacaagactctgtctcaaaaaaaaaaaaaaaaaaaatatatatatatatatgtatatatatatatacacacacacatacacaggccgggcgtagtggcttacacctgtaatccctgcactttgggaggctgaggcaggtggatcgcctgaggtcaggagatcgagaccagcctaaccaaaatgatgaaacccagtctctactaaaaatacaaaaattagcggagcgtggtggcaggcacctgtaatcccaactactcaggaggctgaggtaggagaatcacttgaacccaggaggcagaggttgcagtgagccaagatggcaccactatactccagcctgagcaacagagtgagactccgtccaaacaaacaaaaaaaaaatacagttattcagttgtactagccacatttcaaatgaccaccatattagacagtagagatacagaacatttccatcatcacaggaagttctggccaggcacagtggctcacacctgtaaccccagcactctgggaggccgaggtgggctgatcaatgcctgtagtcccagctactcaggctgaggcgggaagatcgcttgagccagggaagtcgaggctgtagtgagccatgatcatgccagtgcactccagcctgggcaacagtaaaggccctgtctaaaaaaaatagggctgggcacggtggcacacgcctgtaatcccagcactttgggaggccgaggcaggcacatcacgaggtcaggatttcaagaccagcctgaccaacatggtgaaaccccatctctactaaaaaaatacaaaaattagccggctgtggtggcgcatgcctgtaatcccagctactcaggaggctgaggcaggagaattgcttaaatctgggaagcggaggttgcagtgagccaagatcgcgccactgcactccagcctgggtgacagagcaagactccgtctcaaaaaaaaaaaaaaaaatagggccgggcatggtggcacacgcctgtaatcccagcactttgggaggccgtggcgggcggatcatgaagtcaggagatggagaccatcctggctacacagtgaaatcccgtctctactaaaaatacaaaaaattagctgggcacagtggtgggcgcctgtagtgccagctactcgggaggctgaggcaggagaatggcatgaacccgggaggcagaggttgcagtgagccaagaccacgccactgcactccagcctgggcgacagagccagactccgtctcaaaaaaaaaatagacggtttctccctgtcctcaagctccacccttgcactagagggtggttcaagaatggaaagcagagagtggagaagatgaagtccttctctttctctttgcatacatagagcaagctataccagagaatcagatagcaagccctccctcagaggccaagggagcagaagagccatggatgggccccttcccaggacagcaggggtagaagtgggaaaggtgagcatttgtgactattctattactctgacctcccaggactggacctacagagacatctgggattttctgcgtcagctgtttgtcccatactgtatcctgtatgaccgagggtaagggtattaggggaagggaatgggtaagggagtttttagggtgctgggatagggagggccaataggatcgcccaccctaccacatgcttgccctccaccctccctgctccagatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 36788 - DNA, 1877 bp, Homo sapiens
ataaatggggaggggagagcccactgggtagaaggaacagggagcggccagggtaagtccccactctcagagaccctgacatcagcgtcacctggagcagagtggcccagcctcagactcagagcaccaagacccaggcccgcaggcctggacccaccccggtccccccgtcccagctccattcttcaccccacaatctgtagcccccagccctgccctgtgaggcccggccaggcccacgatgctcctccttgctccccagatgctgaatctgctgctgctggcgctgcccgtcctggcgagccgcgcctacgcggcccctggtgagtcccagccggggtccaccctgcccctcaccacattccacaggtcagggcctgggtgggttctggggaggtcgggctggcccccacacagggaagggctgggcccaggcctggggctgcttcctggtcctgacctggcacctgccccagccccaggccaggccctgcagcgagtgggcatcgtcgggggtcaggaggcccccaggagcaagtggccctggcaggtgagcctgagagtccacggcccatactggatgcacttctgcgggggctccctcatccacccccagtgggtgctgaccgcagcgcactgcgtgggaccgtgagtctcccggggcctggaggggtggggaagggctggatgtgagccctggctcccgggtgctcctgggggctgcccagggccctgagtgggatcctccgctgcccagggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatggtgggtctggggacagtggaggtggggccagggtcttagccacagcccagcccctgggctccctctgggctccaggtgggggttgcccggccccctcctgaggctgcaccctcttccccacctgcagagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccaggtgggccccgcctgtcccccgccccccgccccccaacccccactcccaggcctgttcggcgagcgctgacctctgaccttcccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccctatcctgagcccccttccctgtcctaagcctgacgcctgcaccgggccctccagccctcccctgcccagatagctggtggtgggcgctaatcctcctgagtgctggacctcattaaagtgcatggaaatc

SEQ ID NO: 36789 - DNA, 17317 bp, Homo sapiens
atgggctcgcgctgccttaaccctcctccgcccgcccactctgacaccaccggaaaggattcattcgggaacattcgtggggcggagacgggacagggggcctcggcctgtagcgtcacgtccgccagggttacctgtggggctgggagcgaaccgcactcgcaccgcaaccccggcatcagtgcccaggttggcctcgcgccgtcctacggggcggccagaggccgccgaaggcctctcgcgctgcagcagtctcctcaggagcgccgccatgtgggatggaatagcacacgtgggcttctccctgcgtcacttccggggactgcttccagccaatcggcctccgccacagccagcgcagccttgccccttaaagtcacaggccccctagcgcgaaatcccacgcccccctggacggctgcggccgcactcgccaccagggggcagaggccagagaaagggctatttcccggacccgcccccttcagcttgggaaagcgaaagcgtggcaggggccggacctgggagcggaggaggcgggtctccatagaaacctccacctgtttccggccgggctgtgagagattaggggctgctgcgggggccaatctcagccagctcgcctcttcccagcggcctctgcgggagcggtgggtgttgtacacaatcatcatggcggcggccggggccccggatggtgagtgcggcgggggtggcgggcgccgggccggggctgaggttgcggtcgctcctctgggggatgcggcccggcccgggagggagaaccgcggctcgggaacggaggtccggcggcgcccggacagcgtccgttcccaagcccagcccgcggcgagcgcccaccccctaacccccttgcaggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggggaccccgcagcccaggcctcggtcagcaacggcgaagacgcgggcggcggcgcgggcagggagctggtggacttgaagatcatctggaataagaccaagcatgacgtgaagttccccctggacagcacaggctccgagctgaaacagaagatccactcgattacaggtaattcctgtggcgctgacagccagtcttccccaccccgcctcctgatggcccttgcaccctactaggcacctggtggctttccttgcatcaggtccccccatccttacagcagtcttctgaaggatacttggatgcccattactcagctggggaaagagactcaagtttatagagctagtaagttgcagagctgggattaaagccgaagtctgacgtttaggccccagtttctcattgatgttgctctaacatctctaattaaaaaatcacctaaggcgcttgttttacagcttctgggccctttcccaggagattctgattcagtgggtctgggatgtagccaggaatttatttttagcaaatatcttaggtaattcttctaagtgaagtttaggaaacgctgctattgactttgatgctggttcttcacagtcgattctgtttcttaattttaccttgttcatagctctttgccatctgagatttcttttctttttcctatttttttttttttttgagacggagtcttgctctgttgcccaggctggagtgtactggcaccatcttggctcactgcagcctccgcctcccaggttcaagcgattctcctgcctcagcctcccgagtagctgggattacaggtgcccgctaccccgccgggctagttttttttattttatccacccacctcggcctcccgaagtgctgggattacaggcataagccatcactcctggccttgaacttttttttttttttaaagctttctacatgtagccttgtaatctccattaagaacaggagttttgtccctattggcttctgtagctctgatgcctgtggattctcacttaatatgtgaatgatttagatgactgaggaacaacttggaaagaatgagagctagtacttactgaacaattattcaatgctagccaccgtactaaatgccccgcattggtctcttaatccttgaaacaggtctgtacagaaggacttactctaataaatcttctacagttctagaaactgaggttcagaggttgtaaatctcccaagttcacaaagctaataggtggtggaggcagtattcactttttggtctgttaccaaagagctgtgtagtatccatacatttttctgtccttccttcctttcactgtccaccttctaccttttcccaaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaaaggccgaagagaacaagaaggagcctctctgcaggcagaaagtgagtccatcttgtgcttcttggtcttgagaaatttgaggctttgtcctcttgagccgtggctggttatattctccctagaataagctcctttttggacagggcccatgatggaaatttatggcagcagttgggtgccgcagagtggaggtgacaactacctgagatttgcaactttgtctcatctggcgggtcagtgtgtctcaagtctacctactttaggataagaccttggtaaagggaggcttcagaccatgtgttgaaaggaatcagacgtgggtttctctctcttatttagtgccagagaaaactaccagtactagaagtaagccctcattttgtacaagtgcttacatttggctttttggtttgtggctttccccaagtcaacaagcctggctaggcatggaaatcaacaactctcggaggttcccctaaagctgaccgtttcaggaagctaaatgaagctgagtaggaagacaactacactgatggatttgtttatttatttttttgtcctgatctgtgaaataggagcttggttttttacgttctctgttcttttggctgcaagagatcctgccttgtcttgtgctcatcatagccattaacattctttcacgtaacgaggaaaagtgagattattttactatggaaggaacaggttgtaagaatcattacttgttatctttttacctggcaaattatactgattgctgtgtagcctcctgatcgttcttcctagtgttccaaggaagacaggtattctcaactgtgtctgaagtagagtagataaacttcaatcaacatcatttagtgaccatagacactaagatatatgaccaacagtaagaaaaggacacagtttgtgttacagatccataatcccccatgtgtgcttccaaaaccccaaaggagtataaaaacgagaagtgtttttataaatttaacagcaaaacctgaccagaattagtgtgaattttcctctttggtgacaaggtactgccccagaccccacagagaagattgttatgtatttgaaagcaatattatctttataaaaattccaaaaccctgaaagttcaaaactctagggtttcagataaggggttataaacctatattaattatctaaaaggtgttgatttggagacttcacccccacatatggggtctcagtgtcttgaaaccgattgagtttcttctcatattcctgtttttctttgccacatgtatgaaatagtgaaatgtgagcacgtcagataggagtggtcgcaatggtcacacccttggagcataacatgcctcctaaatacaggtttttagttactaatggtagcttaacaggcttagaactgttctccacagtacaggaaatcttgttcaaaaggtacttgaaaggtgtgactcgaattgtacttccagcccatgctgctgtgtttcattgaggccaattatgatgcatcacatgacctaatgagagggatatagtcccttgcctttttaccagcttattaaggggtctgggggtgatgtctggagtgactttttgctagcagtctggcagtgctgagtttattcctcccagagggattccaccatgccagtgaggatttgggctggcttgtggctgcctagtgcttacatttgattaaattgttaccttctatccattcattgtcccctagttccagccttccaagcagtggctatgcctataaggccacagatggagaagaaagaagactcaggcatttgggccaggcaggagaactgtttaaggggccctgaacttagaatccttgaagagctgcctcagagttcttggggcaggtggtaggggtggagtttagaggcttcttaatgtcaggttatagagtaataagcatttctttctgaaaggtggctcttccaggttcctgtttagctggagttaagggtagggcagtggggaaaacttcggcgatgggctgggtctccatttgttgaagaactgctcctcctaggcagttagacggattaccagcatcttatagtgttctctggaagtttaagttgaaaaaggtgggtgccattttttgtctgctaggagagcaacaccctttgtcgccctctttagtttgatggtttaatcatttcagtggtgatttttttttttttttttgaggggaggagggcaatctggaaatcccgtttgctgtagaactttgatatctaatatggtagctatccacatgtggctggttaaaatgaaattaagaattcagttcctcagtcatagtagctgcatttcaagtgtgtaatagtcacagcagtaggtagtggctagcacaggtacgaacatattcgccctcccagaaagttctgctggacagcactgtgctatagtttcaaaggatccatagtctgtcgtcattaaaagcttttgagccaaaacactaaggctttcttcatcctctctttcaagggaatagtaacacgacgaaatgtagtcagctgtttcatttcattctctcttctgacttatagcaacacaggaaagtgttggataaaggaaaacctgaagatgtgatgccatctgttaagggggcccaggtaaggcggatttctttgtgagcattctgaaaatgaggcagccccaccgtctgacttgaggttcctccaatcctgtcccttctcttttttccctgtttttttttttttgagacagagtcttgctctgtcacccaggctggggtgtgccaccacacctggctaatttttgtatttttagtagagacggggttttaccatgttgcccaggctagtctccaactcctgacctcaggtgatctgaccgctttggcctcccagtgtgctgggattacaggcgtgagccaccgcgcttggcccccttctctttttttctgactgtccctccatctcttaccattctctcgtgccttcaggagcgcctgccaacggtaccgctgtccggcatgtacaataaatctggaggaaaagtgagactcacctttaaactagaacaagaccagctgtggattggcactaaaggtatgttcttcctcgcctccttgctggcccactgcctgcctctggcacccagcagcactcacattttagagtgcgatttcacccctccttctgaaacctctctctccactgtgctttgcttgcttctggcttttaaatttgcttttagatgctcgccttttgtttggaccgttttccctcattgttttcagtctgatcttagggctgatccaccaaacagtggctcttcagttgcacacagatttgggggtcccaaacacgtggcccaagggccaaatctggtccacagaaaaatgttttgtgggatgacacacaatctgtaaaaattgggagatttcactaatctgattttttttttttttttggcttctcttgaaaactcaaatgatctggccctttggggcctgcattctcacatggcatcgatccactagagccgagtggtggtttccagtgggccatactacagtcttcatggtcccatttatcttagaagtagccagctttgttcatttgtcacctgcctggcccctgtaggtcagagtttgaccctatagtaggtgaagttttcctaaccgctgccgaggaatctgcctctccctccccgcctggttgccctctgcctgccccacccccgcctgtgcacggtgtctggatcagccttgctgtttgctgggaagtgtctctgactgtcctccctctcccttcccccagatggttacaaagtcttgttagttacactgcagaactgtctgtccctttctttgccacactgttgtgccagttaaagttcccaagcatctttaaacttggtctgttcaaagcgagttaccctgtttcactgccccatctgtgttttcttctgtcctgtccatcttacctactgctttttatcctgggtacccgtgctcaaggacctttggctgtttaaggacacattcaaatgcctaaccatagcgttcagtgttctcaacactgggccttagtttaaattttggttccagcttctggcccgtttgccctgtggtcccctgtgtattttagccgcatctctctgtgaagctcccagtgtgctttgcacagctccttgtctttgctcatgctgtgcccttacctggaatgcctttttcccattccttgttattaataaaatcttccaaggccctacttaaatgtcctctctgaatgaagccttccttgattctccccccaccctccaaatgacttgctgccgcttctgttcatagagcgcttcgtttatatccccagagcactcattactctctgacttgtctgtccccctgttagattcctggagggaaccgaacatgcctaaatcacctgtttctgaccagcactgtaggtattcagtgttcgaggtaaatgctaaagagaagtatagggggtcccatcatctgacgttcactggtttcagggacagaccatttagtgagactccacttaaaatgggaccaagttttatggagaataattggggcaggggtggtgggaagagagagtttttaatcatctaaaacacaaaaatcagtgttcaaccctatactgattgttaaaatgaacaaaaattgaaatgccaaaaatgcttgagttttctatcaattttatgataacttgctattttcttcatttcacattcaactctaactgcatggtcaaagcaagttttgcagaatatctgagggttccccccagtttttgcaagggcctttgaaccctctgctagatcattctcttctgtagagcctgtccatcttccctttatcagtagtaagctgcccagcctctgtcaactttgcaggtgattttgcttagttctgtctcatcacattcacttgctgaagtgcatagacttcctgcctcttgctggacctctacttttgcttgtgggcagcctcattgaaggcagttgctacggctgacctggaaagaccctgccatgaagataggtgcaggcagagaagtctggatgggaactaagtctgtaagtgctcattggttccttggggaatatttctgtgtcaggaagttgtatagggaacacatcataactgcaggaactgacagaacaagaacttcctgaccctgtattggaagttttctttttgctagtaggagcagccgccttcctgctttggcctaaagggagagctgtagaagaagctcaatatgttggggcttctgagcccttgaaagcctccttactcaccagtcttgttgaggagcatggccatggactactcatgttttctagggttgaacaaggttaagattttcattcccacccatagcactgtacctctggagcccaaggggcaggcagtcttgtcacttgcccagtcctgttacctaagtgtcataagcactcataagaggacagcttgttctgggagttggctgctagccactggcttcgtctttctgctggcaagaagaagcggctatggaatgaccatcccagcagcgagttggcctcttcgtggggcgctttgctgagtaagtgacccttaagggctgctactcttgactaaactctgctagcttgtgtaggaggaggcagttctaacagcctcaaaagaatgagaacaagctccaggcaggaaaccggaagccgctggaggagagcatgtaccctgctcgtaggaaagttgaatctggctgaaggtctgatgtagtgatcaggagtgtgggtccagaattgcccaatttttggagttttcaagagaagccagaaatctgttgtatatttttgtgaaatctccagacatttcaggatgaaaggtgttttaaaagtttccatcttaaagacagctgctgcccaggtcctgctttagggccgactgttgtagagccactagaagtccaaacctaaataaacatcttcaggtcccttctccccagcccccatttttcagatactgaggcccacagaactgaagtaaaatgtcttaagtccccagctagaccagaacgctggtctctaaattcctagtctgtttggccaacttatctatttttagactctatctttccagatttttctttctgcaaaggctgcaagtttttttccacttggtttagctgtttgctgagcctccctgcccccctccccctgcgcccccgtccctgaggtgtctgctgctccaggatggccatgtccccttgtgcaggtgcacctcgcctcccctgacctcacccagtcccgcttcacttggctcactcccggcagtctcatctcactccaggcatcccttgctgcccccttctcttacctgccatcctccttaaactcgcctcaatgtcttctgaccccatgtgatcagtggtatctcaagtgttaatcacaaaaggttataaatgttttaagagaacttcataaaagtgtgtgaatatagagtgcggaggactcgaggagggaggccggggaagggagcagggtcgtggtatagaatctagccctaaaatccaggcactccccttcccttgtgagagccacaggggaacgtgttgcctctttgttcgtaggcctcttgactctccctactgcccaagaccttagtcaatgctgggcttgcataaggttacaaaggaatttcttgggtatttatttattttatatttttttttgttgagatggagtttcgctctttggcccaggctgaagtaaagtggcatgatctcggctcactgcaacttctgccccccgggttcaagcgattctcgtgcttcagcctcctgagtagctgggattataggtgcccaccaccacgcctggctaattttttgtatttttagtagagacggggtttcaccatgctggccaggctggtctcgaactcctgatctcaggtgatccacccaccttggccaaatcctgactcacaagatgttaggattacaggcttgagccaccgcgcctggcctttcttggatatttattaaccatcagacttttaaaaaataatcccagggaagatacaattctgccctcagagacctttactataccattgccaaacccagtttcccacttgctcctacggagttcccagctcccacacgaagccctatgtgcactggtcagaagaccctgtcgtgttgtccccagagggcatggcgccagtcacttgagtttactgtagatcccgcagccaccagccctgatgagggactgctgagtcagagaagttagaacaggagggccctttgaataatcactgtaatccctctcaacttagagcggactgagaaattgcccatgggctccataaaaaatgtggtcagtgaacctatcgaaggacatgaagactaccacatgatggtaagtagcgctggctgagttcagcccctctcactagactcccacttcacctggcagggaacagttttaactgagcttgtttaacggaagaaaactcagtctccagaagatgcacttttttaagaccctgatgttttcttcatctacttagaacttaatccatggcctctattcctagttctgtttattttacacccccccacacacaccttccatcagtttaaaggggatatgttttctcttacctcttttagaaaagtctctcttgcctccctcttgtcgtgtgttgtttctagaccaggaaaataaatataaagaggaggaatggcttgtggattttcattataagttttatcttgcttataaaacaaaacttgcccttagccttggtgttggtgagggcaccagacagcctcttttctgtaataacgatgccgctcttccaggcccagtggctgagggcctcgtggggaagacgggctctgtggagcgtctattctgcatagaacccactctgcagagagcaggctactctttcccaagacagaatgtttggaggtgttgtgcaggtctgcagaacaaagcaaaaaattcattcatctggtaaaatgagcagcttaggcagtttccaaaattttcccagtgctctttggaggagccacattgaccacgaagttgattctgcagttgcccatcaggggcctggcctgagcagctgtaatgtgagggcggggcctccggccattgttcatccaaggaggcaggcctttcagtgtccatcccacagtgatgaagccacatcagcccatcccagggaaaagaaggaactagtggtttgaccagtagattgggataacaagtcccaggcagagagatgtgttggaagatcctcttgctatagaaaaaaatcaaaggggcttaaaatatggtgggcaagggaggcagccctgttggcatcctgcctagtgtggctgtagcaaggctgtagctgggagtgcagtccctaggctgtggggctcttggggttttgtcttctggaagtgatgatgccccttggcagcccttccacccctactctctctgtagtctttttttttttttttttttttgagacggaatctcgctctgtcaccaggctgaagtgcagtggcgctatctcggctcactgcagcctctgcctcccaggttcaggcgattctcctgcctctgcctcctgagtagcagggattacaggctcacgccaccacacccagctaatttttgtatttttagtagagatggggtttcaccatgttggccaagatggtctcaatctcttgacctggcgatccgcccacctcagcctcccaaagtgctggggttacaggcgtgagcctccatgcccagccctctctctgtagtctttattacaaggattgcagacaaattggtttggcctggtcagttatttttttctgttttaacagttgggccaggcgtggtggctcatgcctgtaatcccagcactttgggaggctgaggtgggcggatcatgaggtcaggagtttgagaccagcctgaccaacatggtgaagccccgtctctactaaaattacaaagattagctgggcgtggtggcgggcacctgtaatcccagctactcaggaggctgaggcaggagaactgcttgaattgcttgaacctgggaggcgaaggttgtagtgagcagagatcgtgccactacactccagcctaggtgacagagactctgtctcaaaaaacaaacaaaaaaacaaaacaaaaaaaaacagttggacttgaatgtttttaactgggccccatcactcctttttgaatagtttgtgttgccagtcacaccctgtagggtttgtagcctgacttttcaagcagtgtggtggtagggagtccaaggaagttgagtggactgttttggacgtctttggaggaattggtgtggatgggtaatgacttagtatttcattgaaatgttcatttctctcgagttatttctggcagaggatagctctagtagtccccttctcttttccaaacacctttacctttgtcctaatgaaagtacttagttatctctttgggcagatgctatttctctagctaaattaacatgtcatcattcacagttggaaaactgtggctgtgctttttcatttttagagaaatgtttttaaaatacagaaaagaggctgggcgcagtggctcacacctgtaatcccagcactttgggaggccgaggtgggtgagtcacttgaggtcaggagtttaagaccagcctggccaacatggtgaaaccctgtctctactgaaaatacaaatatttagctgggcatggtggcgcgcacctgtaatcccagctacttgggaggctaagggaggagaatcgcttgaaagtgggaggcggaggttgcagtgagctgagattgcaccgctgcactccagcctgggcaacagagagagactccagctcagaaaaaataaaaataaaatacagaaaagaaagagaataactgtcacaaacccatatatccatcactgagaagtggcaattgtaaatattttgtaatttgctttaatttttttaaataaaagaaataaagtttattcacagcaatgatggccccactgtcttcccctcccccattaccatcgtcatgtgtcacgtgcgtccttcccatctatccattctttgatttacacgtgtatccacgaacaagatggagtgttgttttgtgcttccagttttcgtaaatggtattatgtattgttctacaacttgcttttctttggttcaacataagaatctgtcagtattaactgtagatccatatggacccagttgatacctctttaaaaagagctccagtattggtgtgactaagccttgtcactttgaattctgcattcccttactgatggatatgtaggttgccccaggtttttgtggtttcagacagtgctgcaatgaacattcatacctgttttcttgagcatgtgtgacaggttttctagggcagcgtttctccaactgtggtccctggatcagtagtgttgcatcacctgggagcttgctagtttctcaggccccaccccagacctccccaaattagaaacttcacagggttggagcctgctgatccatgttccagcaagccccccggatggctctgatgaccactcaggtttgagaactgctgctttagggttggctcagcttaaccctcagcctgcctgtttttgtttttggttgggagaatgctccccacgtgcaaagttttgtttggtttttcttccctttttaattaactcacatcccaaccctcacccatgtttgtcctgcctgcttggtctcccgacctctgaagtaccgcttggttttcctttttcccttccaggcgtttcagttgggccccacggaagcctcttactactgggtgtactgggttccaactcaatatgtggatgcaatcaaagacactgtgctggggaaatggcagtatttttgaaagcactttcacctctggcccaggagactgacccaaagtgaaggacattgccgggagaggcctgcagcatccctggatttcagagttctggaactttgttcataaaaaatctatattcaatctgaggtgatgtggtgactgaagccagaggtgatgtactttcaccattagcttaattttaacttaaaattaccagttccctttcttgcagtcagcttcataccatttttaaagtcaatacgatggaaatcaataaatctgaattccgaacatgttgtgtggaatactcttaagtgtgtttgagagtagatctgccaattatgttgacaagggaatgatcaaaagctttgttttttttaaaaaaaaaaaaagcagtttcaattgaaatattttcatacatctttggttgcaaacatttggactgcattgcaatgagttggggtgttttttttttccttttttgtataaaattgtatgcaaaatgggggtgggttagtaagccacatatttctgtccattgattcagatttaattctttccctttttcattctctcgcttcctcaatttgagtttttgttttaagaacccaaagatgtcagttcttcttttggtacctcatcaacgcttcctttcctgggctccctcccgccgtgctgctgctgcctgtgaacgcacggtgggagaggaagagctgctcagtcttgggcaaggagctctcacacttgctgtggtgttcgttgagcagcagagtatctcccagtgactcctgtttaaatgtcttgccctttgggcccccatctccaaggagttccattgctggttggatgattgtctgcacccctcactgagcttggcctagaggcccagcctggcatggttgtgcctgggctgtgccgctcaacagccccagctcccaagcagacaaagacctcttccaggaggagccaggtagaagatagttatacagccatatagctgcagatccagataaccttctttctttggaagttttcaagaaattcttaagcagtccaaggatgatttcaattatgcttctccattgggtccttctgctcatgcattcagttcaagtgtcctttatcccaggttcagagatgctgcctttctgaagaagacatctgaccctagcaggttggccagtgttattgaacaacaaaaatgggataaattgctttcatgattagctcaccttcttctggttttagcccttctgttctctgtacacgtgaacttctgtcatctccttctggcttggttgcctctgaaaggagggaaagtctcttggtaaattatctcttttgtgctgtttgctgtttctctgctgccgtctttgcagttctcctctcactggttgcaggctttcatagtaaggtttggcgagaaatgttccaaacatcacattttggattctaggctgtcacccctcattctgtgaaacgtattagcatgtgttcgcccaagatgactattccttgtgagccagttaatgatgatattctacgcccttcccttctaagctgtagttcaggaatccagcccacatagacagactcttgctttccatggtgtagtcaatgccaagtgatgcatctaggcaggaaaatctactctttgcttttttgggggcaattagtacatttgtgaagtgcagcatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacatcatctcgggtcagacattgccccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcagacatagcaccagaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttactgtcagagggaccagatctttccctcactgtggcaggggccgtgcaggtggataaaggaagagctggtttccggagagtgactgtaacagcgttgactcgaagctagagatggagggggtggccgtctcttagacattggacacctctcagagcctcctgagggcttctttgtcttctagaatctctaccggtggtcctcctgcaggttctggctcacagacatcatcatgcctttttttccctccctgaggcgccttggcagaagagcgtgaccctgtgagccaggccccccttagctctgcttcagatcacagaacacagacagactcgcgagttgctggacctctttggtattaagtgtttgaatccatggtgggccttttgcaagtagcgttagctctttttaaatgttgaactgagctaaggatgcactttcttgtggacatagaaggggcccacgtaaggccctgagtaggctccttagttgctgctttacctgatgagggccaaagagattaactctgcctcgttgccatgtctcagaaaagttgccatatttcacccagaaggggcttgttttcctcttactcttactttaaccatgtgcctggaggagccattctgggctcttgcacttgcccagcctttctttgccaggggcagagaagggaaagggggtagattgagtgtgccaagggccgtgcaagggcaggcttgctttccacccatctgctgagggagccctctcctctcgctccttgcctctgttcacacctgttgtcttggaagaggatggtccctttgtcttaaggctttgtgataaagtcatctccagttaggatctgcacctgtttccttcgtaatagtgcctggcggcctttctgaagttacaggtggttgggagccctctcgcatgcagaacatctggtagattgatctgccaggctgggtggttctactgctttctcaatttctaagaaccttttttttttcttaaagagttctgctgaattatttgacaatatttgtaagtaccatgtttccttgtggtgtatgctctgttctggtttctgttttcaaatcaaatgcctgtttgggaggagatgaacgtatttagtctattagatttgcactgctggattttttttttaaagtgtaaccttgaatagctgtcttattgtttatcctgtaagattagtcaatcgattaaagtttgataatt

SEQ ID NO: 36790 - DNA, 128634 bp, Homo sapiens
gttccaagtttggagcttttagctgccagccctggcccatcatgtagctgcagcacagccttccctaacgttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggtaagaggctgtttgcattagttgcaaaaatgcaaagggttgtgcatgcatttatgaatgcatggatgcaattttcgcctggcgagtgcatttttaagtttgaggttttccacagctcagttgcatttcctgtttagtatgtgtctttttttgcagacacagagagttcctgtaaggcagggcttgcagttcagctgtgcattgacgttatttgcattcttctgctaggattactgagctctttttgccttttgcacagtcaggagagacagagcaggttggtagcgtctaaatgtgcaaggctttatataattgtaaaattctttactatgcacagatattgtaagtaattttgtatgcaacaggaatagaaacttttaaaaactctataggtgaagatgaaaggtaaaacttgagttaaactactaggaaattaatgtaatcttatattctttgggggaaatagaccgttgcggtgccagtatttagctaaatttccattgatatcgccttgaacattaggtaacttttgatttttaaaggaagtaaaggtgaagggtgaataacagcatatcacaaaaaagcagacgagtcttgctcttctgagattttgcactttacaccaattgcttattggctcgcaaaatttagaagcagcagtgaagacctaatgttttatgtctgcccatttgggggatgctttgcatcttgggggaaaatattgggggtaaaactgtacttttaagcattacagtagtgtgaagggactgcactgtttcattgacaagcataatgaaatattttaagtgtgtaactgcgtgtatttagtcagctgtaataggttggaagttcacgttatggttgttttctttatgttcttttattttcttttcttaatttttgtttttaaacacagttgtattttgcaggcttaatgtcaccctgggaaggggatttaaaaaattcctgatatgacatcaaagagcagactaggtgctgtcaggtgcccctgggaccccaagtcacttgtttcagaacaattgtttctttaccatagagaaagcatatgccatatgagaagtatgggatgatgaagagaggtgttagatactattgaattaggctacccggggcactctttgagtaagacatggtgaaattaaagggtctaacaagctttttgctacttttttgggagggagtgtggggagttgttgcaccgctttttaattctacctgatgggagtcatatatctcagcagcccaagaaggaagtagtaatctcaagcattcaaagtagcactctgcttttctttgagtattaggggagaatggaaatctgaaaagttaagagtgctgaagaacctaggaattgacatatcaggtggagatgttcctcaagtggggaaaacctaaaaatctccttattgagtagagaaataatagttcagaagaggcagtccatgctttgatgtattaaagagatggcatttagttactttgtatttggtaaacattcgctcattcattcaattcagtttaatatatgtgtaatatattgtgatatgcatgtatatacatatgtatgtgtgtatatatatgcatgtatatgtatgtattgtgtgtgtatgtgtgcacatgatttagggacacacaaaaatatttaaaatgaagtttttccttcgggttggtgaaaacaagaatgtaaggaaatcattataatacaagataataggacaggtattgaagagaaatggtgctattggagtttaaaaatggaagtgatttatctatttgggggatagtcaggaaggtttatgaagagggtggtgtttactgtgatcttatctttggactttagggtctaaactaaatcaggctcctttttgcatatttttgggctcactatgaacgtggctccctcttagtagagccagtttttgagttgagaagccaaaggagatattagcactgcactcttccctatggatgtgtttacaatggatcaggtactggtggtccttcaaatcaattcccatttacccagatgagttttcttaattggattctgcttggaaagtacatctggaatgaacatggggttcttgtccgaaaggaaaattattggtagaaagaagtgggtgatcattttagaaatggcaaaagagccagccgccttggcctggactttaaatgtggaattggccttattcagctacgctattctcaaatggccaaaatactttttgcagtaccaaacttcttttttaatattctaacccaagaaatgggaggaaaagtgaaaagtggatacaatctcatagtattgaagaatttaacaatatgttcaattcaaggacctttacgaactttctagatcactataattcggtttaacagacctctaatttaaggcacagcagaggcaaaggaattacagactctctggaagctggaaggactgggttactgctctacagccttaccaacagtgagattccgagaaagaatttcttaaaaagaaattttgttttccacagttgtaactttaggtggtatgcttttcagcttgtttatattagctgtctggggttgagttgacatttttcaaatattaaagcagtagaatgccttttgaggaaatctgaaatgtaagttaacaggaagggcacccagaaagtgcaggaattcctgcacactacaggaagacaagctacaggaaaaatgtgtcatctacactacccgggagagaaaaactattgttatcagccataatgatctccggagggagggagagaaagagggaggtagggagatctggcatcccccagttcacctgaaaatacacaaaaagtttgaccctgttaaaatacacttttctcacttctcctcctattcacctttaaaaaatattagtttattttagttttagagagcaataagtaaatcatgtaagaaatgcctatgaggcacaattcagaagcatatagcagagtggtaggaaaggtcttaactctactggggttctttgcttctgtaattcattccacccttgggaaatgaaatgtgtaaatttcttgttctctataaattcctttgttaggttgtaccagacggacttgtcatgcttagcctgtaatctgagccagtatgttttataaccccgtacatctcaggacacaaaatcagaataggtagcttgggtttcctgagcttgctttgtattagcattgcattcagttctttagagcatgcggcctgttaactgtagggggcttcaggggtctctggttggtaaatttaatgttggagaaaagagttgagattctcttgtctttgtttttcagattagtgttactttaatgactccccagtattttaaaatctgaaagatctacaaggaatatttttaaaacttaaaagaaatttcataaataacccttgttcattatagaaacatttcatagaaaaggaaaaataagaatgactagttactgcagtctacactttggcatttattctcttggactttttttttctatctatgtgtatgaagcatccaaaatgtgtgtaaaactaagtctatttcgttccctcttgtttcacttaccaatatatggcaaaatattcccaagtttatatatttctacattcatagtatcctcttccattgtatttatttaaatagaatcttaatgtttattaactttcactattgtgaatatttccgtgatgatcataccagttcctacattatcatgcatactatgcccttagattaaattccagggagcaaaaccacaggctttgaatgtccagttcttcttcactctccattctcttttcttccttctgaaaatagctttttattattgcaaaaaaaaaatgacatatgctaatcaaaaaattcaaaccaaagataaattcacaataagaatataaaactcactcaaagtcataccacccagagctaattactgttagttttttgggtactatctccatatttgtatgtacatgttattttacacactatatattgtattttgtaacttgcttttttatactctaccatatatcttggatatctttctgtagtagtacacataaggttacctattttttaacaaccgtgaattttaatttgtaagaatgtagccatttacttaatgtcatattgagttttcaaacagtttccatttttttgcacagctatacacagtactgtaaggaatacctggaacatacatctttatacatttgcccaattatttctttaggatgattcctagaggtggaagtcctgggtcaaagggcatgtatagatatattgctaaattgcccttcatagaggtaacactaattctcatttctaccaataatatttagacgtgcccattctgtcctttcaagcataatggtacatattgccaagtaaattgctcttcaggaagatggtacctttcttcatcctgggtataacaatttgaaaaaatctttggcagtttgatgaaagctattaatattctactctaatattattagtgataaggcagttgcatttttcagtttttttgacatttgtgtttcatgtgcccaaatttctttttttctcatgaaatatatccttaaaattttaatttgggtggccaggcatggtggctcatgcctgtaaccccactttgggaggccgaggcaagtggatcacctgaggtcaggagttcaagaccagcctggccaacatagtgaaaccctgcctccactaaaaatacaaaaattagtcaggcgtggtggtgcacacctgtaatcccagcttcttgggagaatcgcttgaacctgggaggtggaggttgcaatgagcagagattgtgccactgcactgtagcctgggtgacagagccagacttcatctcaaaaaaaaaaaaaaattaattaatttggggatcaaattattttcaaagttagccagaaaatagcaatattgtagaggttaggtaatcctggattgatagttgggttctgtgtatctaaacaatttaattccttgatgagttctaattttaattttaacctaatgtcttaagctgctatcacatattttataaactcattttatttatatagtctatagctatccagacctatatgaaaataataagaaaaatgtagtgatctgattaaattccagtctgagaaatagcttacttttgggcattcctgcattttcagttatcttttcaggcaaaattagtttttctttaggtttataaataattcttacatagcacctggttgtgttatatgcattgttgcagagaaatttaatctaattttttttagcttcctgtgcaatgcctaatcacaaaaggtggttgacttaaatttcctacatttgttaaaataattaagtctagaatctttaagattcttgttaagaatcaattttaatgacctcacaagtcatataagtcaatcagatttaacatatccttaacatagccttaataaatgcgcctatttatgcatcctgatattaagtgatagaatttagagctatgaaagttttatagtccaatcacttcattttacacataagctaactgaggccttggaagtgagtgactttcctgaagacagtagagtggagtcacagggagaagtcagatctacagattctctgtccgtaagttcttttcactaaaccacacgtgaacactaataatccacatttataaaatttttttttcttcagaatctttagtatatttcacatttttagctttgcttgtttttgttgggagcagtctggcaagggggagctgatggtataatgagcaggggttatttttctgtgtccaagaaatggtgacatgtgaatcatggtggtggggtttcttaccagttctctgccaaaggatattttgcaaatgctctcattttgattcccagtgcctacatagtacagctgcaagttttaaccactgtaatggttgtttgccttttatggactgtcttgtttgaaagcccttgctgggtaactaaaccttttcttatatatctttacatctctgactcttatagcattgtccttataaataataggtgctcaaaaaatgtctgacaatgaaagtatttttcatcagtagggataagctctcatttgctcctaagttttatgaaagatttcgggtaattaaattacaatgcaattttcttcttgtgcttcttctttgtttgcactgatattcccattatgtatttgcttaattatttggaagttgcaagaacagcatgaaaagcaacttataatggctggcgaagtgtcatttctcctacctaagccttctgaacagatttaaaggttgcacaattctctgctaactttctttttaaaaaatatgagaagatgaattgtccgaagaatcccatccaatagaattgaagtgatttctgcatcctgtgctggttttaggagctggtttttaagtctatgaggcttctgaaggattgtcagagacaatcctttttttgttgttgttttttgttttttttttttgagacagagtctcgctctgtcacccaggctggagtgcagtggtgcgatctcagcttactgcaacctccgcctcctgggttcacgccattctcctgcctcagcctccggagtagctgggattacaggtgcctgccgccaccatgcccggctaattttttttgtatttttagtagagatgggatttcaccgtgttagccaggatggtctcgatctcctgacctcgtgatccacccgcctcggcctcccaaagtgctgggattacaggtgtgagccaccacgcccggcccagagacagtgtttttaacagctggctgccctctaacaaaacagggaacttcgcaaggatcacctcccagtgaaatgattcttcacttcctccttgaccacctccactgcctctgcccagccccttcctccctggcttgtaccccactctgtctcctttgatggtcttcctgagttggcccatgcggttcagtatgtagtccataatctccctctttctgagttgaggaggatattcaggttataatccccatacaatgaagtctatcagaaatcatcgtaatttttttttttttttttttttttttgagatggggtcttgctctgtcacccagactggagtgcagtggtgcaacctcagctcactgaaacctctgattcccagtttcaagcaattctcctgcctcagcctcccgagtagctgggattacaggtgcctgccaccataccaggctaatttttgtatttttagtagagacagggattcatcatgttggccaggctggtctcaaactcctgacctcaggtgatccacccacctcggcctcccgaagcactgggattacaggtatgagccaccacgcctggccaaatcatcgtaatttagtcaactccagtctgagttgaagcattaaataagcatttgcagcatccctgtcatctgttttactttctggtctgtacatcccttcttaagtcagattcttgagattagtcttctttggacagaccattagccccaggtggagctgctgatcacaacccctccctgtaccactcccaaggctgttgtcatcatcacttaccctaagccagttacttttcatatagtatgctttaggatgtcccataaacactatggacaaagttggtgttattatccttaatttacgagtgaggaaatcaattgttgttaaccaatttgcccatggctggatagcgagtcagtggcagaggcaggatggatgtctgactggtgggcctgtgcagcaaactgcagctcctgggccaaatctagcttcagctgttgtttttgtttgtttgtttgtttgtttgtttgagatggagttgcgctcttgttgcccaactgggagtgcaatggcgcgatcttggctcactgcaatcgccacctcctgggttcaagcgatcctcctgcctcagcctcccgagtagctgggattacaggtgtgcaccaccacgcccagctaattttttgtatttttagtagagacggggtttcaccatgttggccaggatgatctcgatctcttgaccttgtgatccgtcctcctcggcctcccaaagtgctgggattacaggcgtgagccatcgtgcccggccaagcctcagctgtttttaagtatagcccgtgagcgaagatggttttcccatttttaaatgattgaaaaaaaatcaaaatcaatgtttcatgacacatgaaaatgatacgaaattcaaattcagcatcgacaaacaaagttttattggaacacagctatggtcattcatttatatgttttccatggctgctctttgctcgacagctgtcgagttgagtagttgcgccagagcccctatgtcccacaaagccaaaaatatttgctatctggtcccttgcagaaaatgtttgttgaccctttcctttatgactttattccatcgaatactggggtctcttcatgacagagctcccagaaacattcctctctggctttaattggaagttgttaacctggataactactgctctgctgctcagccagagacctcttgggcccagcccacaggaaacgtctgagtggtgtctctcctagttataagaattgtaggtcattgctcatttcctctgaactaagttacccgtctccttttgcccgtcctggggtcttttccccttagttgtgttcttcctgtttgctttatatttctttcctttttttcttcccttcgatgagaagctgcttattaattcttccctgagactcttcatcctccccttattgatcccacatttctttagaaagtattaggttggtgcaaaagtaatattgttttttatcatcacttttcatggcaaaaaccacaattacttttgcaccgacgtaagaaatcaaaaataactctcctgctaccaccattgcctggcttgttggttatcatcatgacccagctcagaggttccatcatttcttttgtgtcaacgtgaaagcctccctgcatgggaccagagaggtttccagttatcatctcctgcaaagtttagagctgttttcttacattaaccccctaaccccgggtgggcaattttcttttgaggacgaatattctttgtgctcacagagtcgcttacatcgtggatattgggtatatttaggagagaaggttttgatagagggtctgaaaatgaagggaggtgaaagctacatgtagacagaggagctttggtagaatgagcccagatttgttcaccacatccagaatgatgtaaatttaagtcacgtacaaagaagtgctaatttctaccatcccagatggtatcactgctgtgattctttctgtgctccagatactgtgcttagtgatgaatgtgaattctatcatttactctcactatggatcagtgaggtgatatcccattttgtagatcagcaaactgaggccggagaggttaagaacttgcctcagttaccaaaccgatagtggcagagcagaggttttagccaaggtctgtctgacctcagaatctgagctcctggcgactccacttgagacgtcactccaaaataaaggtatgaaatccattacaccaaagacatggtcgaagaatgaaaaacgagtgtattctgtaggaatttggatagatttgggcataccagggccaagtatggtaattaagaagggctgacctgtgtctagctatttataggttctttttgacatgtccctttatatgtcttttgatcacagagtacagagtctgactcattttgactcttaaggttgagttccaaatagaaactgcccattggttgaaggaggctgattacaattggcccactgatagttactggtctggatatacaggaatgttatgttaaaatgtaggtaacaaatattgcttccatttgctgttctgtaggttgtatcacacagaaactaagccgactcaaaccttgtgtgtttccttacacatctaagttaaattgtattaaaactaacaagaacgtggccagtgtggcagcatacctaagtgtggggattttgcagcccctttttggcttagtgactttttttcttcctggttgtttctatgtaaatgtaacaatttccttgaaatgatgaatgaacccacatctccagtgttttcctcttgtactggacagagtggaggaaactggaattgcctgtttttgtggcagaggaggtagatggggatggaaatgaatttccttttaaagcaatgaattctttttttttttgtttttttctgagatggcgtatagctctgtcacccaggctggagtacagtggtgctatctcagctcactgcaacctccgcctcccgggttcaagtgattctcctgcctcagcctcccaagtagctgggattacaggcgcccaccaccacacccagctactttttgtatttttagtagagatggggcttcactgtgttggccaggctggtgttgaactcctgacctcatgattcgcccgcctcggcctcccaaagttctgggcttacaagcatgagccaccgcacccggcctaaaccaatgaattctttctcggctttctctccagccaaagcagaacagctatacctatgcctcagttgtttttcatgatcccatgtcgaagctgcggaaatagatggtctggttgttgagtgacaagttatttattcccttcctttattctccctcctccaatttcaaatgggatgagaggagatagctgtaagcgtagggctagaatctgaagaatcagtgggaacagaatagttcagagtatggaaattagtttgaagtaaatgtagagataacctttttgtgatatttgtaaaccttgcgaggcagtcttcacagtttatttaccccttcctgtacccgaaacacctttgccatttgaaaaaaaaaaatcacaaactctgcatatacctaaaaagaggacttggataaggagtttgtttagatcaattcaacaaaggtttttgtttgtttgtttgcttttttcattcagggtcttctatgtggcccagtctggcctcaactcttgggctcaaacatcctcctgtgtagctgggattacagccagtgccactgttcccggctcaaataatacatttttgatctattgttatgtttaagacatcatgctgggtagaaataggcagaaatgcatttgactttactcttccagtgattagccatgtggccttggaaaatctacttaacctctagcttcggtttcttcaccttctaaataaaaagactgacactcattcacgaggtctttatgaagattaagcaaggtcatatatgtaacatgctttggccagtgcttggcattcatttattcaacaaatatttatgagtgcactttatatttgaggtactttgctatagtactctctctataaacatacatttgcttcactcttcctttccttccagcccttaaggaggttattgtctaggaggaggtaagaaaagcataaaaatgtgtagaatctaaactggaatcctagattagcttaaaagaggtactattgagtgggaaagtcctatgaataagagagagatcaggaaagtgttgacaggtgtggaggtatcaatgtgatttttagaatcaatgaggaaattagatccaacataggtacgggaaggactcttgacttctagtatccagtggcacaatagaacaataaaatagagcaattctttagaaggatttaaaaaaaaaaaaagaaaagaaaatgccccagcaaagtatctgaagcttaagagaccttacttgtgttttctaagaacttcctttttcttaccaagattaatactgtagctattgcttgtgattgcaataggtgaataaatggaatatatcatatctcatacttttaggtgttttttggattgtggaaactccaggaaatctagaggttaatagttaaacaagtatatcatatcaaccaggtttatagacacactgtaattatataagcaagctgttggttcaataatcaacgtctagctgggtcagggaatattttccagagcttggccacggctgtaattttcattttttataacctgctaacatgccaacctgccttttccatttctttttgtttttctcgaatcatctgaaatcagtgtaagagaaggaaacctgttcaatgtacttttgaattctcattttatttacctcaagtaaaatagtgttctggaaagttcttcgtattaccaaattgactttctcaagcatgatactggatattagcaagggagttcataatttattttctatttttaatttcagaaaaatacagttctaagagataaaaagataaacatataaaaataaaaaggaagataaaaatacaggataaaagataaaatatttaatacaattaatagattaaatacattttttcttttattattttggtttcaaaaacagagtgacgtatagctctggggctcacagtgggctgtttctctgtgaacctagcatttaatcaccttctttccctcaataactccatttaaacagagtcagtacagtgtgaaggaggtgaattgagtcacccctcctcagattcatgtaagccacagggcagttttggcctcactttgctgtgtggttaaagataacatatgacccagccaggtagaagacctgtcagccatatcatctcattcaagtggcctgcaaagtcttcttgcttgggactttgttcctgaatgagcctctatttttgtaaggaaagtagaggaaaacaatgcagatttaattctgaaattggtttaagaatgggattgagaaattttgatatattcagtctggaataattgttttccatcccgagtttcattctttctttttgatgtaaccctatctaaggacaggatagctagtcagtgttgagcaagacatggcaggtagaggactagctgtctctggattgcatttaacaagcattatagaacaaccaaataaattatctgtacctcactctgtgctagactgatacaaaaatgaacagaatcctcttactaccctcaagaagctcatattctagtgggatgtctatgtttgctagagctactgtaacaaagtaccacaaattgggtggcttaaaccacggaaattaattgtctcgcagttctggaggccagaggtccaagatcaagttggcggcagggctggctccttctgaaggccataaggaaaaatctgttttgtgcttcttccctggcttctggtgtttgctggcaatctctgcatttcttcccctgtatactcatagcccagactttgccttcatgttcacatggcattctgcctgtctgtgtctgtatccaaatttcccctttttataaggaagccagtcatattaaagttagggcccgccctactccagtatgacatcatctgtcatcaagtaagatcccattcagagatgctgagggttagctgagggttaggacttcagtatattaattttaggaggacatagttcaacccataacatggcaggcaaacatggtcagcaaactaatgatactctgtgtgaaatgcacgtaagttctggtataagatacgagtaggataccaaagaaggtgggtgcataactcagcctgggaagatcaggagtctgttggtagaggaaggaccttaagttggtatagcagaacttgcagtgtggttctcaggagaataaggaagtaaaacaagagacttcccatctggtccttgaacggacagactacctgccctttcttctgtttttgtttttgttttttttttttttaattgttaatgacagactggatggttctaaactggggtgtgttaaattagagaacacacacacacacacacacacacacacgttgttgtattgattcccaaaactgaatttgtgtttagtggtaatgagacctacacaacactccctgtggttgtcacaggcagctttgatgtacagatacagggacaggacttggtggttgggagaaaggatcatccttcccattgtaacaaatggtcctagtcctactgggacaaagtttcagagggagagagtgggctgggctggtggctcatgcctgtaaaccccagtcaggctggaggctgagacagaaggatcacttgaggctaggagttttgagaccagcctgggcaacatagtgagactctgtctctacaaaaagtgaaaaaaaaaaaaaaaaattagccgggcatggtggtgcatgcctatagccctagatgcttgggaggctaaggtgggaggatcacttgggcccaggagttcaagtttgcagtgatcattccactgcactccagcctgggcaacagggtaagaccttgcctctaaaaggagagtgagagagagagagtaagaaccaagccatggcaaagctgatttttagataaggcctgtaagtcttaaaaaaaaaagtattcatgtgttaccaagctcttgcaatattgattattaacaaaggtcttttcaactatgtgtatatttcctagagctaatatgcagctttattttctttatgtgatctgggtacctttagtataaaattatgagtaaaatatcagaagctgtttcagtaagaaagggcactaaggaaagaaattgttaggcatgttgtgtgaggtggttgggggtcaggtcagtggaaaggaacttttccagctgagagctgatgtccatcatccatcagattatcctgctggggtgttgatggcagcaggcttcaagtgtgggggccaggtgggcaacccagagaaagtcacaggaaggtgaagctggggtgtggggcctgggcatcccttggagctaggtagagggatagtcgtgggacaggtgatccgaataacaaaagaacaggtgagcagcagaggctcagcagaaagtcaagaattagatgagtcaatgtggaaggggaagaaagaaataataaaataggccgggcacagtggctcatgcctgtaatcccagcactttgggaggctgaggtgggtgagtcacttgaggtcaggagttcgagaccagcctgtccaccatggtggaaccccgtctctactacaaacatattaaaaaagtaaattagccaggcgtggtggcacatgcctgtaatctcagctactcgggaggctgaggcatgagaatcgcttgaacctgggaggtggaggttgcagtgagccaagatcgtgccactgcactccagcctgggtgaaagagcaagactctgtcaaaaagagaaaaaaaaagaaagaataaaatagagaagccaattggaaaccaggaatcagagattgaagagattcaagaaactatgctgcagaatccaggcaatcatgtgagcttttattccatattagttctgcctgaaagaaatgattatacatctctgattctttcagcttcagcagcaatctttgttcatctagctattatgtgaagatgcactcataagaagcctgagtaggtagggtgtagaaggacacacagaaaaagagcaacagaaactagtttggggcttgtttcaaacaagcccggacttatcttccatgctgagtacctgtacacagctctctaagtgggaccaatggagtcagaggaaaacaggaagcagtgaatcagctggactgtcaagccacttcgtttaagacagaaaccagctactggttttctctgtcaggttagagggagcacgcagtctaatgtgaacaagcaaccctgagctctggacttctacattcaaggcaaagctggatagaagaaacgcaagtgctagaggaagggttatactgctactctattctaacaatgtatcagggggatgtagagcgactcactcagtctttgggaaagcatttggcccgtatcaagaacctggacaattttcgtaccctttgatccagcatttttatttatgagaatctagtctataaaagtgattattgagtgcttactgtgtgcgagtctttgtgataagcactttgctaattaggtctaatccttctcaaaacctgggcagtaggcaatatttatcttctttttacaaaggaggaagttgcaactttggtgcataacttgtctcagattataccgttaatgggtgcagagctgggatttgaatctagtttatttaaacactaaagttcatgcttcttttctataccactgctgtgtccaaacagtgaaaaatagaaacacccttattgtataatatacaattatactatattgtatattatgcatataattatgtcttataattatatataataattataatagtaaggggatagcttaagttatcaaatactcacttgatgtaataggttgtgaggagatggcagtaccattaatggaaagatgcctgtgacccaggaggagtggatataaatatatctggactatgattacaaataagtgcatgtgtttgtgtatttatgtgtattttgttttaccttaagtaagagtctgcgttaaggagaatttcatggagtccagttgcaggaggtatagctaggcctggtaggagctaagtaaggcattctctgactccctccctctttctttatctggtctatcccctccctttgcagggtccctcattcggcttttctctgagggtcttctctgctttctgcttttcttgtggaccaggctttttgctcactcatcaatcaacatgcacatagtttaaaagactcaccttctgtgactttcttgcatctatatgatgtgtagttgttccagtacccaccatattttggctaaactttctggtctgagatgacattctctgtctttcagaaaaaaagagaaaaatgggataatgtgatgaggagtggctgccggattggctggatctgagtcaggtgttcacccctgtgcatatgaggcattaaccccatggctcactacccacttggaggtgctgtagatccagcttatctgggtaggggtcacagaaggaacagtcaaatggctgatgtcatacgcagactgaaaggaaatgcattaagcaaatgaaaggaacgaatatggctggttagactgatatttaaatgaagctttgtagtgttgtgacatgtggcattttacatcattcttttaatacaaactctgcataaggttacatactattgatcatgaagaacttgatttttactccagatatatcatttaacccagcattcccattactgggtatatacccaaaggaatataaatcactctattatgaagatacatgcacaagtgtgtttattgcagcactattcacaatagcaaagacttggaaccaacccaaatgcccatcaatgatagactggataaagaaaatgtggcacatatacaccatggaataactatgcagccataaaaaggaatgagatcatgtcctttgcagggacatgaatgaagccggaaaccatcatcctcagcaaactaacacagaaacagaaaaccaaacaccacatgttctcacttataagtgggagctgaacaatgagaacgcatggacacagggagaggaaaaacacacatcggggcctatcgggaggggtgggggagggagagcatcaggacaaatagctaatgcatgtggggcttaatacctaggtgatgggttgatgggtgcagcaaaccaccattgcacacgtttacctatgtaacaaacctgcacgttctgcacatgtatcctggaacctaaaattaaaaaaaaaaaaaaaaaggatcttggttattacagatgcatctccttggatttgcttatattctttgtgaggggaagagactcagaccatatacactatgatttgttctgttgctgattacttttataacaagaccactggaacagtaaaaagggctacaataccctctggtgaacaaactgaggcaatgctcttgaaccaagagaaccagaaaaggcacattgatgctctctaatggttaagtgacaagtacaagcttaattgtccaatgatgtgacagttgcccaatgatatgtggtacaaagagtcagggcaagagatatcaggcaaaatctaaagacaagacttcagaatcatggaatattacacatagcagggactttggaaatcagctagcccaaccacctcattttatagatgcagcaattatgaccgagagagattatgtaactggaaaggccaaggtagcggtaagccaagtgtggaacacagatcttgtaaaactcatgcctgggctcttgttaggatctcagtgcatcttgaagctaagtcagactttgactctctggggagcccttatagtcttcctataaagacagaaactaactgctgaggcttaaagatataaaacaaacaagaacaccaggcatggtggaaatcaggacctctgtttattcagtcggtcatctgctgattgagtgggtctgttcaatcgtgcatgtagccattcctctatttattaattccttggacatgtattagctgcttcactgtgtggttcactgctaggcatggagagtgtaaagagagatgattcctactttctagaaactcacattctaatgggggacagatgtctctgccaatgtttgtgatgtaatgatacctcaaagggaaagtgattattaactgcttggatcttgaaaggtgaatgggagaatcaaggattgggagtggacagtcaaagcagatacagctttggtctgtggggcaagtgaaatgacacgagtatctagaaaattctaaagttctgtatggttgggatgtaggggtcacctagcagacccgtgagagatgagataggagaaatagacaggagccagggtacagaaggccttgcagttgaggaggcattgattgcttgacttcaatatactatgaagtgctgccgagagagggtttcttccagcagctagattagcatcattttgtattttagactcaactatgcatctatgtcccttagcaacaggtttttgttaatattctgagctcagaatggaatggatagccaaattggctttgaagagctttcctctggcaaatctacccctaaaagataccaacctttacagagaagagagtttgcatgggttgattagtactgaatgtagttttctttaactaccatttgatgactcaactcataatgacattttgttggcatttctccaacttgcacttgcctctgttcaacagggcatgccttgaggtctgattatacggttttcattcatacgacatgtctccccctctgctttttgtaacttaacattcctgcctgccaagaacgagggagcttgctggctctccccattggcctcttccatgaggtcatgtgagtgctgctcactcacatttgagtgcctgccactctggaggttttacagaacagaaaactcagcctctgtgttctagagctggagcttctgggcctttggaagtcagtcttaatctctgaaacaggagagtgctccagggttccagagtcttacaaaagtgcaggaaaatgcaccaaggttatgataaaatgcaaagccacacctaacatgggctcttccaaatttcataagcagttcacattattttttatttttccactttcttttttttaatcttgaaatttccaaagtctgtatccacagccttgcatagttcttagcaacaaacttagcaacaaatcagagaaaaaaattagttatctatatttttaacaagatctgtgatctcctccacatcctctaaccgccttgggcctcagtttttttgtctgtaactggacggtcactacatactattatttaaagaattacctaatttgattaagaaaatccattaagcccaaaaaatgtgaatacagagatagggtacaaaagcaaaagtgtaaaattaagacaggtgaatgctagcagatgaaataactcaaacattttacctttcctgcactccagttgggctcaaggatatcatccatgcttttgtttttggttgaagcttgaaaaaataaatgacttaaaccatattctaatagtaacctgaatttatatataaaactgacccatgtttgttttccaaaatgcatttttccattttcactctgctaggaataaaagataaacaatggagatagaggaagaatggcctttgaataagaattgtaaatgcggccaggcgccgtggctcagcctgtaatcccagcactttgggagtctgaggcaggcggatcatgaggtcaggatttcgagaccaacctggccaatatggtgaaaccccgtctctactaaaaatacaaaaattagccaggtgtggtggcacatgcctgtagtcccagctactcgagaggctgaggcgggagaattgcttgaacccggaggtggaggtggttttgagccgagatcgtgccattgcactcctgcctgggtgacagagtgagatcctgtctcaaaaaaaaaaaaaaaaagaaaagaaagagttgtaaatggtagaatgtaaaattaagaaaggttgtgaagttttcaaggaaagaacagcattggctttgtgagttggtttagatctgatgttagtaaaagttaaaaaaaaaattttcttttcttttttagacagagtcttgctctgtcgcccaggctggagtgcagtggcgtgatctcggctcactgcaacctccaccaggttcaagtgattctcccgcctaagcctcctgagtagctgggattataggcacccgccaccatgcctggctaatttttatatttttagtagagatggggtttcgccatgttggctaggctggtctcgaacttttgacttcgggtgatctgccctctgtggcctcccaaagtgctgggattacaggcgtgagccactgtgcccagccgaaaaaacaataatttcaaatatgttccaatcatttggaatcgatttaaaataaaaaaaaaaaaaacaaatgtgctgccagcattagattgttagactgcaaacaacactttaaaagaagtgaacagctgtcacacttctctgtcctctgtagagatttagctttggaaagataacaagtttgtaaattaacagatctcatctaaattccatccttttcctggagcttctgctatcctaatccctcaccctccaagagcacagccctttgatttacttgatccaaagaacttttacttcctttcgctcactgctggatatgctaataggtagggttaaatgaaaattgataaaaaaaatactataattatttttgttttataatagtgattgtacagtaaatattttttatatagttttacaaaaatacctatatgggagtttgtgctttggttatttaaaccttggaaagaattttaagaattttaagaattttctatcttgtttacaatgttttatcctcagattcaggctcggtgcctggcacgtagtaggtggtcaacaagtacctttagaataaataaattatttttatcagtatccagggcgagccttatgcaaacttataaagtggactaagttggtttttgctaaattcatcctcccttttctagtctttcctcttccttcttctcataggagaatatcttgtcacacctgcagaatcctcatgtgtcctctatatagttgaccctgaacaatgtaaggattagggacactgacccccccatgcagctgaaactttgcatataatttttttctctctctctttcttctttttttcttttcttttcttttatttatttatttttttagacactgtctcactctgtcacccaggctgctggagtacaatggtatgatctcggttcactacaacctccatctcccaggttcaagtgattctcctgcctcagcctcccaagtagctgggactacaggttgctgccaccaggcccggctaatttatttttatttttagtagagacggggtttcaccatgtaggccaggctggtctcaaacttctgacctcaggcgatcctcccgccttggcctcccaaagtgctgggattacaggcgtgagccaccgtgcctgcctgtatataacttttggctcccctaaaacttaagtgtcaatagcctactgttgaccagaagccttaccaataacatacacaattgattaacatatattttgtatgttatgtgtattatatactatgttattacaataacctaagctagagcaaagaaaatgatattaagaaaatcatcaggaagagaaaatatatttactaagcggaaatggatcatcataaaggttttcatcctcatcgtcttcacattgagtaggctaaggaggaggaggaagaagaggggttggttttgctgtcttggggtggcaggggtggagaggaaggcaggagaggcagacacatttggtgaaacttttattgaaaaaaaatccacatataagtggacttgtgtggttcaaacccctgatgttcaagggccaactgtatatgtatatatttttattgtggttaaacacacataatgcaaaattcaccattttaatgattttagagtatacaattcagtggccttttgtttattcacaaggttgtgcaatcatcaccactatctaattccaaaacactatcatcatcacagaaggaagccctgtacttattaaggtgttgctcttcaacccttcttcctgcagtccctggaagccgctaatctactttctgcctctttggattcacctattctagatattcctataaatggaattatacaatgtatggccttttgtgtgtgacttctgccacttggcaaaaagtcttcaaggttcatccatgttgtagcatgtatcagtggttcatcccttttatagctgaataataattctgttgcattgctttaccacattcttctctttatatttcctatgaaaacctagtatctggagagccgctgaaaaagtagccaataaattacacgtaagtgtagctaatagaaagtgagttgagaactcatccaggggaatgtgtgttgctcctgtggtggaatctcagggatgaggaaacctttccgagggggacaggagactttctggtgccacatgaatggctgacttgttgtaaagctaagtctaccaatagctatgggactggaaaaagcattgcattgagtagatggacacacaggttttgattctggtttagatgtaactaattgggttgcctgcatttccatgggtccaatgtttctgcttgttgttttggttaccttgggtttggctttctatcaggccttctgctaagctcatttacatgcattatctcatttaattcttcacaaaaaattatatggaagtcatagaagactaaatacaatagctgaagttttactttcagtgaattgtgagggagagattcaaactcatatctgactctctttagcctgagctcataatcactatatggtaggagctggcaaactatgaatctctgcatttttttgtacatcctctgagctaaaattgttgatacttttattttttttctttttaagatgtggttttgctctgtcacccaggctgtaatgcagtggcaccatcttggctcacttggcctcccaggctcaagccatcctaccacctcagcctcccaagtagctgggactacaggtgcaccaccacactggactaatttttattttattttatttttgtagaaatggggtcttactatgctgcccaggctgatattgaactcctcggctcaagaggtctttccaccttagcctcccaaagtgctgggattgcaggcatgagccaccgcgcccagctggtacattttaaaatgctttacacgagtcaaaagaatattttatgaacctgaaaattacatggagtttaagtttcagtgtctataaataaagttttattggaacacagccctacttgcatagctctgtgtttgtactgcaatgatagagttgagttattggcacagaaactctttggttcaaaagctctaaatatttactatctggccctttaaagaacatatttgctggttatcattcataaaatggaggcagagaaagaattaagtcattcctcaggtccctttcaacttaaatgttctgagaattgcagagaaaattgcttacatcttctgttttcctatgaggtctccatctctccctgccctctctcattctcaacagttgagtttgcctcttttcttaaaaagattgagtctatctaaaatagatgcctcatctccagtcatacatccatatgctgacttcccatctctctctctgtatgtgtcctttcatcaattctcgatttcctctattctgagaaataacaatattaccatttattagatgcctgagatttctagcattctacagagttgtgaagaaggttcagagatgataaatgtaaggtcaggcttattatttccatttctggggtgagggagttgaaggttgaggaggtcaaattgcttttctaggttgtgtcaattagtaagttgtggtgccagagtttgaacacgtctttctgatcaaagggactttacttctcttgtctgatgttatctttgctctctgtgcaccaaaagccatctcctccacaccacactccaccctgttcttctgtgtatgccctcttgatttcttcccttctttttctaatcatttcttttggtattaagtttgcctcctgagaacaacattcccttaggccagctcgtcttctagctaaaatagctactttagctgctaagaataggaatagcatttcttgagccattacattcacacaccagacactgtgctaaatactgtataagtgttgtctcatttaaatttcataatagttttacgaagttgctactattattaccattaaaaagggggaaaccaagccttggaaagggtaagaaattatccaagggcatatagttggaaagaatctgaatagagacttgaaccctctgtactttctttttttttgagatgaagtcttgctctgtcacccatgctggagtgcagtggcatgatctcggctcactgcaacttccacctcctgggttcaagtgattctactgcctcagcctccagagtagctgagattacaggcacctaccaccacacctggctaatttttgtgtttttagtagagacagggtttcactgtgttagccaggctggtctggaactcctgaccttaggtgatctgcctgccttggcctcacaaaatgctgggattaaaagcataagccaccacgcctggcctagacttgaaccctctgtactttccaatcagtatgccttacttccctatccctaccccagcctcacccaatataactcatctcctcttgtgacttacagtggtcccctctggcttcttccttttcaataccacccattctgttctgcatctcatagtgtgatacttactttctctttaatactaacattgctttcacagctcacctgtgacttcttttatcatttcttttcactttagagaacttcttttagccattttttttaaaaaaacagtagatctgctggtgaaaaattctcagagttgttcttcatctgaaaatttcttgatttttccttcatttctgaagggtattttctctggatatagaattctgggttgacaggttttgttttgttttttttttttcacatgaaaaatgtgctgaatccttctagcctccattgtttctgattagaaatctattgttactcaacttattttctcttgatacataatgcactgtttctttctggctactttcaagattgttttctttagttttctggttactatgatatgttttcattaaatttctttgagtttaaactatttggagtttgcacagcatgaatccataggggcacatgcgtgagtgtgtatatatgtgtgtgtgtgtgtatgtgtgtgtgcagataatatatacctttctcaaatgtcagccattacattcgtgtgttatgtgactataggtatagtaaacatatggcattatacttttatggggccacccttgtgtatgtaggacagaaatgtcatgatgtggggtgtgactgtatttttgtttgtttgttttttagtccctcaattaaccaatgaagattgtatgtctttgaatacttttcagcctcaaattctttctcttcttcttttgagatttcaaatgttatatctgttgttatagtttcatatgtccctgaagattttttttcaggtctattttctctctatttttcaaattgggtaatttctattgctatgtcttcaaatttattgattctctgctttgtatcttccattctgctcttgagaccatccattgagtttttgaattttggttgttgtatttttctagttctaaattttccatttggttcttctttgtatatgcgatttctttgctgagatgtcctcttgtcatttgtttcaggcatattcaaatgctcgttgatggctgccttaaaattcttgtcaggaaattctcacttctgtgtcgtttcaatattgattgtttttcttattcagtttgagatgttcctatttcttggtatgacaagtgacttttgattgaaatctggacattttgtgatatccgattcttacttaattcttatgattcttacctaaaccttatgatttagaagatctcctctgacactaacctggtggctgaaagggggtgctgcctccttactgccaggtgggtgtagacatctagattctccacggggcctctgttggcacctggagagaagggactccctgttactgataggtgggggtgcttcaggcttcctcctaggcctccactgacagttctctggctgggagggagaaaggcacttggtttctactccccatctggcctccactgatgctgtagagagggtggttttgctaccactgaacagtggtagaggtcttgattttttactaggtcttatctgacactctccctgtggggagaggaagtaactttcttctggacattttctttgatttgtgctatctgtacttattgaaaatccatttagttacctttttataaacacagtgctattcttactttcctgttagtttgattattccttctgttacctcgactccttcttcatcttttaccttccaaatgtggacgcttcccagagtggcttttctcttgaggtatgctgttgctctaagagcacttcactgtttccagacctctggattttacctctcatgatggcaacttccagatcttgctccctagatcttgcctctccttggatccttaatcctgatggtctccctccttgaaagacacttctgacttcatctgccaccacttcatacttgataactatcacaaaaaaatgcagttgttttgctttctttatcccaattttgtttccttctcaatttcccaacctctgtccataatagcattgttttcataagcctgtggacattaaatcatctggtttctttcttttcattcacaatatatatcacacagtgaaccacagggatggaagggggaaatccaaaagtaactaaattgcagttcaatggtacagaaagacaaacctagttccctttgtccctttgtctttcaacatgcattacctaaggtgtgtatttagggcaaaaagcacaagttaaatctggttctgccaattgtaagctgtgtaaccttgaatacttgacttaacttcagtaatctcagtttccccatctgtaaagtggggatgatgataatagcaactgcagaggtttgattcaaggatgcaataagtttatttatatgtaatacctaaacatatctggcatctaatagagattcaataattatagctcttggtcttctattaatataaaacagtattttccatcctattgctcagtcccaaaccccagaattttcctgcttgattttccaaggtgttttattgtctcttcccacccagaccatccagtttatattcagcttgtttttcacacccaaacatgcattctttcctctagtcagcctcttatctttatttaccttgaatttattgtacctctctcataccttatgtttattcttagaatgtccatttcccctccttccccttcaaatcccatccatgcatttgtcaggcctcagcacaagtgctggagtcttctgtggctgttcccttctgtcctgatctcttcctctgtgaacttcctttgaacttggagtaaccaagcaatagaccatggcagtgtaaggcgccatggaggctgtgtagttcttcccatttggccaggttacaagcttcaggaaggttatccgacctgtttgtggtagtgttagaccctgccctctctacgtcatataaaatattctctgaatcctatacactttgttatattattgaccattcagttgataaaaatctgagcggttattctacagtagttctctgaggtagttactgaagaaagaaagatgggtaaggaccagttttatgtacttgcatgaagtttgtgccctaggtgccacacttgtcttaccctaatccttgccctagtaagactttcacttgtcttgggagctcatcactggggtttagggtaaaggggttgactgacactctcaaaaccgagggaagcacagtggccacagtagagattccgataatgcagagaaagtagtgataagttggtagggggagaggtggaattaagaaagattcacaaaggaaggggttgttgagctgtattttgaaggataagagttctccagaaagaggaatgcattttagtcacagtgataggcctgggaaaagcaaaggaggcataaacatgtcctgtgtggggtatcagtttgttgctacaactgggatgtgtctgggtgtattgtccttaggatattgaaggacaagagatgatgaagggaatgaccaaaactagatttttaaagattatttcactaaaaagtccatgctcttcttctaacatcccattctgcttccatataaaaggtctgagtagggttggtcctaaaatattttagatgatctaatctcctaggtttgtctttctgtaccattgaactacaatttggttacttttgggattcccccctttcatccctgtggttcactgtgtgatatatattgtgaatggaaaggttgaatggagtcaggaggtttagtggcacctcactgggaggttttaggatagagcagggtactctgctggtcctggttgatttcttggccttgaggatgatttctgggtcaatgagttttttgttaaaagaaacgaattcttaccaattttggcaagaaaaagaatccatcaaaagaatttggtgtagctcactccacagggccagagaactagaatcagaagcaatccagctggagtgaagccccgaaacatatcgaaggaaggggtctggtgcaatataacacagctaccaccagttcaccaaactgctgccaataaagcctccccaaccggatggagctgctgctatcattgtcaagtcccaaaatggatcctttgcagtctctccatgtctgcatcactggggactgattctgaggtttcagtggttgcccagggcccacactttagctgcaatgaatgctgggagatgagtatccagcactttaagcttctataagggatagcagactctgcctcaagaggtggaagagtcaccaaacataaaagggaatgaagatggcaaatgcatgacaaacgtccactgaactctccaagttggctgttgcatacatgccactaactttcatttactggagacttactggaaatccaaagcacattttcttttatttttatttttattttttgagatgaagactcactcttgttgcccaggctggagtgcggtggcacgattttggctcacagcaacctctgccacccgggttcaagagattctcctgcctcagcctcccaagtagctgagattacaagtgtgcaccaccaggcccggctaatttttgtattttcagtagagatggggtttcaccgtggtggccaggctggtctcaaactcctgacctcaggtgatctgcccacctcggcctcccaaagtgctgagattacaggcataagccaccacaccagccccaaagtacattttcatcagaaagaaattttaccaactccgaggtagaggaaggaaacttgactcagggaagttaagcagtggagagaaaactcttgggtcttagattacttcctgacctcaaaagcaaaagggctggctcagccttagctaagtctgtctgtcagtaagctaattctggttcatttaacaaaagtgaaattgtaaatgtggacagccctgccttgatttgtgaacaattttcagaaatcaaagatcaaatcatggataaatgttgtttggttcatattaaaaagttaacaaagaagaatacatatttttcttgttttgtagatgggaaaacttctgcatatttaaaggaagtaacgtgttttgggcttacatgactaccagttggtgaacccaaggctaggaccgaatctctccattttttttttaaatattcttctcactgaaccatgagtatttccctataagaattctctttgggtaacaatgaattgtttctaaagcctgcgtcattaagaatactaaaagagctcctgatttatgtgtaataattgggttgacaggacatacacactacctttatttctcattaatagttatttagatgagagatatggtgcatttctctaatctggcttggaaaagtaaagcttgtgcaggtctctttttcttattttgagatatttatactatcagcttcagtttcaaatgcatcaatcttaggtttagttccaatttacttcaatttattaaaatatgtattgaacactgcataagaaatcaaatgggtacacatacacctaaggagttaagggttttaagcaagaaaagaagtgcttattttttaccctgcaataaaggtattttgggtatgcagcatgttgttttaccagctgctaccttagcgttatatttacttttattgctgtagtctcttctggtgattaatagacaccaggatgggggagggtggatctatcatttggcctaagaatatcaagaatcaagccaataattgacagttttccattaagcaacagaactctagcattctgctagggaatgggaacacaatacaaggatacagcctggatttacattagtcaacaagctttttgagtgacacacagaaagcctaagctatactaaatgttaagagattgaattgctggattaagaatcatgttactcaggctaaatcagaagtaggactggctgagctaagccattttctgtacctcagtttctccaccaatgttgatagatatttactgtattccagagctctcatgtgtatcagctcattgctccttcactactaacctattaggtatgtgttgtttcttcctttcacaggtgaggaaaccaaagttcagggaggttaagtaattttctctgaagtcacagaagtagttaattgcagagtcgggatgccaacttcgatcaggggcactctagagccactcagtctcattgcttctgcttaccctgccttttgggtatcatttgagtaccccccacagacgccaaagtacatgcacgaacgcctcctccacccttttacaattgctgtgctttgagcttattgcagaatgggtactggaaaacacaattgctagacttaagaataaggttttttttttttttaaaggtattgaattatgcaattatctgaagtggtcattcattggaccacttgatgttgtggatgatttatataactttgtattttattataacctctgtttcttttttttttttttttttgagacggagtttcactcttgttgcccaggctggagtacaatggcatgatctcagcacactgcaacctccgcctcccaggttcaagcaattctcctgcctcagcctccctagtagctgggattacaggcatgcgtcaccacgcctggctaattttttgtatttttaatagagacggggtttcactatgttggccaggctggtttcgaactcctgacctcaggtggtccacccgcctcggcctcccaaagtgttggaattacaggtgtgagccaccacgcccagcctaacctttgtttcttacatacaaaacagtttcatgtagaagtaggtttgggaattggatttttttaatgtcatttttatatttttgagatggagtcttgctctgtcgcccagattggagtgcagtggcatgatcttggtttactgcaacctctgcctccgaggttcaagtgattctccagcctcagcctcccgagtagctggaattacaggcacccgccaccatgcctcgctaatttttgtatttttagtggagacggggttttaccatgttgaccaggctggtcttgaactcctgacctcaagtgatgtgcccatcttggcctcccaaagtgctgggattacaggcgtgagccaccatgcccggctaggaattggaatttgatgattgcatggaaggcagttgagtaaaaggcattggaggaggaaggagatgaagaaagaaagaaatagagcaatggcttagtttgggccattggggcattcagaagggtgagcattagtgggccagggaagagacagttaatgaaggtgtactaggagtgagcaggagctgagggacgcttattcctagcggggagcctgtgctggggagacttgctgaaggagagactgggctgagtccaggggagtgcagaactgccagactgttgaggtcagttggcaaacagggctgtttcaacccgaaattgagaggctgcatctggaatacagcagaaagaggactgagccgttcttggggtagagatgaagggaagtcagcccgttagcctgggactgaaacagggaggcatctttaaatgcctcttctatcaataaaccctgacagactcacctaaatattgttacagcgtttccctaatttgtcttgttgtttctaatgtatatccccaggaccccttaccccactagcaatggctcaattatctagccctgtagggaaatattgtaatatggttttgtttttgttttttttttttttcaaattcaagtttagttttctgagtgcagaggcctaatttgactctgtttttcactggactctttctaaaaaatcactgtcttttttttcttgtcacttaaatgtagtctaactttttatttaggaaacacagtcattttgcttgtctgcagtgcatggagagtccgttaaggttgctaaggtgcggacctttctgttcccagcccgaagctggaggtctgtggttcccccatggctgtcttgctgcttgctgccgagtctgcccatcactgccttggcctcactcccagttgcagccggccctggccagggctcttttcattctccattgtattttctttctgcttttttttttctcagccacatctccactcttgaccccctgtggctcactcttttagccatccccaggtaatgagaaggctccttctccctggtcagtgaactgattgtttgcggggccggatgtcctcctgctgctttaactcatcctggcgctttgcagcattgctcagagggatttgtcttcattgccggaggtggagttgcctttcctttttcgcctctcttttcttctgtccttgggattcatggcatttccacacactgaagttgttaaaaataaaggcttccttgacaacggaggtgttagtaggtgtagggctggctgggtgtagctgttgcaggtgatcagccatgtgtggcgtgccaaggttaagggcaaaggccggcactcccgggttacagtctttgaaagggatactaccgatctttcgatgacagtggagaaaagctgtaaaggagcgtttttctctttcttttagcattatgaagggcatggattttggagccaggctacctgggttcaaatccctgctcttccacttactagctgtgtagtcttaggcaaattacttaacatctctgttttttaatctgtaaaatggggatgatactggtatccaggacatagagttaatactagtattatatgctatataatatacatcatataaatgttacatataatatatagtacataaactatacatagatagttaatatatgtaaaggctttaaaaaagaagtggtatacagcaagcaggtgctgtggaagagtttactgttatttttctttgttttgcagaagtttttttgtgtggggaggtatatttgagttaaaagcagggatgattattactcctcagagtcctctgaggtgttggttgtcctttctttcttttttctttctttctttgtctttctttctttgtctttctttctttctttctttctttctttatttctttctttctttctttctttctttctttttctttctttctctctctttttttttttttttttttttttgagacggagtctcgctgtcgcccaggctagagtgcagtggcgcgatctcggctcactgcaggctccgccccctggggttcacgccattctcctgcctcagcctcctgagtagctgggactacaggcgcccgccacctcgcccggctaattttttgtatttttagtagagacggggtttcaccatgttagccaggatggtctcgatctcctgacctcgtgatccgcccgcctcggcttcccaaagtgctgggattacaggcgtgagccaccgcgcccggcctctttctctctttctctctttctttctttatctttctttcaagatggagtctcactctgtcacccaggctggagtgcagtggcgcgatcttggctcactgcaacctccgcctcccaggttcaagtgattctcctgcatcagccttccaagtagctgggactacaggtgtgcactaccacacctggctaattttttttttttttttttttttaataattttagtacagacggtgtttcaccatgttggccaggctggtcttgaactcctgacctcaggtgatccacctgcctcggcctgccaaagtgctgggattgcaggcctaagccaccacacctggcctttctattcttattttaaagatacagcattttacaagcagtaggcactgcatgaattcatgtagtttgatttaaaaatgaatcacaataaagtactcggcttgactctgagtctgaggcagtagcatccgaaaaggttggtctccaagttgcctggccaggaggtaaccagatggtgcacctgcaccctccccttggaccagcaaaaattgctcctgtttccacaagtgcttttttccttgatacagagacccttgggtttgggatgaagccttagaggtcatgccctgtcccagccttcatccatgctttgcctctctgaaacaatctggaagtaggacgtgggaggtcaaacttatgattcacatttggggcaacggaatgtcttttccttgagacatttttaagacttgtacttcatgataaagttgagctaggaagtggggccaatttttttttttttttagtttattcattaaacacatctcatgagtatactttttgccagttactaaaaatataaataagaccctgccctcagagtagttacagtctagacagtagagttttgtaaacagaaatatgtaataaaatataagaagagcactatgatagaaagtatttatgacacatgcagacacacaaaaaggagggttctgcttcacctttgagtgaaatgggatgggtggaggtgaatcctgaaaatgtttatggaagagattttatgtgagctggatccagagcattgagtaggtttgcatgagtcagacagggaaaggaaacatactctagacagagaaaacagcgtgaataagggcacagaacctcagcgcatcctggaggtctgagatttgcaagaatttgtcatggctgaagcgaaggcaaacaattagagttaacaatagcgaatggtcaggggctatcagtggtgtgctcaagctggcttgtgtctggcttatgggaactgggtattaaatagccagtcattttgcaagccggttgcaagccggtggtagctggagatcaacagtggtggaaatatttgcaccgtggaaatcagcaaatgctacacattagggccttctctccccaccccacaaaccaaagagctgctttcgcagcagatcactgattgtgaccccttgatgcgactctaaaaattattttaggactcttcagtgcaggcgatgagaagtgaatgtggaaaggttggcagggaagaaacatggtcaggtttgtaatctagaaagacagctctctgtttttggtcttgcccttcaggaaagagacccaagaggggagatttgcatacaggaagtttactggggagtgttcttgggaccagcatttgaggggacgctaacaaagcaggtttgggcaaaggaggagttgaatgaggaaccagctgtaacagattcacctggtcccacagggaagctttggaggtggagtggccctatccagagaggcagagaggtcaggcctttatacccctgtgctgagcatgactggatacaggctgcccctgcagaggggcacataaccatagtgaagtggttctctttccctgagggcagttcctggagaaggctcagcaactagaggagagagtgcctcaggctgaaggtgattctggtggtgcactccagcatgcactgcacaccgctggcagtctggagaatgtatgagatccctggaggtgggtggcaaggaggctgttgggagtgtactgtaatagtccatgttgaagatgatgaaggcctgagctaaagtagcagcggtggggatggaggcagtaggaatgcggcaacaagagtgtaggtagagtctatggacaagttcccctaacgcagtgcttctcaacggagggtgggaggttacccctagggtacatttacaacatctggaagcagtttaggttttcataactggggtagggggagggtgttactggcatctagtgtgtacaggccggggatgctgctgagtatttgatactgcccaggaccatccccacaataagaatgggcaagctcaaaatgtcagtagtactgaatttgacacattctgccctaatgatattaggagtaagggaaaggaagtataagatgcctaccttctctgttcctgccttggatgtctgagtattgaatccacaattcattaccagatagctaaagggaagataataatttacaggtggatagagaagagacctttcatcttgtaagcaaatgcgtatcacattgtttttaaagccctacctgcctcataggaaaatttcaagaaatctagataacagtagattcacatgtctttcccactgtcttccttccagaagattaaagtggagtttcatttctgtttaaaaacacagagataggtgtaggtgaaagcaagcaaataataagacagatgaggggctcttacaatagcctctgttttttgctaccatagtaaaaattttgcaaagaaatagtagaactatggggataattttaaaatggattgtttaggttttagcaaagtagcaaagcagatgatgacaattaaatttaattaggcaaaagcagaagttgattagggcgataaggatttaggtcgtaccaaagcataatataaaatgtctttgtttgcgtcttaacattggcatattcaattatagtcagttggtgatgactttggtgctgtctttcatttggccgaaagctggttattgcatagagtgacagcctcaaccaggtgctctgtgatgtccctgtcatagctaagaagccaacaccatttaagcgttgggacgaagtgactcatggagacactttgccttttgctgggaattacctgatgacgcagagcaggagtttggcaggaacaggagtgcagatttctgggataggcactagtgggaggagaataaaagggagatgcattaattcctggtatgacaaactacgtgatagaactagagcagtggtctgaaaactttttctgtgaaaggccacatagtaaatatttaaaattttgcaggccatacagtctctgtggcaactctgctgctgtgaaggcaggcagatgacaggcaaatgaatccaagtgctgcattccaataaaactttatttaccaaaagaggtggtgggccagatttggcccttgggcagtagcttgctgttaggtgtacttgaaaaaatgattttgctgcacttaaaggaaggtgtggacatggagatgtaggttcgactgtaagactgatgattaagggggtcaaacacattcattttctttcctttattttggcctctttctcctgctcacctctctccttttaagtaatttagaatgcatatgtatgcatatatatttgaattgcttattgattgataattttctattcttttttggaagtcttgaatagtaggagaaaccttttctagtcctctcttttagccctttgtaaatgcaatttagcaatttttgtcttgggtatagttcttagttacattttcttctacttgccattcaccttgggtgtaaattacaattacctgggaaacttttagacatctcaatgcccaggctgagtttggaacaattaatcagaactccagggatagcccaggcatcattatattttaaagcttcccgggggattccaatgtgcagccaaggctgagaatcacgtccttggatttaaagaagaaagaaaagtcctgaacatttgctttagatgctggaataaagaaggaaatttacccatgtaggtaacctttatggccctccagttatagccacaaacataggagttttcagattttaaaggctattttcagaaaaacgtatttcctagtgacacggtcaaaaactctttgttgtggtttggtaggagcaataaaagaaatatcaggaagctattgggatttgactgatgtctatatttctagccagaagcgcttcctccatcagtgagtgtggtgacagcctttgagctttgtgaaagcttccaggttccagtgattaagccattactcctagaagccagtcttaccagagaaaatgatcagggcagatgttctcactgtgtccggagggcatagccttctaacattatcatgggtgcatacataaatgatgatatttctttctttctttttctgagaccaagtcttgctctgttgcccaggctggagtgcagtagtacaatctgggctcactgcaacctccacctcccaggttcaagtgatgctcctgcctcagcctcctgagtagctgggactacaggcacgcatcaccatgcccggctaatttttgtatttttttttttttagtagagatggggtttcgctatgttgaccaggctggtcttgaacccctgacctcatgatccacccgcctctgcctccaaaactgctgggattacaggtgtgggctaccatgcccagcctaactgatgatatttcttagagataacctatttgactaagctaaaggtaatttttgttattaaggcaacataggacaattcaaaaggtaaattcaaggactatttgataaaaatatgtggaaattcatttgaagatatagatatgggtataataatattttgcaggtaggaacattttaaagggatcttatggcattttgcttacaaacatcgttcttttcgttttacaaatagaaggtctaatcttatgacactgaattgctcaagcatttaataggctaaatttcaaagacttagtgctttctttcctaagcaagagttggagagtcattcttactattattatttttttttttttttggtggaggggaggtaagggtacaatgttctgaagaattttccagctaggagcaaactatttttaatgcctattgcaacttcccaagctccattatattggagatatgagagttgcttcatttagtgagggataatggaaagagattaggattctgtccactgcatgtaaacaaacacccaacaaaagtggttgcaacaatagggatttattacaccctttatgaagataactggatttatactgttccagggctgattaattcagtagtttagccatgccctggtgagggatggtatccctgcaattcctgattacctgactttttctttctggtcacaggagggctactgtagctctaaatatcatgatgtaatatgacaacctcgaaaggcaggaagagaggacagtatttctcccctgagtctcattatttttaatcaggaaggaaatcttttcaggagctcccagccgactttctcttaggtttcgaacctggagcccaaagctgtgtcactttttcattctcaaacctgtcctgtcaaaggcggggcattatggttggtgtaaactagggattagcaaactttttctacaaacagtgagatggtgagtatttgaggtgttgtgggccacatatggtctctgcatattcttgtttgttctttttccctccgcccttaaccctgtaaaaatgcaaaaatcattttttggagcttaagttctaaaaactgatttgtttagttatagcatgaccaaccctgcagatatgcctgggactgagtgggttcctggactttcagttttttttttttttttttttttttttaagacagagttttgctctcgttgcccaggctggagtgcaatggcgcgatcttggctcactgcaaactccacctcccgggttcaagcaattctcctgcctcagcctctcgagtagctgggattacaggcgcgtgccacaacacctggctaatttttgtatttttaatagagatgtggtttcaccatgttggccaggctggtctcgaactcctgacctcagtagatccgcccgcatcggcctcccaaagtgctgggattacaggcgtgagccacagctcctgtcctggcctttcagttttaaacccagaaacatccagagcaaactgggtgtagttgatcatcctgtttagtggaccttctaggaacctggctgtggctggtctggagcggtgagtgcctatgcttcgggcctctttggcggaaaataacacctgtgtcttgagatgtctcttctgttccattacagagaagaaacttggttagggatggcctggggtttgtattgagtcttattttaaagtaaggcaattttatgtctttagaacttcaggaaatcattgattctagagattggcttgaattacccttctccattgtaattatcagatattgaaactcattagagtttggtctactcagagctacccaactgtgacgttcataaggtggatggtaattggagggtgaggtgttgttgtgtacagagatttgcttgactggatcaattgttttctcagtggggtctaggcatctggtgatgtctgccctaagtgatttttccccactggtctgtcaccactaaaccctgttatttctacccagagatgtctccccacctagccttcctccttcatcctagttaattgctttcttgtgggtattgaccatttcatgagtactcttaccccacctgcccttatctagagatgtttttcatcactctacaaatccctgccctgcactgctgctgactatcttcctacaacacatctgtccccacgcttccgttttaaagttgtccctgctgcttcctttggacacttccatttgactgataaatgccagcttcttagcttggacgccctacctgacctactgcttcacggccgtgcatacggaatcctctcacaacccacgtttttgcatatgctgttcccttctagaacatctccttttccttgtggaaccatcctctctgatctaaatcaaatgtcttctctgtgagacctcctcagcaagagttcctaccccagagagacttcagcatctctctacaatggtggtttcttctgttgaaggatgcagcttgggatttagcagatcaaagcatggcccctgctagtccttctaattacctttgtgcattaacaggaagcatttgaggaaggactcccacgccagcaccattacactattttccctgtcttatctgatgcctgtggacacgtttatcccctaggttgagtggtatttacctggaaatcttcagtgtttggcccacagttggtatttgtatgaatgtctgaatgaacataggagctcaagttggaattttcataggggatcctcttcttattaaagtctgtccttccctgggggcttgctactccaagtatggtccctggacttgcagaccagcagcctggcaacatcagggagcttgttagaaatgcaggcttgcagctgggtgcagtggctcacacctgtaatcccagttctctgggaggccgaggcaggaggatcacttgagctaaaaacaaacaaacaaacaaacaaaaattagctgggcacggtggcctgtgcctggaatctcagctattcaggaggctgaggctggaggattgcttgagcccaggagatagaggctgtggtgagctatgatcacactactccagcctgggtaacagagtgagatgctgtctcaaaacaaaaccaaaaccaaaacaaaacaaaagaggcaggatctccaatctcaccccagagctgctgcatcaggatctgtcttctagcaatgtctgcagaagattcctgtgcacattaaagttcgggaagcactgctctaggctggtctcaaattatggcccattactacctataacacaataccttagaattaagggagtcctaacaaaattgcaactgcctttcttccttccttccttctgtccctccttctttctttcatttttttcttggaggcagaatcttgctctgtcgcccaggctggagtgcaatggtgccatctaggctcactgcaacctccgccttctgggttccagtgatcctcgtgcctgagcctcccaagtagctggggctacaggtgcccgccatcaagcccgctaatttttgtattcttagtagagatggggtttcaccatcttggccaggctggtctcaaactcctgtcctcaagtgatctgcctgtctcggcctcccaaagtgctgggattccaggcgtgagccactgcaccctgccgctccttctttcttaaaatgtacattcaaggacctgccctctacctactgaatcagaatcccagtggggagggccactgtattttaaacaaatacctcaggagattcttatcaccctgaagtataaggaccacattccagggcaaattttaactctttagttgtctctgattttccccaaaaccgtggactgaagatgctcaccttcaaaattagtgttaactctgttgtggtctatacccatctacctttccagtttccctgttgctgttaatagcactatcgttctcctactgtccctagatttctacctggctttcattcccattattgaaatactcttaccttgtgcagtgtctccacgtttcaggaaagaaaagaagaagtttttgttagcatctgtggccttttctagtaattgtcctgtttctttgcaggtgttactttcctgtcaagttcatggtgtgtcgcccctgtcctcgttctctgttgtagtctgccttctcttcccacttctccaccaaaactcttctctcaaaagtcaccagggacttccttattttcaaattcactgaccttttggagcacattaaagcaaacctcttagaggttggcaaccttataaaaaaatttgtatttggttctaacctcctttgctggtgtgcaaagttgaacatgaatagcaacctctaagccagagagaaattggatcttactgtgtctttacttgccagcccccagggtaggaaagtagttggtcactgaaagtttttatacttaaaaacgtgttttacaaattcaggtttactgtgattttttttaaacattaagctagttattttaatttctaattcctttgattactgaattccttcaggcaaataattgcctgtacttttcttgtgatggttaatattatgtagttgattctaactagaattttcccttgttttctggaatgcacccatattcagagtaactaaataagtcattatctttcctttgagaatatgggaactaaatctttacaattcaaggaaaagagaagaacttagattaaaaggaaatagaataagaaatacatacactggggatcatgcctataatcccagaactttgggaggccgagataggtggatcacctgaggtcaggagttcgagaccagcctggccaacatggtaaaaccctgtctcaactaaagatacaaaaattagccagatgtggtggtgcgtgcctatagtcccagctactcgggaggctgaggcaggagaatcgcttgaacccgaaaggcggaggctgcagtgagctgagattgcaccactgcactccagcccgggcaacagcaagactctgtctcaaaaaaaaaaaaaaaaaaaaaaaaaagaggaaaaaaagaaatacacaagaaatacatagattgcaaggtgtctttcttaaaaaaaaaattttgtttccttcttcgctgcctccttccctcccttcctctttttcttccttcctccctttccttcatcctgccttctgccttccctttctccctccctttcttctttccttttcccctccttcctcccttcgttcctctttttcttccttccttcctttccttctccctgccttccaccttccctccctccctccctccctttcttctttcctttttaccctccttctctcccttcctcccttcatctttttctttcctccattctttctttttacgtattcatcagacacatcccagatagcacattaggctctggggatagagcaatgaaacaaaagtggccccttgcctttgagatgcttccagcttagcatggggcagtcctgtcatcaaataaacataacagattgctaaacatactgggaaagtcagggtccagtggtgaggggagggtgtcatgaaggtggggtacatggagaaagggtggaaactcatattagaaggacaggtgcttgagctgaatgtcaaaagtttgcaccattaggaagacggaggtatttaacgcactgcagatacatgagcaagacccggaggtgtgaggttacctggtgcagctgaaggagtattgagagatgaggctggggcaagcaaggaggaacgtgttgggattttaatgtgggaagtagcatgaacatatgtctgtgatggaggacagtggataggagaagtttactcctcaaaaatgagagatcagtaagaaaaccagtgcaaaagtctagctaagacttgttagaccagggcacagtattttgttgttgttgttgggatagggtcccaatgtgtcaccctggaatgcagtggcatgatcatggctcactgcagccttgacctcctgggctcaagtgatcctcccacctcagcctcccaagtagctggaactacaggggtgtgccaccacccttggttaattttggtgtttttgtagagagggggtgtccccatgttactcaggctgattttgaattcctgggctcaagagatccacctgccttggcctcccaaggtgctgggattacaggcctgagccaccatacctggttggggtgcagtattaagaagtgacatagagtggtagaaacctggagaataggttgccgtgggtgagccgcacggggaaagaataggctgaagacagaatcaacctttgatcaggaggagtgaaggaagagctccttagagaagtaggatgtgatacagattcaaaacactcaatatccctttctgactaacaagaaagtcctttttctactataaaaagcatatagtaaaagatgtgagtggtattcccttattcctttgccttctggagtaactcacagcaaattgactcccctttcaacaagacagctcttgaaatgattgaaagaaaactctcatgactttccttaatctcttcctccctggtttatgtactcctgggtgtcctcactgctctgtatgtgacatggtttctaaaccactcacctgccctgtgaacatagccagcagcacgtggtcccgatgcaatggaaagaatgagggcagtgactggccctgtcttcatccttttctccttcagcggagatttatttcttccaatttctgcagccaactctgtgggagttgttgggttggtgaacccgaggggtggaagagacagctctgggaccactgaatagcctagctttgtttaggggcatgttttcctgactgtttatggtgcctgacagggttgtttttgttctggggagagctcatttgataaagcaggctgctgagaaagctgtggggctccactttttctggggatatctccaaggccccccagggagctgcgatttagcatcccgcaggcaccccttgctcacggaggtcatctgaggccctttgcatcctcgtcccaagtctaactcagatagtggaggggagagaaactgttgccagcttcaccagcttaatagtagtcaggaaggagttcaggccagcaagattccattttaatcgtcaatcacacattaccaaataaaaaagaaagaaaaagctgcagctgtgtgccactcttcataacttttcctccgtggttggcagtcagattgctttcttttgcagaaaacacgatgtcaggtttagtcagaatttatgtgtagaaattcgcaaggaggcagtttggaaaggaaggtgaaattagtgaggttttagttcgcacttgggacgaattacagacattcgggatggtggcatgcgaaagtatgctgcattttccttctcagcgccccctgcttcatctcatagccctgggcacattgcagaatccttcacaggcagggtttaaatatagcaaggcacaacactggccatagaggacacgagaacctctacctcagttagcaggggacaggttagcacctcctctatccaggggatggactctggtcagctgattggtggcacgtacattattacgagagtaaagagatgcttggctggtctctgtggactccagcacatgcagtccctccataaaacgacaagagaacacagtgtgctactgaacgccactagatctgtattgagccatctacgttttcctctagagccatgacaaagatggtttttcaagtgaattctagaccagccatctaaggagctttaggttcaagtcccatttccaccccatttgagtttgacggccttgggtcaccttctcaaccactcagaactacggtttctttttcaatatgtgtataggccatggatatttttgccctgcatacgtgaccctgtgtgattaagtctcggcctcatttctgggcctctcctgcactattctcctttttcacactccgggcgtcagctagatgttctgcaaagcccttggattttccaccttcatgctcttgttcttgctgctttccttccccttgcccttagaatgcccttttctccatatttgcctttaagaagtcatgtttttggccgggcatggtggctcatgcctgtaatcccagcactttgggaggctgaggcgggcggaaaacgaggtcaggagatcgagaccattctggccaacacagtgaaaccccatgtgaaagaggcccagcaatgacttgtcttttttttttttttttttttgcctttcatgggcagcacgcagggtgctttctggctgataaatccatacggtcaggattggctgactccttcacggtaatgggagatgtatttgacactgctgcccctgctgacctgtgggtgcaccagccaccgggacacctccatgagacacagtgttagaggtttatggctaagaaactgatttgaagtgtgtgaacgtgtgccaagaaaaaatgattcggcttttgttattttataatgttcagataatcaatatgaagcatttttttacattttgctttcacgtacatatatgtatgtgtgtatatatatgtgtgtgtatatacttatatgtatatatatatcactatataatagtgaatatatgtatattattcactaatatacatatatgtatgtgtatatatatgtgtatctataattatatgtatatatatcactatataatagtgaatataagtatattattcactaatatacatatatgtatgtgtgtatatatatacacacatatatgcacacacacacacatatgtatatatatatacacacgcaatcttggctcgctgcaacctccacctcccacgttcaagcgattctcctgtctcagcccccagagtagctagctccctctctctctctctatatatatacacacacacatatatgtatatacatacatacacatacatatatgtatatacacacacacacacatatatacacacaaatacatatatgtatattagtgaatctacttagaaagaattttattttgaaaataagctataaccaacaatttgggaggccgaggtgggtggatcacctgaggtcaggagttcaagaccagcctggccaacatgatgaaaccccatctctactaaaaatacaaaaaattagccagggatggtggcgtgtgcctgtaatcccagctactctgggggctgagacaggagaatcgcttgaacctgggaggcggaggttgcagcgagccgagattgcgccactgcactccagctatacattgcataggctcaccagtacaacaaaaccagtttgttgattgataaataaatatttaaaatattgtatgtttttattttattttttaatttatttacttatttttttgagacggagtctcactcttgctcaggctggagtgcagtggtgtgatctcagctcactgctgcctctgcctcctgggttcaagcgattttcctgcctcagcctcccgagtagctgggattacagtgtctgggtcttaggttcctcatctgtcaaatggagacagtaatagttgattacataattttcatgaagattaaatgagttattgcacgtttagtatagtgctttccccttataaacactcactacttatttttattttttattttttacttttgagacagagtcttgctcttttgtccaggctggagttcgagtccaggctggagtgcagaggcacgatttcagctcacttcaatctccacctcccaggttcacgtgattcttctgcctcagcctcttgagtagctgggactacaggcgtgcgccgccacgcctggctaatttttgtatttttagtaaagatgaggtttcactatgttgcccaagctggtctcaaactcctgacctcaagtgatccgcccatctcagtcccccgaagtgctgggattacaggtgttagccgccgctacttatttttgtaagatgtccttttatctttgatagattatgtacttatttatttatttgagacagagtctcgctctgttgccccagctggagtgcagtggtgtgatctcagctcactgcaacctctgtctcccgggttcaagcaattctcctgcttcagcctcccgagtagctgggattacaggcacgtgccaccacgcccggctaatttttgtatttttagtagagactgggtttcaccatgttggtctggttggtctcgaactcctgaccttgtgatccctccgcctcggcctcccgaagtgctgggattataggcgtgagccactgcccccatccagactgtgcatttatttaagagaataaatattgtgttcatttttacagacccccacagagcctgatgcataatagctccttgataatatttgttgattgaatgaatggtagctattttaatggtcagagccacctggactcatttaagttgcaatctatgcatacgagattggaccatatccaggcaagaattccagattcatcctgtccttgtcagtaccctagttgggttaactgaaatgactgcctggaacacaaagtctttaataaaatgatattactatgctctataaatctataagttacagcctgcccttatttcccttatttaaatttttcctgccctcttgcattttgtatcaaaagcaacctaagtttaataacttcagcaaaggtaaacatttcttccttttgctttaagattcccagtgtatgtgtattcaatcagcaaatgtttgtgaagcgacctactgtacacttggcagcaggctgaaagacaaaaggccacctcctgatacatccttattgctgattttgttaatggtagaggtgacaaggtaggggatgcagaggagggatgtgcccttcctggtgatgttttgtttttttctttttttttttttgaaacaaagtttcgctcttgttgtccaggctggaatacaatggtgcaatctcggctcactgcaacccctgcctcctgagttcaagagattttcctgcctcagcctcccaaatagctgggattatagacgtgtgccaccatgtccagctaatgttttgtatttagtagagatgggatctcaccatgttggctaggctggtctcaaactactgacctcaggtgatctgcccgccttggcctcccaaagtgctgggattacaggcatgagccactgcacccagccctggtgatgctttttagtgcctctaattcttctgagccttttcctccacttcttagaaatatatagacctttggctgggtgtggtggctcatgcctgtaatcccaggactttgggaggccaaggtgggtggatcacctgaggccaatagttcaagaccagcctagccaacatgatgagaccccatcagtacttaaaaaaaaaaaaaaaaatgcaaaaattagccaagcatggtggcgcacagctgtagtcccagctaccagctactcgggaggctgaggcaggagaatagcttgaaacaggaggcggaggttgcagtgagccaagagcaagccactactccagcctgggtgacggagtgagactgtctcaaaaaaaaaaaaaaagaaaagaaaaaaagaaatatatagacctcctctttccacccccttcctctagtagcttgtcctttatcttcccttcctctatggaaaagcatattgtaaattaaagaagtcaaaaatgcaagagggtattctgtatttttacttttactatgatctccgttttcccagaaagtgtgtagaccctccttatcatccctcagctctattccttggcccattcctttctggaatttgtttctcaagccatcggcactgcatcccctccagtggtttgaaaccgggcaagactttgcattccaaagcaaaagtggaaatcagatgctcttagcaatccctgtgaatgccgggaaatcccgtggcattttcttacagaaacaggttatactgggtggatgggtttaaagcattattcacaggactaattgtatgacttggagcagcctcggtttcctcatctttcctcatttttcctcataaaatgacttctactcacttaaggcctgttccaggttcaaagatctaggattcacttatgttatcagttaaataggcttttgttgggctgatggtggaggctccccattgaaatattgtgtatctgggaaatatatgcagagctaaacaatcagattaacgagtgaacttttgatgtaccatctgtttattatggtggttctaccatgaaatctgttgcaaagataatactaacaaagcagaaaagtgcatcttaatatttacatggattacaataagaattggtaatgactcatgaactggtaatctcagcggctcccattctatccttctggttaatgctttacttgaagctgagttttgttccactaattatttcttcatacctgcatcctaggcagtaataaaggggtctctatataaggcaaagaatatggaattaagtaagcgaggtaccatatatgaataggtacaagaagagactgaaacatgttagaatttgtgttttgatacttgtcagggagaactcctgggatgatgttttacctaatacttaatgatatctgactgctctgctctgcagggagcacagccatgtggtgctcattggctgatgtttgttaggaagtgggccatctgtagccaggaaggcttgagataatcaggagggggaaagtgggaggagaatggattgtatggagctgtgaaatgccattgtggtgagtttcctttcattgtgtattgattgggttttctagaggacagctctggactgagtctttttccattttcactgttgctaggttgactgttaagtaatgcttttagacttcttggtgagacaactgagaacatcctggaactaccatactataaaaatgttaatgtgtacatatctatgtataacagtaactcccaaatctcagtttttattcagtcttttccttgaagcttaagaattgagtaagcagttgtttgctggatttcttttcttagtttcgtgttttttttttgttagagtctcactctgtcactcaggctggagtgcagtggcatgtgatttcaactcactgcaacaacccaggttcaagtgattctcctgcctcagcctcccaagtagctgggattacaggcatgtgccaccacgcccagctaatttttgtatttttagtagagacgaggtttcaccatgttggccagactggtctcgaactcctgacctcaagtgatccacctgccttggcctcccaaactgctggaattacaggcatgagccatcacaactggccttggatttctttacctggttggtgcctgaatcttaacctgtttcagcccaagtgcaccccttcccgcattcctagattgcttctcctgtgatagtgttctcagttgttacctgctatttccctagaaggacctttagtgtaattcagagttccttctccccatctctaccatcactaatccaatccaggcccttctcatccttcatttgagcctctgctgtaatctctcaattagttttcctgactccagtttcatcctctatttgacccactctccatctgccaccagaatgactaaggaagtaattcaacaaccatttacgagccaattactcttttcaggctgggataacacagccaacgaatcactgtttctgctctcgcaaaacttagtttctagtactgaaggccaataaagctgtgtacgcaaacataactaatgtgtttataaactgttgcaaaggaaacaaaccaggatttgaggtggaggatgaaagggaaggtatcctttgcgtagggttgatgaacaagggctgtccttgatgatgacatcgaagctgagttcgaaaaggtgcgaagaaactagaagaggaatgaagggagccaggggtgtccaaaggagagaatacagttatgggttcttagtttctgtttctggttgggccagtaaagccccttcatcatccctcttttctgcttatcactagagagagaaactaaaaaccatgatttcaggctgcaaaaagcctaaaacaaaacaaaagaaaacagaacaacaaaaacaacaaaaggcgggttgaacaagcaatccagacagaatgaacagtctgtgcaaagatgtgtaagagcttattggtttcaaagaactgaacactagaagagagtgattaatgcacagagcaattgaacaagtcatgggagatgggatcagaaaaatgggcaagaatcgtgttacagaggcccttgtggtctgcagcagagagtgcaggacctattttctaggggagaatagaccccactttcttgtaattgtggaaatgagatccctgttttcttgctggctgtcagttgaggactgtcgctaggttctaggggccacatgcattccttgagttctgtccccttccttcatcttaaaagcctgcaaggctggtcaagttcttctcacattgcatctctctaaccaacccctctaccttcctcttccacttttaaggactattttgagcccgctcaaaatatccaagtaatcctgatcaatcattaactttaatcacatctgcaaagatcgttttgtcatggaaggtaacatattcacagaatctgggaagtaggacatggacagctttgagagtggagtggatattattctgcctaccacaaaggtagagtcaaatgagaaaagtatctataggggtccaggtgcggtggtgcacacctgtaatcccagtgctttgggaggccgaggtgggcggatcacgagatcaggagttcaagaccagcctggccaacacagtgaaacctggtttctacgaaaaatacaaaaaattagccaggcatggtggtaggcgcctgtaatcccagctatttgggaggctgaggcaggagaattgcttgaacctgggaagcagaggttacagggaatggagatcgctccactgcaccccagcctgggggcaatggagtgagactccatctcaaaaaaataaataagtaaataaagagaaaagtatctttggggtggttgatgaccttgacaagagcttttttggacatatgatggcaaaggagagccacatcatggtcggtggagcaatgaaagcagaagttagaaagtagaaacaatgggcctggcatggtggctcatgcctcatgcctgtaatcccagaactttgggaggctgaggcgggtggatcatttgagtccaggagttcaagaccaacctgggcaacatggcaaaaccccatctctacaaaaaaaatccaaaacgttagctgggcatggtggtgtgtgcctgtagtcctagctactcaggaggctaaggtgggaggatcccttgagcccaggaggtagagtttgcagtgagcctcatcacaccattgcactccagcctggataacagagcgagaccctgttgcagaaagaaaaccataaagtagaaacaatgtagtgtgtagacaactctttagataacttggattatggctggaggggatgtggaatgaactgaagcatttttttaggcaaatacaaatgatgtttactgataagaataaaccaggcaaaagtagcatgatgatgatactcggagcatcaccaagatgaggccctggaatccttcatccagggaggatagatgcttcatccgtcagggaagggaggaaaccctgcaaggaagcactggaatctttcccaggacaagagtggatgaatccagagccagcagagagcttggcctttgatgggagggacatgcccccttgtgtatagaagggaagatggaggatttggatgctttgtgacattgtgatgggagataagtgaagtgccatctcatggcttttattttgtcaatgaagtatgaagcagggcatcatctaacagaactgtgaccataccaaccttgcttcaaactcctcaacggcactacctgcttacctctgtttttgtttcctggtgctgtctgcctagaacttgacactacctcctcacacattctgcctagccctctggacacaccacacctctttgcttttgatggtgtgtttgcttatggcctttaccagaatgccttgcctcttctcactttcccttttaccgtctcccatccccacctcccaatgcacactccttttccaggaaccagccttgaaacacaccctcaccctggctgtttataggggcagaggccctggtgctttcattgtgaaattcacagcacctaggacagtacctgcacacaggaagagctcagtatatgtttttcaatataataacttcattgcaggtaaattaattgattgagcatatatctcaaactatcaaaatagggtaggaaaaaaatgaactgtattaagcggaaaagaactgttgttatactctttgatgacttggtatgatttcattttgctcactctcaaccaccagctttcagtgggctcaagcattcaaaatgtcaactttacaaagtcatgaaatcaacctaagcatccatcagtggttgactggataaagaaaatgtggtgtatatatatgccatggaatactatacagccacagaggagaatggaattatgccttttgtagcaacatggatggagctggaggccattatcctaagtgaagtaactcagggacagaaaacaaaatactgcatgttctcacttatatgctggagctaaacagtgcatacataaagatggaaataatagacactggggactccagaaaaggggagagtggaaagtgggtaaggattaaaaatattacctactaggcgcaatgttcactattcgggtgatgggtacactggaagcccaaacctcatgattatgcaatacacctatgtaacaaactagcacgtgtacccttgaatctaaaataatagaatacaataaaataaaggaaaacaaaaaaacccaaaatagcaaataaaaaattccataaataattcatatgttaaaaaacacaacaaagtgtcagctttaaatctgtattattctgtaggctgtaaagtctgtgagagaaaagattatggttcagccctccttgtattgtcagtacttgacacaaaatataaagcctgtagaaagtattaaaatgtttagatgaatgatttcgtatgatttaaaaattactatctgtttctagaagctgcagtatctagcacatcttccccgcggggatgtccttctgttctgattggcctttagagaaagtagtctgataccaccctgatttttatctctttatccatttcagaggccttgggttattctgagcatgttgatttcaagtcctgtaaagctgagtgacttaacatatcgttcttcaacttggtgtttttaaagagccaaacatattcacacatgctacaaatgcatgctagctctgcatttggttacttgatgagttcaaaagaagctcaaatctcagcattaagcaccatactccctgttacaaggccgcacatgtacccccgaatctaaaaaaaaagtttaacattaacaataataaattacaaataaatatgcatcgttataagcaagatttgtagtgcagtaggtccttgaataatgccatttcattcaacattgttttattatagtgttgatgagaaaacaaaatcggttcccaaccagggccgctgtcagtgtggagtttgtacattctgcccgtgtctgcaagggtaacctctgggcactcaaatttcctcttacatctcaaagatgtgcatgtggattagtgggcatgtctacattgtccccatctgagtgagtgtgggtgagggtgggtgcaccctgagacgggatggcatcctgtccaggttgggtcccagctcagtactctgagctactgggataagatctggccaccctgaactggagtaattggcaacatcattatcttacttgttttattcttttgttttgaaatggagtctcactctattgctcgggctggggtacagtggtatggcctcggctccctgcagcctctactccctgggctcaagcaatcctcctgcctcagcctcctaagtagctgggaccacaggcatgcgccaccatgcccgtctaatttctgtacttttgtattttcagtagagatggggtttcaccatgttttccaggctggtctcgaactcctggactcaagtgatccacatacctcggcctcccaaagtgctgggattacaagcgtgagccaatgcgcctggcctattcatctttcttaaatgtatgcatagcccactttcacttcagtgttaatattagatgtgtcttggtctttatttagaaatctggttattttttgtgatcagaaatatgccgtaggaaacttattcttgtttatattaattagcctgtggtaaaattgatttcattatatgttgttttgcttaaagtcacagttttcaagaaactgttgaaaatgttaagtgagtacttaactgtattttgagtggaataatttgcaactgaaaaaagtttacaaaaataggattaatttctgcagaaaatgttcacagtaaaatgccaagggataaaaatggtattaaaaattatatacacagtatggtcttaattttaggagaaaattctatatctatgcaagcatatatagttataggtttgtgtacaaaaatggctgtaaagtaatacaccaaaatactaatagcagttttgcctgggtagtggaatttgggtaatttcagctttcttccttatacctttctttattttctaaattttataataaatattttctttttgaactcaggaaatctatggtatttatttttcaaggtaaatttttctttaagcatcagtggtaaaattacttttgtccccctccagtgttgaagagtgcaagaaattgggagtcctaggtttgaaatgtttttagctaagaggactagagaatggcagttaatgtacatcaatgataattgatccaggagacgctttggagttgacttaaaatgtaaaaatgtgttcagggttcaatatatctattttcaaggtgttattgatcagatctgtttggtttcatcacctctggcagatgttccagtggtttcttaggagagcctccctctaccctggtatgtgtgatcgtaagccagactttctgaatgcagcttaatgcccaagaccaaaatagactagtgagtcacttggacatattctgaatcaaagatttaaaaaccaaagcatgcaaataaatgctcctaatgccttagctcagagtaaacatcagttaattttaattttaaggctagccaaatggctattgcttaaggcggccagagtgatgttaatgtgaagagctggctccgtatgggcaagggctacatgttttggtgtgttatggtatttatggtatgctatttcattttaattaattttgtgtattctctatgatactaacacaatgttgggcatgtacaaagtgctgagtcaatgacagagaccagagcagaggagagtaatataaagtactgattgatgaggatgtcataggttggctgagtctgccctgcttcgtggcttttgtcttggtttaatcattaatagtatcctcttttactctcaaaagtctttcatttggatgattgttttatagggccactttttgactgaggtggctgagtaaaatcttctagattccatgcgttcatctctgcctgaacagcagttgtctgcctggcaaaaatgtaagagccacacccaaaagcacatgctttttaatgctccctctctccttcttaccctgcgtaatggctgcagttttgtactaagccttttcagatagattaaatggaactgttgaagaagccctagaggattaaagctctggacaagttgatctctttctatgaccacagctgttccagatggtggtaatacttctaggaccctgaatgctgcatttggggccaatgggatgaaatcccaagagcacattgaaactgacaagctgccttgacatttgctctttagctcctaagccatggattcacttcttctttatggcggtttgcacttctgtttcctttattccttcagggactcctgctccatccccttttttctttagaagaatgagaatttaaaaggcagcatgtctaattcactgaggattcagtgccccttaattgccttagaagcctgaaaagtcaggctctaggaataagctcagaggactcaaattgagacaaacatttgtattttgacaaaagctgtgcagtcttctgattcctgccctcaaagcagagtgtaataaatgagattgagaaaacacttgtattttctgaattagggtttaagttcctggaaacctcttgttcttgtttaatttaagattgaaatctgtgttttttttttttttttttttttgagacggagtctcactgtgtctcccaggttggagtgcggtggcgcgatctcggctcactgcaagctccgcctcccgggttcacgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctgggattacaggcgtgagccaccgcgcccggccctgtgtttgtttaaaaatgaaaatggttctaaacttttcttgggtcactgagccctctgagaaaatgatgactgaggattttctcctctcacgtgtgtacacacaaagaacattttatatataacttcagaagtcttatgttgcctattccactctggattgtaggttaatataggagatagttggttgcctttcccatatccatgctctgtagcctgcattccttcttcctaggagaaaccttattatctccaggtagctcaccctcctccatgggatggtgtgtttgagagggggccctggcctctggtcccaggggtggtggggatggaggagaatgattggtctaaaccaatcatgatggtcccctgtctcctttgctagagactggttcagccatgggtatgtgatacatttctcacaaataagaggagtgtaatcctgccgggtagctttgggacaaagtttcatcactcttaagatgcgaaccatgtagtagtatggatgaagcaatctcgaaaccctttttaggtgtataataaggttgagcaaatgagaaaaggcagaaatagccctatggagtggattggaattggcatattggtgtgaattgaatttatgatttctaaaatatgcaagtgaatgcatatatgtgtgtttatgtgcagatgtatgtatgtgtatatttataaatatgtgtgaagacatatatatgtatagtatacatacggtcatatatttcctagctctgcctcttaaaaggaccaagaagaaatgagatcccaataacaatgagaacacctgctacccagattctgacaccattcttcactaaaaaacccctcaaaaacaaaaccaaaaaaccaagctaccttgcagaaattccagggccggggcgtgaatcaaggtgatactggaatcgcagattgtgtttctcaggctagtctcctaactaagcctttaacaggccaatccagtcttcagttaagctggatgcttgtgaatgaggtggtatatgagaaaactcatggagtccctactcatacactcattgctgcacctcctttgacatatatcgatccctgggtctgaagcaatgttgtgtgggatactacactgatagattaggcattcttatgttctcaaatagtggcacttgcagagaccctaaaggcagagaaagcaaacccaaacctggagtacatgtcaatttatgtaagcatgaatttctatctcccctctcctttttggggtggaagtggtctgttatgatcagcctttccccaagggcctggctgatatctgtgaaggtgctatagagattggcatctccctctgccattggttggctggaccattcagcagtggtaatagctaggtcattgctaagagaaagcccacaataccgagcccacatacagcctttatcctgccacctgagccatctcatccatgggcccattgtgctagcactggttgtctgagaagaagactctggctgacatccacaggggagtcatgcattcaaccagccaccactggatcttctcattcacatggcttgagtgacagggcagattgtaccagagcctgctgctgctgagtcctctcctgctttggaccacatttctgctgtctgctaactgaatacagagcttgaaataaagaattgcatgcaagagacttatttgtcaatgtgatcccaaggagtaggagggacgaggggggatgaaatagggaaggaaggaaagccagtacagcggccatgctaggtacaactgatgttcaatcccatcagatcttctaggagactcatgaaatttatctcagcactgtaaggaactaatggggttatcgtctcctgtccatcattgttcattggtcacagctggtcccacatgttttagctcccaggttgtgcatgtcagctgtcccagaagctttcttcaggtgtcggagaagtctgagggcaggagtccagagatagaaggcatctggtacagccaaaaatgaggtgccatcaagttgcacctgtttggaagttggttggaacctctgctggattggaaggctgcatcggggactgaagtgggaggtgagaggagataaattaggagtgttacataaattgtgtcccatgcacacactacactccaaagggtctaatgaggaaaatgcaggctttgaacaagccacacctggctccactcttatctagttgtaatactttggtttatttacctgactattctaaagttcagtttctcgtctgcacaatgaggatatcaactcgttatgcaactgggagagttagcagatgtgacatctgttaagttcctgctttgggcctggtattgactatgcaaagcagcagatgcacagataactttctagtcttgtagatggaagggaagggaaggagatagtggatgagggacgggttcataggaagagggcattggacaaaaatgcaggaaaaagaactcttcataaacagagagtggtgtgcatgtgttacagggagagaggacaggtaaaggtgttaaaggtggcaagattagtatggtcaaagtagagtccagaccaagattgggtgtgttccaggaaatagcgggacttccatttgagtgccttatagttatttcttaggagtggacacagaagacagcacagctggggtaggcgcttgaacgccagtttgaatagtttgaattatacttggtaggcagcctagaaggagctatagacaacttctccaaagactggaaattcaaccaaagaggccagtttgctttctagtttccccattccctcagctcattcaggccacgcaggaagttaccattgcatatgtgtccttcttgtagcctctggggatatcactgtgtaacttactcattccagaagagacatatgggaagatgggggtgggcaggagtagggggctagctctcattcatgttttactttctttctttttttgagaccgagtttcactcttgttgcccaggctggggtgcagtggctcaatctcagctcattgcaacctctgcctcccaggttcaagtgattctcctggctcagcctcctgagtagctgggattgcaggcgactgccaccatgcccagctaattttttgtatttttagcagagatggggtttcatcatgttggtctcgaactcctgacctcaggtgatctacttgcctcggcctcccaaagtgcagggattacaggcatgagccacggtgcctggcctcatattttactttcaaggcgtagtgtatagtgccccgtgctaactaacgtatagtaagtactgagtaaatatttgaggagaggatgagtgaatgaaagtgctatgtatttatctcttccagttcttttcttggtggcactgttagcttatgtggctccttgggtaagacatttgcctgccttgtgccagagccagccgtgagctagcacaggggcgaacttctcttaggttctgaggttgaagactttggacaggttttgagcttagatgcatattgaatgtgtgtgtctccatttttctttctaggtctgatgtggctgtgtttcagcctgtgcttatacagtattcaattcactgaaaaataatgtggttgtgtaaacactcagaaggaagtgtggtgtgaccggtgatcacagcttctgccagaatatctagaacaggatgcattctgcgatgaaagagatgactacaatagctgtagctatttattttataaaaaaaaattcttagccctagttcatggcctacttcttccaagcagtacaggtcaagcatccctaatctgaaaagctccaaaatgtgaaactttttgagcaccaacatcatgccacaagtgaaaaatgccacactcgggtacttaacacaaagtttgcttcaggtgcaaaattatttaaaatattgtataaaattaccttcaagctatgtgtaaaggggtgtctgtgaaacataaataaactttatgtttagacttgggtttcatccccaaaatatctcagtgtgcatgtacaaatattccaaaattaaaaaaaaaattcaaaacacttctggtcccaagcatttcagataaagtatattcaatctgtattaaatgtaacaaaatttcagtaacatgacagaatctgagcaatgacttggaggcttatgtcactgattttgccttactgtgagaatatttggggagctgagcccaggaaatgtacttttccttttgttcttttttttttttttttgagatggagtctcactctgttgctcaggctggagtgcaatggtgcgatctcagctcactgcaacctctcctgggttcaagcgattctcctgcctccaagcaattctcctgcctcagcctcccgaatagttgggattgcaggcgcacaccaccgtgcctggctaatttttgtatctttagtactagagatgggatttcaccatgttggccaagctggtctcgaactcctgacctcaagtgatccacccggcttggcctcccaactctagctgcagagttacttaactcttggctctttcacagtataaagggatttggagaattaatctgatattcccaggttgaattttttttatttgttcataaaatttaagcaaaaagtattttttaaaatcttccagcaattcagggccttatgttctggagagccgagcattctaaagaacgtagcatcatttcctagaattttgcatcggtaccctgagctccttcatgttctttaactttcgttccccagcacatgaaacaccatggcagcaacccttattgcttgtggctacttctacgtccctcctttttttcacaggacattccgttcttctcaccagccctaacctgtttgccacttggcaagcacggggaacaggactctccacagtcttaccccggggactagtttcagcttttcagagagcaaagcttctggtccaacagtatttggaaattgagacaattgaggagaagtagtaatatgttcaactgcagagaatgtagcctttggcatacaaggaggaagctgtcttggcatctgtcattagagccactgggtattttggaaaaagtccatttcattcttcctctttttggatcctgaaacaagaagctatagtgccatcaggaatatagagattgggaagcatgggaatgattcaagtaaacttctgaagaaagcgtacacctccagggtagctaaacaagcagaatgcttgttggggaagcaaaatcatctgaaaacaacctgaatttggaggtaatagaaaaaaaaagttttttaaaaaattttatttaaaatggaaaaatttaatggtaggatgggaaagtagtacttctagcttggttttggattcagacctggatgggaatactaactgttagaacttgagaaaacaatgttagcatctaaaccttagtttagatgaaatgtgaaatgagagaataatagttcatttgtgcccttttgaaagatgtttaaattgtggtaaaacacaacaacatagaattatcgtcttaatcattatagtataattcagtggcattaagtacatccacattggtatgcatctgtccccagaactcttttttcattttataaaactgaaaatccacactcattaaagagtaactccccagttttttccccctcctccagcccctagtagccatcactttactttctgtctgtatgaatttgactactccaggtaccttgtttaagtggaatcatacagtatttgtcattttatgactggcttattttacttagcatagtgtctccaaggttcatccatgttgtagcatgtgtcagaattccctttcttcttaaggctgaataatcttccatcatctgcatgttgtctttatataccatattttgtgtatctatttatctgtcagtggacacttgggttgcttccaccttttggcaattgtgaataatactgctatgaacatgggtgtacagatatctccttgagacccgtgtgttagtttgctagggctgtcataacagagtccctagactgagtgacttaaataacagaaatttattttctcataattctgcaggctaggcatctgagatcaaggtgttattaggattaatatcttctgaggcctctccccttggcttataaatgactgtccctctctatatcttcacatgatctttcctgtgtgtgtgtctgtgtgtccatgtccaaatttcctcttcatataaggacaccattcatattagatgagaacccatcctaaataccatatcttaacttagttacctctttaaaaatgtatttccaaataaaatgctgttctgaagtactgggagttaagatttcataaattttgtgggaatacaatttggcccatgataccccactttcaattcttttggatatatccctagaagtggagttgctagattatatggtaatcctatttttaatttttttaaaggacatagttcatttttatagggtggctgtgagatttaaatgcccgtaaaatttctagtgtagggttggccccagaaaaagttgacttcaattagctgtataaactgtaaagttaactattctgatccctggatttttaggcaaagaaattgagtccacaaaagttaggcaacttatgtcttcaagtttctggttagcatcagattcagaaaaataacctaggttttggcaatgtcaggactgttgataccaccatgcaccatttcttttcagtccttcatagactgttcagttatttgctattaactattttctggcttttatggtatgtgatttattatttttttaaacttagttttctgaataggtactatattcacttggttcaaaaattgcaaaagtttataaaggtttacagtagaatgtctttctcttatgtttatccaccagcaacagtgtgccttccccataaccaactgatattaccagtttctaatgtagtcttccaaagatattttatgcatgtataagcaactccatttgtgtatttttttttttgccattttcttatacaaatggtaatttgtagtcttctgcatcttatttcacttaatgtattttggagatcgtaccacatcaatacataaaaaaaacttctacattcttgttttggctccatagcattccattgttgaatgccctgttcctcatttagccatctcctgttattaagacagttgttattacagacaatactgtgtttaaaaaacttgtacatacatcattttgcatgagtgggagatgttatatctttatatctttagtatatattcctagtggtagaattgctgggacaaaaggactatgcattcataagacagatttttgccaagcgttccttcaaaggactttaccaatttatattttcactatcatcttatggaacttttaatgacgaggagatggcagtagtttccaaatatattagaccaggccctaatttattaatctagtgatgactgtcttcatgagggcttggcaggagtcaaagcaaaaatcagaggacatctcccatagatcaggaacaacataaggatgtcttttcttgcaatctgtgttaaacattgtactgctagacaagaaaatgaaatcaaaaggatccacactggaaaagaagaagtaagatgatctctgtttgtagataacacaaacagatctctgtttgtagatagaaaattctaaggaacccactaagaaaactattagcacttacaagcaagttcagcaagggtgcaggatacaagattaacatacaaaaatcaattgtatttttatacactagctatgatcaatttgtaaataaaatatggtgaaataatttcctttataatatcctcaaaaagaataaaataccttggaataaatttaacgaaagaaatgcaaatcttatactctgaaagctacactgttgaaagattattaaagaagatctaaataaatgcaaaggcgtaccatgttcatgagtcaaaagacttaatattgttaagatggcagtagtttccaaattgatctgaagattaaatgcaattctcatgagaatttcagctgacttctttgcagaaattgataggctaatcctgaaattcataagataatttaaaggcctcagaatagccaaaacaaccttggaaaagaatgaactcggaggaatcacacttcctgatttcaaaacttactgaaagctacagtaatcaagacagcgtgatgctggattaaggatagacacagacaaatggaatagaatcgaaagtccataaataaatccttgcatttacaatcagttgatttttgacaagagtgccaagacaattcagggggaaaggagtagtcttttcaacaaatgttgcttggactgctggatatacatatgtaaaagaatgaattttgacccttacctcccaccatatacaaaaactacaattaaccaaatacttaaatataagagctaaacatgtaatactcttagaagaaaacataggtgtaagttgtcataaccttggatttgtcaacgatttcttagatataatagcaaaaccgtaagcacctatgaaaagataggtaagttagatttcatcaaagttaaaaatttttctgtggcaaagacacaatcaggaaagtgaaaaggcaattgacagaatgggagaaaatatttataaattatgtatctgataaaggacctgtatgtagaccatgtaaagaacctttcatttaatactgaaaagataactaaaaaaatgagtgaaggatttgaacagacattttaccaaagaagatctataaatggccaataaatacgtaaaattatgttcagcatcactgattatcagggaaatgcaaatcaaaaccccagtgagatctacttcacatctaggatgacaattgtaacaaaaacagaaaataacaagtgtaggtgaggatgtggagaaattggaaccctttacattgctgatgggaacgtaacatggtgtagctgctttgagaaacaggttggcaggttcaggaaaggttaaatatagagttactgttggacctagcaatttcactcataggtatatactcaagagaattaaaaacgtatgctcactcaaaaaacttgtacatgaatgtacttagcagcattatttataatagccaaaaagtggaaacaatacatatctgatgaatgaataaataaaaggtggcacaggtattctatacaatggaatattttcagcaataggaaggaagaattactgatacaagctacaacacagatgaactttgaaaatattttgcaaagtgaaaggagccagtcacaaaagtgcacatattgtataatttcattatatgaaatatctagaataggcaaatctgtagagacagaaagtaggctagtagttgccaggggctagagggaagggtagtgttgaaggaaaagagggagtgactgataatgggtatggtgttttttatgtgggtgataaaaatgttctaaaatggattgtgatgatggttgcacagctctgaatattctaaaagccattgaattgtacaattaaaataggtgaaatacatgttaaataagtgaataggtaaattatatctcaataaaggtattttaataagagtcagagtgcaaaggtaatgtcatggaccaactctaaaattaacaattcaaactcttcagtagcaaacattctaaaatctctagaaaagtatcccatactcacatctcatactcacatgtgtccactgagactcgtgggtagttcttgagatgggaaccacttctgagtcattttttttttcaggttttaggatgagcaactttggaacggaggaggcctttagaagaaagaaggaagttttagatcatgcctgcaattcagccttgcagagttgtttgcctgtttgaattttctcttatctctatggaacattgactacttcctcagaagcttatacactgttagagtactgggtaaaatttcatttgaaactacgggaactcctttgctgacctattgtggctgttcctaatgtttcttggcttcatgctgcttaggaccccatgggaaatcttggcagaacaccctgttatacatctatactgagtgcctctcacagcttcccttcacatcagatttttctgtttgtcacccgcttttgccccttttccttcttgtcttaaagagagacatccttcactcctgtctctgaggctacctgtctcctgtgttcttgatcccacgttgtcccttgggacactgcttcatcatttctgtgtacctctctggcctcttttgaccctttccctcatgggctttttttcttggcttgacagttgctcaaatttcccatcattttttaagaaagtagtaacaaatgtacaaaaagtcccaagcatcaaaactttccttagatgtttatgtctttctcaatagactacaatctttttattttctcacagtcaacttttttttgaaaagtctgtgtattttcctatttccatttatgtaaactttgaatgaagagaccagagttacaaagcaaagagccttgtgctaaaattaagtctagaacatatcatacttggaagcattctgcatgtgaaggagaagtggggtggccacaaggaggagaaggcattttctaaattgtttttccacgttgtggtacttgaagcccaacgactgtaattagactcgtattctggctacagggctggatgcagtgagagtgttatttggtgtcccactttgtttgtttatattttaggcattggagaatggaccagtttcttgggggagaaagtaccattcttgagattaagagatggaagttctccctgtacagaaaatgccctgagagagtcatcaagatgtatttggttaagtgtgttcatttcactttgaatgttaaggtttctggcatgaagccagatttcagaatctcagtgatcttgagtgtttagtctagtctgagactgatgagtgttctaccaggaagtgagaagcatcaggttgagaatatcattgggataaggtgagcagggaatccattaagggactaagagccctttactttgatattgagaggggacactgccacacatgatacaaacagcactgatcttgctcagcatctgcaaataaggatcgcagacacaacttttcaaatagtcacttcagccttacccttctgctaaagtaatttatgtcaagtagggaataggcttttcaatgtcatccaaaccccctgcttagggaaggggcattcgtttgtaaacacactacagagctattgaagaatacaaaacttggtgaccttatctgtaaagctggtgtggtacccttctcaaacaccagagcaccgtttagtgagaaaatcagctagtcgattgcccaaacgttttccattttagcatcagaggaaccaaagtccaggaaggtgaaaatatgttgggcaaaggtcgtggcaatttagttttttgattgagtctagatctccctggatagacctgggtcgtgtcaaaacagtttctggtaaacagttttataacctgcctctgtgatccagaagagcctggacatgtgagtagaaagcctgtacagtggatttaatcctggactttttcctttggataccagaatttatatatagccctgacatagttcagcaataatccttacacgagctagtggaaacagacttgtgatgaagagtaatttcagctgaaggactaaatacaattatatgggaaagccgactgcttacatctgtacaagctctgtgtatgtggacaaggtcctcgaaacagaggaagtaataccccatgcagctgtagtgatcattaaattaagcaattcgtgtgaaatgctgagaactgtgccttgcatgtaacacatacgcaataaattctaggtgctattattattctcatgagcaaccacttgttaataagaaggtacctgccagaaacggcagtgtagctgatgggtaacttacagcgttcatttatcccagacatatttattgagcatcacagcctatattgatttgctcctttaatgccaccaaggtagatattggttttcccattttaagggtgaggcttacattaataacatcccaagttttcactgctaatgacgggcttggtcctttcccactaggtctctttttcacagggtcttgttgtgttgttttccaatttactacatataactttgttggagactttaaaatcatctgactttgtatagatatgagtgggtacttccttcagtctttaattctgcttcccaataatgaagacttgtgagaatttccatcaataatatttacttaaaatcaatccaataaaaacctacaacttaaagaaaatcttatgaaattactgtatgcaggaaatattacaaattacctcctcatatttttgattagccattaaaatcagtttgggaattaaagagcttctgtatagcaaaagaaactaacactagagtaaacagacaacctacagaatgggaggaaatattctcaaacaatgcatccaacaaaggtttaatatctaaaatctataagaaacttaattcaacaagcaaaaaacaaataacctcattaaaaagtgggcaaaagacatgaacagacacttctcaaaagaagacatacaaaaaaatgctccacatcactaatcatcagagaaatgcaaatcaataccacaatgagacagtgagaatggttattattaaaaagtcaaaaaatgagatgctggtgaggctgtagagaagaagaaatgcttatacattattagtgggaacgtaaattagttcagccactctggagagcagtttgagaatgtccccaagaacttaaaacagagctaccatttgacctagcaatcccattgctgggtatatatccaaaagaaaaaaattgttctaccaaaaagacacatgcccacatatgttccttgcagcactattcacagtagtaaagacatggactcaacctaaatgcccatcagtaatagactggataaagaaaatgtggtacatatacaccgtgaaatactattcagctataaaaaagaacaaaagcatgttctttgcaggaacatggaggcaagcaagtcagtgcaggaacagaaaagcgagtactgcatgctctcacttagaagtgggagctaaacacttatgtccacttcggtactcgtggacataaagatggcaacaatagaccctggagactagtagaagcttgaaggagggaggggagaaagggttgcataactaactgttggatactgtattcactacctgggtgatgagatcagtccaaacctcagcatcataaaatatacccatgtaacaaacctgcacatgtacctcctgaatctaaaataaaaactgcagttatagaaataaaataaggctgagtgtggtggctcatgcctgtaatcccagcactttgggaggctgaggtgggtggatcacctgaggtcaggagttcgagaccagcctgaccaatatggtgaaaccccgtctctagtaaaaatacaaaattagccaggtatggtggtgcatgcctgtaatcccagctactcaggaggctgaggcaggagaatcacttgaacctgggagatggaggttgcagtgagctgagattgcgccattgcactccggcctgggcaacaagagtgaaactctgtctcaaaaaaaaaaaaaaaaaaaggaaaaaaggaaaaataaaataagtttgggaacattgcataggttacagtgtatatgagactacatggaacatatttactctaatacgtttcacccacatttctgtgatcacataggtggaacattgttctggtacaatagagaatttatatactttttcttgtgctcagtcttcgcaattaactgatttagatatttcaaggtgactgcctggaacaatttccagacttattacctaagactacagaactccacttcttttgacaccctgagttatggcattgcctgaagcaatagttgttaattacggtaatgattatttcttcaggagttaaaaagttagagtttaaatctttctataggactgtggaattttcactttaagggttacgtgaggatctgaactagttaatattgaaatgagtacacttgcatgaaccaaactacagtactttgaaaataagttgttagtttttgtagattagcgttctctttttagaaaatctcagatttaaattttttgattttcttgaagcaatttctttgtctttgctttttaattgggcatcacgaacccttagccagaagtgtcaccagtgggaaatgcgctaagccaggaaagtatgtagccgaacaaaaggcaaaggctactgtgttcttttgctaggctatggtttgcaaaacatgactctcacaaacgtccagcttctctggaaagaaaggtaactagacattgcagaaacagccatggggcaaaggattaaactgaggttttccaggttgcaggatttgagttacagggtaaagaatcttgccatatattttctattattttggccgcggtttctttaccctcttgtttcttgttggtagggaacatgaagagtttcagaattcatgaggaatttcaggcctggggaaagagctgcatttcttccttatgctttttcctccaagatggcgttgagttagaaagacctggaagggggtcagcctctcctccttccttgctccactgaagagcaggaggggactcctctgctaatatccattctttatagtttgcagttaatttctcaactttggttgttttgccttcttatattgtcaaatggagactctgtagatgtttcttgagtccagggattagccagttctttgtttctgtcgccactagcaatgcaggatcacaagatgcttctgaaggccaaatgctacaggagttaagaaggcaagagagtgaaagtggggtagggaaaggaagagaagagcatgggaaaagcaagaaatacatttgttagagagtgtggcagtgtgggtgtggcaggaaggatgctgcattatttcaataaatgttggaagaaaatttgacaaaattcattgtccatttctgataacagcatattatttaataattttctgtagctgctgtaacaaattaccacaaacttggtggtttaaaacccctgaattttttttttttaagttttgttttacgttcaggggtacatgtgcaggtttgttatataggtagacttgtgtcatggggatttgttgtacagattatttcattacccaagtattaagcctagtacccattagttatttttcctgatcctctccctccccctccttccaccctctgataggccccagtgtgtgttgttccctcatgtgtccgtgtgttctcatcatttagttctcatttatataagtgagaacatgagataatctggttttctctttctgtattagtttgctaaagataatatcctccagctccacccatattcctgcaaaggatgtgatctcgttctttttttatggctgcatagtacttcgtggtgtatatgtaccacattgtcttttttccttccttccttccttccttcctttcttccttccctccttccttcttttttttgacggagtctcactctatcgcccaggctggagtgcaatggcaccatcttggctcactgcaacctctgtctccagggttcaagcaattctcctgcctcagcctcctgagtagctgggattacaggcacgtgccaccacgcccggctaatttttgtatttttagtagagacgtggtttcaccatgttggccaggctggtcttgaactcctgacctcaactattctgcccgccttggcttcccaaagtgctgggattacaggtgtgagccactgtgcccggcccacattttcttatccagtctatcattgatgggcatttggattgattccacgtctctgctattgtgaatagtgctgcagtgaacatatatgtgtatgtgtctttatggtagaatgatttctattcctctggatatagacccagtaatggcattgctgggtcaaatggtagttctgtttttagctctttgaggaatagccacactgctttccacaatagttgaactgagttacactcccaccaacaatgtataagcattcctttttctctgcaacctcgctggcatctgttattattattattattattattattcacttttgaataatagactttcagactggtctgagatgttatttcaccgtggttttgatttgattcagactggtctgagatgttatttcaccgtggttttgatttgattcggactggtctgagatgttatttcactgtggttttaatgatcagtgatgagctttttttcacatgcttgttagccacatgtatatcttcttttgaaaagtgtctgtttgtgtcctttgcccactttttaatggggctgtttgcttttttcttgtaaatgtgtttaagttccttatagatgctggatatgagacctctgtcagatgcatagtttgcaaaaattttttcccgttctgtaggttgtctgtttattcataatttctttagctgtgcagatgctctttagtttaattagatcctgtttgtcaatttttgcttttattgcagttgcttttggcatcttcattatgaaatctttgcccattcctatggctgagtggtagtgcctaggttgtcttccagggtttttatagttttgggttttacatttaaatctttaatccctctggagttggttttcgtatatggtataaggaagggatccagtttcaaccttctgcatatagctagctagttattccggcaccttttattggatagggagtcctttccccagtgtttgtttttgtccactttgtcgaagatcagatggttgtaggtgtgcagccttatttctgggctctgtattctgtcccgttaaaacaccagaaattttttctctgacatctggaggccagaagtctacagtgaaggtattggcatgtcaggctccctccagaggctctgggagaggatccatgcctgtggtggctgctggcctttggcattccttacattgcagctgcatcaccaaagtctctgactcagccttcgcctctccttctcctctctgggtgtgtctactctccctctgcccctctgtgtaaggacacttctgattgcatttaagtcccacctggataatttaggctcatcttctcatctcaaaagccttaatttaatcacatctgcaaaaaattatcatgataacattcataggttgcatggattaggatatgggcatgaacttgggaaccatcctcagcctagcccactcagtaaaatgaaaagagtgatatacctcctcaacatgagaaaaatcattcagttggtctattcagctgaatccaaagccagcatcatttttttttaattgtgaaaagcaagaaagaattctcttaaagtgaggatcaaatgaagatgtctacatgaatatttcatatatgttttggacatgtcagccaatgaacttatacaaaagaataagaggcttaaatattaaaaagttgtgtacaattcatttggaaacaagtagacagattaataggtgatattggaagaactatctagccattggggaagcggaaagaatgtttttaccttatgaaaatgcagagaacataaaagaatgtaaaaatttaaaattttatataaccaaaaaggaaaaaaaacagtgtatgtgtttgtgtgtgtgtgtgtgtgtgttgcaacactaactacaaaaggggcaatgccttcttttacaaagaaaacaataataataacctgttataaaaacgagcagatgacttgaacagggagttcacagaaaaatgaatacagatgacagtggatatataaaaaatactcagctgcagctgggcgtggtgtctcacgcctgtaatcccagcactttgggaggctgaggcaggcagatcacctgaggtcaggagtttgagatcagcctggccagcatggcgaaaccccgtctctactaaaaatacaaaaataagctgggcatggtggtgtacgtctatagtcccagctacttgggaggctgagaaaggagaatttcttgaacccgggagacagaggttgcaatgagctgagatcgtgccattgcagtccagcctgggggacagagtgaaactccatctcaagaaaaaagaaaaaaaaaaatatatgtatactcagcttcattaaatatttttaaaatgtgattcaaaacaatgagacaccccttgtacccttgtacccatcaaattgacagagatgaaaatgttaatttgctgagggattatttatatttattcatttttccttttttcattaagagtttaagttagcttgctaggttgcataaaattaagcaatttagcataaattaaaagtaagtgaggccacctgcaaagtagtcttgccaaacaatctgatcaagttgaatctgatcaatttctaaccaacagagggatgtgtgagtcaataacaagggataagagcagcagaatccagtggaaaaaactacaggacacatggcctgcatttcttcaacaaaataattgcatgaagttgcaggaggagaggaaagggagaggcaaaaagaaatggagggaggtcaggtgcagtggctcacgcctgtaatcccagcatgttgggaggccaaggcgggcagatcacctgaggccgagagtttgtgaccagcctggccaacacggtaaaacctcatctctactaaaaatacaaaaattagctgggcatggtggcacatgcctgtaatctcagctacttgggaggctggggcatgaaaatcgcttgtacccaggaggcagaggttgctgtgagccaaggtcgtgccactgcactccagcctgggtgacaaagtgagactctgtctttaaaaaaaaaaagaaaggaaaaaacaaaatgaatggagagcccctggattaaaagggaaataagaccctgtactgatagcattctaggggaggagttgcagatgaagaacgttcctttgtttctttattacccccttagtcttcaagcagctggttgaattaaagttactatcttggagtttcctttggttaaaagggaggtgatcagagtgctattaaaattgtgggccgggcgtggtggctcatgcctgtaatcccagcactttgggaggctggggcgggtggatcacctgaggtcaggaattcgagaccagcctggccaacatggcgaaaccctgtttctactaaaaatacaaaattagccgggcatggtggcgcacttctgtaatcccagctactcgggaggctgagataggagcatcgcttgaacctgggaggtggaggttgccgtgagccgagatcgcgacattgcactccagcctgggcaacaagagcgaaactctgtctagaaaaaaaaccaaaaaccaaaaaacaaaacaaaacaaaaacccaaaattgtggtcttggaccagaggaaaaaaagaatccattacttccacataaaaaaaaaaaaaaaaacaacaaattcacccctcttattcgctatgccactcttttaactattaaaacagaattttctgtgattctgttactatttaagaacatctttatatattggtaaatttcgttttattttttcttttatttattttttttttgagctggagtctcgctcttgtcgcccaagctggagtgcagtggcgagacttcggctcactgcctccaccttccaggttcaagtgattcccctgcctcagcctcccaagtagctgggactacaggcgcccaccaacacgcccagctaattgttgtatttttaatagagacagggtttcaccatgttggccagggtggtctcaaactccagacctcaggtgatccactcgcctcagcctcccaaagtgctggaattacaggcttgagctactgcgcctggctattttggtaaatttcaaacatattcaaaagtggactgtattataactgccaggtatctagcactcagctttgacaatgaccagctcatggccaatcctattttatctgtatctctatcccccactctgcctttttttttgaagcaaattctagaataatatcatttcactcgtaaacatttcagtattatctctaaaaaaaaaatacttattttttaaaacctaaccaaaacccagtgtgtattttgaaaagctcgagcacgccactaaatttctttgcaacccattgccattttttattttaaagtgatgtttttaacacccttatgactacatttccttgcgatcaatgctaatgagtgaagcagcccataaatgaggaaggagatgaaccgagacagtaggagttccctactgcctgcctcctgccttttccctgggcctagaacataactcagggcattggctgtgatttgcttttaggttcttttaagaacatcttagtcaacaccaaattgttaacatgacataaaaggtctactaggacttttttttttttagctttaatcacatgaagctgtaataaaacccatttgagcacttttattctcttaaaatggggccatttcccaattagcggatggacaggctggctcattcttctttgacaggaacgtaattctttgtgtccttcaccgattcttcgaaatgttcttagcttggctggctgccttcccttctttttttttttttttgagagggagtcttgctctgtctcccaggctggagtgcagtggtgcgatctcggctcactgcaacctctgcctcccgggttccagcgattctcccgcctcagcctccagagtagctgggattacaagcgtgtgccccacacccggctaattttttgtacttttagtagagatggggttccagcgattctcccgcctcagcctccggagtagctgggattacaggcgtgtgccccacgcccggctaattttttgtatttttagtagagatggggtttcaccacgttggccaggctggtctcgaactcctgacctaaagtgatccgcccaccttggcctcccaaagtgctgggattacaggcataaggcaccgcacctggccaccttctttcattcttcttgtttccctgtctgtctcaggcaactttctacctctctgtttgtcattcccagatctactcatttcctcctgtccctctcttaagctccatttgcctgcttgaattctgccatgcgtcccgtccctgcagcatcttatacttaatacatctgacttggaactcatgatctgccctttccccactggccacccccactgacctgactttcctctttcacttaacttcatttgggggtggaaaagccagatgacgagtatcatttttattaccactactattactagtagcaatacttctactattactattactacttccagtactactactatgcttctgttcctttgttcctcttatgcagtaagtgaccagagcctatagattttgcctctgcaaaattcaagcagcttatttgtgagccagattgctgtggtctctacctcttatttttgggtctagtgcttaaactctgtacataggtaagaagacatgggccctgacttcaaagggcttgcatttttagtggaagacatggatgaacagatgggttcacttaatcagcataggaaggttcagggtactgtggcaacacagaggaaaggtatttattgcattggggactttcatggaagacttcctggagaaaaacatacttgagctgagtgtcgcagttgactggggaaaacaggtaataacaacattctgaggaaaataagagcaaagacctggaggcataaaacatcaaggcatgagagtatgtgggtttatgcatgagtgtgtgtgtagcacagtttcaaaacatcctgatattattagatcagttcatcttgttacatctttttttttttctgaagcatggatgtggcatgatgttcctctactgaaaaacatacatgacttctctttttacatctgaaatttaaaatatatttgttacagtattttgatctctgactccaacttcctcctccaggtttctctctccaccacttttcagtttgtccagagtagaaaactcagaattctttgaatataccacagtgcttctccttacaaagatatttcatcctcattttactttgaatccccttattgtctctccaagtcttgattgtcaaaatcccacccatggtctttttaaactttgattttggaaatatttaaatatataaagaagacatacagtataacaaaccctcaggtacccttaaatcctaccaaaatcaaagggccacttcaaataccacttcgtatgtgagaccatttctcagtgttgcttgtcttgcttcttctctcctgctttcagggtgcaatgcttgtattgcacatcacacatacccgctgttattatggagttgggttttcatatctcctgatgcttcgatggcagaattgcatcttaataagttttgacccttgcaatgtgtaccctggggaatgattgacaatttcagctcaaagatagagataacacagtgaggagctagcttggaatttaattcttactaatcagaaagaactggtgggttgtgggggatgtgacaagagccttggaggaaagtgacgttggcaacataaagtgagaaatggtaaaacaagacaaacaaacaaacaaacaaacacaaaacaactttacatagacatgtggtagacaagggctacttaactgtggctgatttctcagacacttgtgaaacttaaaaaaatatatggatcctgaagcctcactctatcaacttagctggtaactactgtccccagtagctgagagacctggacaaaagggcatcagcaggggacccacctgcatgggtccttttggggcagtttcacccatagggataggattgcaagtgtggcttcagtgacacaactacaatgtgagattttaagactttttagcacttagagactctgtatggcacccagcacgcctggaagccacacacacacacctggaagccacacacacacacacacacacacacacacacacacgtgcacgcagagagagagagaagggaccactgagccaatgtctttattgggtacagggcgttatccagtttcctgcagggagctttaattgctgggtttaaagcaagcaggcactagttctaggaggtcacagcgtgactgagaggtggtcaccttacgtttgtgggcaaatgtctgcatggtctgtttaaagggagtggcaggaaagtagggaggccagcctgctaggcaggagagatgtctctaagtttcatgtctggccactggtttggagccaatctggtggagtgtggtattagacaccgtgttaagagtgactgagccctgcttctgatgtgagatagtttaacttaggtttaaaaatggatactgaggcaatgtaaaattataagcactcactacactcagtcccagaaatcctgagtctatagacctggagaagttcccatagtcagtgggcacaaagagaggtagattcaagattgatgagatgtttgaaaaatgtaattctagtgtaaataacacgaaagagggagaatggagcacggaatttgaagaaataagatgccatccagggaacattctgcttaactcatattttaaaaatgtaagcgtaaacatggaagggacaaaaggaagtatttattgagcacctatattatgctacaccctgctaggcttcttcacacacactgtgtcaatcgagtctcttaatgacctgcggagattgtacatcatctccagtttgcaggtgtggaaactcagtttaagataagaaactttctcaacattacgtcactaagtgggacagctgggatttgaaatgattcttattgatgcagaggtttgtgcaatttccattccattcttggttgttcattttgtttgtttgttttttgaagagctctgtacaaatgttcaaaacagttgagaaaagaataacaaacattcagtcaacaaatatttatgatgtgcaggtgctgggcaaaatcattggccatcatggaacttatattctagtggagaaaggtagataaacaagtaataaataaatgcagaagtaaataaataaatacaaaaataaaataattctagattgtgagaaaaggtttgcgggaaatgagtggaagatggtcgtggagatctattgtagagagagtggacatttttcaactaaaatatcaaagtttcagggaagctgctttgagctcatattgtgttgcaggctgagtgtaaggtgccagaatgtgaaagcaggaatgtgtggatagtaatccttagattgtgttcaggaagctctgggaaggttctatgagggaggttttgaatttggaaggttgagttcttgtctgcaagacagctagagccctccaggtagaaggaacagtatgagcaaaggtaaggtcttaggagattcattctgactctgaaatcaaactgactgcaggttttaaaatgagcttttcagctgggcacagtggctcacacctgtaatcccagtaacagcactttgggaggctaaggcgggcggataacctgaggtcagaagtttgagattagcctggtcaacatggcgaaaccccatctctactaaaaatacaaaaattaggcgggtggggtggcacgtgcctgtattcccagtcgcagctactcgggaggctgagggccatgagaattgcttgaacgtgggaagcagaggtttcggtgagcctagataggaccactgcactccagcctgggtgacaaagtgagactctgtctcaaaaaaaaaaaaaaaaaaaaaaaaaaaggccggccatggtggctcacgcctataatcccagcactttgggaggctgaggcaggtggatcacgaggtcaggagttcaagaccagcctgaccaacatggtgaaaccccatctgtactaaaaaatacaacaattagttgggcgtgatggcgggcacctgtaatcccagctactcaggaggctgaggcaggagaatcacacaaagccgggaggcggaggttgcagtgagctgacattgtgccactgtactccaggctgggtgacagagcaagattccatctcaaaaaaaaaagaaaaaaaaaaagaggttttcagcttttcttctctaaactttctgtaattccagagagatttgtcttcagtgtttggaatctcagtggtatataagagccagtggttttggaagattggaggatggcagagtccctgttcacttttacattgctgttgcaaagccagctttcttcctgcatgcctcttcccctgccctgcttcgttcgttgctttgcatatgatgattgcaatttaataacactgaatgatacttcactgctggttttattgccaactacccttggaacgtaagcctagatgcaagtagtaaggagagggcagccaaggcctctagattgccagttacttggctggaaatcccattcatattgggaaacagatttttaaaataaatttggcactggaaacactgccatccttttgtgaagctgtgtcaataatcataaactctcatagtcgtgcccccaaccctcggccaagctaacaaatatttaggcatcagcatatcttcacgatgccaccttctgttgaccgcgtgggcttctcatgctgtttgggttggcagtggaacataatcttctgttttatgtaatgaggaacatcagaggagtgctttgtgcttaccctctcagagtgtgtgcaagacctctcgtgtaccccatcattttcggtgcagtcaaagctagcgaacatttctgtggcctggtaaatattttctaactattggcaaggctttttaaatttttttttccagtgccattttgctccaggccaggattataatgacccagctttgctttggtttcagatgaattttgcaaatatatgtgtgtggtgggattacactattttcagagaacacagtcatgcgggtaacagggtctgatgcaatatagtgctgcatatgcccaatcaggccgacgaggcttaccctttgcagactgtgccaataagcagtcgaggcttgttgcgatctgcagaaatctacagaattctctgtttccgagaaggcttgttgctagcatatgacatcatagaaagcctttttttttttctgacattttttctgctttgctttagaatatcaaaggcaaagactgttgaacatagttggccacttagctttattattcatagtgctccctcccatgtttttttttttttttttttaacagtgttcaatgttagcgtcaggtgttggctgccttcctgggggaacagattgctgtgaagtaaacacagctggaaactgaccacatattgtttttctttcttttaagaaatcaaagaggcatttatagaaaagctgcagaacatggtactgtccagatttatagatttattcctccaagtctggttaatgattaatgtcacgcctgggtgtccacatagacccacttcccttctcccttcctgaagctgcaatttcctcggaacaatgagcttgcagaggtttgctgcaatccgaacttgaggagggggtggagtctgttcagttctgtttctccttgccgaagtgtggtctttggagctaagtgaagaatgacttctgttaggttttcctctgctggtcttccttgcagcctcgaaaacctcaccagagtcgcctctgctggtctcttactgtgctgctctgtcagagatgggcaagtaagcgaactgcagagtgttgctgtgtgtgcttgtgatttgtattttatttgatgtaaacgtgaaggcagagtattttctaacactgtaattcaactaggttttgtgtctcctggatctatttttttttcttgttgttctgaggagctgatatacttggaaatattaggtttaagatatgcagatgtccaacttatatacatagtcaagggtttagagtctggagacaggaggctggcaatttcaactaggaggcagtaaattcagggtaagaatgatgttgatgtggggggctgtgggggtggctgggtgtaacagtgatctggggagagaatcaaaggccttctcctcccacttggaagactttactattattttggtcttttattcctttggtctctgtgctaaaaactttctctcttttttactgtttctttgtatagatgttttggtgatttaagttatggtgtaataattaattgctgttaagaattgctactaattacttgctatattaaagttttccaaaggggttttctcaataaatagctatttctctttacatctatcttgtaagaactgagttagaggtaaagaagagaaagatgtaggaatttaagagtaacttctgcttttggtttgcttaaatgacaactggagaccagttttcataggcaaaatatatgttactttagtttttgttttcgttgagagaactgtagggtcgccttttgggattacctgaattatctgtcacctgcactggaatttgtatgtagttatctgtatagttatctaaacaagttgaatccgtcattcattcctcactgaagaatctcatcgaaagtaacattccctgtctgtttggctgaggtgcatggatgggaattgttggaattaggccatatatctatttggattctcataactgggtccagcacctagcatagttcctggtacataggaaagctctatgcgatgtcaataactgactaatttagtaacatccttaacagctgtttgagttccaagagcaggaaagtgaatggtgagttttgaaccttataaaatacataagtaaacccaaatgaggagagaattgagaaagcctcttattctgaaggtggtcctaaaaggctttctctaggctgattactgcgaagcatattttttcctggctatatacaacttggcagaattgatctgattttggattctgaaggaattgaaaaatttcattatacattatagtgggctataatgatgtggccagttctcttcattaattttttaaatgactttaaaaaaaatgagacagtactgattgtttccctaaatgaatctaattaacagctacttaaggtatcttaatgttttttcatatatgttatctgctttgattctcatatcagtccagtgaggtgagtatggttgttacttcctcattttacaattgagaaaactgagagtcagatgaaaagtgattctagaagttgcgtgatgcgtggaagaaccagatgtcagctgggtattttaaaactcaaaatcccgggtacgtctcacctgccccctctccagtcatctctaaacgtcttctattgcaggatagtagaaagaactcccacctgggtgtcaggagacctggattctgattctgactgggtcattgctgacctctgtgatgtggagcaagtcactgaagtctttggatgttatttttctgcaaggaggttattttaattggtttaagtttctttgcagcttcaggatctatccagggccatatccagggcttgtgttatctctgagtgctcatctgcaatgtagagaagaggtgggaaaggaggtaggattctttttttttctttttttttttgagacagagtcttgcactgtcgcccaggctggagtgcagtggtgtgatctcagctcactgcaagctccgcctcccaggttcacgccattctcctgcctcagcctcccctgtagctgggactacaggtgcctgccaccatgcccggctaatttattgtatttttagtagagacaggatttcaccgtgtcggccaggatggtctccatctcctgacctcgtgattcgcccgtctcggcctcccaaagtgctgggactacaggcatgagccaccgcgcctgggcagaaggtagcattctttccagccattctatgcagctctcccttggtttcccctgccaagtgcaaagagacacaggatctccatgcatgaggaaaaccccaggcccttgtttgctctgttctgcttcctgagctggcatttctcagtctgttcttttttactcatcaacaaaagtattcgagccaaattctcttgtaatttcagcccaggtgtgatcaacatcaagttacctttccatttggcccaagaagaagttataacttccttgcataagctcatctgttatcttaatcctttctggaacagggaaaatgtaaataagtattactctatccctctcttaagtttttcaaattacagcaggtggttgggaaaaggggagggcagaacagtggaaaagcattttttattctacttccattgctaactttgtagtagttaacagatcgatttagaaaatagtgggttactaagataagggtgaccaccctttactaacactaaaaagaaaaaaaaaaagctataaccaagtgtctgccatcaccattatagtgtaaaagaaaaaaaaaacaaaaacaaaaaacaaggccaggcatggtggctcatgcctgtaatcccagcactttgggagaccaaggtcagcggatcacctgaggtcaggagttcgagaccagcctggccaacagggagaaacccccatctctactaaaaatataaaaattagccgggcatggtggtgcatgcctgtaatcccagctcctcaggaggctgaggtaggagaatcgcttgaatccaggaggcagaagttgcagtgggctgagattgtgccactgtactccagcctgggtgacagagtgagactctgtctcaaaaaaaaaaaaaaaaaaaaaagttgcaatgacaaattctcagtggggagaaagggcagatcttcctaggaaaagagagttggcattctcatcctgatgtttgccccctggactaatgaaaaacctcattcatgaccacagtctgtatttgagaagctctgtcctacctggtgcttgggttcttaacactcacagacttcctgggtaggaagtggcgctttgaatggagacatgagagctgcctgtgcaggtcagctctttcctttgccgcagtctctttctctgctatcttgctatgatttagtccttaactttttccttttgtctttccccataggcaagaagcgaaaccctggccttaaaattccaaaagaagcatttgaacaacctcagaccagttccacgtaagttgacaagaccatcatctgaatccaaatccttgtgctttcagattcctcctgggggtttatttttggactgctgagcaatgccttgactttagaagagccctttaagggggaagccatttgctcactgttctgagacctgaaatagtcatcttatcagtcagttacgttgaatgggtagttttgaactcagtgtcttaagttattggttgagtaggaagtgaatgtcacatatatttggcagatggggctctatgtaaggccagaaaggcccctggatgtgaacttccttgccttttccctgtagattggagcaaacaggcaaatccctgtgaaagccactactataaaacttgggttgagatggaaagatggtatttggtgaggacccacatcctgacacttaaattctgtcccatataaacagaaggaagaatgaggtaaaggaacactttttttttattagctgaggttttggcccaaatccctaagtcagctcaagtcctagtgaaggacatcgtgtaaatgacatcctctctgtgaggatgtctccttcttgttttttttttttttatttttattttttatctgtctctgtgtggtgggaacggtacttcctgtccagctggaggtacaaccacctaccaaggcatctgcatgagaggaatggaaattccaaggaaactcacaatagaggtgttagagagacagggcaagggcaaagagagggcatcctaatggaaaagtgagttggtaaggcttttgttcatgtctacaaaagtgcctccctttgtgatgggttttgatcttagctatgatctgctatcaggaagtgcacccctagtgttggaatgtgttcttaaatgggatcatgtctgctgtaagactttgttaaagccactggtccttgcattgcgtgaagcagtatacagacactttccactggagaatttttaaggacaaagtagagttgagggctactcttcagggttctggactgtagctcaagagtctaaactcaagatagaatgttcctttcattagaatctgcaggaggaagatccgtcttcccatacttgctgtcaagattgttttctttttctcttttttttttctttttttttcggtctctctgagcaatttctttttctcgtagacctgtgaactgtgtaattactattgtttcctctctgactggtttctcaagagcttacagtcaaatatgtggcctacttttactacctgtataggaatttatgggatatacttttaaaactttttattttgaaataattgtagattaacaggaggttgcaaagaaacgtacagggaagtcccatagatccctttccccaggccatgccaaactcccccgccatcccaagttaacatcttacacaactataatacattatcaagatcaagaatgtggcagtagtgcaaatcatagaacttaattttgccagctatgcaagtattcctttgtgtgtgtgtgtgtgtgtgtgtgcacgtgtagctctataaagtttatcacattgtgtaagtcttgcataagtactattataatcaagatacttcactacagcaacattacaagactcttttatgctcccctcttataatcaaacccacctcttctccccatctccgtccttaatccccagcaaccgctaatctgttctcctttgccattttgttatttcatgattgttatataaacaaaatcatgcatctctttttgagatttttttttgttcaatgtaattttattgaggttcatgtaaataattgcatgtattgatagtttgttccattttattgctaagtacccatccatggtatggttataccacagttggttcaacaccttagcctttgaaggagatatgggtagttttccatttttggctattatgaataaagctgttatgagcatttatgcataagttcctgcatgagaataggtcttcatttctctggggtgtaagcccaatagtgcaattgctgggttatatggtaagcccatctttagttttgaaagaactgctgaactattggccagagtaattgtaccattttatgttctcagcaataatgtccgaataatctagtttttctggatctctgccagcaattggtattatcagtgtttttcattttagctattctgatgtgtagtgatatatatgtagtttttttttttttttttttttttttttgagacggagtttcgctcttgttgcccaggctgcagtgcaatggcgtgatctcggctcactgcaacctctgccccctggtttcaggtgattctcctgcctcagcttccccagtagctgggattataggcgcctgccaccatgcccagctgattttttttttttctttttttggtagagacggggtttcaccatattggccaggctggtctgctggtctcgaactcctgatcttagatgatccacctgccttggcctcccaaagtgctgggattataggcgtgagccactgtgcccagcctatatgtagttttaatttacaatttctctagtggctaataatgtagaatatgtttttaggtgtttattttccatctatatatttttggtgaaatgtctgtgcatatcttttgcccattgtctaattagatactttttattgtttacttttgagagttatttgtatattctggacacgaggactttgtccgatatatatgtgatatgaaaatatttttcccagtttgtaatttgtctttttatgcttttagcagggtctttcacagagcaaaagtttgttcaacttatcaattattacttttacagatcatgcttttgataataagtctaagaaccctttgcctagtcctagatctgtctagaagttttgtagttttgcattttgcatttaagcccatggtccattttgagttaatttttgttcaaggtatgagtttaggttgagctttatttttttggccagtgggttaccaattattctagcaccatttgttgaaaaggctatccctcctccattgaattgcttctgctcctttgtcaataccaattgggcatatttgtttgaagttatttccgcattgtttattctgttccactgatttatttgtctctccctctgccagtatgacattgtcttgattaccacagctgtagagtaagtcataacagggaaacatgattcctctcactctgttctctttcagaactatgttgactattctaaaggcctttctcttttcatataagttttagaataagcttatctatgtccacagagaaacttactgagattttagtaggaattgtgtttaagctatagatcaatttagggcaaattgacatttttactacattggttcttccaatctgcaaacatggtatatttcttcaactttaaaaattttatttctttcatcagcatttttataatacaattcctctatattagattttgttaaaatttatacctaagttttttttggagcaaattttaagtggaatttgatttgtgaacttggttttcacttgttcattgtcagtatatagaaatgcaatagattttttctgtattgatcttgaattctgtggattctgcaattgatcttctattctgtgactttactaaaatcacttattagttctagaagcttgtcatcgaatcgttagggttttctatataaacagtcatggcatctgtaaatggagactgttttattttttcttttccaatctttactttgatttttactttcattttcttgccttattgaagtggcaagaatgtccagtcctaggttaataaagttcatgagagcaggcaaacttgctttgttcctcatcttagagggaaagcatttagtctttcactattaagtatgaagcgaactgtaggttttttgtagatgttacttatgaggttgaaaaggttcccaactatataaaacctctcagtatactgagaggttctttttgattgtttgtttttgtttttttgagacagggtctcactctgtcacccaggctggagtgcagaggtgtgatcatggctcactgcagtctcagcctcccctggctcaagtgatcctcccatctcagcctccaaagtaggtggaactacaggtacatgccaccacacgcggctaatttttttttgtgttttgtagagacggggttttgccatgttgcccaggctggtcttgaactcatgggctcaagcaatttgcctgccttggccctcccaaagtgctgggattacaggcgcgagccaacgtgccctgcctgagaacttttattatgaatgggtattgaatcttgttgaatgctttctctgcatcaattgatatgatcataagatttttcttctttgatctgtcgatatgtagattatgttgattcatttttatgtactcagctagctttgcataccccaaatgaatcccagttagttatggtatatatatttttgtgcattgttggattcgatttgctaaaattttgttgaggatttttgtttctaggcttttgggagatgttggtctgtggtggtttatttattatttctcttgtgctattattttctagttttagtattaaggtaataatggcttaataaaaatgaattggtaagtgttgcttctattttttggtagacattgtataatattggtgctaattatttggatgtttgctaaaattctccaatgaaagaaaatgagcctggattttttttttctgggactttttaatcacaatctcaatttctttagtagttataggactattcagattatctgtttcatcatggctgagttttggtagtatgtggttttgaggagttggtccatttcttccaagttgtcacatttatgagagtaaaattgttcatagtgtttcctgcctatcctttaaatggctgcacaatctgttgtgacatcctttttttttttccctgatactgataatttgtgtcttcttttgttaaatttgtcaattttgcttgaggtttatcaactttattgattttttttcttctgaagaaccagctttgttttattttcctattttcaattttattgctttctgcttttatttttgctatttcctttgggatttattcttacatcaacctgccaggagtcttacatcccttccccttacaatttttattctttaccttttatattagtttacattatagcataaattatatgttaattttataaattttatgaatttcggaaggctaccataaaccctttcttggtataaacaaggataaaagcagtttatattttccctcgtatggtattaataaggtatactgtgaatatacttatctgtttcactgtgtgaagcaaaaagtatcacttcattattgtagagtataccgctgtagctcaaagagtctcgttgttattactttaatgccaaggcttaaatttgtactcctaaagaagtagctcccacattttgtgtttttcttggcaatttttgaaggctggcttggtgatttcttcccattcataccctgcctccttctgctgcgcttcacaaaaataaataggccttgacaaagctccattctcccgagttcaacgtgtgtggcccctctgtttgagctctttctttgagctaccgatgccagtgtgagctgtcccttcccttgattgatagtgaccaattctaaatcagttcgatgctagttcatattatttcatttaaccaccacaagaaactcagaggcagtgtttgttactctcacttgacatgtgaacaaacagaacgatgcaacggtcaggtgcattgctccaagctgttgagcatagcttcatgggtaagagttcagggtctggagccagaacacttaggtttatatttgggatctaaacttcactagttgaatatcttaggcaaaatacctaactgcgctaagccttagtttccttttctaaaaatacaaaaaattagctgggcgtggtggcgggcacctgtaatcccagcttcttgggaggctgagacaggagaagcgcttgaacccaggagggagaggttgcaatgagccgagatcgtgccattgcactccagcctagatgacagagtgagactccatctcaaaaaacaaacaaacaaaactcaggaataacagtgatgttgctgtcatgaggattagatgtcataatccatatgagtgtctagtgtagtgcctggtgcattgcaattgctcaatgaaaggtaactccaagttagtattatcacacagcttctcggtggaagaactggcatataagctcaggaatctctgactctcaattatgtactcttagccacacatcagactggtagaggctgtgagcaaacagtttatggctagtgaaatgagaggtagtatcctttacagcatactgtgcatgagaagccataatggtgcagctctgggttctaatctcattgtctttctaagtgttttttttttgttttttttttttttttttgagacagagtctcactgtgttgcccaggctggagtgcagtggtatgatcttggctcaccacaacctccgcctcttgggtccaagcgattctcctgcctcagcctcccaagtagctgggactacaggcacccgccaccatgcccagctaagtttgtatttttagtagagacggggtttcactatgttggccaggctggtctcgaactcctgatgtcgtgatccacctgcctcagcctcccgaagtgttgggattacaggcgtgagccactgcgcccggcctgagtgttcttaaattatttagtcactttcaatattaattgttgaaagaggtattaatgaggtattataccttgatttcaattcataccctattctatttcaatagaggtaataacacctctgagagttgtaaaaattaaggaagctattttatgtaaatggtctcacgcagtctcttgcccaaataggtgcttaataaatatttctgaatcaatgaatagtgattgcgatagtaaccagtgaactgattcctcatgtaaaattataaatgaataattatcatactaaaccgaagctggttgttcatataaaaaaatgaatactaggtgacctttggaagacctttggtcttccaggggaagaatttttgtaataagcttggttctttccccagaggactaaaatattgaaaaagtgacagagaacatccacccacagtataaacttcctgcagaatcgcaatgcccctggcaaactaatatgcccagccctggagagaacacagtgtcaactaatccaatctgatttgtcagtcttggccccatcatttgatatttttggcccacttgatgagcccaagggcctgcggcacaggcgaattgattattttcattagaggaggcctgggtattgggagcaagttccttgtattcagtctgcctcgatgggaatcgcaagagcaggtaaaaagctcttagcccagttttttatatttccttctcttcttcctctttctcctccttaaatcaaggctgagattcgggtgacttgagttttattttcagctccgttgatgaccgtatggcttcagaaaatcacccagcttttctgggtttcatttttctcaatctggaaaatggcaccagacccttctattaggttcaggggtaatgcaaagttagtatagggccaaggtcagcaaacttttttgtaaaaggccggatactaaatattttaggctacatgggccacagaggatgccgttgtttattttttgtttttttacaagcatttaaatttggaaaagtcattcttagctggaccacaggctgtaatttgctgagccctggtatatatataaaatataagaatattagacttggaagaactcatttttcgataacctcattggatggcaaaaaaacagttgcagccccaaataattagtgacctttctgttgcttcatatttttaaaaagtcaggatggtgggtgacgcctgtaactccagcactttgggaggccatggcaagcggatcacttgaggtcaggagtttgagaccagcctggccaacatggcaaaacactgtctctactacaactacaacgattagccaggtgtggtgcctgtaatcccagctacttgggaggctgaggcaggagaattgcttgaacccggtaaggcagaggttgcagtgagccgagatcgtgccactgcactccagcctgggcgacagggtgagactctgtcttaaaaaaaaaaaaaaaaatcagggtgttgaataattgcaaaggatttttgttgtttatattagtcacatgtttcaagtcatatttgcctttatttcaaagtgccattacaaattagtacaagcaaattttgacaactgaggaaaaatagctttggaaatcttgagaaagaggaattagaattttagaaatttgattcttccagaaaccttttctgaagaaaaattccctgctcagaaacacaagatatataaacacatcactgctgtttgtggggcatgtgtgtgtgttttgttttgcattgtttttttctctctctccctctcagtccccagttttaagttagtataagaaactttaagtattctatgtattccaaaaggattttgaggtgagagaaggcttgccattaaaatcttagagtcatgtttatatctgtatttgtatttctctttttttttgttttgttttttgagactgagtctcgctcttgtcacccaggctggagcgcagtggcacgatcttggctcacttcaacctctgcctcctgggttcaagcgattctcctgcctcagcctcccgaatagctgggattacaggtgtccgccaccacgcccggctaatttttgtatttttagtagagatgaggtttcaccatgttggccaggctggtttcaaactcctgacctcaggtgatccgcccacctcagcctcccaaagtgctgggattacaggcgtgagccactgcgcctccgcccatattcctactttttaattttatttatgtattcaatttcagcaaaagggttagaatcataatacctgagagttagaaaaaatcctcattggcaaaggtttcttttctctctcactttcatctttccattttcctttgcctttttctggcatggaatgtgcttccagagagacatgagtctttacctgtctgctcaccctctttccctcttttctggcagcaccaggattctttcgtctttagcctctagttgttctttttgtttgatcacattaacaatttgtttctcgaaatttgcttttttttttttttaatacagagtctcactctgtcacccaggctggagtgtaatggcacaatctcggctcactgcaacctccgccttccgggttcaagcgattctcctgcctcagcctaccaagtagctgggattacaggcatgcgccacaatgcccggctaatttttgtgtttttagtagagatggggtttcaccacgttggccaggctggtctcgaactcctgacctcaggtgatccgcctgcctcagcctcccaaagtgctgggattacagctgtgagccaccgtgcccggccagcatttgctatgtttattgtactactgttggtacatttctttcaggaaaatgcctttctcagctcctagttgtgtgcacagccagagccaaacatttttctcttaagtagattgataccacctgagagatcattgaagtggtagaaataaatactcaggaagtgactatagaaacaaaatcagcaaacctctggctcttaagaagaccccagaattgtatatgtgctgtgcacagaagaaatattgctgggcttgataagacagcctggttgagtagagaggatgcagaactggatatcaggagacctggggcagctgtgggctgggagcagtcactttacttctctggaccttctgtccatctataaaagaagggacgagatttgaaattcttatgttctatgaattttgtgagttaacagaatatatgccattactatttgtttcttaaaacaattgtgagacatgtggtgaaataattacatatattggtgctcttgggtgaaagaaaaagcttgagacttactgctgtagcacaatgacctatatcagcggtccccaacctttttggcaccagggactggttttttgaaagacagtttttccatgaactgggtggggggatgatttcgggatgattcaagcacattacatttattgtgcactttattattattacattgtaatacatcatgaaataattatacaactcaccataatgtagaatcaatgggagccttgagcttgttatcctgcaactagatggtcccatctgggggtgatgggagacagcaacagatcatcaggcattagattctcataaggagtgcacaacatatatcccttgtatacacagttcacagtagggtttgtgctcctatgagaatctaatgccactgctgatctgacaggagatggagctcaagtggtaatgtgagcgatggggagctactgtaagtacaggtgaagcttctctccttcacccaccactcatctcctgctgactggtattagtccatggcttgggggttgggcaccctaatctatataatagcacatgtatagctcatacgaattagatatttactgtatgccagacattcagctaagcattttacttgtattgtctcttttaatactcactcctgcttcacaatataggtatattaatatccccatgttaaagaagaaagggagccccaaagagattaagtgatttaaacccaaatgtgatttatttcaaatcccctcttattcacactcataggctgctttagtttactcatgaacttccactttcttcttaaggaaaaaatatcctcagtggtgtgtgatttgggaaggacataattgactcaatagcttatgtttcttcttttcccccttatctttcttagaccacctcgagatttagactccaaggcttgcatttctattggaaatcaggtaagaaaaaatcatgtctgccacctaatacgttggccattttatatgtatgctttctgactgaaaaatttattttccctagcatgctgtcaggggatgagtcaaaaaaagtttgcatttaaagggaagtggtatgcaaagtttttgctattttgaaagaatgttgaattgaaatcaggctattgtggttttgatggaaggtatttgaatagagtagatggttctcttgggagggcatttctcaaagctcagacataatctagttgccatcagtcaatagtgggttacagacacaatgaagggtcatggctaaagaacttcagtgaaatagcttcaactgagacattggcaagctgagtccaagttgggtttctgtgttgcctgggacaagcaggtgggctaccgtgggagctcctagacatctcttggcccttcttgtagcttcttgctttcagaggctgctttgacatgctagaaaatcttctggcccagaaataatccttagaacattgagagaaacgagatagaggataatgtgctctctgttctgtttatttttctctttcccattgcattattccttttctctcttgcagaactttgaggtgaaggcagatgacctggagcctataatggaactgggacgaggtgcgtacggggtggtggagaagatgcggcacgtgcccagcgggcagatcatggcagtgaaggtagagttgacattctcccaaatgttttatatctgctgtgtatacatttgtccacctcaattgtcaaccagcccttttaatagaagcaaaaccatcttccgtagggtaaaacagaaaagattatttgcagggaacagtattttcctccaaaggtatggaaaagtcttccttggtgtgagttgtatctactttttatttgtttttttaactcttaactctccctccacccattcttctaccatttttaatttttacaaaactaccatgtcatcatcacacttaaaaataattaatggcccaggtgtggtggctcacgcctgtaatcctagcagtttgggaggccaaggcgggtggatcacgaggtcaggagttcgagaccagcctggccaacatagtgaaacctcgtctctactaaaaatacaaaaaattagccaggcatggtggcacacacctgtagtcgcagctacttgggaggttgaggcaggagaatcacttgaacccgggaggtggaggttgtggtgagccgagatcgtgccactgcactccggcctggacaacagagtgagactccatctcaaataatattaataataataataataataatgatacttccttcatctaatccggagtccaaatgaaaatttccttgatcatctcaaagtgtgtgtgtttgttttgtcctgttggattttcaaatcagcatcccaatgaaagtttacgtattgcatttggctgttatgactcatagatctcttttattctatattttgttgcttttaaagaattgcctctgaaaatcaagaaaccagaattgggagagaaaattgtctccatttgtggaaaaaggagggtaaaatatatctagagtaaatttgcatagtttttgagctatgaaaggaaatttaaaatcatttcatattattgagtaggtgtttggaggatcataaagaattaacatctctagctgagttaatagattggggctattgttaggaataatcaggtgacttggatccttttgcttttaaagaatgggaatacttttatcttgtagatttttcagtctgttcttctgctgacttgctaagtaggcaaaaagtgtgaagtcccagtgatattgtatctctcctatcatttaatgacataatcatgtttctgtaaggctacatttcctagtgtgacagattgttcttccctcagaagcactgggataggaatgaacagtttctctatttctctaattgcttctattttgtatagctgtaccaattctcttacagttgctgttccctccaaatactcttacatgttcccaaagaagagcttttggctttttattttcttgggaccccagataagcagcaaagtccttaatattgtgccctctttgcactgaacagacataatacagtaaaccagattgttttcataccttggaaatacattccaaaacattttgtcactctccaaaacacactatcaatttgtttcttaccaggactattcaggaaatcaaatgagtaacagccttccttattttcatgtgttacaaatagctaatcactttgggtggctattcacaatgtcatcgccagaacttgtgtcatgaactattttcacgatgggactccttcaggtccctgcctgcctcatcctcagagtagtaaccataaattttccatgcatttccattcagcggatccgagccacagtaaatagccaggaacagaaacggctactgatggatttggatatttccatgaggacggtggactgtccattcactgtcaccttttatggcgcactgtttcgggaggtaggtgacccttcaattcaaagtccaagaggaacaataacttaaaaagaagtttctttgatcacgtaaatgccttcacaatcatggagctctttcttgtttgacacatcttgtatacgggggtttacgtgtgtgcaatgatgacatgccctggagcaaggttggattgaaattatggtattttcaaatgtggttagcctttttaagatgtggagtttctcgtctcctttcttttttgttttgtttatcttggcagaactttctatatcgcctatagactgatttgcttagatctcttataatttgaaatattctggtcttttgactgctttaggagcttcatctagcctacttgtgtactatatagacttactttgatctcttttctctacctctgttttccactttagcgttatatggattatgaggcttcacctcattaaaaccagctttttgactgactgttgctggtatttagtgtgagagatacgacatggaggaggcatctagacctaactcctagacagtggtatcagtaaaggcctggatatctggggttgtattgcttatgtctgttagtaattagattccatttttcattaaggggtaggagagcacatgcaggttctgcttggctacctactggtttgctctttgtagataaccttgcttatttgtaaattcctttatgatcttgacagaagacactgtatttccccccaaaattcaagaaagaaatagttaattcttcaggatagggtttactgttttttttttttatttttatttctccctttttcatccttttaaacaattcctgaaacaattggtctccagggtgatgtgtggatctgcatggagctcatggatacatcactagataaattctacaaacaagttattgataaaggccagacaattccagaggacatcttagggaaaatagcagtttctgtgagtacattttgatccctactgcaaggataatgtgagaaataaagtccctatgtgtctttggacctcagtatgaagaaatactacctgggccacagctactattcgtacatgtctgttgacatttattggtggatggataaatacatgctttcctttctgagcactgtgtagaagattctagcactgctttggtttggcagactctaggttaaatgactctaagtgctgcattcatcagctatgaccacattcctggtgtctatattctgacattagtttattttgattttcatttatggatttttaaaatgttctcttgagactagtaggcatagaagaaagcagaaggaaaataaatagaaagaaggtcttctaccttcatggctattcaggctcaggagggtggagagaaaaagaaggaggacaaatgaacaagacagatgagggagacatcctctctgatataagatacagtcctctctggtggatggagtccaatttgtgtaacttcctatgtattttcctagataggaccaccactatttgagaaaatatctcactggtaacctaaagccaaggataataaaccttgatatacttaacattcaatttctttccagcaatgtgataaataaatctatcttgtgtttctcttgcagattgtaaaagcattagaacatttacatagtaagctgtctgtcattcacagaggtaagcatccatgagctgccttggctgttcctttgataaagttcatctctttcacctggagtccgtctctacccccagtcccccatgggtggaagtagaattgactcaggcaagagaactaaggggctttcctttgagattggatagcaaaccatataagtagtattccttatcatggctgaggacataagaagaagacgtgatctttgtcttacatccaaattgaatataaacacttgttagcaagcagagctatgagatcatatcattgagaattttagagaatatgataaaaattgatcttgtattggccatcacatgagagcttgttggaaaagaatcatgggtctcaagatcaaatgaattggaatttgcattttaacaagatttccgggtgattcttgtgcacatgaaagtgtgaaaaactctggtataaagtagagccctttcagacaacaggaggcaggatataatgatttatctcttcctctttccttttcttccttcttattggcctgttatctcttcaaccagccattcatccatccatccattcattcattttctatccccccattcatccatttattcatcttttaaaatcacttttaaaatgtaatagatcccctgagaggtatctgagaagaaaatatattctgattaaattatgcatcaggattcttatagggaagtaagataaatgtacaaaaaaaaaaaaaaaaaaaaaaaaaaaccaccttagaaatatgaaagtaccaagctgggtgccgtggttcatgcctacaatcccagcactttgggaggccgaggagggcggatcacctaaggtcaggaatttgagaccagcctgcccaacatggtgaaaccccgtgtctactgaaaatacaaaaattagttaggtgtggtggtgggtgtctgtaatcccagctacttgggaggctgaggcaggtgattgtagtgattgtggtgattgtagtcagggaaacttctgggaagagataaccagaaccctgtctttgggaagaataatggaatgtattggtaagtaagagggccttgtggtttggataattcttaaactctctgagcctggaaataatgtaaaatgccttccacagtgtgcctattattgttagttgttattattaaaaattggaaaaataggatgaaggaagatgagaagaaaataggaaggaatacagataggaaaaagactgtagattattcacaactttgaaattaacattaagggttatttcaccattatgaaatatgtaattcatattagagaaaatatgtaaggtataaaaataataaaatgaaatttgtgtatcttctagcttaaagggaaaattataaaggataatttttaaagcttttgtaataatcttttacttccaattttatgggtgttatgaaaagtatcacaaagggaaaaattagctgtaatttcaaatgttattatccagagataatcgtagttccattttttgggcatatgggcgggtgggttaaatttttctagtcaaaaggattcgtttaaaatctggtctgtaatactgcttcttcagtaacctgccctgtggtctggaatacctgggtttatgatcctttacactatgtgacctctgacacatcgctagcagaggtttcaatcaaaatctgttgctttgggccaggcttggtggctcacacctgtaatcacagccctttgggaggtggggtgggaggactgcttgaggccaggagtttgagaccagcctggtcaacaaagagacatcctgtctgtcaaaaaaaaaaaaaaaaaaaagttagctgggcatggtggttcccacctgtagtccaagctactcaggagactgaggcgggaggatgatttgagcccaggagtttgaggctgcagtgagctatgatcacaccactgcacaccggttgagtgacagagtaagaccttatcttgaagaaaaaaccaaaccaaacaaaaacaaaggttgctttggtcatatttggtgtatcattgtgtcacagtctgcctttttgttctttgttttattactcctacgttaaatatcaatagatcattttgaattggacatttgattcagtaataattttttaggctcttactacaagtatgagggtaatgaagatcataaaatcagtggagaaaacagttctttgtatggagaaattcacaattctacaaggcatgaacaaaacatgaaatagaaaatcaagttgaaagcaataagctgttgttaactgtgggtcagggatggcagttacttctgtgttgggcagcttggggaaaggaagatgaaggacaaatggagattttaggccctctggtggcagagaaatgaaccttgaaagcaggctgaaatgatggcatcctggttgttttcgctttcagacgtcaagccttctaatgtactcatcaatgctctcggtcaagtgaagatgtgcgattttggaatcagtggctacttggtggactctgttgctaaaacaattgatgcaggttgcaaaccatacatggccgtaagtacattagctagggtggcatctggtaatgtcactgccgacaaatcatgctgggaaacaagaaatggatggccacagagggaaaatggaaatgtacctaagactccagaagtagtctgcctcttagtatttcttcaaaattttatgtctgaaatctttactcacttgcttcgtatattgtcttagtttgttcaggctgctatggcaaagtaatgtaagccaggcagcatataaacaacagaaatttatctctcacagttttggaggctaggaaatccaagatgaaggcaccagaagatttggtgtccaatgagggctcacgtttctcaggatcatacatagcaccttcctgcttagtcctcgcacggtgaaaggggcgagggatctctctagggcttttttaataagggccccaatcctattcattagtattccactttcatgattcaatcaccccccaaaggccctgccttctgatgccaccacatgtgcgattaggttttaacctgtggattttggtggggcacagacatagttatatatatattactttaaaaaaatcaagtgaaagagatacgttatttgaaaaaatatatacacaatacatatagcctgcacagttttccacactgtattgcaggggagtattaccttgtttgttgaggacaaaatagtaaatagagcttaaattacccaaacaaggcagttagattagttatgagaggacctcacagctgtgaagattcaccgtcattagcagagaccttgcaatcccctttaactggaggaacggccactagattctacctggaaatggacttgtgctttgaattgaaaagcttcctgtctgtgtttagctaaaaattgctcaggtctattagcatgggacagtagcccagtgacacttgttttattgagttctggactgttcatgttttaaacaaggataattctagatgggcaaagtagctttataatgtataccctgtttcttcttaaggcaaattttaaatttgttatgaaaggaacttgatccattactgtgtccaagaaaagacaaacacagaagaagggaaaccccacggaggcattgatatttgttgtagttaaccgggtcttcttggccttggtggcatgttaacagcttataacaactcacttggcagctggtgctacccccatccccagagactattgagctaagaacgttatctcaattgtcttcccagtttctcagttgtctgtcttctttccagcctgaaagaataaacccagagctcaaccagaagggatacagtgtgaagtctgacatttggagtctgggcatcacgatggtagtgtatgccaatcatcatgaactatgaggttgtgggtaatgaaactagaatgaggtggacgttgggttcaagaaacaaatgccctaaatgctggtttggggcgccctctcctgctgagctggtaggagattttgagtaataattgtttgtattgtggtacaataaaaacactgatatgggattggggaaaccaatctttctcttgattccacctctgacgagctgtatgcctttttgagtaattgttacagtcacatggactatcttcctatcctcctctgtaaaacgagaggatctgaccagattccttatagtttaaaattaaattattcgagccaaggcaagaagcttaagctgtgcaaagaatgctaatgtgcgtgaaccctgatagggccgtgttatccaggacatagactatgcttcccaggatatttttattggagaagtagaagtcaaagtctgatcaggtcagtgtattagttcgttttcacactgctgataaaagcatccccaagactgagtaatttaaaagaaaaagaggtttaatggactcacagttccatgcagctggggaggcctcacgatcatggcggaaggtgaaaggcacatcttatatggcggcagacaagagagaatgagatgagacagccaagtgaaaagggagatgcttcataaaaccatcagatctcgtgagactttttcactaccatgagaaccatagaacagtatgggggaaccacccccatgattcaattgtttcccactgggtccctcccacaacatgtaggaattatgggagctacaattcaagatgagatttgggtggggacacagcccaaccgtatcagtcaggtatatcctcaatacatgataaccaataggatgatttccttagacacagccctaaagttatatgatttattcataacttattcataactttggtgattgtaaatttcataactttggtggtcatacattttcagtggatcaccaaggtctggaattatccactgtggtcctggctcctccccaggcacagcagctgaataaatcccatgagttatttctcctgcctgcccagaaagcacatgatcctgtaatgcaaagtggccttttctcaagtccaaaaaaagatctgtcatttggttctaggttgctttttctccctgtcatttcaccaagggacctgaaggtggcagtagatgctcggctctggaaagatcttaggctgggaattacttgtcagaccaaacgtttgaaatcctcgtagctttacatcctgaagtttaatacggttggcttacaatttttatgaagtgccacagtgggttttagtgagggtccccattttagataggcttaagtggctgtgtctagtaagtaatatttaaaaatccctagcactaggaatttggggaaaattgctagagaacaaattattagtttatttcctgcccccctacccctggacttatacttgaactttgccttgtgtttcctgctgtctatccacaaatgaaacgtgggtgattccctaaagcagccctgttgaaactgttgtctccttttttcttcttttctccagattgagttggccatccttcgatttccctatgattcatggggaactccatttcagcagctcaaacaggtggtagaggagccatcgccacaactcccagcagacaagttctctgcagagtttgttgactttacctcacagtggtaagacagcctcacctcccaagtgtcagtgtgaaagaagaagatgagttctcatgaatttcttccatcggggttgaatccatcatgcatacattcattccgaaagcatttgtggagtatgccctctctgctggagaagcaaagatgaccgtatcacactccctgccctcactgagcccaaagtcaagtagagaagtctcataaatgaataattatagtataatgtggcaagtccagtgatagagataggggcataggcgatttaaggaactcagagggaagacctcaggataggcttttctggaggagataaatctggagctgcgatcacgagaggaattttccagacaaaagggaaataggaaaggaaacatattccaaacagaaggaacatcattcacaatgtcacgaaagcaagaaactcctttatgtgagctttaagcaatttgatgttgattaaagcataaagagaaagctgataggacccactagaggcctggggataggaagtagaggcaaagaattactttcggtgagaagatagtgggtagtttgagagtgtttcttaggtccccagaagtcttgtagaaccttggttgctactgaatacttgctaactgtggagaaacttgcccaccataagagacaatgctgaagttctgggaagggaatccaaaggaagttggggtggaaagtgggagggagccatactcatgaggtgaactatattttcatgaaaactgccagggcagtcaagaaaagcaagaggggaaagtattctctagacaatccagtaatttctatctgcatagaggtcatgatgcctagcatggcttgatagtaatgatcatggcaagtgatgctggaagcaggatgccagaagtgaagcacacccctgagccaggttagcgtatttggccatccgggagaagtagatgagaattaggaggaagggggctcggagatggtggcaggcccagctgtgaccctgggaggggagccgttctgagtactcactgctggggaagggcctggagctctgaaggctgtttgaggtactgaggaagctgaaggaacatcttccccgtggcttcattcctcagcctccatggtttttagaagtgctgtgaggcagggcacccgcgcctgtaatcccagtactttgggaggccaaggcgagtggatcacctgaggtcaggagttcaagaccagcctggccaaaatggtgaaaacctgactctactaaaaatacaaaaaattaactgggcatggtggtggacagctgtaatctcgggaggctgaggcaggagaaccgcttgaacctgggaagtggaggctgcagtgagccgagatcacgccattgcactccagcctgagcaacaagaataaaacttcgtctcaaaaaaaaaaaaaaaaagctgtgaatacagcattcatcaggaaacatggaagaaacataaaacaaagcaactgtctgttgcttgtgaacctaagagctcttcgactctttgttagccctaggccccttctcatttctggtacttttccctgatgatgtatgaggctggtctgcagttgtttgtttttgtttttggctggatgactagagaggggctggagcctcgagcactagtgtaatagttgttggatgcctcttaaaagatatatcttctaggctgcttcctgtctgttttccttgagggagtgtgctggatgtggtagtacctctgccaggttgacctgggttcatgattttgccttctggattcaaagacttgttttttgtggatggttggttggttggttatttatttatttattgccttatcctcagatgtttaaggtcacatcaaaaaaagggatgaggggccgggcgtggtggctcacgcctgtaattccagcactttgggaggccaaggtgggcggatcacttgaggtcaggagttcgagaccagcctgaccaacatggtgaaaacccatctctgctaaaaatacaaaaattagccaagtgtggtagcacacacctgtagtcccagctactcgggagattgatgcaggagaattgcttgaacctagaaggcagaggttgcagtgagctgagattgcaccactgcactccagcctgggtgataagagagagacgccatctcaaaaaaaaaaaaaaaaaaaaaaaaaaaaagatgaggcatcttgggtagtacagaacagtagttctcaagaggggtggtaatggggaatgatcttatctagctaagtctcttcaaattattctccctattacctttctcccacctatccccttttcccaagattctgggtgctttaggaaattttggtaagaacgaggctggtgtgaaaagtttgagaaagctgagtctaccattgtgaatcaccagtttaatccaatgattctcaactgtggctgctcatttataaaactctagtgagctttcaaaatcactgccccctaggcctcatcctcatagactctgatttaactgatctggggaggggccaagatactaatatatttttaaatgttctcaagtcatttttatgtacagctgcggtgataaccccaggtttagacatatgatctatggacctgccatcaactagtttctgtttagaaggtttattttcttcaatttgtttaaaaaaaatcatccaattgcttgaattttctttcaccagtgtattttttctcttactggaattttctccgaagaatcagagcattgaaactttttagagatattttaaaatgaacatcttgagaaataaatggtttttaatttttttttttttttttttttttggagacggagttttgctctgccacccaggctggagtgcagtggcacgatctcagctcactgcaagctccgcctcctgggttcacgccattctcctgcctcagcctcctgagtagctgggactacaggtgcccgccaccacgcccggctaattttttgtatttttagtaaagacggggtttcaccgtgttaaccaggatggtctcgatctcctgacctcgtgatctgccccgcctcagcctcccaaagtgctaggattacaggcttgagccactgcgtccggccaatttttctaattttaatgtatgcacacatatatggaagttccagataccggcatcattgctcttcatataatgactgccctgtgccttctctctccttataacacccatagtgccttcatggctgcctgcaaagatatccccttctctctcattttcttttaattttaatcccagctaccacagttcattaattaaaaaattttgagccgtagacatgtctcagctttcctgaaactgttaattctattaatactgtttgctcggtgtcatgtcatttctactcaagtaagtcagtttgtcttatatctgggtatattaaaaacaatactctgtctctacaaaaaatacacaaattagctgggtgtggtggtgtgcacctggggacccagctacttggaaggccaaggtgggaggatcgcttgagcttggaaggctgaggctgcagtgagccataattgtcccactgcactccagcctgggtgacagagcaagatcctgccaaaataagataaaattaaataaataacaaaatgcaatataaaataaaataaaatatgaaactatctagaaacaaaacccaaatcactttaccctagaagtcattaaaagataaattttccttcctcaaagtgtcagtattatagttctggtagaatgctatacttaagaatatcagttgtctaaaatagtcattttgttggtatgggaattaagaaatagaagggaatcgttaattctgaattttatgagcattcttacttatcctcagtttgactttttcagcatgcaagctctcctatttcagatcccaggtcaataactttttttccctgccacaaaccaccaatatattttctttgatatcccttaagtatgaacattatttttcaactgggttgaaaaagtcatcttatactcaaaaagtagcactgattttcttttagagtttatgactggcctagaactttacggaagcaattttatttttcatacatatattaatatatgggtacatacctccagccattagccatctagtgattttacttgtttgattactgaaagcttgaggtttgatctggagcttggtggaaagaatggaaaagtgataatgttaacagaagagtacctcttctacctcttcatgaacattccctgtgcacgtaactcccctttatcagctattcttttatttttctcatgaataaagctgtgttattgagacataacttcattaaaggacctttttttttttcgtgagctccatgttttttatatttttattatgtaggctatggtcctcccagacttctcagaaaggccgctctatgtgctaagtggggaagggagactacggatttcaaaagtgaaatatttaatctcaaatttcaagatagatacatctatgtttttattgcctacatctgtctttggtatgcagaaaaagaacccattatacccgcagcctaggtaactgtcagagtatttgtgaacttgtgtatcctacctaagcattcgatgtcacaaagctactaggtatcatacacctgcctaggtatcatacccgtgccaaggaatcaacttggcacgatgccatcaccatgttgcaaggtaccataattctgtatccagggaattgacttggtagccactcttgtctggcccatcagtattgatcactgcttgttagttgacagtaaatcacttagtttgtagggtgaagtagaaaagctctaacaggctatcatcaccacacccaaagttagacctagagtccagagttccagtttttgcatttcttttgcagtaacatctgacaaatgttatcttgaaggagaaggaagaattaaccatatgaacgtaaaggaaaaaagcaaacccacaatggtttcttacaaacccttcttttctgtatttattttgagataggactacagaatgagattttcttcctctttttcctatatatctctttcttatcgtaggggttttaaggagttcttgagttgggttgtgttgaccatgtcagccttgttttgagattcatcatagagaagtctaatagagaagtcttgctttctagtcctgcagaagggttaacaaacgagttcgcaaaagattggaatcttagccggtttacacttttcattataaactcttcctataggttcacagaaggaagtcactggaagtcaactgccgagtgccagatcagctggacttccctttggctttttctccaggcctatttaagaagctgtgggcccaactgaccagtctgatggcatattgaagggtagtggaggcccactcaagcatcaatattgtctgactcagggaaactagcataaaacacagacagtcaaatacagtctcctacttgtgtaggaaggacagtaaaaagaggcactagatgtttatttagcttttgacaaatgtatgccttgaaacgcgcaatgtgtttttattctgtggatgtaccaaatagcccttcttggaaatgatcgggggaattcaaataggcagaaatcctctggtcagcacaaactacaagctagcaattctcaagacagcatgagctgttttttagtgtcagctatggtcagaagcgtgtgttgtggcatttggaaaaggaattagggcagttagctaattgcacgcttgaaaatgagaagctctttgaaaattcaaaagtctgattccagttcaaaaagaaattggtgttgctttgaactccaaagttgttattgtatactgaatttcaagtacttcctactaaacatggaaaatttgctttccccccaaccttatcctgagtgtattgctattcttagcccatgttttgaagtgttcttgatttaaaagatggagagaatgggttatatcagttccattaatttaataaacagccttgctttgcggtgtaagtattttccatctatattctgcagtagtgtttggggtagattgtgagctttctaatcaggggccatgagtcaaggaatagcctattgaccagttagtcttggaggtttcaggaatccttaacactttatgatggatcaactagggtactttccccatattttctttatacagagttaacaaaaatctggagattttttttttcttttttgatacagtctcaccctgttgcccaggctggagtgcagtggtgcaatctcagctcactgcaacctccgcctcccaggttcaagtgattcttgtgcctcagcctccctagtaactgggattacaggctcctgccaccatgctcagctaatttttgtatttttagtagagtcggggtttcaccgtattggccaggctggtcttgaactcctgacctcaagtgagctcaagtgatccacctgtctcaccctcacaaagtgttgggattacaggcattagccactgcacctggtcgagaaatctttataagctgttccagaagtgaaaagataagatatcctgactcaaaatcagtattttaaaaaaatacagcatttaaaaaaaatacagtatttttaaaaatggagatgtttaagctcatctatctgttggaaagagacagtcattttatcttttctgctaaatataaggtaaaaaatcagcacatttttacatttgagaaacaagcttttcttcctgacattgccttggttctgttgttgaccaatgaaagctagtaacggagtgggcctgggtcctcagtgagagtgttccagatgcaatgcggagtttaaggtctaaatagagacagccagaatcaaccatctgaatattgagtgtggatttaatgttgtgcttgcactttttgttatttacttagcgtgttacattgttccagcgatagagaagcatttctggtttttgatttgctttgaacaatagtgggaaattcagggcttctagcctgtttgttttttttttttttttttaccagggtctgtgtgcaagtcagcaacgctcctgggatcacattgcttcttctgtgtttctttctaggtaaactagctcttgaacttagaaagaaacacttttgcttcctggggttgagggcaggagacggtcgtggtgagaatgtgcttaaagacaaagacaaaccagctggagatggtccttttaagtgaaggggagaggaagccgcaacaaggagggaccacctattacacaaagcacagcgtttcttaatctctgcactcatgacattttgggctagagtgttctttgttgtgcgggattgcccagtgcattacaggatgcttagcaacatccctggcctctacctattagatgccagtaacaccctgccaccagatgtaacaaccaaaaatgcctcctgacattttccatatatcccctggggagcaaaatgacctccagctgagaaccacccacgtagactctcagcatctaggtacctacaaaaccatcggtgggagttacacggactcattcatttcactcagcacacattcccatatcaatcagactttgccgcctgttaattcctctttctaatgcgctcttatttttatcctcagttgagatgaaactttctctcataggttgtctggtcactgaggtcactaggtcctaggtctgccctcagttccaggttgaaacttctgtcctcacatctacctgtagcctgtctcaggttccctggcttccacccacagcattgcctggaacaaactggtaggctgattttaagttgttttggttcaaaaactttctctctctcttttttttttttttaattttatttcgttttaaaccacagtttctcaaagtgcctgaactacttcgctctctcatggttctgtaccttaccccgtcatgcttagcttcggagggtgaggcagagctcacgtcacacatgctaggtctcatttgctcaaaatgatcccttagctcaaatcccagcaacctaacaatcagttacattttgattcctccaactccaggcaaaattcctttccattccaatgccaggcaaagctcctttccattcatgtatgattttgtggtccgttgggcacaggagtctgtaggttgccttgcaaatcatagttttcaaaatcatctttttctgcattctgtaacctgggattccaactccaagtaaattgtttcttttcttttctttctttctttttcttttttttttttcattttaaggccagagttggatagaggatagggatgggctgagaatggggtgatgggttggtctcttcatcttacagttttattactgttaaataataagtaacagcatttattgcctccggtatcaaatgttattaaatgtctgtgtcaatggagagcagaataaccagaagtcacctgacaatagcgcatgaccataaagtatttctaacaagaataattgctgtcactgagtgcgctctctcttttatcagctgtcataaacaggtcttattacctttgtcataaacaagtagtattaccttagaaatgttatggggggttgggcacagtggctcacacctgtactcccagctctttggaaggctgaggcaggtggatcacttgagcctaagacttcgagaccagcctgggcaacatggtgaaaccctgcctctacaagatacaaaaattagccaggcatggtggcacgtgcctgtaatcccaactactcaggaggctgaggcaggaagatcacctgagcctagggaggtggaggctgcagtgagccgagattgtatgcccctgcactccagcctgggcaacagagccagcccctgtctcaaggaaaagaaaataaatattaggggtttattgcttctatctcaggcagatttggttaggactatataaaagcaaattatacattcatgggaaacagaagcaaaaagaaccaggtacctgacagtgaagagataacaaatggcaatgtaagaaacacttgccaatttctttgtctgtggaaatggcattaaagctgctttgaaggaaagtagattttttgaaataaaatggctatagatcagaaaaattagtgtgcatatcatcggtaaagtatcaaaaggaaagtacacacacacacacacacacacacacacacaactatttttcccattaaggcacaaccagggtgatttaaaacatgatacataagtgttacagaagaggaaagtcaagataggaggctgtgttttcaatacacttttaaagctgattatgtttagtgttctacaggttctgaaatccttgtctaatgaaaatatatatggcttctagattttaatgattatttttttttctttaagcttaaagaagaattccaaagaacggcctacatacccagagctaatggtgagtattgttagcaacgtaaacatgactatactgatagctacaaaaggcaaagtcactaagacctaaattatcatcacatcaccatattggaagagttggttcattgatacatcagtgacaggaattgaactccaggaaagagagttaaagagttcatcctacatccttcttaaacataggttgggacctgtcactattcttagtagtttttttccaggctaataaacctgtcatgatacagagcaaattatgtgtatacaatttatatttttgaatttaaaagatatgagaagcctcatattactaagataaaattaaggaaagtatgatttaagagatttcaatactgaggaaaacttaaatgctctttgactgatcaatttttgatcaaatatctgggctaaattagatgaacaactttttggggggtagctaaggaggaaaaaaaattttgctttttgttttcactttggtggaaaaaagtaagacaaagcatgattagtttaaattatactccctcagcattcacagtttatcacttgctgtgtctataaaaagcaagagtgaagaaagtaatatcttagcattgtttgttgtattaaaataacgtttcttaaattgtggtaactataggccgggcatggtggctgttcatgcctgtaatcccagcactctggtaggccgagttgggcagattgcttgagcccaggagttggagaccaacctgggcaacatgacgaaaccccacctctacaaaaagtacaaaaaattagccgggcatggtggcatttgcctgtagccccagctactcaggaagccgaggtggcaggatcacttgagcccaggaagttaaggctgcagtgagccgtgattgtgccactgaattccagcctgggcaacagagtgagaccctgtctcaaagaaaaacaaacaaacaaacaaacaaaactctggtaactacaattctaagctaattactaatgattctaaaagctaaatacaaatggcaaggacctaaacttggcaatgctttgctttatctaagtatatgttgaatgtaggagaaacacatttttgggggggagaaatatataaaattcagactatttgctaatttatgttaattcctagatttgtttcaattatcaaggttttcattttagcaggggaaggaagagttacgttcatgcacaatttcaaaagcaataaaacactgacaccctttcttactggaacacagttattcatcaggcattaaatgcttgctcctctgctatcccagccacaagccctgctgtcttcaagaccaactcagggcatgtcttagaagcatggattcctagtgtcaaatgctgtggtgaggtggcttagatatgaggaagcacagcttggaaatgtcgagtcaggaagagttacagaaagctgatcaggaagatgcgtgatagttacagccaatcacataggttttcacttctgttgcctaagctttgattgaagattgaaccattttgcaactggatgaattggagatgagaccatctcattgggcctccattgggtgcattaaaaggcagcccctggtgctcagcactctaccatctttattcaactaaaactcacagttaaagaaggaaatatgagtaatgtttgagaaaatcctagcatagtacatgtttaagttgaatattttcttcccgattattttttaatagccagtcaaaggcttttttggttctgtttactctttttaaatatgcttatgcacccgctaggccattttaaaattaatttcatataaaatacagtagatatacagttattcttgtaggatactatggagcctgtaatcctattttatttatttatttatattttaatttttattttttagagatggagtctcattatgttgcccaggctggtctcgaagtcgtgggctcaaacaatcccccggcctgggccccccaagtagctgggactacaagtgtgcacctgtactcctattctaaagttgccatgttttgtaactaagttcagataagaagaacattttctatatatttctggctactttttcttcttccaaatggtttcggatcagaaatttcactgaaacacacttgagaaaagaatgcttaatatacatgggcagctgatgtcaaattctacatttgtaatatgttctaaccctgtgatattttatggcctacatatatatcaatgttataaaatcatgtcagtcccccttttcttcttacagcattagtctttgtggtactggaaatggacttgccttttaagactataactgttccctgctttcctgtggaactgaggttttcaaacggaaaatctgagtccaaactccctgactttagcattgggaaaacacttgctgagaggcaattgtttagattttaggagttggtgaggaagtatgaaggaaaaaaataatcctttttccaggtgaaggacagtttaattaaggccttaacctagacatgtccctcttatagaaatcccaaatgtttctctccctaacacggattgaagggtgtgtattctttaagatcatgtcatttgcttcttctctcaaatgtcactggggagtatgactcagtagaatttgttcttctaaagtaggtagcagccaacgatttctgtaaaggactaaatagtaagtattttagtctttgtaggctatacagttgctgtttacaatggcttaattcagtgttgcaatgtgaaagcagccatatccgatgtgttaaaaaaaaaatggggtgtgtgtggctgtgttccaataaaactttatttaaaaaaacaagcagtgggctaaatttggcctctgggtcataggtagctgatccctgtcctagatgataatcaccagaaaagataaccagttcattcaagtgattgcccagtgaaataatgttctccaattatcttaggaagttctagattgaactgtatgttaaacaaagatgcctgacccattcaaaaccatagtcttaagggatgaggtgctgtgcatgggacagggagacctgctggtgactgtagcttgtctgtctattcctcgtagtatgttcacggatctccatgttttcttcaggcacatcagtgagactaaatggtgtaaagtcctcccttcttgtctccctggctcctcttttgggaaacccagcctggtattatagtctgagtattattcatagtccctcatttgtcaatttcctggttgctgcccttgctaatcttaatccattgcttataggagggactgggttccctcttaaccttttacagcctcaaaacccacacaagaaggcaagtcacactttccatttgtcatgcctacccgttttcccctccccctgcccttctggctctcatagcattttctcaacctgggaataaatggaaagatgcctagcgattttctttttttttgattaaagacttcaagtcaggttatttaattcatttgcagactcaggcaacatctactgagctaatagccactagcagaacaaaaggcaaggtggggctggcaggtgttggaagcagtcaccaagataatctgaggtttggcatgtcctgttttgatagtaaaaagcttttaagtacattaaaagatttccaaatgtccagaggatgtgggaaagctaataagcatgatggtagagtccttggtaagtgtgctgtgtatgtggtgactaatcagaagtatggctgctatttagtttttgagggagctcaggaggaaggacctggcactcagagcttcagttgatttcatgagtgtaaggatcggagccagcactcaacctgtgtcctcagatgggcaaagggagaaaatctcttttccattttctgagtcatgatacttaatcgcgaccagctatcttctttggggtttttatttctttgttcctttcccatttgcattgtttcctagagtttccatgagcaggaactcagttttccacggagctgactcatccaaccctctgctgtcaggtttaaaacaaatataattagaaaacctacagctgggcaacataaaggttgtaaactaaactccctaaagtcaggggaaacagagtgagtcacttatgtgtctggatgtaaaaatgcttacatttagctactcaactggtcattgaaaatagactaccaggcaatcaagggagtgagcatgggaggtgagacacgtgggactaagttctacctgtaagaattatccatttggggtaggtttggttggttctatttccactataagaactgtggctcatgacctgatatatctttctaagtagaggtggcaggttccactgtgagagctgggcacttattgtaacaaaattgagcaatctggggagaattgttctagtgcagagaaaatggcttcctgctcaggattgttttgaaatgcatggcctcttgaatcacataccatgcttgttcccctagcaaagcataagacttgttatgtttttagagtttacttgttctgagctgtgaggatagagactcttcttttcccttttcaatctttaatctccgagttcagttttctctgcacataactagagtttggcagtctacattatttttcagatggatcaactcttcatcaggagagacataaataaagctcgtggcttggcaaatggctttaactgttttagtctaaaccaattctccaacgtcaagggcgagggctaccttccttgcacgtttactgttcaacaaaattggcttctcattccatcatctttttcctgagaaataaaagtgcatactgctggccgggcatggtggcacacgcctgcaatcccagcactttgggaggccgaggctggcagatcacgaggtcaggagatcaagaccatcctgggtaacacagtgaaaccctgtctctactaaaaatataaaaaattagccaggcatggtggcatgcacctgtaatcccagctactcgggaggctgaggcaggagaatcacttgaacccgggaggcagagtttgcagtgagccaagatcgcaccactgcactccagcctgggcaacagagcgagactccatctcaaaaagaaaaaagtacatacacctatgaattgtcttattatcttactactatattagcctaaaatgaccttgtggggcccagggctatttgtaaatcagagtttgggttgttttttgtcaatctttgtattttgctgtagatgagacttacgtagcataattacacttttttttaaaatttaatatagtggaaacctagagatatcaagatggaaagagtgacaactaagagatatctttaaaatgtttgcatcactagatgtgtgcttgattttggaaagggtaggaaaagcccagcctagctctgatagggatacttaatccctgtaccaagcagatctattcatttgctaatctcatatattgattgtcagtaagacattaataccatgttttttctttttcttttccagcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatattataaaaatatcaaaaaggagctcttcttgtgaaatgtctgttccagctgttgtgactgctgccatttttgcaaacatctgcccaatcctgggtgatcaccacatcttttaggggaagtgacaagatgctctggtcatactctttttcccaactttggaaaacataaaaatcactcatataacagctcaaagagtaaaacatttggttcttctgacacttgtggtatagtattagtggaaagtgatttgtaatatgattttatatccacctacctattcatctacctgtgtgtatgtgtgtgtttgtgtgtctatttggcaattcacaagtcctgccaagtggtttctatgagcatctctgtttggtaaggaggacaattgtcagttttgagggggacatgtgttaaatcacagaaaaaaatggtgccttcttctgcgtttgtccctcctgccatgtgtaagttgtaaggattgcctttgtagttaatgtactctttggctttgtttgtttgttttcttcttcagtgaagcagccttactattcatagaagggctagaataggagaaaatgaaaggtagtgagtaattctttgataagatgaggaaataatgggaaaggttgaattaattcctgggcatggactaccagatgaccacaagttgcgttgaggccgcatctttcttcagcagcgtgcaatagctggctcctctataggagatgagcttcattgggagttcctagcaagttgactaaacagcaaaagttctttctcgtgggtaaatatacccacaggttctatgatttgtagctctaggtttcttgatgatcaaggagtgaagtaattgacagggaaaatatagacctatgataaataaccaggaagcattgcttttggacaaggaaggacagagggttttgattttaaaaagaagaaaaaaaaaccttattttttctttcttggcctcaagttcaatatggagaggattgcttccctgaatcctctcttccttccccttttaga

SEQ ID NO: 36791 - DNA, 89826 bp, Homo sapiens
tgtgcagaattgtacagttgcgaaaccatgtcgctggcagctggtgctggcggtggagacttccctgtgcggtgctcagtgcagctgcacccgtgggggagggagctctttctctggccctgcagtcacctgaggttgttaccattatgaacggccgctgggacccccgcatgtgcatgtactcccccagagtgtccgggggccccagccaagggacacagctcaggcagctgggaacatgtgcaggctgatgaagagaaccggatgagggcttcacatgaggaagcatgtggccaggtcctctcagaacatcagcctcatcttcctgtctctgatctatttcagcaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaaggtaggctttctgctggtcagcctgcagttggcacgtggccacggaggtcaccgttgggcaggtcatagcttgaggctgtgacgacgggggtgggaaagggtctgctgaccttgggggctcctgcccaaccatacctttgggagaacagaactggggagggtgatgcgtgtctcgtcttctgtgggttgcatgaccatttcccatggttggtctgattgggaaatcaccgggttaactcaaaaatgttgcgctagagtcctggaaatctgttacccgtgcttaccttgttgcataatgatttcacatcctttatccgattgggagggcctgggcctgggctagctttccccaaagccctggatacaaagacacaagtatgttgaaagcacatggcatcttgcagtccccttgccaggcaggcaggagggtggctgccctttttccgatggtgcaagatccaggtccccagatccccagcctccacgttttccaccacaccatgttgttcccaaggaaggtggtggtgctgtagaaactgtaaagtgcgcgcacattcaaaatggtcccaagaggaaatgatttcttagattcattcctccctcctgaatccccaccggagagtcttggcaaggtgcttctaatctttggctcagggtcgcgcaggcttccttccttcaagcaaatagtgtgaaagctcctcaaggagctcagatgtgtctccagggggctgggtgtgctctttcgaatgttggaagatctcagtgtgctgtctttaccttcagcaagaaagcctcagttcgtggattcctgaaaacatcaagaagaaagaatgcgtgtattttgtggaaagttccaaactgtctgatgctgggtaagtgacgtgatttgtgtgtaagacctctgacttcttccttccgatcccacatggagtagctgatcaggccaagacccctcagggcctcagtgaagggtcactggagatacctctgtctccatacgaggcttagagtccacagagcatttccacctaacccttgcaagcctcctgtcggggacagttgaccctcatcctgcctcgcaggtgcagggaccaaagtgcagagtttaggtgacttgttcagggtcataagggcactgtcgcgcggcgaggcccagtggtgtgaacacagatgcatcctctaatcctctcatttccacacctgcccccaccccaagagagagagtcccagggtccaggaactggaagggccttagggagagtccatggccagaagactgcccccctgcacagcttgccaaagccagaggcccgacttgcccccaggccccacagagccccctttgcccctcctccccacagagcccacgactcaggtgtggccaagacccccgcccaggcaacatggccactgtctctgagtggctggatatggccctccggagccgatggtgctccccgcagttggcgcccctttaggcacggacagagtgttgattcatgtttgtgtgccctccccgagcaacacccatttcatgctcttccacaaatgggccacacgcttcctccttttactccattgcctggtgagctcctacttatccctcaaggcctattgcagatgctgcctctgccgtgcagccttccgtgactatacaacctctaccaggaagtgagcttccctcctaccgcaccgtgtgtttctctttgatcccagctgtcgtgctgtaactgtgtggctttgtgttcatctttcttgctagctgctgagcttctggggggctgggacgaaagcagagtgttgtgttaattcccagagagtggccttcagctcatatttactgaatatggggagggagaagcatcctgtgcttgggaaatagaagaagactgtgttgccccagggtacctctagtgtactcggtacatcatcagagtttcacggtcaccaatacaacagctgtccctccgcatccctggggaattgttcccggacacccacggacaccaaaatcccatatctcgtatcagtcccaaaatctcatatcaagtcactgatatgagatggtgtggtatttgcatataaactatgtacatccttcagcatactttaaatcatctctagattacttataatacctgatacaatgtagatgttataaaaatagttatactgcatttaaaaaatttgtatttttgggccgggcgcggtggctcacgcctgtaatcccagcactttgggaggccgaggcaggtgatccacccgcctcggcctcccaaagtgctgggattacaggcgtgagccactgcatctggctatgttatttttaattgttttttttttcctgaatatttttagtctgcgtttggctgaatctgcagatgcaaaactcgcggccatggagggctggatgtagagacagtgatgaagagccccatgtggaaggagcggggtctgtagagcagtggtactccagcctcggagctcacccttgttactggaaaggggtcccgatccagaccccaagggcgggttcttggatctcacacgagaaagtatttggagcgagtccacagagtaaagtgaaagcaagttattaacaatgtaaaggaataaaagaatggcttctccataggcagagcagccctgagggctgctgcttggctattttttttttttttttttgagacggggtctcgctctgtcgcccaggctggagtgcaatggcatgatcttggctcgctgcaaccttcgtctcccaggttcatgcgattcaccatgttggccaggctggtctggaactcctgacctcaggtgatccaccagccttggcctcccaaagtgctgggatttcaggcataagccaccgtgcttggctggttggctatttttatggtagttttggatcatgtgcttaacaagggtggattattcatgagttttatgggaaaggagcggggatttcccagaactgatttcctctttctttcagaccatacagggtatttctgatgttgccatggcatctgccaactgtcatggtgctggtgggagtgtctcttacatgttaatatgttataattagcgtgtaatgggcagcgaggataaccagagcccactttcgtcgccatcttggttttggtgggttttacccagtgtcttgcaccctgttttatcagcagggtctttgtgacctgtgtcttctgctgacctcttgtctcatcctgtgacttagaatgccttaaccgtctgggaaggcagcccagcaggtttcagcctcatttcacccagcgcctattcaagatgggactcactctggtttgaacgccgctgacaccctgacctgctgtgtcctgagaagcctaggtgaggccccgtgggtctggggcctctgccagtcggctctgcgtgcttctcacatggaagtggaaacccttggggcagcagggcccagagaggaaggggtgctgacctggatcagatgtaagcaggacagacttgcttctggaggtccccaaagccatcccccatgctcaggggtttgctaggactcacagctgtgcacacagctaaggtttatcatggtgaaggcctacgtgatgggcttggcaagggagaaagacacaggccgagtctggagaatctgagggcaggctgctgcggctctcctgtgcaggcgccatgcatgctccttcctctagccgagaagcacgtggccacctgcaaagcccattcgaggctcagagcccagggcgtgcatcctgcgctggccacgtgggcccctctgcatggcaaccacccaaatcccagactcccagcaggaaagcagctgttcagcacaaacccattgcaggaacagtccaggcccggcaaagcactcctagcagtcaggggacggagagacgctccaaaagccccgttcccagacaccaccttgaaagcaggcccctctgagaaggcaacctgagatctgctgcaccgagtctgtcccgcacagaagccgctctcatctcaccaaccacggtggtcactgcagcaggatgggaagagggaccaggtgtgttcctggctgttccttcctgaggagtggatggaatgtccctccttcttgtggaaagaccagggcggaacgagtggtgagcatcgtctgccacaaacacagcttttcaagcagatttatttataccacttacatgtttccattaagcatggtagggtcttcctaccccactcgtccagacctggagcccctcgacacccgcccgggtaatcccactgcttagccccacgtcctggtaaccctcctcagctctgcacagactcgtctcatttccgtgtctgctgtggccaccctggtccagacctttgtgctcacattttgccaccatggatctcatgaccttgggcagatgacttctcttccctgggccaccaatcctcatctgtgagcgcagagactggaggggatgcctcagaattcacgcgcacatgcggtgggggtggggaggcagggagccccccttgggtggcaggaaggagcccaggttggagagaatacacctccaagagctctcatttcccgtggggtgccgggggtggtgtcccgtttacgcctatctgggccgagttccgagcgagctctccggcgatgtaatttctggatcagtgtccgcaatgcagtttccagcatcacatcaggcttgcaaacgccatgcaggttcaagttccaatctcatcagaggtgatcgttcaaggacaagagggacaggaggtagcttgtgataggctgttaggaacatacaaggacatttggggcagcattggagcaagacgggagagctcaggtccttgtctagggaactcctttccccacctccgacccaggtctctcatccataaacagtggaggtcacattgtgtccggagttggttccttcccgggggtcttggtctcgctgacttcaagagtgaagccggggaccttcgcggtgagtgtcacagctcttgaagatggcagggacccaaagagtgagcagcagcaagatatattgtgaagagcgaaagaacaaagactcctcagcgtgaaaggggacccgagcagtttgccgctgctggctggaggggtggccagcttttattcccttatttgtccccgcccgtgtcctgctgattggtccattttacagagcgctgattggtccattttacagagcactgcttggtccattttacagtgtgctgattggtccattttacagagcactgcttggtccattttacagtgtgctgattggtccattttacagagcatggcttggtccattttacagtgtgcggattggtccattttacagagcaccaattggtccattttatggtgtgctgattggcgcattttacaatcctcttgtaagacagaaaagttctccaagtccgcacccaacccagaagtctagctggcttcacctctcaacatcaggtgctcgcaagatccctgcaagtctgaagtgccttgagcgtgaccttaggggtttgtacggatttggatttgtagggtgcacatccgggaggaattattttttccattttaatgattgagaaactgagtgtagaaacatccgagatcacacagtcaatacgtggcggggaaacctgtttcctttctcactgctcagtggtctttcccctgtgccatctggttcaggtttcatctggttttagagtttttttgtttgtttttttttaattcccttatttgtccccgcccatgtcctgctgattggtccattttacagagcgctgattggtccattttacagagcactgattggtccatttttttcctgtctcatctgtgtatatatatacacatatatatgtatatatatatatattttttttgagacggagtcttgctctgtcacccaggctggagtgcaatggcctgatcttggctcactgcaacctccacctcccgggctcaagcgattctcctgcctcagcctcctgagtagcggggactacagctgtgcaccatcacacctggctaatttttgtatttttagtagagacagggtttcaccatattagccaggctggtctcgaactcttgatgttgtgacccgcccacctcagcctcccaaagtgctgggattacaggcatgaggcaccatgcccagcctcatctgaacttttctaggttatttgttaccagcaaaaaattggaatctaaaaatatggtggatttccaattaaacaagttacaaagaacacataaatttatctcttcttgccctgaaacaccaatgaattgcagtaaagcaaaaaaagacttcaacccacaaagaaaaaagagggaagttagcagttgaagaaagagattgccgcattcttgccagaggaaggggaggaggcagagtagcaggtcctgaaggctggcgactcgggcagctcctgccgtccccaggcgaggggaggaggtgggagaccttgggcgaggtgctagccccatgtcgtctgcttggagcctccatttgtgtgtgcttttaactttttattttgaaataattacagatgtacagaagttccaaagatactgcagaagggccccacggttccccctgtggctacattctgcataactgtagtacagtacccaagccaggaattaaagctggtagaatgcatgtgtttagttttatgtcttttttttttttttttgagatggagttttgctctgctgcccaggctggagtgcagtggcaccacaccagctcactgcaatctccgcctcctgggttcaagcaattctcctgcctcagcctcctgagtagctgggactacaggtgagcactaccacgcccagctaatgtttatatttttagtagagatggggtttcaccatgttggtcaggctggtctcggactcgggacctcaactgatctgcctgcctcggcctcccaaagtgctgggattacaggtgtgagccaccgctcttggccttatgtcatttttcacatgtgtatttgtgtaactaccaccgtggtcaagatacagcactgtccatctccaccgagctcttcctgtacttcctccgtatggtcagctcaccttctcccccatcatccctgatccctgcaaccaccagtctttcttcatgcctatcattgtgtcatttcaaggatgttacgtcaatggaatcatacgctacatgacccgtgtctttttccctcagcacagcgcacttgatatccatccaagttgctgcttgtgtcaatattattattattattatttttgatatggagtctcattctctggagtgcaatggcacgatctcagcttactgcaacctccgcctcccggcaactgggagtagctgggactacaggcatgcgccaccacgcctggctaatttttgtattttcagtagagacagggcttcaccatgttgtccaggatggctttgaactcctgacctcaaatgatccactcgccttggcctcccacagtgctgggattacaggtgtgagctaccacactcggcgttgtgtcaacattatttaactgctgaatattcctttccctttcgccttgcctgtgtcattacacttcaagtgagattttggtagacgtcaaataattgggtcctatttttttaaatacattctgtcaatctgttttttaattgtcatatttagaaaatttatatttagtgtaattattggtatgttagggcttatgtctgccattttattttttgttttctgtttgttctgtgttttttttttgccttcttgtgggttacttgaacattttttagaattctattttgattattcatactatttttgttttttggagacagagtctcactctgttgcccaggctggagtacagtggcacgatctcggctcattacaccctccacctcgctgggctcaggtgatcctcccacctcagtctcctgaatagctgggactacagacatgcaccaccatgcccggttaatttttgtatttttggtagagacaaggtttggccatgttggccaggctggtctcaagctcctgagctcaagcaatctgcccaccttggcctcccaaagtgttcggattacaggcgtgagccactgcttacaccatactatttttgagtgtatcttcttgtatcactttttcttaaaggggttgctctagatagtatattatataatacagcttatcacaatctgctgatgttgacattttaccagtttgagtgaaatatagaaacattatctcctttaacatctctgtccccttcttaatctataatataattgcttgaaatatttcttctacatatattgaaatgagggccgggcatggtggcttaagcctgtaatcccagcactttgggaagctgaggtgggcggatcacgaggtcaggagatggagaccatcctggctaacacggtgaaaccccgtctctactaaaaatacaaaaaaaaaaaaaaaaagccagatgtggtgatggccgcctgtggtcgcagctacttgggaggttgaggtgggagagtggcgtgaacctgggaggcggagcttgcagtgagcaaagatcggcgccactgcactctagcctgggtgacagagcgagattccatttcaagaaaaaaaaaaaagaaagaaagaaaaccatgtcagatagtgttataatttttgcttcagccatcaaacatcagttatgaaattcaaggggttactctttttgttattctttcttcctttcagatatttcaaaattccttttcttgtttcctttctgtttagagaatgtcctttagccattcttttagggtgtgtctgctcgtgacaaattccctagccttccttcaattaagaaggtccaaacttcctgtcttttctgaggtgttttttttgttttttttgaggagtctcccactgtctcccaggctggagtgcagtggcaccatctgggctcactgcaacttccatctcctgggttcaagcgagtctcctgcctcagcgtcccgagtggctggggttacaggctgctgccaccatgcccagctgattttttagattttagtagagacagggtttcaccatgttggccatgttggtctcgaactcctgaccttgtgatccacctgcctcagcttcccaaagggctgggattataggcgtgagccactgcgcctcgccgcttttaaaagtttttatttgtttttagtttttggaagtttaactgttgtgtgtcttggcatgtatctctttggatttatcctgtctggtgttcactcagattgtagcgtgtgtaggtttatgtcttttttgtcaaatatgggaaattttggccatgacttctttacatacattttcaggatcactgtctttttcttttccttctggaactctgagcatgaatgtatgatcttttgttatagtgctgcaggtcccagaggttttgtttacttgtgtattttttctttgttgttgtttgtttgttttctctctgttgttcttattgggcaatttctactgttatatcttcctgctcctgggttctttcctctgtctcctccatcctgctgttaggtccatcctttgagttttttatttcagttactgcatttttcagctctaaagtttgcatttggtatatcttctctttttttactggaaatttatattttttcatttgttttgagcatgttcatgattgcttgttgaagcatttctaatgtggctgctttaaaatcattttcagataattctaacatctgtgtcatcttggcgttggtggctgttagctgtcttttttcatcctggttgagattttcctgtctcttgttaaaactagtgatgtttgattgaaaccttgatagtttagattttatgttaagagactcaagatcttgagttttagctggtcctcttgacatgtctatggtgaaggaaggaggtccccccatcactgccccacaaagggtgaagtctaagcccccctgtagcctccactgatccactgacacttcctggggaggcttcttgttactgctgagggtgagaagagctccagcccaccattaggcctttgctgcctcccccatggctggaagggcaggtgctttgtttttgctgggtgggggaaggttgcggctttccactgggcctcctctgatgccttcacagggagcaggaagggcaccacactccctgggtgactggtgctgtgtctttgcaggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaaggttggtttccatcactctcgctctgaactgtaggtggagctgcatggccccacagtgacacgcggtggtcggcatttcctggggcaagagcaggaggctggcaaagctccagggtgcatagagcccactgcacagcaagggaagcggcggggaggggctctgcaaggcaagcaagacatgcaccccactctcagagtgcttggccatctgcaaagcagggtggggcacagtgagctttctaggaaggtgcaagctgggagtggtgagtgaattctggctgggtgtccttgggcggcatttgtcagggcctgggagggagtagggaggaaggagagggatgcaggacacagatgcgctcagggtgtgctgggagaatggtaggaagggtgtggggagggagggaaaagctgggggaaggggcccaggatagcagggaggcccatgtggcaagtctggaagcaaacgcgagagtccttgcgaggagtctgggccaggcatggcgggatccaggctgagcctggcctgcaggagagcgctgtgagggtgcagactgctggagggaggcccaggtgcagggttaggttctctcgtgcacaacctcactgaggtccctggaccagccatctctgaccaattctcaggccccatcccaggcctgtggagtcagaggctcagccccttgcatgttgaccagccttctggagggttctgagactcgcgtgttgaccagccttttggagggttctgagactcgcgtgttgaccagccttctggagggttctgagactcgcgtgttgaccagccttctggagggttctgagacttgtgtgttgaccagccttctggaggttctgagacttgcgtgttgaccagccttctggagggttctgagacttgcatgttgaccagccttctggagggttctgagacttgagtgttgaccagccttctggagggttctgagacagtgattgggtgccactgtcctggaggtggggagggtggcactgatctctgtgctggcgtctggagccctgaacttggtacctgtcgagtgtgacctgtccactcaatgcatggtgttgccatgaggtggccaaagaggttgagtggggcaggtcccggagacggggtcatgtggccccaggcttcctggctggcacagcccctgagccaccctgtgtcaccatgacacgtgggtgttctccaggcccctggacccctctgtcgctgtggtcacggggacagtcctgttgttgggtttcagatgagggattgaggtatggggaggccctacctaccctttgtctgatgccaccgtggccgtggcagtggtgggtttgaatccagctgtgtctgagcctggggtctggctgcatccctcccccaaccccccggcttctcccagccccctccctgcagctgccgacaggggccggtggtgtgagggagaaatgcctgtggcctgacagtgagggacgccagggacacagaccctgtactgcagcaggtctgcctcgaagcccgggagcgtccaccatgcaggccacagccctgctcctcccagggagaccagcacctccagatgcctggtggacccggtgggacccacgttctgatggtgacaggcactgtgcttgtgggttaactggaccttctttagtgacaatgccaccacatggttgttttgagggcacctaatggcatttctggatttcacccatcacctttgtgtctctgctaggccaatcccggcggagattgcagaccccgctgggtctcttcagacacagcccgcctagcggaacagggaaagtccgctgtgtacttgggagggtctcctggaggacggggggccagagtgacgacagaacctgggagagccgtgttcagacgggaggcagaggaagctgggcccactgagtccccaggacgggccagggcacaggggccacagagcagaggggatagggcagaggggacaggagaggggacaggagaggggacaggagaggggacaggagaggggacaggagagggggcagtgctgggtgcacaaggacagaagggcagagaccccggtgcaggagctgattagacccgggggaggcagggcccaggcgctacggcgggaattggagtctgtgctggcgcatgtttgggaggcgctcccaaaatcgagaggaagaggaaaaagtgggtcccgtgggggcacgagggctgggggaggtttgctgagggcgatcctggtccccaaaggatggcctgatgctcctggcttgggcctctctgcctccctcttctctcgtgatctgtgccctgcccacatggggaccccttttctgggtctgagccggaaaggtgtgcggtgtctgccgcccgctggggcctctctgcatggcctgtgtgggtcggtgctgtccctgaccactgacacacaggttccctccgccgttttccctttcccgcagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggtaactcggaggctggagggacacgaggccccggcgggtggggtgggctgtggaggcagtgctggggcaatcagggccatcaggacccaaaaagtccctgggagccgccgaggctgtgccccagcctgagtcggacccatgcacctctcacctgggcacagctgctccctgacgcccgatgctcccactggcttgcctgtgggctggagatggctcagtgcatggccctgctggtgcccagggccaagcagagatgagaaccttggtggcctgggaaccttggtggcctgagaaccttggtggcctgggaacctcggtggcctgagaaccttggtggcctgggaatcttggtggcctgagaacctcggtggcctgggtgcacggctggggccagcactgcaggccatttgtagggggtcagcgagagttcccagtcatcaagctttccattatcgtgtttttccatcaaaatcagggaaggagcattattatttccatctcttcacttaaggcaactgcctggttggagtcaaatcacctcccaaggttgcaccactggtgagagccaggcagggacccagtcctggtggatggtgtgagatcccaggtgccgtgacctggtgccccgccccaccctaattccatggggagggggccccaagtcctcaaggctccctgggcctccctggaggggactgtggatgaatagtgaggccctgaggtgactacttggcaatgttgcgtccggatgggcctagagtcaccctgctcttcctggggtctggggtctggtctttgcctcgcagtggagtcgtaactgagcctgacttggcctgcatggctcacagagtcctcagtttcattgtctgcctggtgagcgtgaggcacggctgcatcttttgacctgtgagtcccacagccctgcttgtaaaatgaccagaccttttctcagcctggtcacatgggactgggtttaacgcaggtcaccatcccacaggctctttctgaagctttgctgcctcaaataatgccatggatttgttcaggtctcacctgctccaggtcttgatgttgcatttttttagctttcaatatccgtgtccttgttgtccgcttcctggcccaaagccagtaccaccttttcaattgttatctttctatctatctatctccatccttccatccatccatctatttatttttgagacagggtctcagtctgttccccaggctggagtgcagtagcacgatctcagctcattgcagcctcgacctcttgggctcaggtgatactcctgcctccgcctcctgagttgctgggactagaggcgtatgccaccatgccaggctaatttttgtagagacaaggtctatgttgtccaggctggtcttgaactcctgggctcaagtaatcttcctgccttggcctcccaaagtgctgggataacaggcgtgagccaccatgcctggctgattggctgttttttttatttttttgttttttttttggagttggagtcttgctctgtcacccaggctggagtgcagtggtggtggcgctatctcagctcactgcaacctctgcctcctgagttcaagcaattctcctgcctcagcctcctgagtagctgggactgcaggcgtgtgctaccatgcctggctaatttttgtatttttagtagagacggggtttcaccatgttggccaggctggtctcgaactcctgacctcaggtgatctgcccgcctcggcctcccaaagtgctgggattacaggcgtgagccaccgtgcccggccggaggtgtgtttcttacaggggtggctgcaaaccaccagcagcagatggcaggtgggaggtgaggggcatccttcctagggaccaggctgagtgttgggagcgaggaagcactctgccgcacctgggtcctgaaagctgggaggaagagggaaagcaaaatacaagaatgcagagaggtgctgagaaccgcgatcctgagactggggcctgaggaggcggcagggaccgggagaggggcggggcctgctcctgttcccaccccacctgagcgcgtgggaacctcggttccttacacctgatgctggtttgaaagcccctgagtgaggagctctgcgttgttgggggcggggcatcgctgagcctagaagggctcaggcgtcaggctcctgggtgtcaggtgcccctcagtgctgtggggcctgcccacccgtgctccttccccaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacggtgagtgcggccccctagggaggggagcctaagaccaggggtgtgggtgaggtctgactgggcgctgtggggagcaggtggagtgtacgggggccggggtgtgggtgacgtctgaccgggcgctgtggggagcaggcggagtgtgcgggggccggggtgtgggtgacgtctgaccgggtgctgcggggagcaggtggagtgtgcgggggccggggtgtgggtgagttctgaccgggtgctgcggggagcaggtggagtgtgcgggggaggcggggtgtgggtgacgtctgaccgggtgctgcggggagcaggtggagtgtgcgggggaggcggggtgtgggtgacgtctgaccgggtgctgcggcgagcaggtggagtgtgcgggggccggggtgtgggtgagttctgaccgggtgctgcggggagcaggtggagtgtgcgggggaggcggggtgtgggtgacgtctgaccgggtgctgcggggagcaggtggagtgtgcgggggaggcggggtgtgggtgacgtctgaccgggtgctgcggggagcaggtggagtgtgcgggggccggggtgtgggtgagttctgaccgggtgctgcggggagcaggtggagtgtgcgggggaggcggggtgtgggtgacgtctgaccgggtgctgtgaggagcaggtggagtgtgcgggggaggcgggcacactcaggagattgggtgcaactcccggcccacccctgacccaggtgaccccggacaaacggctaacttggctggactctggtatctccctcaaggttgtaagaggggtccacgtgacagtcactcgctgcgagggttccgctaacagagcagagggagggggcgtggccagcaggcagctgggtggggctgagccagggcgatccgaccccgaaccggagcttttagcactttgagtccctgtactcagaggtctcctgcagccgggaatcccactgtgctgtggtccctggcagccagcacccacccccagcttctccgtcaaggttgaggacggagcactcctgcctctgattaactggacgcaggagaagcagttgctttaatccggagccttgagttgggacagataatgagtcattcaaccagattttccaaggacacactaactttggtatgatgcgtgtgtgcccctgaatccacgtggtcaggaaagcccagggaacactggcctgtgactcactgagcaggttcccttgttaccccgaggggtgatttactcctctgacagtgacacggacactgtgcgtccattccccgggcgggcagaggacactcccagatgcccacgaggggcccagcaagcactggccagccccagcccggccttcgccttcctttgcgtcagaatcatgaatgtgtccggcggggtcggactggaccagctgttgggctttgtttgctctttttacgaattgaaaaactgaagccaggagcggctgggtgacgtcccaggtcactccttactttcctccccacgctgagctcagacgacttcccgtgacaccactgttggtggcggaatgggactgtggctgcttccgctcagccacgctccctctctgtggacggcggagggtgtgtgtcccagcccggctgccgccctcccttaggtctgtctcccggggctgctgtaacccaggctcacaaacctggtggcttaaagcagcagaaacttagtctatcagatctggaatccgcgtcgattggccatcatccagccatcggtgttggcggggccacctccctctagggcctaggggaagagcattccttgctgcctccagcgtctgggtgctgatggcattccctggccagtggccacctccctccagtcgctgcctccgtgtcccatggccgcctccctccagtctctgcctccgtgtcccgtggccgcctccctccagtgtctgcctccgtgtcccgtggccgcctccctccagtgtctgcctccgtgtcccgtggccgcctccctccagtctctgcctccgtgtcccgtggccgcctccctccagtctctgcctccgtgtcccgtggccgcctccctccagtctctgcctccgtgtcccgtggccgcctccctccagtctctgcctccgtgtcccgtggccgcctccctccagtctctgcctccgtgtcccgtggccgcctccctccagtctctgcctccgtgtcccgtggccttctctgtgtgcctgtgtcaaatctcccccaagagttccgtaagaacactcgtgatggcgtgtaggtcccactagggtcatctagggtgatgccttcatatccagatctttaactgacatctgcaaagatgcttttccaaacaaggaaatgaggagcagcacttaccgggtccatgagcaggccttgatgtctttgggtggccatgattcagccaactgcggtcctccctctgacctcaaagatttctgtccactccacaggcaaaatatgttcacaccattgccagatcttggctgggtgtgggggctcacacctgtcatcccagcacattgggaggctgagatgggcggatcacttgaggacaaaagttcaagaccagcttggccaatatggtggaaaccctgtctttactaaaaatacaaaaattaactgggcatagtggcaggcgcctgtaatcccagctgaggcagaagaattgcttgaacccaggagctggaggttgcagggaaccaagatcatgccactgcactccagcctgggtgacagagcaagactctgtctaaactaaaccaaaccaaaccaaacaaaatgatcccctccaactacaaacctgttacagcagaaactccaagatcaaaatctcatgtaaatatcataagcttggccgagtgcggtggctcacacctgtcatcccaacactttgggaggccaaggcaggcatatcacctgaggtcaggagcttgagaccagcctggtcaacatggagaaaccccgtctctacaaaaaattagccgggcatggtggtaggcgactgtaatcccagctactgggaggccaaggcaggagaatcgcttgaacctgggaggcggaggttgcagcgagccaaggttgtgccactgcactccagcccaggtgacagagcgagacaccgtctcaagcaaaacaaaacaaacaaacaaaaatatcatcagctcaaaagtcccaaatgtcatcatttaagtcagggacgctgaagactctgggtctgatccattctggggcagaatttctcttcatatgtgcacctgtgagaccagaaaacaagtcacctatctccaaaatacaagggaagagcaggtgtagcatcacagctgcagacactctcattcccaatgggggaacacgggaggaacgaaggcatcaccagccccaggcaattccaaaacccggcaggcagaatgcactaggtgataagaccggggagacccctctgtggcttgggcaccccctaccctgctctgtgtccacggccctgccttcaggacgatccttttccctgaaggttatagcttttagtctgcttgaagattttaaggagtctgacgacctttcattttatcccgtctctgtccctttcagtccaaatttgcagtgttgttgttgatataacatttgtgaaaaccttgcagtcctcctttgaatgccataggaatttctgccagtagacaaaaagggctctgcagacctttcctgtgatgctgtctccactcctggcttctgagatggttgagtgaattgcagtctccttgcctggtctcttcatcactagcaggaggttgtttagacacacccttggccctctctcttttttctttttgttttttttttgagacagtctcactctgttgcccaggctggagtgcagtggtgcgatctcagctcactgcaacctccgcctcctgggttcaagtgattctcctgcctcagcctcctgagtagctaggtctacaggcacccaccaccatgcccagctaatttttgtatttttagtagagacagggtttctccatgttggccaggctggtctcgaactcctgacctcaagtgatccgcccgcctcggccccccaaagtgctgggattacaggtgtgagccactgcgcttggccgttggccttctctttagagtctgcttttcgaacagtgaatctcttttcattttctgcattatatgcgacctgcattatatgcgacctgcattatatgcgacctgcattatatgcgacctgcattatatgcgacctgcattatatgcgacccggataggctgagaatttcccacatcatcaagtcctggttccattttgtctgtcagtttttccctcaatttctctctttccttttgcattttgtgagaagcagcaagaaaaaaaagccaggccacaacttgaacactttgcttggagatctctgcggctaaatcttcaagttcatcatttacagttctgctctccacaaaactgcacagcacaattcagccaggctttctgtcactctgcagcaaagttggccttccctccagtctccagtaccacatttcccacttccttctgagccctcaccagaagaagcaactgtgatgttcatttttctgctaaaattctgttcatgccagtatatgtattctctctctctctctttttttttttttgagatggagccttgctcttttgcccaggctggagtgcagtggtgcgatcttggctcactgcaacctccaccttccgggttcaagcaaatctcccaccttagcctcccgagtagctgggattacaggcatgtgccaccatacccagctaatttttgtatttttagtacagacggggtttcaccatgttggccaggctggtctcgaactcctgacctcaactgatctgcccaccttggcctcccaaagtgctgggattccaggcgtgagccaccgtgcctggcccgtatatatattttctaaggcagcggtccccagcctttttggcaccaggaactggtttcgtggaagagagtttttccacagatgggggcggggtggtaagcggttggtttggggatgattcaagcacgttacgtttattgtgcactttatttctattattacattgtaatatataatgcagtaatcatacagctcaccataatgtaggatcagtgggagccctgagcttgttttcctgcagctagacggtcccatcatctgggggtgatgggggacagtgacagatcattaggcattagattttcgtaaggggagtacaacctaggtccctcgcatgcacagttcacagtaaggttagtattcccatgagaatctaatgccgcggatctgacaggaggtggagctcggacagtcacacacacgatggggagcggctgtaaatagggatgaagcttcgctcgttcacccaccacccacctcctgctgtgagcagcccagatcctcacaggccacagaccattaccagtccatggcccagggggtgggggacccctgctctagggcaacaaagccctctctgccctgctcctcacttccttctgagcccttactgcgagttgttttttttctgagacagggtctcactgttgcccaggctggagtatgttggtgcgatcctcagccttgacctcccgggctcaagtgatcttcccatctcagcctcccaagtagctgggactacaggtgtgcaccaccatgcccggctaattttttcatttttgtagacatgagatccgctatgtcgtccaggctggtctcgaactccagggctcaggtgatcctcccgccttggcctcccaaagtgctgggattccaggcgtgagccaccgcgcccgtctccgcaaggcctttaataccacattcccaccaacattctcttcaaggacgttgagacgttttccattcatggtgcttctaaatcctcccgtcgtctccccattgccggtttcaatgccacttccacatttttaggtgtttgttgcagcagcagcccacttcctcaccccagacctgtatccgtttcctgtggctgccgtaacaaatggcctcaagcctgaaacagcagcattgtggtctctcacgtgtctggaggacagaactctgaagtcagggtcacacgtctgtttccccgcctcctccactcctggggggtccggctttctccacttgtggctatgtcacttgcccctgcctctgtggtccctcggcctcctctcctgtgtgtgtcccccaccacctctctcctgtaaggacacctgtgatggtattttgggcccactcggatcatccaagttaatctcatgtttcgatcacatgtgcaaagtcgctttctccaataaggccacgtccacagattccagggactgggacctggtctctgtgagggccggtgttcagcctgctcgcgttagagaggcagagctttccagaagcagtgtctgacgcttcctggccatcccagggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtaggggagcttgctttcgagggtgattgggcagagagcacagtgggctggtcagagtgtcaggtacagctggtcacgaccaggacgttcaacaggcctggcgtttggcagagagtgcagtgggctggtcagagtgtcaggtacagctggtcacaggtcattcgtggcactcggcagagagcgcggtgagctggtcagactgtcaggtacagctggtcacaaccaggatgttcatggtactcggaacgtcctcagaacacacctgggtttctttcccgtgtctctttatactttgttccaggagggtcatcttctcttgcccattttagccagtgggagggcggtctggggggctggcagctcacctgtgtgctcgcaggtaatgggccaacctacattttttttgggacagggtctggagcgcagtggtgtgatctcagctcactgtagcctcgaacttctgggctcaagggatcctcccatcaccctcccaaagtgctgggattacaagcttgaaccactgtgcctggccctacaattattttaaaccttgatcatggtctgctctcaggttcagaaatcagaatgtacgatagtcaaaacttaggatttgatacctttttcctcataggtgggatgggatgggtttgaggacgtcgggaggtcaagtgcggggttttgcatatcacttgaggagggttcaaagaggagatggtgaacgggaggtgtctgacctgtggctgggtgggctggggtcccttgcagggttccttgtgcatcgaactcccctggagggttcctcaccagcttgtgggccccagccccagggtccaactcagcagctccaggtgggctgagaacttgcattaggagcacgttccctggtgagggcgatgctgcagttcagggaccagggaccacactttgagaaccctgcttgactagtaggagcacgttccctggtgaggacgatgctgcagttcagggaccagggaccacactttgagaacctgcttgactagtaggagcacgttccctggtgagggcgatgctgcagttcagggaccacactttgagaacctgcttgactaggacatctggggtgggatgtgtgggtgagtgtgtgaagacgatgggcccatggggggctcacagacagagtttgctgcctggggaaaggggttgccaagtccttctcaggctccactgctgttgggctggatgaagttcagggtggggctgggcggatggacacaggatggacgtgccgcatgctgctcgcatccacgcgtggcaggttgtgccacctgcttggggcctcagctctgattgtccatagcccctctccctccctcccaagaaagcaggcaggggtggatgggaagcaagcgagcggggaagtgtgggtggcggggggctcttgagtctgctcattgatgtggaacaggcaggtcccctgggaatgtggagctttgactttaaacggcgactcagcactggcaagaggcctcccagcaggtgcttcagtgtgtggttaggctggagccagcagggggcaggggagagtgccctcagtgcagggtcttgccccccacctctgtcccctcactcggctccatgctttgttcaggtgtggccctcactcggctccgtgctttgtttaggtgtggccctcactcggctgtgtgctttttctaggtgtggccatcaagatccccatcgtgtgcgtggtgctggagggcggcccgggcacgttgcacgtgagtatggccaggtgggagggggcatgtgtgggcccgtcctgctgcaggcagatgactgtccaaaagtgcttgtctcagaactcaagactgttggcaagagggcgatgagctttcccaccagaagaagagaaagagcatctacgctgtgtcggggctgcttctgggtgggtggaggacgggtcggaggaaggtgcctggaggaggaggctgggcttggctatgactgggccattgaccggcgtggaaggaaagggtggggccccagggcctggagtgagtggggcgcctctgctcccaggacctgctggggaggctggggggtttctacaactctgcccccaagattcctccaggaagcatttttcaaagtacagggctgtggcccccatcccagatccgtggtgccagcagctgtgtgactgcagatttggcaggcagcttgaatgcgctgctctgccggccttccttcccgaccctaaccctaactgctttgtggcgtgcagggtgcgaggtgacctcacctgctgtaggaatgtacgaggacatatagcctgaggatctggagcaagagtatgggcttttgtgaaggatgggatcacaggcaatgtcccgtttatgtttcatgattgcaggaggtcaaaacagagccttgggggcttgaggctggatgggaatccatagagcactgggtcctcactccctatgcgtgccgagtacccttcacggctcttctgctggggcggctgcacccgcctccttaccccaggccgatgctcatgcacacggcagagtccttcctgccagacagctttgtgtccagtcccttcccgaagtccagcacaccctggagcccaggtgccctcctcatggctctgctcttactgtgggcttttatgaggtcggtaactccaggtccatgcagcgtcccctttgctgcgaggccctcacgtctgcaggtccatgggcaaaaatgctgggagtctttgattctgctggagctgaggcctgagaggtgccaggtgtgcagcccccagtgtgttggggcagctccctcttcccccagagcaggggacgccacgaaactaataagtgctttcagtggatctcggagtagtgttagccagctctgcccttagctggccttggagaattctccatttcagaaagcatcggagcggtgaggacccagtcccgggctcacacccccacctgccttgcagaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaaggtgaggctgacgggcacgacggtcaccagcatgtggctgctttgcagagacactgtcagcctggtgggcaggaccaggactcatggaccgatgcggagaacccactgggtctgagtgggtgccagagcgatttgcagagggcagggcccaggtggtaaacctcctggctgggttccggaggtcagatcccaagacagcatgtgaaaggagggtgtgaacctcacccgcagcacaccagggcgggctgggaacgctgcggggctcagtggtgctgtgaaaagggtctgctggattggaggggtgggaggcaggcgctggggaggcctcagccgagtcgggcagcagggcagctgctgagcaatggctgtgggtcgcagggtccagtccagattgtagcctcataggtgagttaatggaggcatgtagagtggcctcaggaggggccattgccccagtccaggggtagattttgggtggcccctgccatgaccccagcctccagagggggtccgttgtgaagggccgtggttggccagccctggccaccccaccaagcccttgaccaggggggtgggctccagtggagagcctctcccctccctgtgcctgctgcttccagggtgacctgactcaattcctggcaggattctttgcaggggctggcactggggccttttcatcctcagtttcccagcaagccagggccggcagagccctctgtctgtgtctttcctgcagacccgggacatctccaggttctgagtggctgacatgcgctttccactgtgttgaatttgggttctgtgggcagtggtgacccccagctgcaggccgcagggacacacctatttggccagattgggcctgtggagagtggattaaaaatgagcaccctcaggaaccacgggtgtcggaagggctgggtggaggtcttggccccgttggccgattcagaagcagagtttctctgactggtgatttgtgggtggcacagtgaccttgtttccttctgtgctttgcgatggtctcagagtgacctcgttctgcacagatgtcttctgagagcgtttttgtccggcaggagaataacatgatgtagctgcaagcgtcagatcagtttgtgaaaacatcgtggtccggctgtgagcggccgctcagctccccatgtcagggcggctttccttccttcccggtgccattgggacttgtcgggcgggccctggagccctctctctgctggttgataaattattcaggcaattctcagaactgagtttaatctgctgttgttgaaaggtgcctatttttaatgcactctccatagccaagccaaggccctgaaagtggtgctttcacacacagccgtcaggcctcagcaggggctcggcattcgctgatgctcctgctcagtggggaggggcccagccatgcagccagggtcagtgcgctcctttaacacgccttctcagagtgtccgtctacactgtggaggagttgcagagctaccctcgggtgctgctgctggtgggcggccccgtcagaggggcccggggacctccctgcaggggctcacagctgtggccaggaagaagttgcccaccctcgctcagccttgcctttctcatctgttaagtaggggtactgagtgctcgactcagacgaggaaacgaggccctggcgtccatatgggctcagacgctgggagctgcttcaccctatgaggacagggcgggctgaagtccaggagacttttatgggctcagacgctgggagctgctttacggtatgaggatgggggtgctgaaagccaggagacctttggctgctggatgagggtggagttcgccagggagctcaggatgtgttttggagttgtcatgaaagctggaccccgagggatggggcaccgttggggtcttaggcatggaggtggagtgtgaggagccctccaggtgagggcagagtctatgtggaggcaatggggccaggctgcggacgaggagagaagcaggggaggccaggtgtggctggcctggggagccagagggagaaggctgaggcttactttgggagcagtgggagccatgggaagatgcgtttgtggagttgctcgccctggacacagggggaaggtgcttcaaggaggagtaactgtagtagacatacctgctagggatgccatgatggatggatggatggatggatggtgggtgggtggtagatagatggatggatgatgggtgggtgtgtggatggctggatggaaagatggatggatgaatagatggatggatggatggtgggtgggtgggtgggccatgtggatggatggatggatggagggataggtgggtagctagatgataggtagattagatggatggatggatggatagatagatagacagacaggtgataaaatggatggactgggcactgtggctcacaattgtaatcccagcactttgggaggttgatgcgggtggatcacttgaggtcaggagtttgagaccagcctggccaacatggtgaaaccacatctgtactaaaaatacaaacattatccaggcatggtggtgggtgcctgtaatcccagctacttgggaggctgaggcaggagaattgcttgaagccaggaggtggaggttgcagtgacccaagatcgtgccactgcactccagcctgggtggcagagcaaaaagtctgtctcaaaaaaaaaaaaaaaagatgaatgaattgatatgatagatagatggatagatagatagatagatagatagatagatagatagatagatggatgatagatagatagtgggtgggaggtagatagaaagataagtggatggatgaatggttggtaggtgggtgtgtgtatggatggatggaaagatggatggatggatggatagctagacaatagatagatacatgtggatggatagatggatacatggatagatggataggtagatagatagatacatacatatatacatagatgaaacacacacatggatggatagatagatttatagatggatagattatgtagatagatggatagatgcatagatggatagatagatcagattatgtagatagatagatggatagatgcatagatggatagatagatagactgatcgatcgacagacagacagataaataagtagacagatagataggcaggtaggcaggtggtgaggagtggcctgggcttagcaggagggctaggaggagcagcctcgcatgaagctgcactatcgtcagggtgaagatccgttgcccttggattgtgttttccacccaacagactctcacgaacatgatgtatttggtccccatggatcttcatctgcaccatctagggcaagaggagatgtggtggtgtcctggccacaagcgcaggcaggacccaaggctctggctgtgtccggggcctcaattctatgtgtcctggaggaggcaggggttcaggagtcactgtgtgtctcacttagaaaatgcttgttgcagatccaagatatcgtccggaggcggcagctgctgactgtcttccgggaaggcaaggatggtcagcaggacgtggatgtggccatcttgcaggccttgctgaaaggtgagggtcagggaacatgggggcaatggggtggaggccagaacgtgagctctgaggacgccaagttctagtcttgaagtgccatgattctgggaaccagaatattcctccttggtcagaaaccctggccagagggcagctggcgacgtgcaggtgggcgcctgcctgtcacctgatgttagaggtatgagctcctttatttgtaactggaatccgagtgcagcctgtgtcatttttacctttgtagtggtcataatttctcataaaacttcagggtggaaagaaagagtgcagaagttgcctctctcaacttcctgcttgctggctgctttagctcctctacctctgatgcaggaaagagtgtagaggtagagcagggcctcaggaatggtgtgatggacttgagctgtagtggctctctgtgtaacttctgttgcttagcctggcccattctccaggccacaaacatcactgtcctcttctcatgccacaggagagaaggcttatgcctctttgtcttacccagctggcacctgacactgggaagccttggtcttatatgtgctcctcccgcccgatgctgggcttctcaccctccagggtcggaggccccaggctgattctgaagggctcagcagagtgggcccaggctgggatcagcagggaacttttgtgataaaggccagactttcatcttgtttctgtgttgatttgagactccccttatcaaggacttgatgttgtgcataaaacctcacacaaacagcgagatgatagactacatattagaccacaaattaagccttaatttatctctcaatagatttaagatagatattatacaaattatcttctctgacaacaagatgaagttaggaattaataatggatgtaaaagtggaaaattcacaaagttgtggaaactaaacgacactaccttacacagccaatggatgaaagaagaaatcaaaaaggaaatcaagaaaccaatgaaaacaaaagcacaatatatcaaagcttatgggacatagcaaaaacaatgctaatggagaagtttatagctataaatgcttacattaaaaaataagatcttaaaccaacaacctaactttacaacttaagtaattagaaaaataagaacaaatgaaatccaaaagtagcagaatgaaggaaatagtacagattagagcagagatcaatgacataaagaatagaaaattgcagagaaaatcaataaagtgaaaaattggttatttgaaaagatcaacaaaattgacacacatttagctaactggactaagaaaaaagaaagaagattcatattactaaaattagaaatgaaagtagggacattactcctgactctacagaagtaaaaggattctgtgaataattgtatgccaacatgttggataacctagatgtgttagtctgttttatgtgactaaaacagaataccacagactaagtactttataaactacctagtactttataaatcaatcactgaccatccttgccttcccagaggatggtcagcatctggcaaaattgaggggccagcatctggcaagggcctgcctcatgtcattccagaatggcagcacatacatgcccttccactggaaggcagaagggtaagggagcacacagatgcatgaaagagagtaagaaagcaagagggagctaaacttgctttttataacaagcccactcttgaaataactaacccactcccaaaataagacattaatccattcatgaaggctttgccctgtaatggatcacctctattaggccccacctcccaacattattatactggggattacatttacaacacatgaactttggggaaaacattcaagccatagcactagatgaaatgaacacatttctagaagcacaaaacctaccaagactaaatcataaaaaaatcaaaactctgaatagacctataagtagtaaggagactgaatcagtaataaaaaatctccccataaaagttttagggctgatagcttcactggtgaattctaccaaatgtttaaagaactaacaccaatccttctcaaactttccccaacaattcaagaaggaaggcttcctaattcattctgtgaggccagcattattctgataccaaagacagacactacaagaaaagaaaactacagaccaatatccattatgaacattgatacgaaattcttcaacaaaatattagcatacaaaattcagtagcattaacaggattatacactatgactacatgagatttattcctggaatgcaaggatggttcaacatatgaaaattaatcaatacaccacattaacagaatgatggggaaaaaacatgattatctcaactgatacatttgacaaaatttgacaccctttcatggtaaaaacattcaacaaattaggaataaaaggaaactaccttgatgtaataaaagccatatatgaaaaactcccagcgaatatcatgttcaatggtgaaagactgggacatagcaaaaacagtgctaatggagaaatttatagctatacatgcttacattaaaaaataagatcttaaaccaacaacctaactttacagcttaagtaattagaaaaataagaacaaatgaaatcttttcctccaagatagaaataagggaaggatgcatactttcaccacttccattcaacattgcgttggaagttcaagccagagcaattagacaagaaaaagaaataaaacttataaattgggaaggaagaagtagaattatttgttcacagatgatatgattttcgtatttgtccattttcacactgctataaagaaatgcccaagactgggtaatttataaaggaaagaggttaaattgactcacagttcagcatgccttggaaggcctcaggaaacttacaatcatggtggaagatgaaggggaagaaaggcactgtcttcacaaggtgacaggaagaagaggtgccaaatgaagaaggaagagccccttctaaaaccatcagatctcatgagaacttactaccatgagaacagcataggggaaactgtccccacaatccaactacctccacctggtctctcccttgacacatggggatcatagggattataattcaagatgagatttgggtggggacacaaagcctaaccatatcaattttctatgcagaaaactaaagattctacaacatacccctgaactaagaaatgaattcagcaaagtagcaggacacaaaatcaatacacaaaaatctgccacatttgccaggtgtgatggctcatgcctgtaatctcagcactttgggaggcggaggtgggcggatcacgaggtcaggagattgagaccatcctggctaacatggtgaaaccccgtctctactaaaaatacaaaaaattagctgggcgtggtggcgagcacctgtagggcatggtggcgagcgcctgtagtcccagctacttgggaggctgaggcaggagaatggtgtgaacccaggaggcagagcttgcagtgagctgagatcatgccactgcactccagcctgggtgacagcaagactccgttcccccaccaccaaaaaaaaatctgctgcatttctatacactaaaaatgaataatcagaaaaggaaattgtgaaaacaattctatttacagtagcatcaaaaagaaaaaaaatactgaggaattaattaaaccaagggggtgaaagacttgtacaatgaaaactgtaaaacattgctgaaagaaatgaaagaagacataaataaatggaaagacatcccatgttcatgaattggaagccttaatattgttaagatgtcagtactactcaaagcaatctacagatccaatgcaattcctatcaaaaccccagtgatttttttttttttgcagaaatagaaaagcccatcctaaaattcatgtggagtctaaagggatcccaaacagccaaaataattttgaaagggaagaacaaagctggaagactcacactttctgatttctaaactcactacaaagctatagtaatcaaaacagtgtggtaatggtgtaaagaaagacatagagggctgggtgtggtggctcatgcctgtaatcccagcactttgggaggccaaagtgggctgattgcttgagctcaggggtttgagaccagcccaagcaacatggtgaaaccttgtctctataaaaaatataaaagctgggcaaggtggttcatgcttgtagtcccagctgtgtgggaggttgaggggagaggatcacttgagcccagaaggttggggctgcagtgagctgtgattgcaccactgcactccagcctgggcaacagagcaagaccctgtctcaaaaaaatcccaaaaagatatggagaccaatggaatagaatagtgagcccaaaaataaaccctcgcatatatggtcaaatgatatttgacaggaatgcaaaaatcattcagtgaggagagggacagtcttttcaacaaatgatgctggataaactggatatccacatgccaaagaatcaagttagacccttacctaacaccatatacaaaaactaactcaaagtagatcaaggacttctgaatataagacctaaactcttagaagaaagcacagggcaaaaacttcatgacaaaggatttggcagtggtttcttggccatgacacctaaggcacaggaaacaaaagaaaaaatagataaattggactttatgaaaattaaataattttgtgcatcaaaagatattatcaacagagtaaaaaggcaacccatggaatgggagaaaatatttgcaaatcatacatatggtaagggattggtatccagaatatatagagaactcctataactcaacaataaaaaaaaaacacaattcaaaaatgggcaaaggacttaaatagacatttctttaaagaagtcgtacaaatggccaataagcacgtgaaaagatgctcagcatcactaatcattagagaaatgcagatcaaaactaagagatatcatttcaaacacattaggatagctactatagaaaagaacagaaaatcacaaatgttggccagtgtgtggagaaactggagcccttgtgcactgttggtggatatgtaacatggtgcagctgccgtggaaaacaggatgacagttccttaaatatttaaaaatacaattcctatatgatccagctattccactcctcagatacatatgccactccccacccccaaatttaaagcagggtctggaagagatatgtgtatactcatgttcatagctgcattatccacaatagctaaaaagtggaagcagcccaagtgtccattgacagaagaatagataagcaaaatgtggtctatacctacaatggaatattactgagctttaaaaaggaaggaaattctgacacatgctgcaacatggttgaacccttaagacattatgttaagtgaaataagccagtcacaaaaggacaaatactatatgattccagttacaagaggtccctggagtagtcaaattcatggagacagaaagtagaatggtgggtgccaggatctgggggagaggtgaatgaggagttaatgtttaatggggatagagttttagtttccaagataaaaagatatatggagaaggacagtgatgatggctgcacaacattatgaatatacttaagaccagtgaactgtacgcttaaaaatatttggctgggtgagctggctcatgcctataatcgcagcactttgggaggctgaggtgggaggatcacttgagcccagcctaggcaacatggagaaccctgtcactacaaaaaaaaaaaaaaaaaaaaactagtcaggcatggtagcacacacctgtactcttagttactcaagaggctgaggtgggaggattgcttgagcccaggacgttgaggctgcaataagccttatgattataaatatgatcacagcactgtgctccagcctgggtgacagaggaagaccctgtctcaaaaacaaaaacaaaaacaacccaaaaagttaagatggtaaattttatgctacacgtattttaccacagtttaaaaacataatgaattttaaaatatcaactttatgaaggttcagcttagagacaataagctccctcaattctaaatgtactgtataacaagcacagacaccgtgacccaccacagtctccatacaggacatctcccctatcctgaatattccctcatggccctttgtagttaagcctccctccagactggctctggaaatcatctgtctgctttctgtcactctagattagttttgcccattttagaacttcacgtgaatgaaatcatacatgatgcattctttcatgtcttgtttcttttgctcagtgcattgtttttgagattcatccatgttgttgcatgtgtcagaactttgttcttttttgtctgtgaaggagtgtcctgttgtgtgaatacaccacaggttgtttttccattcatctgttggggtgcatttaggttgtttccagtttggggctattatgaataaagctgctatttgtcttcatttctcctgggtcaatatctaggagtggaattactggcctttatggtaagtgtatgttttactttgtaaaaaactgacaaacttttctgaaaatattgcattctttttcctgtgtgctggcagtggatgagcgttaccctacatccttgtccacacttggtgttgtcagtcttttaaactgtagccatcctagtggatgtgaagtgacatctcattgtggtttgaatttacattttcctgaggactactgatgtggagcatcattttaaggactttttggccatttgcctgtcttccttctgaaatgtctttcagatctcttgtccatttttatttgattgtttgtcttccagttttcgatttgtaagagttatttatatattcggatacaaatcgttcgtcagatattattttctcatggtgtgtagtttcctttcatattttcttcaagatgtctttgaagagcaggaggcttaaaatttttttttttttttttgagatggagtctcgctctgttgcccaggctggagtgcagtggcgcgatctcggatcattgcaagttccgcctcctgggttcacaccattctccagcttcagcctcccaagtagctgggactacaggtgtccaccaccacgcctggctaattttttgtatttttagtaaagacagggtttcgccgtgttagccaggatggtctcgatctcctgacctcatgatccacccgccttggcctcccaaaatgcgggattacaggtgtgagccacctcgcccagccaatttaatcaatttttctttatggttcatgttctttgtgtcatagctaagagatctctgcccatcccaaggttgcagatattttcttctgttttctgacggcagttttgtagacatagcctttatgtttgggcctaagaaccgctccatgttgattcttgtgtatggtgtgaggtaagggtcaaagttcttttttctttttccccaaataacaacccatgttttaaaaagttaaaccagaaagggaacacagaaactacttgagcaaaataacttgtcctgagaaccagtgaggtggttgttactgttgaacatttacaggcagttgaggcaggaaaggaaatgtgatggcttctgagtcctgagttttggatgttagtgtaagatgcctgccctccagagacctatgtcttcttaaaacagtgaggcccttttcttgcttactgcccacctgtcgcttaggggccagggcatggccaggaggagggcaggggaaacaggagtgagtggacgtgatgaccaaagccccaagattcactgattctgactccgaaatggaacatgcttttgcaaggctgtgtgtatgggaggaggtcactgggtgctgcgcctgtcactttgaattgttgagaggcaagggctcatgacacatccctgactctgacatcatttccctggagggaaatggctttgagctccagatcgaggcccaatatgcacctgttcatctgcagcctcacggagccaagaccactttggccacgagaactgggaccaccagctgaaactggcagtggcatggaatcgcgtggacattgcccgcagtgagatcttcatggatgagtggcagtggaaggtaagtcttccagagcaccccgtggaggggcctactgggcccacatgcattgcaccactgaagcaagggcaggcaaagttcgcattgtctggatcccagcccttcccttgagggtgggtgacctgggcagctttcatcctccccaggttggggacaacagcagcccccatctccagggtctttgagatcaggatgacatggggtgatgaccaaatgcaaccgtcactgcacaatgcttgctctcagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcgtgctggtaacggggcccatcctggactcgtcttcgcgggctactgctatgttcttagagctctctgtttttaaaattagcttttatttttattagaaaagacacatgctctatcttaggctgcttgggctgctgtaacaaaattccacagatggggcagaaactaccagtttattttctcgaagttctggaagcccgaagtcccagattaaggcaccagcagggctggcttctggccagggcctcttcttgcttgcacgtggctgccctcttgctgtgtcttcacgtgacagagagagaagtctctggtgccacttcctcttctttttcttttatttattttttatttttttgagacagggtctcactctgtcgtccaggctggagtgcagtggcgtgatcttagctcactgcagcctcaacctcccaggctcaagcaatcctcccacctcagcctcccaagtagctgggactacaggtatgcgccaccacacctggctaattttttatttttttgtagagatggttttgctattttggacaggttggtctcaacctcctggcctcaagtgatccgctctcctcaccctccaaaaggctggaatttacaccctccagccaccgtgccttgtctatttttatgtttgagacagggtctggctctgtgacccaggctggagtgcagtggtgcaatcatggctcaccgtaccttccacctcccaggctcaagcaatcctcctgcctccgtctcttgagtagctgggactataggcatgtgccaccacacccagctttttttttttttttataatattttgttgagatggggtctcattatatggcccaggctggtctcaaactccggggctcaagtgatcctcctgtcttggcctcccaaattgctggcattgcaagtgtgagcctccgcacctggcctcacccctctttttataaagagaacacacctatccacttaggaacccacaatgtggcctcgtttaaccttaattaccttcttaaaggccctatctccaaatgctatagtcacactgggggttagggcttcaacatatgaattttaggggggacagagttgcgtccataacataccctttctaaaagttccaaacagtacaaaaggttctgcagggagcgtgatccccctgccctgagccccactgctgcccactgtgtatgctggttttttccgacagtcaggtcagtaacattccaccgtatttttgtgagatgcccagggtgcactgcagctgtgggagagtggatgctgtagtctgcaccctgtgattcaatgggagccctgctctagtctcacctttatttaatggtgagactgccccagtctccaaccttattcaagggaaccctgctctaatctccacccttatccaatgggaaccctgctctaatctccacccttattcaataggaaccctgccctagtctccaccctgattcagtgggaaccctgccgtaatctccaccctgattcaatgagaatcctgccctagtctgtttaccctttttcagtgggaaccttgcagtgactcaatgtcaggaatgatgctggattttgtatttgtatttcctcttgggagtatttatctctgattcattaaggttttacaaagcaaagcatcgatgcctttgagaagattgagctccttttcttctttgacctatgaatttggtgaattattttaatagattttctgatagtgaaacatgtttttatccctgttttgaatttcagcttggcctcagtgcaagtttaatatactggattctcttggcaacattttcaggatgtttgcatcagaatgcttaaggctttgattgcagttttatttggggggctatatttgtcaggctctgatatcaattttatgttagttttgtaaaaaccatttgggaagctttctttccttctccgctccaggacagtttatgtagctggagttaactacttcttataagcttggtcgactcccctgtgagtccatctggacccagtgccttttttttttaattggtaatagttctagtaactttctcagtttcttttctgattatttttctgtttaggttctctatctcttctaagatcacatttttttttttttcctgctagaaaattgtctgtttcctccaggttttccaatcgatccattgttccaggtgagctctgtctgactcttgagaaagacatgggtatgacttggtttctttgttttttgtttttgagacaaagttttgctcttgttgcccaggctggagtgcaatggtataatctctgcttactgcaacctctgcctcctgggttcaattgagtctcttgcctaagcctcccaagtagctgggattacaggcgcccaccaccatgcccagctaattttttgtattagtagagatggagtttcaccatgttggccaggctgatctggatctcctgaccttaggatccacccatcttggcctcccaaagtgctgggattacaggcgtgagccaccgtgccaggccgggtatggcttggttttatacattcacgatctgcacttcttaagtccagtgcgtttatttaagacgctcagttggaatatgcttaggaaggtccaaagcagaatctcaagcttatctgtacctgtggtttaggaagaaaaacacatttcttttttttttttttttttttgagatggagtcttgctctgctgcccaggctggagtgtagtggcgcaatcttggctcactgcaacctccacctcctgggttcaggccattgtcttgcctcagccttccgagtagctgggactacaggtgtccgccaccacgcctggctaattttttgtatttttagtagagatggggtttcactgcgttagccaggatggtctcgatctcctgacctcgtgatactcccgccttggcctcccaaattgctgggattacaggcgtgagccaccgtgccaggccgggtatggcttggttttatacattcacaatctgcgcttcttaagtccagtgcgtttatttaagacactcagttggaatatgcttaggaaggtccaaagcagaagctcaggcttatctgtacctgtggtttaggaagaaaaacacatttctttataatgaaaaaccttcaggaaatttctaggatcacttgaggtgtgttttgtacagtatgtgatgtgggagatggttttttttctacttctggggagcgtttcccagctacctgagtacgtgtttcctggtccggggaaaagcctagccatgcagggaggtgggtctgggcaaggtgccctgtgcttgctcgtgagtgagccatattgcccacctgacagatctttcctagtggcctctctgccagagacactgcaggagagtccctcagggagaagacagtcactgacctattaacatactccactgtgctagaattttgcttcgttgaaagcagctttgatgccatcagataagactggggaacttgaagtgcctggcatgaaacaagagtctacacatgttggtaaaggagttagacgggcgtttcactttctagatgtctccagaacagtgttttaaaaaacttcagtgtgcataagaatgatctagggtgttgctgaaaatgcaggttgtagttctccagggacagtgagatcctgagaaggtcggggctggggtcagggcctgcacctctgacaggctccgccagtgactctgagccaggcggcccggctggggctctgacagttcactgctcaccaggtgcagggagtgagcctccggtccctctacaagcgttcctcaggccatgtgaccttcaccatggaccccatccgtgaccttctcatttgggccattgtccagaaccgtcgggagctggcaggaatcatctgggctcaggtaataagactggcttctcagtctcagcagacacagctataggccagcggccagctggggagtgtggctggagagagtggctggagagcctgaggccaagtgcacgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggaggggtgtggagactgtggaggggtgtggaggctgtggaggggtgtggaagctgtggaggggtgtggaggggtgtggagggctgtggaggatgtggaggggtgtggagggctgtggagggatgtggaggctctggaggggtgtggagggctgtggaggctgtggaggggtgtggagggctgtggagggatgtggaggctgtggaggggtgtggagggctgtggaggggtgtggagactgtggaggggtgtggaggctgtggaggggtgtggaggctgtggaggggtgtggaggctgtggaggggtgtggaggctgtggaggggtgtggaggctgtggaggggtgtggaggggtgtggagggctgtggaggggtgtggaggggtgtggagggctgtggagggatgtggagggctgtggaggctgtggaggggtgtggaggatgtggaggggtgtggagggctgtggagggatgtggaggggtgtggaggggtgtggaggggtgtggagggctgtggagggatgtggaggcttgtggagggctgtggagggatgtggaggctgtggaggggtgtggaggggtgtggaggggtgtggaggctgtggagggatgtggagactgtggaagggtgtggaggctgtggaggggtgtggaggctgtggaggggtgtggaggctgtgaaggggtgtggaggctgtggaggggtgtagaggggtgtagagggttgtggaggctgtggaggggtgtggagggctgtggaggggtgtggaggggtgtggaggctgtggaggggtgtggagggttgtggaggggtgtggaggggtgtggaggctgtggaggggtgtggagggatgtggagggatgtggaggggtgtggaggggtgtggaggggtgtggaggctgtggaggggtgtggagggatgtggaggggtgtggaggggtgtggaggctgtggaggggtgtggagggatgtggaggggtgtggagggctgtggaggggtgtggagggctgtggaggggtgtggaggggtgtggaggggtgtggggggttgtggagggctgtggaggctgtggagggttgtgggcgtctccaacactgggaaggacttggggcacctggagttggagaacaaagaacttagctctaggcaggaaaggaattttttttttttttgagacggagtcttgctctgttgcccaggctggagtgcagtggcacaatctcggctcactgcaacctctgcctaccgtgttcaagcgattctcctgcctcagcctcctgagtaactagaacaacaggcatgtgccaccacgcctggctaattttttataatttagtagagatggggtttcaccatattggccaggctggtctcgaactcctgacctcatgatccgcctgcctcggccttccaaagtgctgggattacaggcgtaagccactgcatccggcccaggaaaggaatttttaaattaaaagttctgctaaaaaaaactggttctgtggttatgtccagggccgagtctcactgggcacgcacaggccgggtggtgccgccctctgcagctcacacgggttccgatgggggctggtgcatgtgctgggcccgtgctgtccgtcaggctttgcagggcaagcagacccctcccacaggccacgcaggagcctgggccatcatcagaggttgtgtattgactggggtggggcttaagttgtctgtatagatgtggtcacacacagtgattgcccagtggcccgcactgtccccgggcctcgttttcatcacctggggcagtgtgttgggttcctcaggctgggttgagcctggctctttagtctcacggtggctcctctggtccccagagccaggactgcatcgcagcggccttggcctgcagcaagatcctgaaggaactgtccaaggaggaggaggacacggacagctcggaggagatgctggcgctggcggaggagtatgagcacagagccatcggtgagctctgccgggcacgggctgcaggccatggctcagccgtgcatgccctcacctggagttcccatccctgggtctcagccccatgtgccctcaccctggggtcctcgtccctgggcctcagccctgcacgcttaccctggggtcctcatcccggagtctcggccctgtaaccacccagtgggttcgtcttgcctgctgctcagatagagcccatttgttaagacagcgagattgcaatagagaaagagtttaattcacacagagccggctgaatgggaagctggagtttcatcacccaaatcagtctccctgaaaatttggagactgttttttttttttgagatggagtgtcgctctgttgcccaggctggagtgcaatggcacaatctcggctcactacaccctctgccctctggattcaagcgattctcctgtctcagcctcccgagtagctgggattacagctgcctgccaccacaactggctaatttttgtatttttaatagagatggggtttcatcatattggtcaggctggtctcaaactcctaacctcagatgatccgcccacctcggcctcccaaagtgctgggattacaggcgtgaaccaccacgcctggtgagactggggttttttaaggataatttggtgggtagggggccaggcagcggggagtactgattggttgggccagagatgaaatcacagcgggtcaaagtgggttcttctcactgtctactattcatgatcacaggggtcgaagtgggttcttctcgctgtctgctgtttctgcgtgtggtcacagaactggttgcaccagatctccagtcggggtggcgtcagtgaagcatcagaatgcaggctttcaaaatatcctgggttttccaatagtgatgatattcctaggaagagttggggaggtttggaatcttgtggcctctggctgcgtgactcctaaaccataatttctaatttgtggctactttgttagtcttacaaacgcagactgctcccaggcaagaagggggttcgtttcgggaaagggccgctatcatctctgtttggaagttaaactataaacgaagttcctctcaaagttagtgtggcctatgcccaggaatggacaagggcagcttggaggttagaggcaagatggagtccattaggtcagttctcggtccctgtctgagttttctccctgttgtcatttttgtagaggcagttccagccctacgtgccctctccctggggtcctcgtccctgggcctgggtgttttgagacaccagccccacatttgccctgtgcccttccctgtgtcctggtggtgctgtcccgagtggttgccctctgacccgtccccagggctcagtgattgtgacctgctgctctgacggggctctcatatctccgcccaggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggtgacctcccaagagccccttccagaaacagacgcctgtggtgcctgcagggcggacacagcctcctgttcgtgcagttggcacgcacactcacacaggcttcagggccctcagcagctcggggacagcgcctgacccctcggccacctgctccaggctctggcctcccattttgcagatggggggaagctaacatgaagcaaaagcaggagctggtggccatggagatcgcaattcacctccccatggatgttcctacctgggagcggcaggcagaagcccaggtggctctgggaacggcgtctgccctctctccctggagggataagcgggacacggcgtgtcctccctggagcagcaggggctcccaggcatggctgccctcagcatcgccctggaacccccggcagggcctggctcccagcgagtgccccttgcacgctgggcttccttggagcgccgagctattgccaagtccatgagctcccgtcatgtcctgggctgtgccaggcctagggaggcctggggaagggtcctgtcccccactgcagagctcagaggggccagtgctctacagcctgcaactgcggggccttcgaagccagcagagatggggtcccatagcttgaggtcaggtgaaaggcgggattggacacccaaagccccagggcaagctctgtgtcttcaccactttctgctgtgagactgcaggctagctctgtccactaggcaccccgagtcctcagcagacagctgacgggcaccatctggggcacagggctgggcactgccatcctgagactgcccccatccgcaggccttcctgaccaaggtgtggtggggccagctctccgtggacaatgggctgtggcgtgtgaccctgtgcatgctggccttcccgctgctcctcaccggcctcatctccttcaggtgctgcagggctgcggggctgcgggactgtggggctgcggggctgcgggagaggctcctgggggctcaggatcttccctagatcccctcgctgggagcaagtcatgtgtcctcagaattgtccctggatcctggggctgtagagatgggggtgggaagcagagcagggccccacgtgctggaagcacctgccttgccccagccccagcactgatctcatgatgctgatgagcccgtccctcagccacatcagcctggggttggggaggccaggaaagatggtctcctgctcctgccggcactgtagacctgagccagtctgcggcgtgggcagttagtgcaggtctgggatgcgagcagcgagctgcggctgagtgcctccctgtcctcgcagccgcagagcctgtattgatggaatcgctttcccttatgaaggaggaggacacggctggccatggttgaagacctggcctggcctggtgtccccacctgcacctcctcagaggcttgctggggcgttgtgggatctgctgtgttttactgagggctggatggaggctcagggtctcctgggagtcagggcagattcaagaccccagcgaggtggctgagccccttctgcaacccgcagtccacactgcctgcctccttccctttctcctcacggccaggatgggtacttgagtgttcaggaatcctggtgggaaactgaggcagggaggagcggctcaggtgtcctaaagcagtgctggcttctctcctgctctcccgaggatggcagagccgtgtcactgatggccgcctctgctcccgttccagcggcccggggatagggacctgggatcagggcacaccacagggggagtgtggtcagccccacccccattgaggacggcaaggaaagcctgtccccatttacaggagggtgactaaggcctgagcgtccactgagcactgggagctctgaagctggggcccacccaaggctgggcttggggcaggctgggcctccctgtttgcagccattaaggtcatggccatgggcagggcgtcagcgggcatccctgtgtcctcactttgctgggctgtggggtccagccccaccccggtggctgtgtgtgaggctcccaggctgtgctgtgccggctccgcctgtagctgccgttatggccccggatccctgagtgcttttgcctctaaaagcacatctctctgaggggcacgggggatcacggggtggccaaagcctgtggaggtcaggaccctggccctggtggtcactgtctcctctctgctgtgacggccgcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcaggtacagccccacccgcttttccacgccccagcccggggccacccacttggctgcattctcataggggacccatggcttagagcccaccccatctagcctgcccagctccctgcaagctgagcagagccggtgtttcctccccaaaatgggtggctggggcgctgccctccaagcccctccctcctcatgccccctgcgcctgcttccctgctttccctcggcccaggcatccttccctcctggagaccggctgatcagctcaaggtggatgccctgaccttgtggactatgagtatgtcccttcccccaggaagagcagtgcaaggtgtggggtccctaagacccctctcacgttcaataacgagccagaaggacccacagacgctggggagtggcaatgctcacttatggtttattaagcaacagtctacagactaaaccagccagggggagggacgcagctgcatccaggacagctctgagcccagggcatccggccagtccctccctgtggaggtgtgggtggcactccatcctcccggtgatgatgtgtggcctcatgcatggaggcacgtccccagagaggctcgcgggccttggtgtctactggaggtcagtcacagaggcgaggctgacaccacatggttgacctcagtctccagccctccaaaggtcaaactgaaaactgcccggggccccaccccaaatcacactgtgggaccacctggcatggcccaggccccaggaacaaagacaccctcatcaggcggacattccaagggctcagaggctatctccctggagctgggcgaggccaagctgccccccaggtggggcgaatcccttactgtgtggggtctccactgtgcccccacggtgcctgcacctgctggcagccggtgaatgggaactaggtccttggaaccctcagggcagtggtgagggggtggggtcagcccacggggcagtggtcctggcttagacttacctctgctctctaaccttggtggaccaccaggcccccagttaccccagttagaaagcagtgtgcactgtgtaaataccactgcctactggggccctgggggaggcaccggcgtccccaggaaggaagatcaggtccaggacttggcggggcctgggagctgtgctgtggccctggctctgctgggctctccttggctctcctcttgccacagggcttctgccaccagaccctctctacaaggggccagaggcctccatgcacccccagccccagccccatgggcagcagcctgagagcagagggggcacttccttctccctgcatctgtctgtgatccagggagggccctggttggtcctgctggtcacctgccccacctgtccagctgctgggtcctggggcctggggctagggagggtgtggggactcctgccaagtaggccaaatgggggctcccacagcccctgccaggtcctgcactcttggcctgctaaagaaacagtgtggcccctgacagaacaaagatccttgtgggaaggcagctggcgcctgacattgagggcgctgctccaacacacacacacatgcacacacatgcatacacatacaggtacatgcacacacatgtacacatgcacacaaatgcacacacacataggcacacacacatacatacatgcatatgtacacacatacatgcacacacatgcacacagtacacacataggcacacacattcatgcatatgtatacacacatgcacacatgcacacacatgcatacacacatgcatacacatacatgcacacatatacacatgcatacacacatatgcatggacacacatacatgcatatagagatgcacacacatgcatacacatatacatgcatgcacacatacaaatatacacagataaacacatgtatacacatgcacacacatgcatacacacattacacgtgtgcatacacacaaatatacacatacatacacatgcacatacatatacagcacacacatgcatacacacatacacatgtacacaatatacacatacacatatgcacacatacatacacacatgcacatacacatgcatacacacatacacatacacacatgcacatacacaaatatacacatcacccaagcacatatacacatatacatacatatgcacatgaacaaacatgtacacacatacacacacatatatacatatgcacacatgaatgaacatacacatatgaacacacacatacagacacatacacatatatacacatgcacacacaaaaacatgcaaatacacatatacacagagacacacagatacacatacacatgcacacacacaaacatgcatacatacacaatacatgcaaatgtatgtgcatacacatatacatgcacacatacatgcacatacacatatacacacatgcatacacatacaaatacatgcagacacatacagaatgcacacatacatacacacacatatgtgcacacatacatattcacacgtatacacacatacatgcagaatatatgtacatacacatatatgcacacacaggtgctgagtgagcagggggccgaggtagctgctgccagcgctattctgcattgttcctccacgtcctgttcccatctccctcactgacccagctctcttcagatcagaaccaatgttcggatttgctgaccgtgatgatagtgatgatagtgatagtgatgatagtgacagtgatgatagtgacggtgatagtgatgatagtgacagtgactgtgattgtgatgatgatagtggatagtgatatgacagcgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatagtggatagtgatatgacagtgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatgatagtggatagtgatgtgacagtgacagtgaggatagtaagagtgacaacctgtctgccttcctaccgcccctcttcccagtagctcttctatgaccctgacgagtgcgggctgatgaagaaggcagccttgtacttcagtgacttctggaataagctggacgtcggcgcaatcttgctcttcgtggcagggctgacctgcaggtgagtggcctcaccccgatggcgggcccgtctgaggcagccagccctgcaggggatgagcacaggccgggcccagaaccagccacaccgggtgaggctcagctcgtctgtgaaccctggattgtcatctgtccaatgggtgtccaggcaacagcgccccacctacccttgggattgttgagggagcacagaaggggcatgagagctcctggcagagctgagattgtccatgtgcaaggggccatagatggcaacctctggaattgtcccagctccacggacacgcggctgccgctttctccctctgcctccctactgtgggctcactgcactgcctgtgatgctctcgtgtctctgcgaggccgcggccccctttctcggaggcaatagggccctggctaactgctggctctccaggtgcccccatgccaggctgccctgtggggctgggcgtctgaagaaaagtgggaggctctattcctcaatctcatgccagctttgaacacctgggatgcagggcccaccagagccctttgcctccagggcccacctgggctaggacaggtggaggggcgacgggggacagctctgggggctgctgtgagcaggtggctgagatgtgtgtgcttctgcccggcggccaggctcatcccggcgacgctgtaccccgggcgcgtcatcctctctctggacttcatcctgttctgcctccggctcatgcacatttttaccatcagtaagacgctggggcccaagatcatcattgtgaagcggatggtaagggggcgggggcaccggctccatcgcggcctgcagcccagggtgggcctcggggagggcaggccccttgccagtggctcggactggggcttaaacacacctgtaggttccccgtccctgctttgccccttgggctcccaagaatgcccttctcgtatctttgcctgtacgtcacctcttccaggaagccttccctcattctcccctctgatccccactcattcctggcctctgattcagctctaggagctttcctccttggtcacggttatgtctgaccgcactcattcctggcctctgattcagctctaggagctttcctccttgggtcacggttatgtctgacccctcttgcactttgtggtgctagcacaaagatgtcggcagtccacgagggtgtgggggcagccccaggactgctcctgggagcctcctgcatgccgtgtctgtgctgtgagtggcagtgctgtctccaccgctgctgggcctgcctctgggcccagtgagcatcgggggccaggagagtgtagcccacacactctctgtcctgcagatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtaggagccgggcgccatgggagctcgggtggtgctgccgggaagcaggagagaggctggaaaggggccgcatgagtgggagtgaggccggctccatcagggggtcctgcggttcccacctggccggtgtcctccctgggggcattcattccccagctcctgtggcaggaagtagaaggggccccaccaggggagggaggaggggggcctggtgggggtgagtggtgccacgcagaggtcagagtgggccgagggcacctggggcatcagctgacagccccctgaaatggaatgtcaccctgtatcccctttccctctcacctcaatcagaaataacttccttcttctcttgatggaaataattcattcctcccttcctcccttccttccttccattttttgacagggttttgctctgtcacccaggctggagtgcagtggcacgtccacctcctgcgctcaagtcctcctcccacccgtctgctgagtagctgggactgcatgtgcacgccaacacacccggctaatttttgtattttttgtagagatgggggtttcagcatgtggcccaggctagtatcgaactcttgagctcaagtgatccacccccttggcctcccaaagtgctgagattacaggcgtgagccaccatgcctgccagagagaacacttttcatatagaaggttttttttttttttttttttttttttaacagcttcattgagagaaatttcacctggataaagtgcacctgtcagtggttttcagtatctttacagaatctaactttataacatctgcatcaccctgaaaagaccctgcatactcacagtcactcccgttcccctcccctcagccacagccacccacgaagctacttgtgagctgccttttctgggcgtttcatagaaactggatgatgtaataggcagtctttggtgtctgacttctttcacttgatgtcccgttttcaaggtttgtcaccgtgtatcagtatttacttcccgtttatggctgaagaggaccccgctgtgtggacacaccacattttgttcatccattcatcagttggtggacatatgggttgtttccacttttccttttttttaaaaaaaattaatatttaattttttaattaaaaaattttaaattaattaatatttaattttttttttcccctagagggagtctcgctctgttttctttttcccgagagggagtcaggccaaagtgcagtggcacaatcttggctcactgcgacctccacctcctgggttcaagcaattctcctgcctcagcctcccgagtagctgggattacaggcacctgctaccacgcttggctaatttttgtatttttttgtagagatggggtttcaccatgttggacaggctggtcttgaactcctgacctcaggtgatccacccgcctcggcctcccaaagtgctgggatgacaggtgtgagctaccgcgcagggccgtttccacttttcacatgctgtgaataacgtagcatgaacagttatttacagggttttgtgtgggtatgtttttatttctcttagacacctaggaatgcacggctggctcatatgggaactccatgtttaagtttttgtggacgtgctgggctgttttccaaagaaccggccgcattccacattcctgcctgcccagtcccaggattccaatttctctaccttcttgtcaacatttgttattgtccattaaaaaaacaaagctcgcatcccggtgggtgagaagtggctctccttgtcgctttgacgggcatttctctaaggacccgccatgctgagcatctcctcctctgctaacctcgtcgtctgtaagtcttctttcaagaaatgtctctccctctcctttgccctttttttttttttttttttttccgacagggtctcgctctgtcacccaggctggaatgcagtggtgcgatctcagctcactgcaacctctgcctcccgggctcaagtgattctcctgcctcagcctcccgagtagctgggactacaggcgcacgccaccacgcctggctaatttttgtatttttagtagatacagagtttcaccatgttggccaggctggtctcgatctcctgacctcgtgatccacccgccttggcctcccaaagtgctggcattacaggcataagccactgcccccagccatttttgcccatttttcaattgagttgtcttttatattattgagttgtcttttatattattgagtcgtaagagttctttacgtaaggatgccagtctcttaccaaaggtatgatttgaattttttttgtcaatctgtgcactgacttgttattttctttatggtgtcatttgatgcacgagcttttgaaattttgatgatgttcaacttatcaatctctttgatcattgtgcttttggtgtcctagcgaaaaccattgccgtgatttatgcctgtgttctactaagtgttttatagctttcgctttttgtttgccctggtgtgcggtaagggtcagtcttcgttgtggctctcctgttgtcccagcactatttgttgacaagactgttgtttccccagtgaagcatcttggcatccttgttgaaaatcagtggaccattaacataagggcttatttctagagtctcagtttgactccactgatgtctgtccttgtgccagaaccacactgtcttggtgagcatagccttgtagtaagttttgaccgcactgtcttggttggcgtagccttgtagtaagttttgatcgtgctgtcttggttggcatagccttgtagtaagttttgaccgcactgtcttggttggcgtagccttgtagtgagttttgactgcactgtcttggcgtagccttgtagtaagttttgactgcactgtcttggtgtagccttgtagtgagttttgaccacactgtcttggttggcgtagacttgtagtaagttttgaccacactgtcttggtgtagccttgtagtaagttttgactgcactctcttggttggcatagccttgtagtaagttttgaccgcactgtcttggtgagcgtagccttgtagtaagttttgaccacactgtcttggcgtagacttgtagtaagttttgaccgcactgtcttggcgtagccttgtagtaagttttgatcgtgctgtcttggttggcgtagccttgtagtaagttttgacctcactctcttggttggcgtagccttgtagtaagttttgacctcactgtcttggttggcgtagccttgtagtaagttttgatcgcgctgtcttggtgagcgtagccttgtagtaagttttgaccacactgtcttggtgagcgtagccttgtagtaagttttgaccgcactgtcttggtgagcgtagccttgtagtaagttttgatcgcgctgtcttggttggcatagccttgtagtaagttttgaccgcactgtcttggttggcgtagccttgtagtgagttttgactgcactgtcttggcgtagccttgtagtaagttttgactgcactgtcttggcgtagccttgtagtaagttttgaccacactgtcttggttggtgtagccttgtagtaagttttgaccacactgtcttggtgtagccttgtagtaagttttgactgcactctcttggttggcatagccttgtagtaagttttgaccgcactgtcttggtgagcgtagccttgtagtaagttttgaccgcactgtcttggcgtagacttgtagtaagttttgaccgcactgtcttggcgtagccttgtagtaagttttgattgtgctgtcttggttggcgtagccttgtagtaagttttgaccgcactgtcttggttggcgtagccttgtagtaagttttgacctcactgtcttggtgagcgtagccttatagtaagttttgaccacactgtcttggtgagcgtagccttgtagtaagttttgaccacactgtcttgttgagcgtagccttgtagtaagttttgaccacactgtcttggtgagcgtagccttgtagtaagttttgaccgcactgtcttggtgagcgtagccttgtagtaagttttgaccgcactgtcttggtgagcgtagtcttgtagtaagttttgactgcactgtcttggttggcgtagccttgtagtaagttttgacctcactgtcttggtgagcgtagccttatagtaagttttgaccacactgtcttggtgagcgtagccttgtagtaagttttgaccgcactgtcttggttggcgtagccttgtagtaagttttgaccgtgctgtcttggtgagcgtagccttgtagtaagttttgaaattcggaagtgtgagtcctaatttgttcttttccaggattgctttggcctctgggtcccttggcttcacaagaatttttggatcagctcatcaatttctccaaaaagggcatctgtgattttgattgtgaacatgggatgtctttttgcttatttaattctttaatttctctcaataatgttttatagtttccagtaataagtcttaatgcttcttctgttaaatttattcctaaatattttattattgtccaagctattataaatagaattgtcctattgatttcatttcaaattgttaatgactggtatgtagacatacattgtcttttgtagattgatcttgaactctgaaaccttgctaaacttctttattacttttaatagttttttagtggatttgtcatatacgagaccatgtcatctgcaaaaagagagttttacttgttcctttccaaactggttgccttttatttcttcttcttgcctaagtgccctggctagaacctccagtacaatgttgaacagaagggacaatgggggacatccttgctttgctcctgatcttaagacgagtccactgatcttagggaacaagcctttcaccattaagtgtgatgttagctgtggggcttttataaatgtcctttatcaggttgaagaagttcccttctattcctagtttcttgagtgtttttattgtgaaggagtggtagactttgtcagctgcttctcctgcacttattcaaatgttcagatggtctttgatccttttactattaatatggtgcattccatcaattgaccttcgaatgttaaaccaactttatgttcctgggacacgtcccacttggtcttggtgaataatctcttttacatggtgctggattcactttgctagctgttttttgatgatttttgcacctatattcatgaaggttattggtctgtggttttcttttcttgtaatatgtttgcctagttttggcaccaggataatactggcctcataaaatggcttaggaagtagttcctcctcttatattttggaagagtttgtaaaagagtggttttaattcttccgtgaacatttggtagaattcaccagtgaactcctctgagtgtggacttttctttgtgtgatgtttttaacttactaattcaatctctttatgtgttataggtctatttatattttctatttcttctccagtcacctttggtagtttgtgtctttctaggaatttgtccattcatctagatcatctaatttttttagcatacaattttctctaggatttcctttgagttctttttctttttgtaagattagtagtaatatcctctctttcatttctgattttagcaatttgagccttctctctttttttccttgatcagtcttagctacaaggtggtaattatttttgttgctctttttcaagaactgagtttggtttgttgacattcattgtttttgatttctcgatctcatttatattctaatcttcattctttccttccttctgcttgcttttggcttgtctcagggaaagcatccagtctttcccactgggtatgatgttagctgcagggtttttgtaaatgtcctttcaatcaaagaggttctctttgattcctaacttcttgagtgtttttattgtgaaagggtggtttgctcttctttttctagtttactacagtgggaagttacgttaataatttcagctcttctttattaatataggaatttatagccatcagagtgcgtttctatcttagaaaattagtaacacattcaaaataggtttgattacccaataatgcattgctcattgttgaacaattttaaaattcaagataagtataaggaaagaatgttattcataatttcacctcccggagttaactactgttaacaacttactatgtttccttagagatttgtttaaggtagaagctgtttccatattcaatagcccttactttctatgcacgcaggacgctatttttcttcacaatcacccgtttcacttgtcgatacattgcctctgcaacatcttcccttttccacatctccacgtctcccttctctttgggatagttgttatttttttccttttcaattctttttttttttttttttttttaatttttgagacagacatttgctcttgttgcccaggctggagtgcaatgaggcaacctcggctcactgcaacctccacctccctcccggattcaagtgattttcctgcctcagcctcccgagtagctgggattataggcgcccgccaccatgcctggctaatttttgtatttttagtagagacaaggtttcaccatgttgaccaggctggtctcaaactcctgacctcaggtgatccgcccgccttggcctcccaaagtgctgggattacaggcatgagccactgctcctggcctttccttttaaattatttccaccaaattgaactccccaggcttgggacctggtgctggccctggctgggaccctggcagtgccctggtgggtggcacaccctgggcggaggcacgggccagcctgggtgcagctctgcccccggggcctcctacctgcatctggctggagacagatgcctctttctggacttctggcccagaggtgacagctgaggtcacccaaatgagcagcatcaggcctgcgggggacctggcagtgactggaggcctcgagggccccctcctgccaagctcctcttgactctgtgttgttttcttggctcacccacccccattcccaacgccaggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaagtgagcgcctgggtggggctggcgtgcaggtgggtgggtgggcggcgttcctgggccgcagtggccatgctgtctccagggtctcgtggacagtgtggatgatgggctggtgcacagaggcgcgtcactcatatcctggtggagtgtgcacagccactctctgtggtcactgctgcgtctcttgagctggcgtgagtctgtctcttgagctggcgtgggtctgtccttgtggctgctggggacccgcggtgctgtggatccacaagggccctgctcacggtgctgctgcggaggcagcctcctcccgcagggcagggatgttggtgtcagcctcgttccttctgcgcaggcgcagcattattcatgggctcactgctctacccggggagcgtgctggggccgctgctgctcagggctgtccccttgtcaccccaagggctctgcctgtgtctccctgttactgagcaaaagggctcgctgcccgatgtgcaggaggccaatactatgacaccaggtttttgagaaaagaaaagcttttattctaggccaacccacaaggagacaggggcgcagttcacgtctgtctccccgcgctggctttaatgcagtgtttctattagggaaggttcgggggtgggttcttggatgagtaagtggctggtggaagaaaagggggttctggaaagttatgtctcctcataggtctcgtgtgcacatttgggcggagttactgggaccctggggtggaaactcgggctgtgcagactccagctggccacagtggttccagctgtgacctcagccagttccaaaagctcctgcaagcgagtctcagcatcccagcaggtggcttcttttcccgtctgccatctgtaagtgtgagcatttcggttagttgctgggttctttagctctttggggccggttccccagccctagacgtgttcctgctgcccccaccgtgtgcctcagacggcgctggctctgcggtgccttccccagagctccgatccatctgtggacggctctgtgtctgccctcccgtgccattggggtcttcctcatctgcacgtcttcacgtgctttgctggttttgtggatttgcacacacgtgtccacctcctctgggcctggtgtttgtggcatctgtggcagtttgaataacagccccagggaggtccacactcgaaccctgtggctatggggccctatgtggcaaaagggactgggagggtggggttaagtggaggatcctgaggtgggaaattatctggggttatctgcatgggcccgacatcatcatgaggggccgtggaagagggaggcggagaaggaatgtgacggtggcagtgagcgtcggcgggaggggagagcctcagcccaggaatgcaggcagcctctggaaggcaggaaaggcaaggcatggaggctcccgacctacgggaggagcacagccctgccgaaccttggttttagcccagtgagactcctgacctccaggactgagagaagagtctgattgctttaagctgccaaggccgtggcggttcactacagcagcatcaggagacccatgcagtagctgtttcttctctttgaaaatgtctaggattttctttaaatcctagtgtcttgaagtcttatcatagaacttttggaatgttatttgctattgttgcttttgaaacaaggagtacaaaataggtggctgtccatccggcccctggtggacgtggtcctctggggtcgtatctctgatcagccgcagcagctgtgggccccaggctttgggggttctgttttgctcttgcagcttttaaacttagaacaaattaaatgctgaggacctcacaccagaggcagcataaaaaagaactccagggaaccaggaggccacgcagaatgaaaacacaggtgtttggggtcctagtgggccccagggttggctctgggggttctgtggccaattcctagccctgacagtggagctgaggagcccagcacggctgcggagctgtcatggtccacagaaagcccagtctccccacgttgcccccataattcagaaagcctcccaggccctcagagcccttcccagcatctgcagacagaccctgtgctacccaggactctgaaaatccttgtgttcctggttttgttaggaaccaaccgtttctcttcttgtttcattggctaagttgctgaggttgccacctttcagaacgtgggttctgaacattgagagaacccgagcatgggccaggactgtcatctcgaggccaaggggctggtggcaggacactgtccctgcagcaagtatggcacccacacttccggctcccactgcggagggctctgtgcctgtcaccctgagacacaccaaggaggcccctgcagccctgccccttccacatgcacccctggagggtctggctcttgtgctcgtcagaatccacagatcaggtcctagagttcagtgccagacagtgtctgtctcctgataaacacccacttcgtgttattagccagtgaggcttataatatcgaaagtctgtgtgcttctccttttttcttgctttggttcccaggaagcctggaattgtgaggtctgtgggctgagttctgtgcctggagctggcctcccgtgtggcgtggctctgctctctgtggcatcacagtgggcacgtgggcatggctctgctctctgtggcatcacagtgggcacgtgggcatggctctgctctctggcatcacagtgggcacgtgggcatggctctgctctctgtggcatcacagtgggcacgtgggtgtggctctgctctctgtggcatcacagtgtgcacgtgggcgtggctctgctctctggcatcacagtgggcacgtgggcgtggctctgctctctgtggcatcacagtgtgcacgtgggcatggctctgctctctggcatcacagtgggcacgtgggcatggctctgctctctgtggcatcacagtgggcacgtgggcatggctctgctctctgtggcatcacagtgggcatgtgggcatggctctgctctctggcatcacagtgggcacgtgggcgtggctctgctatctgtggcatcacagtgggcacgtgggcgtggctctgctctctggcatcacagtgggcacaagggcgtggctctgctctctgtggcatcacagtgtgcatgtgggcgtggctctgctctctggcatcacagtgggcacaagggcgtggctctgctctctggcatcacagtgggcacgtgggcgtggctctgctctctggcatcacagtgggcacgtgggcgtggctctgctctctgtggcatcacagtgggcacgtgggcgtggctctgctctctggcatcacagtgtgcacgtgggcgtggctctgctctctggcatcacagtgggcacgtgggcgtggctctgctctctgtggcatcatagtgggcacgtgggcatggctctgctctctggcatcacagtgggcacgtgggcgtggctctgctctctgtggcatcacagtgggcacgtgggcgtggctctgctctctggcatcacagtgggcacgtgggcgtggctctgctctctgtggcatcacagtgggcacgtgggcgtggctctgctctctgtggcatcacagtgggcacgtgggcgtggctctgctctctgtgacatcacagtgggcatgtgggtgtggctctgctctctgtggcatcacagtgggcatgtgggcgtggctctgctctctgtggcatcacagtgggcacgcaggcggtgagaggggtctgttctgggtaaacaccctgacctcgaggtgttgctttctcctccctgacagctacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcagtatgccagccccagtgcctctcctgaatgtcctggccacccgggtgcagagggggtggagatggcatggcagctctgcccagaaccctggacgctcagcaggcgtgcaggtcactcaggctgctggccttctgctggccttgagcaagtggtgggggctgagcccagaggcccccttgggggcaggtgtgcgatgggctcttcctgccactcaggactggccccctcccacggggcccccccggtgggtcagggcttcagggcccacctcctgaggattccaggtcccctggtctgtccgcccaccctgacagagaacaagctggagaagaacgaggaggcggccctgctatcctgggagatctacctgaaggagaactacctccagaaccgacagttccagcaaaagcagcggcccgagcagaagatcgaggacatcagcaataagtatgggggctccggtgggcctgggggcgggaagcctctgggggacctcctgcaggtccacaggcaccatgagtacatgtcccacctggggaggcccagcaatgcctcaccggtgagggagcgctgtatcccgtggcccctgcaatgctgcaggcatccgggcctgtgcccacagctgacccaggaccctctgcggtccttaggaaggctgggccccacagggcgcagggtcagaggctgggagggaagccttggcggctgggggaggggcaggttggcccgcaggatccggcttggaggcctgggggcatgtgcacacggggtccaggctggtttgggggtggtttgctctgtgagcttgttggtgcacagccttattatagcttctgcaggacctcggcagcccagccctcggggtcagccatgctcagcaccgtcctccctctcagctcctcccatcttgcttctttccaaggtgcgaggtcagtgttgggggaacatctgctcccttctctccactgccaggccttccgccctgctaggtgtcagcagggcctaatggcccagcagcgggcagcaggaagggctgcccccagtgtcctgctctcagtgtgcgtctcaccatggcatgagaggaggagggggaaatggacacggtgccacctagttatggccgtgtggaggctcctgcagccacaaacaggagcatcctggagctggcaagggatggccaagaccaggccaagtgccctcccccttagagacatgtatgtactcctgcctttccatacctccctcaccttgtctgtaagatggagacacgatagtccctgtctcttggagttgtttccagaatacagtggggtcctgactgtaaagaattgagcacatatgctggaactataaccagggatctgctaacgtggctggtgcttttatcatcacccttacttatgagtagtgggggcggtggtggtgatggtgatgatggtggctgcgatggtgatggtggtggtggtgatggtagtggtggtagtggtgatgttggtgatgatggtgatgtggtggtgattgtgatggtggtggtgttggtgatggtggtagtgatggtgatgatgatggtgattctgatggctgtaatggaagtggtggtgatggtggtggtgatggtagtggtggtgatgttgatggtgatgatggcagtggtggtggtggtggtggtgatggtagtggtggtgatgttgatggtgatgttggcagtggtggtggtggtgatggtggtgatggtgcttctgatggtggtaatggtggtagcggtgatggtggtggtggtggatggtaatggtgatggtgacagtggtggtagtgatggtagtggtggtgctggtgctggtggtggtgacgatggtggatgtggtggtggtgatgatagtgatgatggtgattatgatggcaatagtaatgacgatggtgacaatgtgaggaccttaatgaactagctgatgtcaaagccccttctagctcccattctgagtgaactagatacacgtgtcctgtttgcttgagtctgggcatgatgacttccagttgagcccttggcatgctctttgcctagaacagtcttctcccagagagagtcaggacttgctgtctctctctattcaagcctcacttcattggagggcctttcctgccctccacccaccctgtccccatcccctgtcgttctggaatctggatgttggttggttggctggtgggtttgtgggttgtgtcatgtctaactgccaggctccatgtgagagtagggacagagtcccacatgttccccatagtatcctgggatgtagagcaggcccagtgcctagaaggcactgaggaaatcctatgcaattctggaactgctgttagttcctggcctggcagggttgcaggaggctggggtcgctggtctccaggcctgctcagccctgacgtttggctctgatggtccacttacagaggaggggggcctggggccatgcagtgccctgacaaccttctcttacttgctgttgccaagtacagctttgatggatggcctcgtctgggactttgagcagtggccatgcccagggcccagatgctgggggaaggtgcttgggagagtttctgaaaggcggcctccgcatgtcaggatgaagctggaaggccacagctctgctgatgaccaacatagtcagggctggaatatgatggctggcatgtgttaagggctcattgaggaccacacccttcacctgcatcatctcgctcaacccttttgcagagggaggtatttttccttccacttttacccatgaggaagtggaggcccaggaaagtgagagaggtggctcagcttccaccactggccagcggtgtggcctggaatgcaggccccagcaactttgcagcctcctgccttaagggagtgggctggaccccaaatgaatcagtcccaggccgggcgcggtggctcacgcctgtaatctcagcactttgggaggccaaggtgggtggatcacaaggttaggagatcaagactatcctggctaacatggtgaaacctcatctctactaaaaatacaaaaattagccgggtgtggtggcgtgcgcttgtaatcccagctacttgggaggctgaggcaggagaatcgcttgaacccaggaggcggaggttgcagtgagctgagatcgcgctgctgcactccagcctgggcgacagagcaagactccacctaaaaaaaaaaaaaatttagtcccaaatgcctctcagctcctgccctatcccagacatcttaaagctcagagctggtctgctgcctatttcccagcctaggtgctcagtggaagttgggcgcctccagttattttctgaggttgaaaaagcttaactaaaatataactttgcaggccaggcacagtggctcatgcttgtaatcccaacattttgggaggctgaggtgggaggattgctcgagcccaggagttcaagaccaacctaggcaacatagtgagacccccatctctacaaaaaataaaaataacaattagccaggcacggtggctcatgcctgtgatcccagctactaaggaggccacagcaggaggatttcttgaggccaaaagtttgagaccagcctgggtaacatagtgagaccccatctctacaaaaaataaaaaaacaacaacaaaaaaggaaagagtagccaggtgtggtggtgcacatggggtcagagtcccagctgctcaggaggctgaggccaggggttcgaggctgcagtgcgccatgatggtgccactgcactgcagcctgggtgacagggtgagaccctgactctaatgcatatttgtatgtgagtagaagttttcccaagatgagcctgcagaacgtgtttccgctgggccgctggctggtgtgctgagctgtcactcccattggtcagcagctcttgctcatccgcagaggggcctgggacagaagctgatgtgcttcagtcgacctgatcttgcagaacacgggctccagggaaagtgaggaaagagctcctcagcccgtaccaagggccctagcctggtcaccgtcccctcctccagtgaagaagctgggcacctgggaggcgcatgagtgtggggtgccataaccttgcagcactgaggtgagctgagttcaccaaagctcctcgcccacagggcagggctggagctttgggggtcaaggacaagctctgtctgcaaatctagacagttcctgcatctcacggtggtggaatcacgcgggtccgagaaggctccagtaaccaccctcgcatgtttgcaaggctgtctgggaaaacatggcaggtgcggttaagcggcttttgtgggattaagcaaaatgaaatgtgggtgaaaggagatgcccaggcctggagcgaaatcactttcttccctctccctagataactgtttaaagtgggtcatatccccagaaagtttctgtgttactaaaatagttgctcagtgtattataagaatatcacttgcagtgggcgctgtggatgaaaggaagtgagggagcccaggggacagcggatgagagctggagactcgggtttgcccacagagttattttaaccataaacacagcaggccgaggctgggcgaagcaaaataagacagaaaccaaacatttccagaataatagcgccgctctacaaccccacaaaataagacagaagccaaatactcccagaaaaacagcgctgctccacaacccccacaaaatacgacagacaccaaacatccttagaacagcagcactgctccacgacccccacaaaataagacagaaaccaaacatttccagaataatagcgccgctctacaaccccacaaaataagacagaagccaaatactcccagaaaaacagcgctgctccacaacccccacaaaatacgacagacaccaaacatccttagaacagcagcactgctccacgacccccacaaaataagacagaaaccaaacatttccagaataatagcgccgctctacaaccccacaaaataagacagaagccaaataactcccagaaaaacagcactgctccacaacccccacaaaatacgacagacaccaaacatccttagaacagcagcactgctccacgacccccacaaaataagacaaaaaccaaatattccccaagcaacagtgccgcgccacatcacccccaaaacaaaaccaacctctgctgtgcccagaggaagtttcattgtttgtgacctgtcacctggccctccctcagttcactcacctccccctctctcctgggaccgacaggctgccagagcttgccatgtgagcctcggctgtccgtctgctgagacatcttcccctctggggccctgggcagtttggttctatgggagaaatgcatgttagaaatagtttcatattaagaggaagcaaaggctgacacagggccttggtggctgcatctggcagggctgtctgcagagcggtgtggcgttcccagggccccaaggtgtggtgtgcgtccagctcagctgcttcctctttcagggttgacgccatggtggacctgctggacctggacccactgaagaggtcgggctccatggagcagaggttggcctccctggaggagcaggtgggtccgaggtcggggcctccgtcaggaggtgccactgctgggcctggtgggcggctctgccatgtggtggcaccaagaaggagggctctgaggagtgatggtgaggaggaggccggaacgttggggcagccattcccagctggaagaggcaccctgtgtgtcctccagaaaaccccgcccaagggtttctgtgactgagttccttctgtgtgcactgaggcctccacggccgggctgtgctcctcgctgctcccaggaaacagagtgcttctcccctcccggcctccagggaggctgtgggactctgtgcctgagccctggagaggccgcaagaccgaggtggggaggacttagagacggcctctcagggtctgctcccaccaccccatcaacgtccaccagctgggccgggctgtgctgtccaacaacagcacctgcggccacggcagcccctgcgggcagtgctgagccctgtggatggctcagccaccctgtgctgctgctcccagccttgctctgtggggcagggctgggacctgtgctgctggggcatccaccatccaccagtcctgcccgttgcacccaggggtctgcccaggccgccctctacccctgtcttggccatgctgggacccctgacagggtgcccagcactgagccacacgagtgagacatgtcccactgtcccctgtgggaggcgcatcagcctctggggaggctcctcctgggaggtgcaggaaccctggaagcctctggctttggcggcctgtgacctctccctgtggtgcagaattgcctgactgtgccttcatgctggctccatcctctggcttgtccagtgcagtgacagtcccactgttgtgtctcttggggaggctgcaccatcagatgtgtgacttggcagcccccggggggagccgggtgggcctggggcagcgttctggctggcttggtggctgcctggggaggacgtggtgtctcactttcaaagggcgcaggggctgagtgacaggggtggggctcctggctgggggagtgaagtctcggtgggcagtggggtgtgtaccatgcgtgtgggtggcaggtgctcactgtgtctcgggccatgccttccaggtggcccagacagcccaagccctgcactggatcgtgaggacgctgcgggccagcggcttcagctcggaggcggacgtccccactctgggtgagtgggtggccaggccagcagctggtctccagccgcctgtttcttttgggtctggggtcagttgggaggagaggcagctgggggtggggggctctgtccaggaggaaggcactggctgcagcctgttccaggcagggccagcgccctcaggaactcagcccacccaccgacgctggcgccgaggccccgcccaatccctgacctgacctggttcctggacgtccacggggaggcctggcctgctgtgccctgagctccccacataccgcactgcagagtgggggtgcgaggcgggcggctgcagactgtgtctgaacctggtcacgtaggctgagtgacgagaagcaaagtctgttttcctaaattcgcagccggctatgaaatgcacatcagtagccttcctcgggctgctgagtttcgccggccctcaaggagcatatttgccctcgtaaccgcactgcgagttcagctcattgccgagggccctgactgccgctgcacaaagaggcaggtgccggcggggacgctgcctgagctcccgtggctgtcctccctgggggccctgcccacttcagagctggtgttcgacctgcatggccatttgggctcggggaggtggaggagcccagatgttttggcggaaggaccacagaggaagtccttgtcctgcgggcgggcacctgagcccgggctccgccttgcgtcacgtcttcctgactgtccccagcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggaggtgagcgcctgcccaagcccaaccaggcggagtggccgggcccctggggaggggagggcggccctgtccccatccatctggtattaatcctggctcccagccactgcagccacagggggatctgtgcgtctggcagcccctgtttgacatttgaggaaaccgaggcacagagaagtcaagtcacaggggcctcacagctggaggtggtggaggggcctgaggggggcacactgatccccacagagctcgaggcttaggctcctcccatgaccatcccagggcccagccccccggccccattcccccaggtcatgccctggtcctagaccccacccaccccggtgaatggctctggcccctttccaggtgccaggcatggaagagagacagagacacagagacagagagatggctaatggcccctgggagacccccgccctcctggtgcagggcttctctctggcctatccagaacattccaggctgctgcttccgctgcctccccttggtctctaccacatagaatcctccttgcctctagggtccagcttagccccctgccccactctgggaagacccccaaggcccccaagtcacggccacctgcccttcagctggccccagggtgggggtccctgatcccagcccccggccctgcccagcccccagctctgcctggcacccggatctgcccagcttggagcttctgccctgcatgttgggatgttggggtcgggttcagacccagctgagcagccctttcaccctggtgcctggcccagctttgcagtgggggtaaaaatctgagggaaaactccctgttttgcgacagacggagttcctgatctatgacccacccttttacacggcagagaggaaggacgcggccgccatggaccccatgggagagtgagtatgagccgctgtccgtgctcccagctggccccaaacccagggcctcctaggggctcccttgagaatcccagtcagagcccagcccggggaggtccaggtgagcaggaggggcccgtgggggcctgaaggggcccagctcctactgttgtgtacacccagcctgcagctactcggctgggcccttggtgggggggtgatccctctgcctgtctgctctgtcccacctgcaacacgggcacacagacacgccttctcctctgctcccagcaccctggagccactgtccacgatccagtacaacgtggtggatggcctgagggaccgccggagcttccacgggccgtacacagtgcaggccgggttgcccctgtgagtgtgccccctgcgggccccgccccgtcagcctttggggtttgcctggggggcaggtttcctctctgggcaaaggaagcatttttctcataaaacaaaatcaaaaaaagcacgtgagccaccgaaaggaagaaaacatcaactcactgcatctccgtagcccccaggactgggcttgggggcgtgggacttgccccctggcctcgggcaggccctgccccatggtccctgccgtaatctggggacgtggatttgtctgtgtacgtggggatggctgtgctgggagaggacgatgcctcagaggatgggcaggggctgtgcggcagggaggggacacggagatgggcactggcaggcttacctggccgggaaggtggcctcgcctggcatcctgttccccacaggatcggcgctgcacccatcacacaggtgaggaaacccaaaataaaggtgtcaagtgtcctgtgagcacctacaagtgccctggaaggaaggagcctgggagtcttggaccctgccatgaggaggaggtggaggaggggccaccagaacctgggactggggggttgccgggatgtggggcatgaaccatggagcagaggaaccaaagggtctgaaggacggggggactgcgtggcaggcctttgcagaatgctctggaacagggtgtgggctcctctgcctggagccggaggttgagtaaggaggtggtaggaggcgatggggcctgagagcagaggtcctggccaggtggctgcagctgcaggcggcccgctctggtgttgggggtatgtgggacgggcaagggcgggtgtttagggaggtgcatccggtggctatgggaagctgacgaggagagcagcaggtgcctggcatgggcaacaaggcgtgagcacctgctctcacgggtggctgccacacaggcaggtgtgtcaggacttggcaggacgtggtgtccatgcgggctttagtagtgcagaagagcactttctgtatgcaccatgcttctgttgtggacttgcgaatcatattttcattatatttccttaggtgtgttctctttctatgaaattataaagacacaccttcctatattcatttgatacattttaaaattagtttttttcactgagactttaatacagctgaaggctgattgtataaggtgtgaggaggggcctgatttattttgtgaattcacagagaaagtgagctgcctgacttcatttcctgctaagatctggcccctcccctgaggtgtggctcctccctgaggtgtggctcctccccttaggtgtggctcctccccttaggtgtggctcctccccttaggtctggcccctcccctgacgtgtggctcctccctgaggtgtggctcctcccctgaggtgtggctcctccctgaggtgtggctcctccctgaggtgtgactcctccccttaggtgtggctcctccctgaggtgtgactcctccccttaggtgtggctcctccccttaggtctggcccctcccctgaggtgtggctcctccctgaggtgtggctcctccccttaggtctggctcctccctgaggtgtggctcctcccctgagatgtggctcctccctgaggtgtggctcctccccttaggtgtggctcttccctgaggtgtggctcctccctgaggtgtggctccttccctgaggtctggctcctccctgaggtgtggctcctccccttacgtctggctcctcccctgaggtgtggctcctctttcaaagctctgtatgcctctgtcccagtcatctcatagcagatcatgccactatttgccacagcgttgcagtaatcctgactctgggatagcatgtctttaaacctgccttttctagtcttgagcctttagcttttttgtgagtttaaaagccagtttttctagctccatgacaaatccattgataagaattgtattaaatttatagaaaaatttgagacaatggacacttttatgataatgagtcttctatgactgtatttgtcaacatttatttatgtcttctctttgtccttccctaaagttttataattttgttcataaagatcttacatttttaaataatatttattcctcaggtatttgataacttttgttatttggggtaattataacatttttttctttttcttttttttttttttttttttttttttgagatggaatttcacttttgttgcccaggctggagtgcaatggggtgatcttggctcactacaacctctgcctcctgggttcaagcaattctcctgcctcagcctcctgagtagttggaattacaggcatccaccaccatgcccagctaattttgtatttttagtagagatggggtttcaccatgttggccaggctggtcttgaattcctgacctcaggtgatccactcgcctcagcctcccagagtgctgggattacagacatgagccaccatgcctggtgtataacatttttttatattttcaatttttaaaaatatatataggggcattattaattttgtttgctgactttgtatctaacaactttattaaaccttctcgttaattatataaatgtgtttgtagattttctatgtaaataatatatattctgcaaataacaatattgtctttctccttacaataatcatgcctcattcctttttcttgccttattgtgctgggtaaattcttcagtgtaatttagaatattggtaatattaacaggcttccttgtttctgacttaatggaaatgctatcaacatttcaccattaagtatggtatttactgaagaaatttataaataccttttattggattaggaatgtttctatctagtcccaatttgtcaggggctgaatgctactaaatggtttttctgccattgattgagatagttataagatgtttcccctttagccaattagtgtgtgaattatttttatagctcctttagtgttgagccatccttgcattcctggaataaactcttctgttatatttaacgtactgctggagttaatttactaacattttacttaagattttaaaaaatctgtgttcaaaagtggaatttgcctataatttatatttcttgtactgtcttactttggttttggtatgaggttataccagtctcaatgaatgagctggtcagctttccttcttttctcttctttacaaagaagagaatgtttgtatgaggtggagataattatttgtttcttaaagtctgataatacttagctatataactgttagctctaacatattttgagcaagtggatttctttttttttttttttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatcttctgacctcatgatccacccgcctcggcctcccaaagtgctgggattacaggcgtgagccaccgcgcccggccgagcaagtggatttctaactactttatcttccataatgatttttcgaatcttatttcctgtttcttcttgggtcctttttagtaattgtaaattttctggaaaattataatttcatctaacttttgaaatgtattgtgtcacagatgtccataatattcttttatgatttaaaaaataatataaatatatagtaatttctcttttgagcattgatatttattatgtatttctcttctttttttttttgattattcttgccagtggcttaattttataatcttttcaaaaaactaacttttggatttgttgattatcttaatttttcgatctcatccatttttgcttttattgttatctttccttcctttctacttcttatggatttgctcttgatttgtgtgttagagctcatttttattcaactttcctggttttctaataagggtacctaagactgtaaattctctctaagacctggtaggctgtaacccttaaattttgatgtgtagggattttattttttactttatgaatttcattataatcttcattttacacttttgttttgctcttttttttttttctttttgtggagaatgaggtcttgctctattgcccaggcagatcttaagctcctgggctcaagctatcctcctgcctctgcctcctcaagtgctgggattacagatgtgagccaccacgcccagcatagtcttcatttgattgtttagtgatgtacttttagctttttttatcttgagatggagtcttgctctgtaccccaggatggagtgcagtggtgcgatcttggctcactgcaacctccgcctactgggtcccagttcaagcaattctcctacctcagcctcccaagtcactggaattacaggcacgcaccaccatgccagctaattccttttgtatttttagtagagatggggtttcaccatgatggtcagcctggtcttgaactcctgacctcgtgatccgcccgccttggcctcccaatgtgctaggattacgggcgtgagccactatgcctggtcatgtgcttatagtttttaagccattctttgttatcaccttctagttttattgcatttttgttggagcgggattggcaacacgctgattcttgaaattgaaatgtcctccgtggcccgtctctaccctgggttgttgcagctgtttggctgtaaccctaaactaacacctaacccctaaccttaaccctaaccctaatcctaacccctaaccttaaccctaaccctcttggcccattcacaacagcagcctgtgtgagcttgtctgactcaagtcattcacacactcagatgccctttctggtataggagtgactgtccccacgtctgtctggggccagccccctcactgtattagttttctatggctgttgtaactaagtaccacaaactggggggcttaacagaaatggattatctcacagttctgagggccaggagtctgaaatcaaggaccacactccctctgagggcttgaggggagacctcttcctgcctctccagctcctggtgttcctggcagcccttcgtgttccttggcttgtgatctctgcctccctagccacatggcctctccctgcacgtgtctgtgtctcttctgttcttaggattataaatcgtactgggtttagggccaaccctattccagtgtagcttcatcttaactaattacacctgcagacactatttctgaacaaggccagattctgaggttctgggaaggacatacatttgtgggcattgttcaccccagtgcatctttgtgctagacccatctcccattgcctttcaaggacctcatcccgggaatgtcctgctcctcctgcacccgggtcctcctgccctcttgcattgctcctgccaacataaactaaacaagcccctgcccgcaagtcccttcctctttcgaatccactccacttgggctttgcttgccccctctttctgagatggattgaggtcaggtcagcaaagattctgccttgttcaacccataggccagctctccacccctcaacccacctgcatttctggagctgagtggatgagtgaatgaacgtgtgattgctgtagccagactgtcgctgtttttgcgctttggggttgtgtgcgtaggtttatggacgggcctatgccttgatgtcgtgatggaactaccgggcacgtggcagggagatgaggggttgagaaccatatggacgagatcatgaccgggggatcagagatcagggcacagtgagagcagctgaagactcaggtgtggggtgggggctgcggtgggaggagggcagcatggtggtccgaagcccctgctgcccggcccgctcaggctgactgagaagcaagggtgcagagtgtttgtttccctcctggcagaagcgagcgtgcatgtggtaggagctggcaggcccctaacctccctcctggctctgccactggccgactagggatggggacagtgagatgacagcagggccctggggcccagagcttcctgtgggggtggactcatgccaggcagagcgtgtggcctcctctgtgagcttcttgaccaatgcactgcactcagcacgaacagcagttacagggagacgaggcagccttgctcccagcagcacgacctctgccttcctctccttctggagctcagtgcagctctgcccagtgccgaatttgtccgtggccttggttctgggttctgcccgctcagtggcgtgagtgcaggaaggagaatggtggctggcaagggcggggtggacgggagtgagagacgggcttggggttgaggggaggcagcagtgaccctcgcaggaaccctgactgagccccggccttcgagctgaggtccccaagccttgctgcatgtgttgccagctctgtagctgggtggggccggggctctggtttctgagcagcttctggggaggctgcctgggccccaccgtgcaaggccccccggccacagaggagaccgcagagtgagctgggagggctgtctgagaggcctggccaggtgggccctacacactgggcatgttctggtgcggactctgatcgctgtgggctcgggcaggtctgcgcagaggtgtgacgagagctgggacccctgacagctgggcgggaacagggtggctgctgaggggtaacagagaggaggggctgggtggaggcagggaggccagctggaggctgccccgccaggcagggtcagggacggtagcgcaggcctggctggtggccgccggtgctagaggtggtcagctgtcctggggcagccacggtcagctgtcctggagcagccacgcactgccgcgcagactcaggaggatggagtctaggctgtggggagaggaggccatgaggggtgggtcagaggctgcagctctgatggggtctggaggtcagagtggaatggtggaggaacgataccactgtccccactgtggcatggatggtggtggggactgtggtggggacggtggcggggacgctggcggggactgtggcagagacgctggcagggatggtgacggagactgtggcgaggactgtggcagggacgctggcagggatggtgacggggactgtggcggggacactggtgttgggaacgctggtggcggggatggtggcggggacggtggcagggatgctgtcggggactatggcggggatgctgctggggaccttctgtagacgtggatgccgcccccaccgcacgatagcggcagtgcatttcttccttctgttttagtggtacattcacaggaaatcgcccgtttctagaacttgctgtttcatataggacctggtggtgtcagggagaccagcctggccccatgggaagcgtctgtggctcctgctgcccgtggttagcacactctgctgggggtctgtgtggcctatcatctgtggccacacggacgcagggcctctgggtgtctggcctggttcccacactgcccctcggaaggctgccaggatggaggccatgctctcgcgtgctggggcctttggatgcaaagtgctggcccgagcagtcggccagttccatgctccgtggggagaaggtggccactttagcccctcgctggcctgcagtggccggacttctgctcccagggagacccttcccccaccaggtgaccccgagttaacccagagccttggtctcactccttgggggtcccaaagggatcctactccctaggccagagcaggtctctaaagaagcctgcatgctgtcccgctgtgcgccggctcctgacgcccgctgtcccctctcagtccccctccctgccctgtcctgctcccccattggtggacggtggactgactcaacccctctgcatcccaggaaccccatgggccgcacaggactgcgtgggcgcgggagcctcagctgcttcggacccaaccacacgctgtaccccatggtcacgcggtgagttcatgtgtgccgggcaccagcacctcagcaaggcggtcaccccaccttcacaaggggcggctgccattgcccagtgctcaggggccgggagggcggctttgatgcttggcacttggtgcctactggggggatgcgggaggcgtctgtggataaacgtgaatatgcccgaaatggggcaggaatgtccatgctgcccatcctggaggaagatcccaggacccatcccctctcccggggctgccttcactttcctgccggtccctgcccattagagggcaccctccacggggacacagccccacactcacccctaagtctcactcctccattcccatccacggggacacagccccacactgacccctcagactcactctccacacccatccacggggacacagtcccacactcacccctcagacccactctccacacccatccacggggacagagccccacactcacccctcagactcactttccacacccatccacggggacacagccccacactcacccctcagactcactctccacacccatccatggggacacagccccacactcacccctcagactcactctccacacccatccacggggacacagccccacactcacccctcagactcactctccactcctatccacggggacacagccccacactctctcctcagactcactcctccccacccatccacagggacacagccccacactcacccctcagactcactctctactcccatccacagggacacagccccacactcaccccctcagaccctctccatactcatccagagggacacagccccacactcaacccccaccacaggctcattcctccacacccattcacacacagggacacagctccacactcaccccctcaggctcactcctctgcactccagcagctggcccactgctctcacccaaggcacgggccgccttctgtgcaggtgcagacgcctgcgtccctgaggaagctgccgggggctcttgctgcccccattgggcaggaatgggattctggggcccaggcccagctgctgtgccctgtgctctctggggcctctgcctccacagctgggacctccccccagcggaggggcctttggcctcagggtcctcttgctgcccagccactctcacccagtggcttctctggccgtgcagacatggccctggggtgcgagtcactctctgctccccagtcctttggcctctccttggcctgcccaggtggcactcggcaccccacgtcacccccacgtcacccccgggctgcactctgcaccccatgtgacccccaggtggcacttggcaccccacgtcacccccatgtcacccccatgtcaaccctgggctgcactcagcaccccatgtcacccccacatcacccccaggtggccctcggcaccccacatcacccccaggctgcactcagcatcccacgtcacccccgggaggcactcagcaccccacatcacctcactggattcccactggcattttctaagagtggtcaaactgcaaagctgggtcaaagggcaggtacctctctaaggattttaatgtttaaaaaattctccatgaaggctgggtctctttctagttctaccagctatgatggaagtgaagaaggacgtcccctaagtggttactatctcagtcttttccctggggatgaagaacttgaaaaagaacacggtttgagcctgcagtgggcctgacactgccccgccccaggcagggccagccccgccgcggcgcaggggagggtggaggccgcagcgggtcctgggcagccatggccgctctctccgcaggtggaggcggaacgaggatggagccatctgcaggaagagcataaagaagatgctggaagtgctggtggtgaagctccctctctccgagcactgggccctgcctggggtaaggctgccgcgtgtgggacctctgtccactgggctgtctgtgggtcactcgtccattcatccattctgcccacggactggacaccagccccctgcagccccctgcagcccctgggcagggagggttcgagaccccgcctgttttgtctgtagaagacactcctcctcccttttcctcatgttgcagttaggaaaacccaggatcagaggatcttttggtgcataaacactaacggggcacctactgtgtcccaggcatgggctgggctgcggctggaggccacctgggctccccttgtggagttcagggtgttgggggcagaggtagctcttctcccgtgtctcagacaccaaccagctcctgaccttcagggccaggtgctgagccataaatataggacggtgtcatccaggggtaggggcaggtacaggagtaggggcaggggcagcgacaggggtaggtagggcccagggttgtgcacaggcccctcagctcaggggctggttgtggggctgaggctggagcgcaccccagcatcttgtggggaggggtgcacacaatcaggacagatggcctgggcctttcctgttcaagtgcctccaacagctcctgtttcctcccaggccagcctggcctccgcagccctccagcccgctcactgcaggggatggaagaggctggtcctgccaggaggtctgagtcctgccaggcctggccgtggcgcatggcctctggggtacagcctgccccgcagggcctctcctctgcacctgatccggggagtctgtgacttacaacaactcagcaagaagctgttgcatttctctgaccccgagctcacggcctggtggctgcctctgctgctgtgggagtgtgtgtgccaccacggtgtgcagggcagcagtgccacaagggcctctgggcaggaacggggactccggagcccaggcccagctgctgggtcccagtgctttgggggcctgtctccacagctggaaccacccccgcagcagagggggcctttggccttggggtccccttgctgccctgctgcgctcacccagtagcttctctgcctgtgcacacctggccctggaacacgagtcaccctccgctctctggcactttggcctctccatgcggggtgcgtggagttgggtttgggggtcccactcactggcatccctgtcagctcaggctggtcactgagaggggcactctgaggggcctcctgggttcctggctctgtagggcacgcacgcttgagggtgggagtgtcatggggctgaggtgggaccgtcttgacgtggcctgcaaagtcttcatgagaaacccacgggtgtttcagtgggactttgaatgacaaatagggtgggaaagatgggtgtggggaggaggaggtgcaggccggagctgggtccctgagtcaggtggcgctcgggagcgtctgggagcccagccagccgcagcacaggccggggtgggactgggagagacgggaatgcaaacagggaacccgccgtggcagcctgctgcactgggcgggagctgggaggggcgacgcgggggcaggcgccaggggagcgggaagggggtgccctgtcacccttggggagtctgagctcagggtgggtaccctgggggctgtccctgctcctcagaggttgtgtctgcagcccagtgccccctgctcgggccacggcaggcctcacagatgctgacgtggacggcgggttctgggcaatgtcactgcagcctgagatgccgcctgcctgtggctcccagggctgggccgctgcccacgccgggcaggaggccagtggagacgggtgccagggcagcctgaggtcccgcttcggtgccctgttgacctgcctccgtcctctgtctgtccagggctcccgggagccaggggagatgctacctcggaagctgaagcggatcctccggcaggagcactggccgtcttttgaaaacttgctgaagtgcggcatggaggtattcctggcctgtttgctctgttccacctgtgtgtccccagggctgcaggacaaacacagtgtgatactggggacctgccccagcaccactgggtggcagcggtcccacccagcttcaccaggtgacggtggtcccagcccctgcccccacgttgcacagctcccagaggacccggaagcatagctgtgtgcagggcccctcagacatctcgccctccctctctgttccattttctcctctctaaatcaagggggatgggctgaggacccttgctgccttcgagtgtgacagctgcttggaggcctggtgccgccctcctccccacatccacccttgcctcgagcacagctgcgcccaagggtgctgggaagccagcccctccctcagacctcgccccgactcccaagctctggaggggcccttcccacatgcatgcccagcctggggaccgactgtaccaggactttttatttacttctttagaaacctcgatctttccttagaaagcctccatctccagctctctcacacaaatgcatgcacactttttttttaatttttatttttggaaacaaggtcttattctgtcacccaggctagagtgcagtggtgcgatcttggcttgctgcagcctccacctcccgggctcaagcaatgctcttgccttggcctcccaggcagcaggggctgcagcggtgagacaccacacccgtctaatattttgtatttttagtagagacagggtttggccatgttgcccaggctggtcatgaactgggctcaagcgatctgcccacctcagcctcccaaagtgctgggattacaggtgtgagccactgcgcccagccctttatggacgctctttataaaagcaggctacacgggccgggtgcgctggctcacacctgtaatcccaacactttgggaggctgaggtgggtagatcacttgaggtcaggagttcgagaccagcctggccaacatggtgaaaccccgtctctactaaaaatacaaaaattagccaggcctgatggcgcacacctgtaatctcagctacttgggaggctgaagcagaagaattgcttgaaccaggcggcggaggttgcagtgagccgaggttgcaccactgcgctcaaaaaaaaaaaaaaaaaaaaaaaaagtgatcaatgccatggtgtggagcacttcacaacattgtgcagccaccacctctatccggttccagaacgttccatcaccccagtcacccccagctcctccccagcactcccgcatctgcttcccatctccttggatttgccggttctgggtgtctgttatgagtggactcctacaacaggtggcctttgaaactgtcttccttcactgagcagacgtttccaaggcgtttccaagatctctgcagggcaaggacgtgtctgtccaggatgaagcccgcattgggctgctccgccttgcaggcccaggcaggctggcgggggctggggagagctgggccggggtcctgtgtgtgctggaagctgtgctcagagctgggtcagggtggagggcacgaggtgggccggggcaccgctcaggtgtccctcgctgtcgggcttaccctgccctgcccatccaggtgtacaaaggctacatggatgacccgaggaacacggacaatgcctggatcgagacggtggccgtcagcgtccacttccaggaccagaatgacgtggagctgaacaggctgaactctgtatgtgcctggcctccctggaggcgggagtggggaggcagggacgggtatgggcgtggcctccggggagggggttggcagggatgggggtctggattctggcaggctgaactctgtatgggcgtggcctccggggagagggaaggcggggaccggggtctggattctggacgtgcctcgagggcttccaagggagggacctggccgtgctcctggggcccagggccagaaactggaggctacagggtcagagtcttgcccagaaagtgacaaagggggcaccagggagaggccggggagccacctcaggtggccagagctcacagggctggccaggcgaccatagggccctgtgtagttctgggacctgggtcctccagggaggcctcgaagatggcatccaggggtgaggctggcaaggccccctcagcccccggctgccggcttttagctctttatggggatgtggattcccagtacttggattaatcctgcatgctcctaattcagaactgggatgggaaattccataaataaccccgggctttaaatgcgggctaaatagctcccggcaaagctgcacctgcatcttcttcccctgaaggatcctcagggccttgtgggtgcatctctggtgcacctgacgcaggggtcctgcctcccatttcacagaggagtaaagggagggtgtgcaggccccaagccctcgaaggctgcagtccgtagggctcagctgggcagaggcagggctggcggggagggtcagctgtgcccttgttcttccagaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggcctggctggctcttctgtgctttccacaaataaagttcctgacacgtccagggccaggggctgtgtgacggctgcctgaagttctcctcgatcccccggtgagcttcctgcagcctgtggatgtcctgcagcccctcagccctacccccaagtttctcctctgacccatcagctccctgtcttcattttcctaaacctgggctccagcatcgtccccaagcccaccaggccaggatgcaggcatccacatgccctcctccttggcttcccctgcgtggtggtgccaatgtgccctggcacccctgcagaggctccggatggagcctggggctgcctggccactgagcactggccgaggtgatgcccacccttccctggacaggcctctgtcttccacctgacccaaagctctctagccacccccttgtccccaggtat

SEQ ID NO: 36792 - DNA, 66283 bp, Homo sapiens
acctggtgcgggaggcccgggcagggagaagtgtgcggggccgggacaagccggctccgagtccggctccggggggcggggcgggaggggcctgcgcggcggcgggagcccagagccgcgctaaagcgggtcaagcgtcctccttttctccccgccccttctcctcctcctacctgggcctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagtaagtggagccgagagaggcggacgccgcgccctggctgggtcctggttggaagcgggacacttgagagcaagggtggggcccgtccagcgtcaggtgaggctgcacgctgccggtgcaccttcctccctgcctggcactgcttcctccttctccagagggggtcgggacccgggatcccagtggcggtgaggttcccaggatgaccgcggccgctgcccgggagaaatgggccactcaacccggcttacagtttagcttcatcctcttccggtcccttcttcaggatctggggccgacgctggaatcaggagggaacctgtcctcctaggggctgcagtgcagttagtagctgccacctcacctctcttttcagtagagggaacaaagttagtaaggactagagacgtgccaccgtcggctgtatcatttcatcggatcctgacgcgggaggcttggcttctcgcgctgccccatatgcacttacattttctccatcctttttcagtatgatagattttggaggttttagagtatcatgcacgtgacataatagtaatcttccagcttcttttgagtacacgacagacagtgcaattcttctgtctaccagtagatttcatataacccgacgttaattcatgaagacttttcacttccttttctatagattactcttctttcacatttaagaataagtagatgcgatattactatctgtttaaagctagaaaaggaattcgggcgtgtttggtaatatagtggtgcaagtaagaacttgtgaagaaatgcagttttatgatcttatggactggatggtttgggaaattggaccagagaatagattgttgtatcaaaccgtctgtttagaaaattccattttatttgagaaacccaaaacacgtaaactgtttctagaagcatactttggaagcaggcattgcagtttgaattacagaagtgaggtggattgcccaaggtcaagttcgtggctcttgaaactagaatctaagtttcctgattccttttcttctggtttatgtggttgctgagactggctggcagttctgatttggggaggattccacctgaaagttgatgttgatgagtttgatgtaacccaaattacaaagccctaataggaacatatcacatgatatcacgaaataaacgtaaacgtgattcttagtactaaaactttagaatcaatggaatcaatgtagtgacacttttccccttacccttgatagtaagtagaataaaatgagtctgtaataaaacataagtgtcaaggaattacccaaaatataacaatttccagctactgaaggttgaagttacaaaactaggaacagtgggctgagaatagtctttgtgaaaactgccttggaaactagacccaaaatagaattaattaggttgggatttgttttgttttgtttttagcactggtatagtttagcatcaaggaaataccagcttctctatgctgacttccttaactcgacaaagctaacaagcttttgttaagagaaaagatgttcaggaagccatgcataaaataccttcggaattaagttttttctttttttaacaccataatgtatttaaaatggaaactacttctgtagtgtgatttgactcattagaactgttgtctctagctatctgtgactaggttacctcgctgcatatttatttatttatcaatgcagtactgttggtttttattgacacatgtccagctggattttgttttctgaaagtagactttgctatatgtaacctgttttgtcaagatttcttagacaaggatgaacatattcaaaccatatctaaaatactgctctacttttagagtttatcatgaggaacttttgacttggcaagctgatagatattgaactctatccctgtctgtcctttcttatcagggtgtgtatttgaatacacctgtatttccaggtcaagggctattttaaaatcagtttgcacactggaggctggttaatatttggtcaattcaaactcattaagggccttccctgttcagttgcagtaaaggcaaaactcttggggaattagtgaaagaagtgaaggaggtacattatattctgctattataatacactcccatgcattgccattttgtagtcttttaataatggtgttattaacatgacactccctttgttccggactggtgacttatgctgagagaaggctctgtactccagataattagcaagtgaaaaaaatacttcttacctgcagaggaatgttcccaagtgttaaatgttggagtggtacttgaaaaatgacaagggacatcttcaaggaaccctgcaggagacatatatgagttagatttattggaagtctgtacaaggctcattgttagcatagagggcatgcttggcgtctacctggagactgtaggaaaagctctaaacagtggatgaggattgagctgggaatgaaaagattcctgggactcaccaggtttacaagggtttgggtagggtgttctaggcaaaggacgtgttgggttttttcttgaatcagcattctaggcacagggttgcagatacagaggaagagataatgaaggtcctgagagcaaaaggaggaggcattgcttagagcagtggtccccaaattttttggcaccagggatcagttttgtggaagacacttttttccacggatgggttggggggatggtttcaggatgattcaggtacattacatttattgtgcactttatttctattattattacattgtaatatataatgaaataattatacaactcaccataatataaaatccatgggagccctgagcttgttatcctgcaactatacagtcccacctgggggtgatgggagacagtgacagatcatcaggccttagattctcataaggaacatgcagcctagatccctcgcatgtgcagttcacaacagggttcaagctcctgtgaggatctaatgctgctgttgatctgacaggaggcagcgctcggtggtaatgcgagtgatggggtgtggctgtaaatacagaggaagcttcactcgcagaccactcacctgctctgcagccgggttcccaacaggcccagttcctaacaggccggtactggtctgtggcctgggggttggggacccctggcttagaggacatcatcagtagtacttaggaataagggctgagatagaacgtggagtttagcaaaagatctaagtagaagcaagtttaggttgaggaaattgagaggtgaaatgttggtagttattgttataaagtggcagtgaaaggaatacaggatggcaactagagagacaggaggattaatgaagatttttcttttcagaggaggggagatatatatttgtatgaaagtcaaatgagtaaagatgttgaagacaatgggtaggccctaggaaaaagaaagcaaacatggggtagagactatggattattgggatatccaaggaaagaaaagagggatgcatgtcttttccttaagaaaagaaagacggaatgaagagtggatacaggaacattttgaaaagcagaaaggagaagatcaaatgttggatgccttcagttagtaaagtaggaactcagaaccaatgagcttcaagggatcttagaaacaacttggtttaactcaattcatatatatttgtatttgtatatatttatatataatttggtatatatacaattaaattttaaacaataaatttgtattcagttgaatcttcactgagtttaataattctgtatagttttataatagttaccttttggtcatttcctatcacacttcccaaaaatgacagttcagatgtgttccagtcacgttcagtgttgtgtgactgtgtgttaggaatatccccatttaatagctgagaataagaaaagcaatgggagtgatttaggcctggggagtgccagaggtccaggatgtagggaattagagagtcagtgaagccaagattgaagtggatgaccacagattcaggtcggcagggaagtgggctggtgaagatctaatgggttgagtgggaatgagtattgaaacagaaagagctaagacatgacttatgtagagaccaagggagaacttcccctctgccctctgaagacttgccagaaaaaactgacaacaggtagattaatcggagaaatggcatacaagtttattaacgtgtggggtgggaggagggagacagagtgattacctgaaccccaagaggctcagaagcttatataccatcttgaggcaaaggtggtcctgtcatgtagatgaaacctcatagggaggagccctcagagagaatagatggtgaatatttctttcagacctttaaaagtgtcagactctcagttagtctttcctagatccagacaagagagaaccttcagagaaggccaggttgcatcaatgcagattttctctacagacacaaatctacctcacaaaagacagctttgcagggctgtttgtttgcaggccctctgaacagccatctcaaaatatgtcaaagaagtataatttggggtgaaatattctgatttccttcacttgctagaccctgaagtgggagaaaagagggtgcacattgaggctgtggccagtcaaggggagcacacgtggaatagtgtgctttcaggtaagatccctgtgtgtttgtgcatggggctgctacttagggattttggtttgtgaagttgaggagaaaacaatccagagatcagttaacgtctctcctccatttgagatgtgtgcagcttctttcataaatacattattattttcaaataaacttttaattttggaacaactttgatttatgtaaccaccccacaggttcttctttcttgctgcccagatagaactggtttatcaacacgggagaattgcaatagagaaaaagagtttaatgcacacagagccggctaaacaggcggccagggttttattattactcacattaacctccctaaaaatttggaggctagactttttaaaagatagtttggtgtgcagggggttagagaatgggtgctgctgattggttggggaggcaattgcaggggtatggaaaatggtccttgtatgctgagtccatttctggatgggggggccacaggagttgctggtttgggaggagttatccagtcatcagaaatataaaaatctgaaagtggtctatcttttaaaaggccaatcttagcttctttaatagtgatattatgtgtagaagtaattggagaagttgcaaatcttgtgatctccagaccagtggctggtaattgtttacatgtaatcacaacaaaattcagtcccctctcataatcctaaacttgtgaccttttattagttttataaaggcagtttagtttagggaagagctgttatcatttaacctgtaaactaaattcttccaaagttagcttggttctcacttgggaatgaccatgggcagcttgaaggttaaaggcaagatagagttggttaggtcagattttttttcactgttatgattttctcactgttacagtttttgtaaaggtggttggttttatttacagaagcattacaaagatttctatgtacttttcaccgactttcccgtaaggtttgtatcttgcataaccgtggtacatcggtcaaaacttaagaaattaacatagctataatatcattttagactgtagatactattcagaaattcactggttgttccactatccatttactgccctgggatacaatccgagattcaacactgcatttagtctagtttattttgttattgtaaaagccttattgtgtttttgtaaattacttcttcattttggtacacttcactacaggttgtgctgatgtcacctgtaagtgtaatgaacattttctatagtttttcatctagatctaggccattaataaaatactaatgtttagatctagatttctggactaccatttgggctgatactccctaattgttgataaattatcagtcagtattaccacctaaataattttccatgattcagcttttatcatgcacagcatattcatttcatttaataacatttttttaaaatgctggcttccaaaatatcggcaacccagccaggtggtaagacagagctgggtttttagcttactgcagtgaggaacacttccacagagccttggtagtatttcagagggggagaggcaagttgtaacgtatttgagaattggaagtttggtttaaggcaggtcttttttgttttgttttgttttgagacggagtctcactctgttgcccaggctggagtgcagtggcgcgacctcggctcactgcaagctctgcctcccgggttcacgccattcttctgcctcagcctccgacgtagctgggactacaggcacccgccaccacgcctggctaatttttttgtatttttagtagagacggggtttcacagtgttagccaggacgatctcaatctcctgaccttgtgatctgcccgccttggcctcccaaagtgctgggattacaggcatgagccacctcacccagcctaaggcaggtctttcaatgtggggaattgattaggattgggtaagggtcacaatataacaatttggggttagtagataagccagataaggattttgaggcaaacattttcaaagagtcttaggactaaactgttcattgatgcttcctttcaaagagttgatgtgtcttttagaaattcttgtaaacatcatgaactcctagcaagagtttccaggaatactcaagttatactaataaaagagtgaatctaaaggcatggtaatgtaatagtaagctatgtgcgggttaggaatggtagttaacttgagatttctaaagaatatctgagggttaccatgtgaattttcacttagtgtttatgatctttaaacagttcattttcttattattttgagagatactaccatagaatgtcatcaactacatcaagctttggatgtgtaccacagtgggtttttttgatgctgtcatcctaaggaagaagctgaggcataacatagaatttaaggacaatacttgagccaaatttaaagactttacttgagccaaagtgagtacactgcctgggacatacttccaagttgcctgggggtgtgccttggttggcctttgttataagcaagtttttaaaggcaaaaaggaacagggaatgggctggtacaaagttgtttgacaggaattctcattgccttacagagataatattgatgaatgattggctattcagttttaaaatgtaaggtatgaggtacaatgtctagtatatggtattttatggctacatggtatcagtccagagccaacatagcaagtggctcgaagaggtaattgtttagctcaaacggtgagagacatgactgctgacacattttaaatgcctctcggggcctgataatttaatgagactcatattcttcaaaataaaagtttcttttcctttttaacacaaacaatattttgtttgtcaaaatatactggggaaaagtgggacaatttaatgtcctctggaaaagtatgaagaaaaattaagatatatacacatgtagtatgagtattctttatgtgtttatgaatttcatttttgtaaaatagactctcacatttcttcccagataacacagataaatacaggggtttggcatgtttgttttcctttaaccattttatatttggggatgtcttttccaaaaatacagattttatttcagtgtaaagaacataggtcatttaagaaattataaacatatttcttgaggcttggtttggttctgtgcattcagtaaatgcttgttgagtgcctattataagcaagacactgcttgaatgttactttttggtggcttttttatactctttgagaaaagaggtggtgtcaggatttgtttgttgctcaacaactgattgtagaatatattaatctcttgaattatggactttccctgcatggaataatgatataaactaattttttagtgcaaaataatttataatttgcaaaatacttgcttatacttaatatcaattttagtcttttaacaattatataggcaagggagataggtttagtttacatatgagaaaattggaatttgacagcctaaatgccctgctcagaatcatggtatttagagccaggatttaccttaaattttctaattaaaaaatgtaaaggagaaatcagatgtgtggtcctaaatgtataaaatcaatttaaaacattaagaaaatttttactgttactaccttgtgtgactttggactaatttggtctttttgaatctatgaaatgttggcagcggattagaaatttttagctgaaagcctgtcattgggtgatttcaggcgcctagatttaaaacagcacttcaagtgtttcatcgcttacttatgatcaatttcaagaaatcattagcctttatttcattttatagctgtttatactttatttggttgagaaatgtttcagaacttatttaatgagaatgacatcacattttgaaacaactctagaaatggagaggaagtaatttcattaatgaccaatttttttttttttttttttttttttttgaggcagagtctcactctgtcacccaggctggagtgcagtggcacgatcttgggtcactacaagcttcgcctcccccgctccccgtttcaagcaactctcccacctcagcctcccaagtagctgggattacaggcacgcagcacaaaagcctagctaatttttgtatttttagtagagatggggtttcaccatgttggccgggctggtcttgaactcctgacctcaagtaatccacctgtcttggcctcccaaagtgctgggattatgggcgtgagccactgtgcccagccaaccaattggtttttgatcatccctgagatacaccaagtttattatgtaagtatttacttattttcttatcctcaaaatgaggtgaaagatatttttcaggtcatgtcattgaatgtttgtttgcttaagactttctcagaactgtcaagattttaaacttttaaaatatgaaattgaaaggcacaggatgggagaaaaaagagtccagtccagagtggactcttatctatggaaatttatagctgctttttgcaaacaacgcagctaagaaagcagtgttgcttttctgcttcctggctatggttgtagttccctttatttgccggaacccatggccaactatttaagagctttctgcaaggctgatgtagccaatctgacttcatcacctgggtgacccaggtgggatcagacatcttgacagttaagttgtggctcactgctaccttccagtcccaagcaggtcatttcacaaacaatatggggctgtctgtgggtcaatgaatatttattaagcccatctggaagttcacattttatctcaatatataaaaatccagattcaggaaaccaaattagactcgtctttcaaggttgtgctttttattttttcatctacttactatgcttgtacttgaaccgtctcagagttgaggcttcgaacaattctatgggacactattcatgtagagttcaatgtagatagtgccccctggaattctgcttgtagtagtcccatttataataatgtatactgcttttaataaatatgaggttggtacaaaaaggtatacaaagtatacaagaagataaggatactagctagcgatctgggtgacttatcccctcagaggtattccttctttgtcttgataggtttacaacatatgtttgcatcctctgtcgcctttaataatgaatttcaaatgtatgattatttgagctcaaagcttgaggatggccactctggagcttagattcaagttgccctgagtatacactctgatcagcagcagttacaaggttttttttgttttttttttctcgtttagatagagtcttgctctgtcacccaagctggagtgcagtggcacaatcttggctcactgcaacctctgtctcccagattcaagcgattctcctgcctcagcctcctgagtagctggtattacaggcgctctccactacgcctgactaatttttgtattttcgtagagacggggtttcaccatgttggccaagctggtctcgaactcctgacctcaagtgatccacccacctcggcctcccaaagtgctgggattacaggcatgagccaccgtgctggcctacaagtgggtttttaaggaaaaaagaaaaggcagatcctaaattgtttaacaagaatttagattaaaataaactattgattggctacacattgttctttgcatcataaattccaggaagataaggggtgaggcagcgagtctgaaacaaaatgcctttaagtaattgctcccaggcacgggtgtgggggtgtgactgaagtcccatactctggggcctgataaattttacatacctcacatagctgggtcagctcagagctatttttcttttttcacctcaatcaatatattatttagtgtaggggagtgaaaacccttctaggtttcttggctgggctgcaaattaaattgacataagacaagagaaaaaccatttttctcttgtttaattacatatgtgcaaaacaaaacaggaaagaagggtcagatttttgaagtttatatagcaccctgagatactgaacggaacctattcagcttctaaggggtgctggccacgcaagttctgggagggtaaggggaggaaatgcatggtgaataaaggctgtcttgttatgcggatagtctctcaggtaatgaaagttgtctcagagcagctgtcttccttatacaaatactttactaatgtagatttcctttatagatatacattttttttttacaaaataactgcatttcagagctactaatgtgtctgcagtttctcagaattataatcttgaaatataccaaagaagtatattttggggtggcatattctagttctctatagtcatattttagggtaatatgtcctgagtctcaatattagttttaaagttttccctacttttttattgtaactttttaataatatcaaaatgttaaaaggttagtacaatgatcatcagcatacctaggacttaactgttattaagagattgctaaatttgctttatcttgccatatatacacagttggctctccatatctatgggtcattgctcactgcaggctcaacttcccaagctcaagtgatcctcccacctcagcctcccgagttcctgggaccacaggcatgcaccaccatgcccagctaatttttacattttttttgtagagatggggtctccctatgttgtccaggctggtctcaaactccttggctcaagcagtccttctgcctcgggctcccaaagtgctctcaaaggtgaagcacaggatatgaaaaccctcaaagcacatcatccaagaggtggccaaaatcagtctggtgatggtcagtttttaggaaaggggtgcattgtgaaactggcaagctgtcatatcaaagctgcaaagagggagagtccagtagcagcctcagatgactggctaaaggtgataaaagaaagggtactctgtttcttgttttctggagctggtttctgcttactccttaggaaagaattctggctaaaggttaataaggaaggggcatactgaggcatgtccaacctcctgtcctatcgtggctggaactcagtttccgaagtttctctggtgtccctttggccaagaaggggtttgttcagtcagctgggggggcttgggcttttatttttatttctcaattatttataatacctcatacaatgtaaattctacataaatagttgcatactgtagttgtacaatatagtatgctgtattgtttagagaataatgacaagaaaaaaatctatgtgtttagtacagatgcaaccacctttttttcccctttgaatatttttcatctgaggctggttaaattcacgaatatggaacccacaaatgtgagggggccaaccgtacttgtttctcactctaaatgaaggcaaggcagaaaagctggaggcattatttatcttagccctgaaaaagtgatgtacctgtgagaaccaatcattaataagatctcaggtaaaaaacaagtttgggatggcagtaataattcagattttgagtgaaactccttaattttctctgttcttttgtgtaattccatggagtttttttcttctagtgatctttattcttaatttggaatttaagacttacataaatgaaaccatacaaaatagtgtgatcttaatgtataatagaatgagatatcactggagaaagatcagaaggagccaaacatctaggaaagtcttaaaatgggccttaaaattaagtaagatttgaatattgtagatagcatcttaggaatggcaaaaaacagagcagcaatactgtagcctggaagacttggcccgattccatttggggatagagagatgacagtcataattctctcagcacatactcaccaagctcctggttgcaggaatggccatggtgggtgagactgctgggtgaacaggcaatcaaaacatgtcatacaaatgttggcatgcgaagagttgcacaaaatgggctgaggagctcccctagcttctgattgctgctaaaacaaatcactaaaaacttagtgtcttaaaataatataaacttaccttacagttctggagctcagaagtccaaaatgggtctccctaggctaaagtgaagatgtcccggtaggaccatgttccttctgcaggctgcaggggaaaatctgtttccttgccttttctagcttctagaggctaacagcatgccttggctggtggcctcttactccttgctcaaaaccagcatcactatacctctgcttctgtcatctcttctctgactctgatcctccagtcttccacttataaggacccttgtgattatattagactcacctgtataatccaggataagctcaccacgtcaagatcagttgattagcaaacttaatcctgcccacttccttaattctcccttgaattgtaccaacatcttcacatgttctgggattaagacgtgaatatcttggtggggggagtggggagggaaccattattttgcccttgacaggctccctgaagaagagttttctagaaattacatctaggctgataccttaaagataaataggcaccagtcaggcaaagccaggctcaaagaggaagagcgtaagttataaatagaagaataccgtagcacaatattgagaggctaagactcttcacactgtggggagcgcagaagctttagttctgcagagcctggagtggctgggtgggtgtggccaaagccctggctggagagtaagaggaggctgggtttataccctgtgatgaggaggtaggtggatgatgtaatcaggtttgccttttactcaggcattttatgttatgttgagacacatttggttttctcttatccaagcattgggatccaccacaaagtgtaactcctgattggattagtaaagtggtacactggaccaaccagtcacctccttccttcagtggggaatagaacagggctgcggagaaagatttggggacgagtctttccctttgcagttcaaattaaaaaaaaataaggaggctttatcaattatcattaattagtgtaggataggaccacagagctgatgaatgaggtaaccagatttctgtctataaaatacagtgttgtgggagcagtggctcacacctgtaatcccagcactttgggaggccaaggtgggaggattgcttgagtccaggagtttgagaccagcctgggcaacatagggagaccctgtccctacaaaaaataacaaaaaattagccaggtgtggtggccccacctgtagtcccagctgcttgagtggctgaggtgggaggatcgcttgagcctgggacggtgaggctgtagtgagtcatgatagtgcactgcactccaacctgggtgaccctgcctcaaaagaaacaaaacagtgttactaagtcccttgactattctctatcattgtagaggccttgagcttcctcactcttcgttcaccaaactgctgactcactaggaattaaatcagtttagtccttctccccagcacagatagaaagcagttccttctcttcacttccactcctgggagaaagagaaggaatccatgcctgtatgaaaaccatgaagaaggccgggtgcggtggctcatgcctgtaatcccagcactttgggaggccgaggtgggcagatcacgaggtcaggagatcgagaccatcctggctaaaacagtgaaaccccgtctctactaaaaatacaaaaaattagccgggcgtggtggcgggcgcctgtagtcccagctactcgggaggctgaggggagagaatggcgtgaacccgggaggcagagattgcagtgagccgagatcgtgccactgcactccagcctgggtgacagagcgagactccatctccaaaaaaaaaaaaaaagaaaaagaaaaagaaaaccatgaagaaacagacagaaaatgttgaaatcaggagcacagcctcatgttctttcaagtaaaactgtttagtttcaagatttttaaaaggctgcctcctttcaggtgtggagctctatgtctctgtgggtttcctttggcttaattgcaaatcttaatgctgaactgagctacagggatcagtgtccacatcaagggattcttgacggaagagctgaccctggttttctaactcactttttttctttttcttttttttttttaattttattattattatacttttagggtacatgtgcacaacgtgcaggtttgttacatatgtatactcactttttaaggggccagttgtaaaagagatgaaaagtatgagtgatttaatatattatcctttgttgcatttttaaccactgctttaccttcatttgtttagagacttccttttggagccatcatctatttttaaaattttgattcttattttaattaatttattttcaggtgggatcttgctatgttgcccagggtggtttctaacttcggggctcaagaggccctcctacctcagcttcctgaatagctggaaatagctgcttgccactgcgcccagctcttttttacttcaactgacataatagttgtatatgtttatggagtacagtgtcatattttgaaacctgtgtacagtgtgtaatgatggaatcatcctcttgatgaactatatcctttgttccctgagccccttgtccttgttcttgtcctttttgtcctcagtattgggaagcacctcagttctctttcctggactgctctttaagagtccccatgaactataaatgatactcactaaattgagtacacttaaagtgctatcttagctcaagatgttataatgaaaatactgtagcctaaacaacaggaattgatttcttataaatctggaggctggacattcaagataaacatgctggccaatttggttcctgctgggagccctttgcagacagataacttgctgtgtcctcccgtggtggagagattatttcttgtgcctctttataagggcaccaaacccatttgtgagtctccaccctaattacctaattgacttcattatcttacaaaggttacctccagataacattacattggaaaattgcacttcattgtataatttgttttttggcagggacagaaacattcattccatagcaaatataatttggcaaattttgacacacacacacatatatatatatatatatatatatatatatatatatatatatatatgcctatgaagccatcattataatcaagataatgagctagtctatcaccactaaaagtttgcccctttttgtagttcttccctcatccttagacacgtactaatctgctttctggcactatagatgagtttgcattttctggaattttatataaatggaataatataatacgtgtgtgtgtatatatatatatatgtattacatgtacattttgtctggcttcttttactcagcataattattttgagattcatccatgtatcaattgttcacttatttttatcacaagagaatattccactgtatgaaagtaacataatttgtccatttccctgttggctatttgagttgtccctagtttggagctattgcgagtaaagctaccatgaacatttgtgcacaagtctttgcttgtatctacacttcagtttatcttgggtaaatacctaggagtgaaatggctgggtcagttgttggttgtatatgtaatttttaaaaaaactgtgatactgttttccaaactggttgtactgttttacattctcaccggcagtgcgcaagcctttcagttcctccagattttctccaacatttggttgttcaattttaaaatttcacccattctgatagatgtatggtagaatcacattgtgattttgacttgcattgccttaatgactaataatgttgaacatattttcatatgtttatttaccatctgtgcattgcccctgaaatgtctgtccaaatattttgttcatttattgtttccttgtcgaattttgagagttctttatgtattccagattacaagtcctttgttagatatgtgatttgaaaatatgtttcgttctgtgacttgtcttctcattctcttagtatcttttgagaaaagaaaattctaattttgatgaagttatatttatcatttttttggaggataataattttgttatcatactaagaaatttttgcctaaccaaggtcccagagagtttatgtaagatttatagctttatataaatgtctgatctgttttgatttaatttttatctgtggtgtgaggtatggatcaaggttttttgttaaaattgtgccagtaccatgtatagaattacctttgcaactttgttgtcaatctgttgaccatatgtatgtaggtttatttatggactattcttttccattgatcattttgtctattttgtcaataccacattgtcttgattacagtagctttataagaactcttgaaaacaggtaatataagtccttcaactttattctctttccaaacttgtttggctcttctatgttctttgcattttcatagacattttagaaaaatttcttcaaaaaagccttctgggatgtttacagaagaaggtgatgctcagcaaggcttgcagcagtgaatgagaatggaaatggagggaggctgggcacggtggctcacacctgtaatcccagcactttgggaggccaaggcaggtggattgcttgagcccaggagttcaagaccagcctgggaaacatggtgatacaccatttctatgaaaaatgccaaaaaaaattagccaggtgcggtggtgcatgcctgtagtcccggctactcaggaggctgaggtgggaggatggcttgagcccaggagtctgaggttgccatgagccaagatcacgccactgcactccagcctaggtgacagagtaagaccctgtctcaaaaaaaaaaaaaaagagcaaaagaaaaagacatggagggaaagacaaatgacagacttggtgccgactgaatgttttggttaaaggaggcagatgtcaagtgttaaggtggtgcctaagtttctgacctgagtaattggttaactggattggcagtagtatcttctccaaagaaggaattacagaaggaggcagcattttgatgtggaagagagagaagtccattgcttctgttgaatttcaaatgatgccagtggaaaaccacctggagatggcatgttggaagctggagacataagtttacggggaatcatccgtgtatggggtccatgagatcacgtggtggtgggagaacacaggcccaagatagaaagttgaggatcattatctttaaattatgacctggagaagaagcagctacgaatttttaggttcttgtaaacattttaaatgccttcattcaggtacggtggctcacccctgtaatcccagcactttgggaggtcagggcgggcggatcacctgaggtcaggagttcgagactagcctggccaacatggtgaaaccccatctttactaaaaatacaaaaattagccgggcctggtggggcatacctgtaatcccagcaacacgggaggctgaggcaggagaatcgctggaacctgggaggcagaggctgcagtgagctgagattacaccactgcactccagcctgggtggccgagtgagactccatctcaaataaataaatacatacatgcatacatacatacatacatacatacgtacgtacatacataccttcattcaacatgcacagtgccgcatggctctatttgatcattaaaagtattatagtacttccttcttttccctgatctccattcacactcttattttccttttcaagtctagcatctttgcaacagagtctatacattaaatacagtaaaacaagggcccctgctactcattctcatagttgagtaacgttgctccaaaatgccactatttagaaattgtcttgtattctttaattactgaatgaaagactcctggtgcaatttaagtttttattttgtgtttctctaaagggtataaaatagaaatcagaagcttaaataatataaataaaagcaggacagccttgttgagggtgaggaggggagggttgcagcgcatcaccattactgcaaagtggactttgaagtggcttgcagagaactttaatattttgaggagcacaatttgaatgctagtctaatggttttagtattttataaataaggaaaccaaggcctgagtttccttcagattaagtgatttgctgtttgtctcactgctagttagagtagaggtggaattagagctagtaactcctgattcctagtctcatgctctttttgtaggatggtgatactgccctagagaaccacttccattagtcaccaaccccactacccctcacaccactcctgtcaatactctgggttattaaaggtgaaaagaaaatggcagggaaaagaaaaaaaaaactgatgtgtttcccttgttctagatgtccaagctctgtggcttaccagactgacggcaggtgccctgccattttctgaagggatgttctatctggttgtttattagttaccatctctctctatttaagcagcttcagggccaactgactctcggtgtcacagtgggaatttgacatttctatttctcatttgtaatttagggtacgttgacacatttaatttcgtaattgtgtacttaaaaagtgagtaaactaaagtttattagtgctttatgaaaactgaaaatactcccgaagactaacattatatttggtgagcctcctaatgaggaattagaagacttgattcaatcataatattatcttactgcttatttgaatttactaagtccttggcattatactaaatgcttcattttagggatgaagaaacagttcgaaggggtgatgacatttgccaatgttttggagctaataagggctgagtttggattgagaatcctcaacattctgaattgttgggtgcttttattcctaggattatttcaggcttgatatcctgctcaatgctctatttgtatttgcctccagggaatattctctttcctctatcccagttcaacaccctcactccagtttcctcctctgtaagccattctcccaaggtttctgtgtgttcaccactcataactgaaggttgccagggtaggatggaaagggtagggcctgaggcgggagaggttgtagaagaggaaagaacatggcagtggagacttacagcagaatgaacaactttaaaactgagcattagatgacatttctgttttgaaaattgcattgatcaccctatccctggaaattctgcagtgaccacctttgttgaaaggcctagagctccctgccatctccaacatactcacgcagctcctgtacatgcactcagaagtcggtttgtgttttaaataacttctttaaaaatctcatcaccaaatgctgttgatcatagtttacctaccagtaaaatagagatgaggtccatttgacctgcttcaattgggattctctcttgaggatctaataaaaatgatggaagttgaaatgtttacaaatatatatgaaatgctacgctcgtgtaagatattactcttactgttgatgctttaattgaaatcaaatttaaaaagggactcaacagctgatcagaatctacatggaactaacaccgtgatctcccagttaagtggcaaaacatctgattttaggggtatatttctgatttagaaaatatgggagcttcttttgtgtcttttgtttaaagttatcctttgtattattagtagtagattttagcgaagatagtcaaactttcctaacaaagaagtatagcagtgctaagattttcaagataaatagtagtttctttgtttcagattatgtcactgagatttgacacactgagcaataaatgaatgtattggccagcctgtgcttttttaaacgtgattttgcaaagtaatttgtctttttaattttaggaaacagatattgatgacagatatggagatttggattccagaacagattctgatattccggaaattccaccatcctcagatagaacccctgagattctcaaaaaagctctatctggtttatcttcaaggtatgattggatgaagatgagtatatcttagtgcacaagataggctttgaggttatccttgtccatgtaataaatttggctttttgtaagttttccagccatggtattaggtggtcaaaaaggccacctaatatccgaggtatagttctatgtatttaatgtgtatccacccttaaaaccttgtgaagtataagaaaaccaaggctgagaggttaattgttgaaggctacagagctagtaagatatagacctgggattcttgccttgggctgtcagattctgaagcctgtgatctatttaccacgtcacattgctttttctggtattagaacacctaataaaactccatagtctctgttccctatttttcaaatgccagacagaaataggtatttttttcttttttcttttctttctttcattttttaaataagatggggttttaccacattgcccaggttggtcttaaactcctgggctcaagcagtctgcccactttgacctcccaaagtgctgggattacaggcgtgaaacatggcaccaggccagtattttcttttcttttaactgagtttaagattattgtctaaaactccacaatccattaccattttatatttgtgcaacatttaaaaatgtgtgatgaccacaaaatttcagctaattatattacccttcattgtatactttagtaatatgaattataaaatttataaaagcaaagtaaacctaagcttttgtccagattaatgtatgaaatgttacatattggtgtagaaagaacaatgtttccccaactttttgacactatgacacagtaagaaatacattgtataccacattccaagacacacaaatgtatattttaactgctgcaaaaatgttatgaaacaattcttcccattactgtgtaataccctctgatttcttttgtatttgatgctgttctatgttattgaacaaaaaatgctacatgtaacttattcaatggattttactacccttgggtcatagcctgcgatctgaaaaccactagtttagtcgtatctagtaaatgtaatatgaatttttctttttttttttactttgtaagggataaccatattagaatatattggttaaaagcaacattttcatattttttaaccaatagaacatatctttgatctgctatgaaaagcatgattattttaatagttcttgttcccagttgttttcatgacctaattcccagatataactttgcattaaaatctcatcaagtctatctcagacctgaaattttgtgtagtcgatgttctgtaagaatgatgccagatttgtgtgtgtcattcataataagatcttccttaatcatgaagttgtttttttctgatataaagtaacaatagcaaatactagcagctaatatttatttagcatttactatgtactagtattgtttcaggcactttatatgtattgactaatattctcatggcagccttgtaacacaggtatataaatgtggaaacgtaggcagatattatatatcaagggtcatgtagctagtaagttatggacccacattctgaacctaggtactgtggcttcaatgcctgtattcttatctatgctatttatgagtgaattggttttagaaaatgaacaatagataatatagtggtttcaatcttctcgagaaacttttctacaaagattacatgaatgttttacatgtaatctgttttatacatttttatcctgtttttagtctaatattgaaaacagactgtcttgcaaagacttagaatttgtagatacataggattaaaaatagtaattacataagaaatgtacattacttgcagaaaaaaaaatcctgtaatcctcctaccaagacattaatatttagaatacttcagtgtttaccctttgaggcttttttcttgtgcagtgtgtgtgtgtgtgtgtgtgtgtgtatgtgtgtgtatgtatggatgtgtgtaaagcaaaaatgagattgtactgttttctaccttactgttttaattttcattccatggtattattaggaacaacatttcatgcaggatcctaaatatatttcagaaacatttttaatgtctgtatattttgctgcatggctatggtctagtttatccaactgaccacctattgctgggcatttagtatattactaaatgttcacaattaaaaatacctctacattaaacatttttctttgtagtaactttattttaacatccattaattatttccttaggataaagtcctaaaagggaaatcccttggtcaagttttatgcccttcccttactttttttttaaaacagggtttcactctgttgcctagactggagtgcagtggtgcagtctcaactcaccacaacctctacctctcaggctcaagcaatcctcccacctcagccacccaggtaactgggactacaggcatgagccaacatgcctggctaatttttgtattttttatagagacaggattttgccttggcttgtggtcctttatttacctctgactagatttgcgacctagcccagttttctaatccatccattaatccacaaacagttatatctgtacaactacatggggccttttagccatagcatttttgactctacactcatttttagttctgcctcatgctcatgctctcatgagaagtttatgtctacatagtttgttaaacaatagagggaaataaagttgaatgaatgcaatttgactaccttatgaagaaactcataagctggaaaaaaatgtatgttgttggtatgttggtattttagatcctgtgtgtagaaatgacatgataaaaggaatatttgaaaagagtatttgttggaagtatttaaactatattggagagtggttgaaagcaaggaatgtaatcttttttttttttaagagacagtatcttgctctgccacccaggctggagtgcagtggcacaatcatggctcactgcagccttgacctcctgggctcaagtgttcctcccacctcagcccccaacatgccccgcctcctctccccccactccccccgcccctcagtatcggggaccacaggtgagtaccaccacgcgcagctaagttttgcatgttttgtagagctgggtttttaccgtgttgcccaggctggtctcaaactcctgggctgaagcaattctataccttatgaaggcagctaatatttctgttctaagaagggaatgagggctggacatggtggctcacacctgaaatcccagcactttgggaggccaaggcaggaggatcacttgagcccaggagttagagaccagcctgggcaagatagtaagaccctgtctctatttttttttaaaaaaaaggagtgaggacttgtgcttagaatacactgcatatatgttactagactttaagttgaatcaaaatctcttgtaacataatttaaatgctaccagttgaattaataaaaatcagaaaagtcctaaagaaaaacagcgacaattctaaatatagaagtcatcatttgtatataggagcattcagaaattctggatttttcatacagagctgccaacagtttatatgacatggtaacacaaggagtgattatttgtatggcacaatggggatgaagtgtgaggcttgtggcggtggtggggtgcggtcgggcatgccaggcccttacagcgagggttgagggagaccagttctcagcatggcaaggaccagctggtgtaccagcaggaaagctctgctctgaggagcaaagaaaggcccaaggataaagaaatactttgttttttggagacggagtctcgctcagtcgcccaggctggagtgcagtggcgcgatcttggctcactgaaagctccgcctcccgggttcacgccattctcctgcctcagcctcccaagtagctgggactacaggcgcccaccactatgcccggctaattgttttgtatttttagtagagacggggtttcaccgtgttagccaggatggtctcgatctcctgacctcgtgatctgcccacctcggcctcccaaagtgctgagattacaggcgtgagccaccacgcccggccaaggaaatacttttactaaaggctttgtccctaatcaaagaaagcagtcaatacactttgaacaacagaagtgtccttccatctgtctttatcctcagtggctgacctcttaggtaactggcacctcactccttcatttcactgaaatcactgttctttccagttttagttcggtattatctttcattacttattctcattggcagtccatgctgtctatatcatattcttaaaatcatgactgtattcatctgccatcctaattgggcatcatctcttttgagggcttttgtacctggctcgttcttcccctccatgtggtccctggtgggatgcctgactttcacatccaccctgaccacctaacgtcctaacctcacggtttattccccactcacatttaacaaaaattattttctttctggccgggcgtggtggctcacacctgtaatcccagcactttgggaggccgaggcaagcagatcattaggtcaggagatcgagaccatcttggctaacacagtgaaaccccgtctctactaaaaatacaaaacaattagccgggtgtggtggcgggcacctgtggtcccagctactcgggaggctgaggcaggagaatggcgtgaacccaggaggtggagctttcagtgagccgagatcacgccactgcactccagcctgggtgcgacagagcgagactccgtctcaaaaaaaaaaaaaaaaaaaaagaaaagaaaaattattttctttcttggctaacataactttaaaagttaatttatctcccagtgtgtgaatgaatgctgtttgttttttgtttttgttgtttgttatataaagtgaagtagtagaatcttatagttaaggaaaattcataaatctggcaaatcaatactgaaaccacacaaaaaaccttaagaacacgttaaatactaactttacattttctttgtaggtggaaaaactggtggatacgtggaattctcactctaactatgatctcgttgtttttcctgatcatctatatgggatccttcatgctgatgcttcttgtaagtttttgacttttccctgagtgtctcttgctttgtttttcaacatttatataggattgaagtaatttgagcatatcataaaaaagaagctaattcaacactcagtcacagaatatttagttcctttaagtgtcttttatttcatgatatgatctaacttaatcttttctgtttgcaaaatgactattcagtgtgttcattcagcagagaccaagtttgtataacaggtacatatctatgtgtctgacattgtgccaagcatattttatcaaagatatgacatgagcctgggcaaaaaaacacaagcctgagacctcgtctctacagaaagttttaaaaaataagcttggagtagtggttcacgcctatagtcccagctactggggaggctgaggtgggggatcacttgagcctgggaggttgatgctgctgtgagctgtggttgtgctactgcactgcagcctgggcaacacagaccatctcaaaaaaaaaaaatgacagaaatacacacacatataacatcaacatatgactattagctagatccctgatttcaaggaactcagtgtaataggaaaaacatacaagtaaccatatgaataaatagcatgataaataagcgagataagttctatgatagaacatgttaggagtgcatggtagaaaagcacctaatccagtctgagggagggatgaggaggggcttccagaagagacagtgccgaagccgagtcctgaatactggacagaggaaggaattccaaagtggagacatcatgagcggggcatggaggtagtgagaggatgcggtccattggaagatctgcaagttgcacatgtagagggtgtctatatagggcactggagaggcaaggaaaaaccattctgggagttttggattttggtgtgtgtgggaagctcagtaagtcaggaagccaaacaagtatttaaacccttcattcattcgtgtaacaaacggttccaagatgcctgctatatgccaggcattacgttagttctagggatgatacagtggtactgagaaaaatgtacctgtctctgccctcatggagcatactatctgcactttaaagagctgattatgtatttacagtgagatgccacctgatgacattttggtcagtgatagacaactatacgacagaggtcctataagattataatggagccaaaaaattcctgttgcctcatgattttattccagttgccaacggtattcagtaaagtaacatgttgtacaaatttatagcctaggaccaataggctataccatatagactagatgtataagaggccataccatctaggttttgtaagtatactctatgatgttggcacaacaacgaaattgcctaacgatgcatttctcagaacatacccccttgttaagcaacacatgactatatataattacaaactacaataagcatttgagaaaaagaataatactaagagagcaaagacggagctgggagactttccagaggcacagtgccaagcacgtgggctgcaatctgaaggttgagtgggaatcaacaaggtaaaggatggagtcttggggaggaccatcacaggcagaggatttctgtgggcaaaagcccagatatttaaagcatgaaacatttgaagcccacaagtgttggaaccgaggagaaatgcatttgttcaatgcattcatcaagcacttaggcagtgctgagcatggtttgacagcacacagtgagagcctgccctccggggtgccctgtggccttctttattggtattatcattgttattactttttctcattccttttcagttaatccaggttcttcttatgtactcatctccttcatctctgatttctcttgcccacttagaaatgtgtttatccattttgccaatctccctccatattcaattctattcatagctcataagcttatgagctatatgatatggttttccttttattttataaaagaataagttttgatgtgaaattagacatgatgaaaaaaaattccatcagctcttgaagccacttaaagtggcttttataagcacctcaaagcctctttcacttctctttttgtcctctcattaatttttcacttccttggggaaatcaagtaatgaaaatgaataagaagttaatttctttttctgctaatttgctaagatcttaaagtgctttttctcacaaaggaaaaatggataataaataggacagacttaatgtgagagcagaggaagcggagcttgaaagccaagtgggcaggcgtgggaaattgtctgcatttgattccaggaagaggcccccagctcccagtcttctgtcgctgaatgtgccaagggctaaaatgatcaccattggccctgggacttgggcatttaagaagcaagtgtgtgcagagcacttttcaatgctaggtggtgagtgggcaggcttgaggaagaagggaccaagtgagagcaaggagttccacaagtctttgtgggtgaagggacctttgagtatgattttgggcagtgtatcagggtggaggcagcactgtgagcaaaggtccaagtggctagaagtgtgccacttggacctttgctcacggtgcttcctcggtggcagaaaaaggtgctttttccttgagcacagggctgaaaaataattagagatcagattctggagggccttgctatgtggagaagtttgggttttatttgggaagcagtaaggagaagtattttgggagaatttatttggaattaagaattaagaagaatttatttgggaaaggtaaggagtaagaagaaaatgttgatctaagatatcagaaaccaccagtatcctagatacagtgacttcggcaggtttggtgggttcccctgtgatttacatttttctccaaactgaactgttgagtataataactagggcaagaatttgtggataaaaactattttctaaccactctttaagacaaaattcaagacagttttaaagacatgcatgcatacatttggattctgattttttaagagaaccataagtgtgcctacggtacttgagtttttttgtttatttttttctactatgaaaggaaaatatgatcttattactagttatttgcttcaattggtgagtttaattaaagaagaaaataagagtattaaagatctggccaggtgcggtggctgacgcctgtaatctcagcaccttgggaggccgaggcaggtagatcatttgaggtcagtttgagaccagcctggccaaaatggtgaaacctcgtctcttttaaaaatacaaaaattagccgggtggtagaggcgtgtgcctgtaatctgagctacttgggaggctgaggcaggagaatcgcttgatcctgggaggtggaggttgcagtgagctgagatcacaccacggcactccagtctgggtgacagagtgagatcctgtctcaaaaaaaaaaaaaaaaaaagaatattaaagatctaagtaaagtaggtttgaactgttattggttatttaagtttattacatacacatacatgcatagatatatatatatatattatgtttttatgatatttgtgttaagagaatatggatgattcacacatatagttggtactcaattgatattactttatgtgttttaaaaccttgtttctattcctattcttaactagatcatttatattttgagaaggacatgttgtatctagcttgcagttgccttataatgtcagcactcaaaaatgactaattcaatatagttttattaaaaacttctaggaggtcgggcacagtggctcacgcctgtaatctcagcactttgggagggtaaggcgggcagattgcttgaggtcagaagttcaagaccagcctggccaacatggtgaaaccctgtctctactcaaaatacaaaaaattagctggatgtggtggcgcacacctgtagtcctagctactcaggtggctgaggcaagagaatcacttgaacccaagaggcagaggtttcagtgagccgagatcgcgccactgcactccagcctgggcgacagagtgagactttgtctcaaaaaacaaacaaacaaaacttctaggaaattacaggtactattttaatatggaatgcatacccatgttccttaaaaggccttctatttgtagtttttaaattgtattcacagcttagaatcatactttctaagtgatggagttactaaagcatgttttgatttaaaggcagatgtgaacatatagaagatattgaaagaggttttttccccccctgccttcttggaaactgttgtcattaacttttaattcgtgctatgtagtttacttttaaatagtgtgtttactttttcctattatgagagttgtatacgtgtgatcaaattactttggaaaatagataattaaaaataatcattccaaccctattgttaaccaccaaaatgcagttagtagtgttacattttatttcatcactttttgcttaatttatatgtttttaaaactgtggtcataataataatgtgactaacattgtgcatcctgctttttaagctaaatatcacatcaaaaattttgtggccaggtgcggtggcacacacctgtagtctcagctattcgagaggctgaggcaggaggatcacttgagccctgaaattccagtctgagtccagcctggataatatggcacaaccctatctctaaaaaaaccaaacttttaaaaaaaagttttgtgttgttctgtggtctttataatcattagctttactagattgtctgcttgatggaatgtagttcatcatggagttattcacttacagtgaatgaatatctgaattcattcagtgcatcatttaaagttattcaaatcattgtgttatttgtagacattcaggttatgttcttttttttattgtgaataacactatcatgaacatattagaacataaatatgctctaactttatatgtgggagtattttcttagaaaaaatttgcaaagtgaaaatagacacttatttgaataacccataggtactcaatatagttcatactcaaaatgaccagatctgaacttctagtccatacctcggccatccagagtaaatctgttgtcaaagttaaataacaatacacagacaaatctctatgcaaagcattttatttgggaatgtatatatattttttaaaaaaacaaaattgcacttcagagcatatacccagaccagggtggtctttgatatgtctaaagaataaagagaaggttgggagttttattaaagagagaaatgctacatattgttttgaaagaaagcccattagcactagtgcacttttggggagttggcaggctctgactggtgagtgacagtggtggcaggtaaaattagtcttagagtcatggcacattgttgtttcagcagccaccaagtaaaactggtctgacggtatggccagctgtttcagaagctgggctttggataattcgtggagcaggtgctgtgtgccctgagtgctttttccgcttggcccctcaactctgatcttagttgaatatgacagttgacccaatttgtataattctttcatattgtctactttcccaagccttccttggtgttattttgtgttcccttttctcccttagcccctcaatttcctcacgcaccatgtctagtcagttctaccccctatacttctctcctgtcttcttctctactccgctaccacttcacctggatagtgaagtggcatcttgcctcctgactgccttgactcttgtcaccgccccagcccactgtttccaccttattctcccaaactctcatgtccagtcatgttgcttcaactcctcggtgcactgcttcctgctgtttcctaggattccaggaccaggctcatctctctctccttcttacccccacctttgtcttccagcaactccaccctcctagtagttcccttaatacgccccattccctctacaggtggtgactctgcagatcctcctcctctggctctgccgttgcccaccccctccccctgccacaggtgtgtctgcctctacacacgtccatttgcctatttcacatgggttgtagtcgtgtttcctccctgagagactgtacctctctgtgaacagatgccctatgttatttctataagtcctcagtaactagtaaagagtagacacttaaatactgacttgtttttaaggttcttgaaacattaattgggccaacagagtcctatgagtgtacattgctaccagtgttgatggtgtggagtattaatttctgtgtaatcctccagtcctggaagatacacatatagttgaaggatttcaacactactatttggaaccttttgttttctgttttcctagaagttccatattaattgtccttgcaagctatagttgatgatcatataaatataatgcgtgttattaaaaatacttttgttctctcctctcagtaaaagaaatacaatttatagtgccagtggatgtaccctagcaaatatgttcatagaaattacatcagtatgatattttaaaagccctttggatctgactaactttgctttaccgttttatcttaatactaaacattgtctccgttctgtatttttgttagaaatgacttgatattatatacaaaggttatttgaagaaggacacttagatttcctcctgtctttataacacatttatgacttttgcctacaagtactgtttatggtttgacgtacttttctttatcatgtggctggaaagacacatttactttttaaagtatgtgattggacacgtaatcagtataatgggaaaaaataacttaaaaataccctgaatggtaggttttggaaaactaacttgtggaaatcttaaaaagaaatcccggaatatatcctctgacagagtttggtaagctttttctgttaaaggaccagatagtaatattttaggctttaaggagctgcatatgtttcagtcacataatattttatttttaaataactctttaaaaaatataaaaatccattcttagctcaaggacagtataaaaacaagcccttggggtgtgttctctagacgctgaaaagctagtctgctgtattcacaaagatttttacctcttaattcatgataataagtgttcaacttgccatttgctctttgagtcttggaatcgacaggtcaagcaccgggtgtgatgctacatcttgagaaattaccttcacccaggttgctgaatgcagcagtttgaaggactacaaaatagaacatcaaaaagggatttataaatctaaacccgtttaataggtgtgcaatcaggacactgtgtaaacagaaatgcataaactcagttgactggccaaagtggctgcaaatgtggaaggttgcttatactttgctaaggtagcccagcttagattgagcagccagtagctggctatgggagagttgacacaactgggaggatgaaaaggccattccagggtgactggctagaaagtgttctaactatttgtcctgacagtatctttattatttgcaggtataacaatgcatggttacaaataaatatgtgcaagcaaactttcatatatgattttcttagggtatctcaagaaacataatggacaggttggacaaaaagattctccatcttgacaaggacaatctcaagaatgaagtagtaatgagggataaatcctagtcaactgcggccaaccagactatatccctcaaactttaaactccattgccattccccaccccaggaaggatcttccaagcctttttgagtaaaacattattttgcctacccctttgagttatcacttgattttagagacatggaatattgcattttttactgacatttagcataattaaacattggtagattaagattttttaaatacatatgacaaactgctttattgaatgattaagcacaaatgtaaacattgagaaatgtatgttaatgttttctcttggtttcaggttctgggcatccaagtgaaatgcttccatgaaattatcactataggttatagagtctatcattcttatgatctaccatggtttagaacactaagttggtaagtaagcttgaaactatttcagatatgaaaagttaatttctgaagtttgtaaaggaagcgtcttgatcagtcagtatccactcaatttaccctatagattgattctagagaaagataaataaaaataatgtaattgaattttgaaaagatcacctttgtctttcctactccaatacaacttttttcagatctcatattttagtctttgtagagatatctaatatgtgaatatatacaccattcttgtcctttttttaataaaaaactaaacattgtattggaaacatttttgtatcctttacaataataattttagcaaaatatttacatataatcttttccttcattttccttcatttcctctcagttgacatgataacatacaacatattgtatatatacaaatgcacataaagttagtaacaaaatcaccataatgatattaacatttaaaattttatatcttttaaaacttttcatatataaatcattgctctcagaaccttgactaggaaacatgataacattatagttcatatttaacccaagtggccatcctttttaatatagttgataaatatcaaccagggagtcagtgtctttttaaaacagatggggtttagaatagtcaaaaagaagtgtcttgatttcggtgatagctgatttttccttctagcaggtttcttcacgagtggcaaagtatacaggaaatgttagatagataaagtaattggagaataattaaatgtaaaaccatgcagtattgattctaagtattattaagaagagaagataaataaggatgggctccagtgattgtagaaggtgtcaaacaagaggtaaaagataaactggtatttgaaatgaagacaagttttggataaagaagagttttctagttggggatgtagcacccatcagtttctagatgtgggacagatgtacttatactaccgttgatgagacattcctggcccttctgagcagatggtattgattagcggacagtgggtaaatagttggattggtagaccaggttaggccttgattgccttacagaggaagcatccctgctcatctggagtccactaggagcattagaagaggggagataccagtgtgtgcagggcagtggggagacaggttgaattacctcttctttctttccctcctaatcttcctgaggacaggtggggatttgtcttaggacttctactattaaaaagcattagagctgtgagtagttacgagttaattttcattatgaacttaatccctcaatatatacacccacacattatacatacatacaaagtattaaaatcatacacacacacaaacatacacacattatacatacacacaaagtattaaatttatacacacacacacacacacacacacacacacacacacacacactgctcccgcctcccaagggtgagggattgtgtgtgtgtagtattttctacattgtttcctaattatctctggcattagattttcagctaaataaaggtatgaactatgtttggtaaatttttgctaatcaataaatttgaaattaagtttaaaacaggaaaatagcattttggtaaaatatatcttgaattggtcttctgaactttgttttgatctttgtgtcatcagaatgtagaaaataattttgttgagtttgaggggaaggaaagcttcaaatatagaaaagctaattgtttttaaattataggtactttctattgtgtgtaaactactttttctatggagagactgtagctgattattttgctacatttgttcaaagagaagaacaacttcagttcctcattcgctaccatagatttatatcatttgccctctatctggcaggtaagttaaggaatattctgtattgatatatagttaacatattttccatgtttatttttatttctgttattttaattagtaattttttggttaaattttattccagcctctctttttcattgtttcttgtgtataaagctatttctttcatcatgttcttaaatagcaattactcccttatagtgggtttaaaaagtgcttgttaagaatcactccaggccgggtgcggtggctcactcctgtaatcccagcactttggaaggctgaggcaggtggaacatctgaagtcgggagtttgagaccagcctgaccaacatgaagaaagtccgtctctactaaaaatacagaattagacgggcatagtggcacatgcctataatttcagctactcaggaggctgaggcaggagaatcgcttgaacctgggaggcagaggttgccgtgagctgagatcacgccattgcactccagcctgggcaaaactcttatctaaaaaaaaaaaaaaaaaagaaagaatcactccatatgtttgaaaattttctttgcaaattgtagtaaaaaaacttttaagtaaataaaaattattaaccaaatttaatttatgaaaaaactttcacatatatattgctttatttgtccctaggaaatagagctttttcatgtagaactaatcagggtaattagttgtttttttttttttttttttttgagatggagtctcactctgtcgcccagggtggagtgcagtggtgtgatctcagctcactgcaagttccacctcccaggtccacgccatactcctgcctcagcctcccgagtagctgggactacaggcccccgccaccacacccgactaattttttgtatttttagtagagacggggtttcaccgtgttagccaggatggtctcaatctcctgacctcgtgattcgcctgcctcagcctcccaaagtgctgggattacaggcatgagccaccgcgcctggcctaattagttttttagacatagtttataatatatgcaactgtttatagtatgctatgccacatgtttttgtaatttttaaattaaaaattagattcttaagataaagttagaatttacagatatcttttctatgaaattttacagatcataaaaacccctaagcaattgatttttttaaatgtgctttttaaaagccagattgctcatttgaattctggacctaccaattactggttgagtaaacagtgagatatttgggctgggcgtggtggctcatgcctgtaatcccagcactttgggaggccaaggtgcacggatcacctgagtttgggagttcgagaccagcctgaccaacatggagaaaccccgtctctactaaaaatacagaattagccgggcatggtggtgcatgcttgtaatcccagctacttaggaggttgaggcgggagaatcgcttgaacccgggaggcggaggttgcggtgagccgagatcacaccattgcactccagcctgggcaacaagagggaacctccatctcaaaaagcaaacaaacaaacaaaaatgagatatttaattaatttctctgtgcttcagtttctttgtaaagcacttagaatagtacctggcactacttaaattttttttattgttattttcactttaaaagaaggacatgaagtttgtttgtgagttttcaccttagctgttactagttattgttttagctcctaggagtttcccaataaatgaatttttctcctggtacaatcttagaaactgggtaattcttttccatttctctttaaaaatatacagagtatgtggggaagcatgtccagtcctgtagaagtatgctatttcattaaatagttatgatgttcttcttggtgcccctcagctccttcagttcctaggccttctaattctaaaaagccagaaagtgaaatacaatctgaaatggtaatgggaattttcagagaacttgtttttatgtaatgaggaggaatacattttcgaataattttccaccttttacattcaggttttttgttactttttaaaattttaaatttcattttattttcccagagattaggtctccccatgtggcccaggctggtctcgaactcctgggctcaagggatccttccgccttggcctcccaaagtgctgggattacaggcacaagccactgcacccagcctttcattcaggtttattgttcagttcagctttccaaatttgttccttcatttaaaaaaacttttcactgctatatctatagaaagtacattcctagaaataggtattgaaaaatttctactcttttactggtactcatatgatggtagttggtccattttaaattctgaccagttggaaggattatgatcatggagagattatgattgttatcagctaagaagaccatactaaaattttggagagtaaaacacttgactctgattctgtgtttatcaaagcacatttgtgcattttcttggtattctttgtagaaactttgagtattttctctcatttaccaaaccagtaagcttgatttattttgttaaaggtaaggtagattctggaatggattctttttttattatgggagagaagaatgtagtaccttctcagtttatatttaaggtaacaagacttctggcattttgagttttgatgataataccaacagtcaaagagtctatggtatcttctgttattgaacccaacacttttgtttcatgtgattattcttgtaattatttaaaacaactgcgggccaggtgcggtggctcacacctgtaatcccagcactttgggaggctgaggcaggtggatcccttgaggtcaggagtttgagaccagcctggccaacatggcgaaacccgatctctactaaaaatacaaaaaaaaattagccgggtgcggtggcaggtgcctgtaatcccagctatctgggaggctgaggcaagagaatcgctgtaacctgggaggcagaagctgcagtgagctgaaatcatgccgctgcactccagcctgggcgacagagcgagactccatctcaaaataataataataataataaaagaacaattgtggttaattaaaacataaatcatttctatcattaatatctgcacattagttttcaaactgaatttcaaaagaattatgatgtaaacagcaaccctgcaccccaccgctttgagagtttttccttttctgtaagtaataggcctgtttcttagtttactttaggcattatctattcacttcctgttataacctactttacttcttcatattcagtttttttatagtaatagttagcattaagtaggtacctaaaatatcacttcctgtagagccaaatagtatctatgattacatttccttcttttacaactttttgtttttcccgaacttgaggaactgcctcaccttctctttcccatatttgctaatttcagtgtagaaatccttaatttttcctttaggtttgacccatgtctgttggtagtattttcagatgtttacacaagtcagatagtatatcaattgccttttttcatggagacttctgtgccagagacctctgcattcctgttcctgtgtgagctggctgcatatgggcccactgctgagctgtcctcatgatttgagccggtttcttccatcccagtcttccatctcttagttaacaccctcactttgctgaagcatggcctgctgtagtttcttatgaaatgatgtgtagaaggtagttgtcttatgtttgtgcatttctaaagatatctttagtctattcttacagctgattgctttggctagggctcacacttattgttggacttttacttaataatccaggtcagaagcctaggcctcagtcttgccttccaccgggccctttctccttagtttctgtagaaaatacgtttaggcacctgtaatttctcaggcctactaacagttttctatctgttttctagcttccaaattttgtagacatgtttcttcttttctccttcacatttcttcagttttctctgttcttgtggggcttccccttaatttattttaatgttattttgcagggataccaggatggaatacaaactatcatttaaaaacaaaaagccttaactagttttatttttcccttggcttagaacaatttgttatttttgctcacagtcctgcggattggcgggcttaacttagccgttctaaccccaggcctctcacgtggttgccatgagacagaggcgggtgctcatgtcttgagtgggctggacatcaaagatggctccttttcatgactgcagttcgtgccgcttgctgacttgggcactgacctgtggcccctccatgtggcttggatgggacaggcagcccgggttctgaatggggagcatgccaggagccaggtgtttcaagaggcctaaactagttttttttgctgggcgcagtggctcacacctataatcccagcactttgagaggccgaggcaggcggatcacaaggtcaggaaatcgagaccatcctggctaacacggtggaaccccgtctctactaaaaatacaaaaaaaaattagctgggcgtggtggtgggcgcctatagtcccagctacttgggaggctgaggcgggagaatggcatgaacctgggtggcggaacttgcagtgagccaagatcctgccactgcactccagcctgggagacagagcaagactctgtctcaaaaaaaaaaaaacaaacaaaaaaaaaaaaactagtttttttttttaaatgaaaatatatgcccatgataaaaatttagactagaaaggagtattccatgaaatcctcctccacctcagtgccttacttacgatatctggaggcttactactgttattccagaaattgtctgagtattcaagcttttatgtttatatcccccctccctttttcttatgcaagtaagagtatctcttctgtaccatttttccacttcatatattaatagcttatagatggatttatattggcacatctacatctatcattgtatccatatctgcagttacatctatattgatatacagcaatagctgagaggtagaatgtcagcatataaggtgattactgttttcccctttggttttgctataatttatgcttgagaataacatctcaattgagtgtggaccgatagtgtagttcattttctttgttgtttctttttatatattttgtctttcatagcctcctaaccagcccctttttagtaattctttgttccatatatgactttttggactctacttctataaaatacaatcaatgttgtgtcttttttttttgaaacacagtctcactccattgcccaggctggagtgcagtggcgcgatctcggctcatggcaacctctgcctcctgggttcaggtgattctcatgcctcagcctcccaagtagctgggactacaggcatgcgctactgtgcctggctaatttttgtatttttagtagagatggagtttcactatgttgctcaggctggtgtctaactcctgagatcaagtgatcctcctgccttgatctccaaaagtgctgggattatgggcatgagccaccatgtctggcctggtatttcttcatttttctaaccgtatacttatttctgccatagacatgttttaccatttcttattttacactcttagaatcacagaaacttactgaaagtcatcaaagtcattcttagagcaaacatttcagtgttttccaaaagctagatactgtgaatgatgttgaggatataaagggagatgaagtgattgtgtgctttccagggtcttgaaattggtaagatgtgagtcttctagttcattgctgaaatgtgaacaagtcctgtcaggagcatgaagaagaggaaggaaggccatggaaggcctttgagaagagatgacaggtttcatgaaaaggaaagagcaagcaggcagttgccaggtatcgtatagtagaaaagtccattccaggcggaggaacagctgtgcaggcatgagaatgagaaaggattgcatgttttgggttcatggaggcattgaagatagggaaggtaggtaggagccacatcttaagaaaatctgtatgtcatgggaaaggtttggactttatatctgggaaaacattggaggattttaagctaagaaatgatataaccagatttgtaattaaatgaagtaggttgggagacatgatcaggcagactagataggaagttactactgtaatccacactaaatgtagtaatgacctaaactcttctggtttgtagttaatactaaatgagtaataagttagaaaataggccgggcgcggtggctcatgcctgtaatcctagcactttgggaggctgaggtgggtggatcacgtgaggtcaagagttcaagaccagcctgaccaaaatggagaaaccccatctctactaaaaatacaaaattagccgggcgtggtggtgcatgcctgtaatcccagctactcgggaggctgacgcaggggaatcccttgaacccaggaggtggaggttgcggtgagccgagatcatgccattccactccagcctgggcaacaagagcgaaactccatttcaaaaaaaacaaacaaacaaacaaaaaaaacatagaaaataaaaataccacaggctgatcgtagaacccaactgctattttatgacagtctatgaaaagttgtttatatatcacaagttattggcttaaaatgcacttctttgttgcaataattgcatattcacatgcagttgtaagaaataatagatctttttacactttgctcagttatcaccaatgatagtattttgcaaaattatagtacatcacaccaggatattgacatcattacagtcacacaaatgtactttttgtttgttattttgagacaggatctcactattttcccaggctggtcttgaattcctggactcaacttacccttctgcctcagactccttggtagctgggattacaggcgtgtattaccacgcccagctctacagatatactttaaaaatgcaacctcatagtaagctaggagctactcagttaaatgatgtaacttccagtataaaacaggcatagaatactatatgtctattatcattttaagcgttgcctaaaaatggctcggttagaccaaaagcacccatggtgtacctctcttgtttatttaattcccagagcgcagtgcaggcctggcattgagggtccgactatgtatttgttggataaacgattaagaggctgagaacatgcacatccacacacagtgcttcttaatgatattttcttagtatcagtgttttgtttgctgagtcttgaggccttagtggctactcttgaagtgcttagcaacatttgtgagcttagtctagcaaatggagttagactttgaaacaggactatggaaatagaaagtatgctaacattgagatatttgtacctttctttcaaattatgttgtagaaatctttggaatccaagtctttctgttaaacaatattccaagtgccctgtgaaaattttagttctattacagtggtcaaatgacttcagaaaatgtatgtcttaccagatttaaaaagcagagacagttcaaattacttcattgacattgaattttatttaaataaaatgtaggtatctccaattctgaccccctcatggaggtccatgaaattaaatgacttgtttaatattatacaaaatgtctcactgactaggacctagaagtcatattgacatttagataattttgttgcaaaatgagtttgactgatagcagagaaaatcagggagactaaaaataataaaacaaacgttttctctagagtctagatatatattaaaaagaactcatcaacttggtgatttggaattggggctctttagaaaccagagcagtcatgcaattatatggttagcagtgatgtgtaaacagacttaaggtgtttgacccttaatatcatcaccttacatttctttatccaactatagtgatgtgcatattatatttaataaattattttttgcttgtatttgtgcatgcatagctattttgatttctttaaagttcttatggagataatatgacttgaatataatgctttgagtccaagaaaattgatggacatataaaactaagttatagccaaaattaatgcataattaagatgttttccccaaacatcctgagtatcttttatatcagaggatattaatgaaatctttagaaaagtgtcacaaataattcacaaaggactgtatctccaaaactacttaaaatttctgaattaaagactgctaaacactatacacatgctagtattggttctaaaccttagactaaccattcagattaatagaaaactttttaaaatgttaactaatatgatgattggtttgtatggtaatctccacgatgcatattcatttaaaactttttcagaacaactcagttatagcctggtgtctgaataaaggcacacaatgcagtgtgattttgaatttatttaatttgatgctagaaagttttgatggtttaggcaagtataatgaagaatataaccaagcggaagaatgggggatgagtcagaagctttagtattcaatcttgggcccatcctactgtctgctttttgaattaagggctatatgtgtttactaaattttgactaatcatcaatggtaaattttaaaaacaactttattttttctttgtttttggtgtcttcaacaagagcaagagctcctgaatggcagtgcctatcttattcatttttgcatcttgtttctggcatatcgaaggtgcttgataaatatttttttatctatttttctgaaattccctctgtctcatctattgggcttttcggtgtcttgtgttttttcctttacttttcctgacccccttaaaaatcttcatcctcttcttcttcctttttaaagaaatttttaaagagatggtgacttgctttgtggtccaggctggagtatagtagcttgatcatagctcactgcagcctcaaactcctgggctcaagtgatcctccagcctcagcctttcaagtagctgggactgcaggtgtgtgctgtcctgctcagctaatttttacttttatttcatagagacaggatcctgctgtgttgcacaggctggtcttgaactcatggcctcaagcagtcctccttccttggcctcccaaggtgttgggattacaggcatgggacactgcacctggattctcttgttatttttgaatacacctctctttagtttgttgggtaactggttctgcttaatgactggagaactctttgatgctgggcaacgagatgtacgtatctttgtattgagaacaccaggcacaatactatgtagataaatgatgataagtataacttttatataaagaactatatattaggaggccttttcagtacttttatttatactactacaacacattctgtgattttaatttagaaatagttatacaagcattctttgttaatcagggaaaaaacctatggatccaattgtacaaaaagtgaccgtttccacagatttattaacatataaatgtatttttaagtatttaaacataaaatgttaatatatccatatagttgtgaatgagaaagattaagttcatatgtttctcttttacaatgtttttctttaaaaaataatacacagttggccctcctatatccatgggttttgcatctctggagtcaaccaactgtggattgaaaatactctgaaaaaaaaaaaaaaaccacaatggatggttgtgtctttattgaacatgtataggcttgtttcttgtcattatcccctgaaaaatacagtctaacaattatttatatagaatttacattgtattaggaattataagtaatctagaaatgatttaagatacacaggaggatgtaagtaggttatatgcaaatactataccattttatataagggacttgagcatccatggatttttgtcctttggggatcctgcaaccaatcacccagggatactgagagatgactatatttagcctcagctatgctaggaaaacactttatacctcccccttcctctaagtcagagaactgtattatcttactgtatctaggagtcagacaattgtatcccataggtgaaattggattatgtaaacgtgagttgccaaggttgtcctggataaaatgtccattaggaaaatgttaaatgattctactggtaattgtgtttgaagaaatgtaagtaagggtgaatggtgttatcatttcaagaaagagaaaatcatgtattttggagtagtatttgtgagtagataattcatagttaatgatattgagaagttcccaaggctgtgctgggagagtcaaggggtctgtttggacagaaaacatggtttctgtcttgtgtctctgctttgccccttacccattggctttgaaccgagtccagtccacgtttgcctttaaccacggatcagtggcacaaaaacagcatagaaattatgttattacttgagcttcaagataagtctacctgctgtagaagaaaaactcaaaagcaggaatttttaaaggaatctttcatacaattggtaattttgatgccattaatttcatgttttagtatctctctctctctcattctttctctctttcctttctctcaataaagtgacataatggctttcatttgtgcctccactcagaaaatgtgtccctattgcttgtgcaggccagttagttggattacctcatagatgacaaataggaggtgagataggattggggtcagtattcattctcttcattttgtcatggtcctttatgctttggcatttcaaattgatcaccaaaagtagcgaaaggcagctgctgtttgattctttgcttggtgagagtagtaatacccttgtttactctactggtagaattgccttgataagtataacttggatgtacaaagtctagtatttatacagaaattgatcaactgaaaattcaatttctctcttggagaactcactctttaaagatactgcagaggctgggtacagtggctcacacctgtaatcttgatactttggaagaccaaggtgggaggatcgcttgaggccaggagttcaaggctgcagtgagctgtgattgtgccactgcattccaggctgagccatagagcgacacttgactcaaaaaagaaaaaaaaaggatgttgcagaatagaatgcatacatagccatttatctgaaattaaatttggtttatatattttcaatatccacctctgtaaaataaacctatctttagacgtttactggtatttttggcaagaagtgattcatattgcctcccattattttagtatatgattactagatttcacttaattggttagaatttaataaattatcattgtaataaatttgtaaaatgtaaacataaatacatatactgtttgtaaatctttacattattaagagtattacattttactataattattgtatgcttttgagaaattgcaaattgttcttaacctgaattttgctgatctcagttcatggaaccacgtgactcttaagggtcaataggattttagtgtttattttctagccctgtgatcctcagtaaattattaaagccctttgtgcatttttcctcatctgtaaaatggagctaaaaatgagtacctatattataggaattttgaaaggattaaatcagttggtaataaaggatcatcattaaagataaaatgcttagataagagcctagaaagagtaagcattcaatagactttagctgttataatagttattattaatttttctattatgtagagattgaaaacattctgtacatacacttgatgcattgttatagcaaataaatactatttaatttaaatttaagatctgttttccatgcccacatattagcaggggactaattaattgaattaatgcagaggatgtttattgaatttgtgccatggaatgtattaggcactttggagagtacaagattgtttccctcaagaaacttactttaaatgcttaatgtaagatagtaggagagatggcatctgagtaagtagctaaaatatgcctagctgtgatacagcaaattggtttatttgggctcaaggaatcttaaccctttgtaccaaattgtacaacgagcacatgttttttgttcttgaacaggtttctgcatgtttgtactgagtttggtgaagaaacattatcgtctgcagttttatatggtgtgtattaactattattccttagtcattatctgtgataaaaacccttaacttttttttttctgtagtgagaagatacagtcgaatctgctagctgttgttttgcatgaatgtgagggatacttggatttcagatgaccattagatataaactattaaagttgagaagtttgtgaggattttaaaattttaactgttttcaaagtttactaaaaactttttctttgaatattttcaaatggtgtaaaattaaagtttttgggttccttaaatttgtagaaatttgaagaattttcttagtctcctggacagttactatgtctgagaaacatctaccatattgttctatgaaagtaactatgtttacttgcacttggcgtgcgcataaagcagcagagcatgtattatcttggtggttatggttagtcatagaattgtgtaattctttttggcataagatattttgttcaatgtaccaaagcctgtcttaagaaatgtatcactttacatatgaactttttttattttcttaaactgtagctagtacaactgtacaatgcaatgtagtattcagatctgtaaattcatgtgatagtgaggcttattttggacttggaatatattttctgttctttatgcttagcttttctccattaagacattctgctgaacataattgctgggaaattgttgtgtttcttgtatttctaatttaagggaatctgagcatgaagagtaaaattcttagtgaattttatatagaaacaagacaagtaaaaatagtagaatatccagtgaaaatgtaaatggcatctattggaaaaaatttaattaatgcatttttaagcaatcagagtaaaagagaattggatctttcaagcagataaaaatagaataaaatagagcaaccaatataatatggttgcttaaatgggaaacaggtttattaagaataaatcaaaaggccaagcgccgatggctcatgcctgtaatcgcaacactttgggaggccaaggcaggcggataccttgagcccaggagtttgagaccagtctgggcaacctggcaataccccatttctacaaagaatatgaaaattaaccgggcgtggtggcacacacctgtagtcccagctactggggaggctgaggcaggaggatcacttgaacctgggaggtcaaggctgcagtgagctgtgatcacaccactgcactccagcctgggtgacagagtgagaccctatctcaagggtgggggtccagggagaataaatcaaaatcttaagaatttttaaaagtaattttatgaatttcaatcaaaatcataagactcgtacatggaaaccatattgattatattaaaagtggccatctctcaggctagatagaattggcaaaacacaaaggtctttaaaaatttgaaattgaatactgtcattgaacagacctgtcacgatcacccttcaagtatgaaagatagagtttaagggcaattgaaccctgctggtttgaatcatttgaagttggaaataactctttatgggaaaaagttaccgtaataaactctgaaagaaaaggaattttttagcattttgttaataactgcagaatgcagccagagtaaaatgttcccctttaaatgttgttaaaccagcaacagaaatctctcatcatcacttaaatctaatgattcaagataatggtttattttttatatgttttaaaagttagtactatataattagaattctatttatatataaattaaggttactttgttaaatgttttcattattttaaggttccagtaggcaacaaaacaaacataatttactaacagtgtttttattttatatgactctaacttgtacattttgaccaaaagtcatggtagaaatttgggtttcaaatcgctgttgcttcttcagctgcactgatcagttgtgttcactaatttttgtattgttgggctattaacagttcgcatggactcatgtcactttactgataactgtcactcagtcacaccttgtcatccaaaatctgtttgaaggcatgatatggtaaggcaacagaattatgctgctttataagtatgtcatagcacttttatagttctttaacgttggatagtgtcttacagatttctactaaaatgtactgtttgttgttcttatattccattaaactatcttactgagttttgcttactctttgacaactaaagacaaaatgcttcattaacaactggataccattcttattcaagttccaaatataggaagttcccataaaagacccaaaaaattaattacattttcaggtgttaataaatcctagtgtaacttttcacaaaagacagactttaaatataatatttattaagatattatttacatagaatgcaaaaaaatataaaactttgcctactagtaactactgtgaagaaatgcatgtttttctaggtgaaagttgggtaggttttctactttgctcctgtgtaggagtgggtttccagattgtagaagttaattgctctatggcagtggcttgcatattcagaaagcatttttgttaggtaaaaattataaaacttattacttaaaaattagttggaatggagaaaaagcttaagattaaaaaaaaatctgactgtatttttcccccactcatttaaaactcattaattaaaatcttttacagttgatgggttttgtcaagataaattgtattcccttgacagctttatgtctttttaccaagggtgtggttgtgtctttgtgtgtgtgtgtctctgtgtgtatgtgcgtgtgtaaagtaattggaatcattttaagattgtctttcatgtattgtacagacttttcattgatggggcagttactgaagtaagtaggttctgtacattcagtagggtttactgaaatcataagctaagatagaattaaaattaataattgagaatatgtattaagagcttgatataaatttatcagattatgttctgtctaaagaaatgactcattttcatattaaaaggctggttttcttaagattagctttcagtctgccttttattttttattgtaacatgttcctcataaaactaaaatgaaaacatccataactgtagaaatcaataatttaatattttcctagcatgctagtttatttttagattttgctctgtttaaattggtaagtgggcaaatttggttgatatttatcatttctactgttttggcaagtgttatgttctgggtaggctgcagtgcaatccaaagggttattctgatggttcattatgaatcataacctttccgaatatctgccacttactcaggtgaacttttttctgctgacttttttttttttttttaaaaacaggttccttgttccaatatcaagtgttatctgcaatgacataactgcttacctttttggatttttttttgggagaactccattaattaaggtaatggaaaaattttataagcaagccactatgtaaccttaaagattagccactggagaacatttccaacaactgtgctgttgtgcattttttatttttgaggtgctttgattttccttagctgcatggtgcagaagcagcaaaccatatttctcagtacttccatctgggttcttcatcagctcttctgttggctcctcaggaagggcatgactccatcagtctgcctgcctgcctgcctgcctgcctgcctgcctgcctgcctgcctgcctgccttccttccttccttccttccttccttccttccttccttccttccttccttccttccttccttccctccttccctccctccctccctccctcccttttcatcttcattttatctttatgtggtttcttttctttcctttttttttttgaagatggggtcttgctttgccacccaggctggagtacagtggtgctaccatggctcactgcagcttccacctcccaggctctagcaatcttcccacctcagcctcccgagtagctggggcttcaggtgcatgccaccacacccggctaatttttgtatttttggtagagacagagtcttgccatgttgttcaggcttgtcccaaactcctaggctcaagcagtctgcccatttcagcctcccaaagtactgggattaaaggcgtgagccaccgcccctgggctctgtggttttttctctcggccattggtgcagttcttctttatcctcctttccagcaagcctatacacaagccttttccttgactctcctctcccttcaacctgtcgccttacctgtcccctcctttaccaaactttctcaaagaagagattatataatacaccttcacatcctcatatccatttgtgtgacttttcatatccaaactcataccaaaagaagattttggggccctacaataaaatactaataaaatacaagtaataatgaaagggaaaggaaaatacacatgagtagaccatgttgttttgctatagaattggttctatttatgggcaatggtaaagaaggaaatgaactaaattacatagttctcatttgggagaagaaataaactaattcttcatggaaatcaaatcattttctagaactgatttcttctaaaagagctcttctttatttttgtttagtttttattcgtttttggagacaaagtctcgccctgtcacccagtctgtagtgcagtggcgcaatctgggttcactgcaacctccgcctcctgggttcaagtgattctcctgcctcagcctcccaagtatctgggattacaggcggctgccaccatgcctggttaattttagtatttttagtagagacagggtttcaccatgttggccaggctggtctagaactcctgacctcgaatgatctacctacctcggcctctgaaagtgctgggattacaggcgtgagccaccacacccggcctaaaagagcttttcatgttggagtttcagataagattcacacatttcacattattgggcaaagtttttaataatgttctcacagacatattattacctggctgttttgatattgttatatgaatgcagttttggaaggactgagacaattgttcagatataaagccttctgtttgttcagagtggtatgagggtagtttagtattaccagaggaatttgtggactgcctgttcttccaaaaacctctgtaaactcttcccctcttggggaggagctcacagagagcacctgctgaaagcatcagcacacagagagtgttgggctgagctgtataaggatactggtaagcaagctgtatatttttaaaacgtttctaaagctgctccagagtttctaaagcttgaatacatgatttacgtattcaagagttctacccagactgagaagttttcggcttgggaagctgtattagttcattctcacactgctataaagaaatgccagagctttaattggcttatggttctgcaagctgtacaggaagcatggctggggaggcctcaggaaacttatgatcttggcggaaggggaagcaggcacatcttatatggtcagagcaggaggaagagggagagtgaggaggtgccacagacttttcaacaaccagatatcatgagaactcatgggacagcaatagggggatggtgcttaaccattagaaaccccctccctgacccagtcacttcccaccaggccccacctccgacactgaggattacaagtggacgtgacatttgggtggagacacagatccaaaccatatcagaagccttcaaaaaggctgttatagctgtggaagaatattagcaactgattttgaacacagccttctagtgaatttatcaggctggattaattgtataatatacttagataattgaacagttaacccctaaatcgatatgatatgcatcaatttaatttgataagctatctttacaataatcagcaggcacttttgaatttgagtctgctcctacttcatggcagtgatagtgaattaccctaggagaaggtgtgtctgtcccttctctgtggcagaattgttatcagatttgtcaagaaaccatttctgccaactgttttggtttggggctttatgaatatcaggacaagaagtctatgaagagctcctataggttaacccataacccattttaatacttcagagactttattctgatatttggtttctgtccctcattaatgacctgatgaccaaatcctcccacacatcacagtctttatctcccctgagcaacaactttcactttttgctcctgaatcttttcctcctgccccaacaccactaacttctagatttttttccagatttctttccatgaatggtccattgactgggcagcaatagcctgaatccaacacaaacaatatctcttctttgaagtgcagcatgttcctttcttcttggaaatggacatagattgtgaaaaaagagaggatatgtcaatacttgagcaaatacagtatctggggctctggagtattttgccatatcagaaggaagtctgtgtgtatatagcatattaggaatatgtgaaaattatatgtgctaaaatgtccatgttttgttgtactgattctatttttggccaatagcaggtcaatactgactgtgtgtacttggaatgaatacgtctcattcttattccaagaacttacaccaactattatcaggttttatattagcataagagtcatgggacagttattttagtatagagtttatactcttttgagagacagaacaaatttagaccatttaacatgaacaaacacatattcacagcatttcaaatatttgagggcctactatgtgtttaaatattattagagagattttcactagtaaatcaagatcagagaaaaggaaaaagggttttgaactattccaataagagaaaaagtaaggagagatgtacaagttattgaggaaatagtttatatatatatatatatatatattgtgagttttgtgagtgcagtaaagctttttaattttatttgcccttttttagttgtctcctaaaaagacttgggaaggattcattggtggtttcttttccacagttgtgtttggattcattgtgagtattactaagatttttattttgtatacatttcgaaatatgataccaagcttactggtctaattttaaacctagaaaaattaaaccacaaaatgctaataatatatttattgaaacctactgaaaagaaccagttctgtacctcagcagcccttatcctggctacatatagaatcacctgagaagcttaaacaaaatctatgtctcagccttatcccaggccagttaacacccccaggtaattctaatggccatccatgctgtcttgctgacttgctgacttactgttgtgctgttgtgtttggtagtttctaacagctattctgccttaggcggggcacaagtactgggacaggtggtggccttgtgtaatagcagaggatgcaaatactattgaaaagctctgccttcttaaacacatggtggccacttggctcagtgggtggttactgttgtgggcccaacttgcagaaacagtctaactataaactattaatgtttgcttttagcatgttaaatagctatttttcatgttttacaaattagtttacagttataggatttagatttttattaaaaggtgtctagtgagaatgagagtatagtaccatagctggatataagataaatgtacaaaaaagtactgtcaggaagctttacttttcctagtttctgacagttgtggttacattctgtatccaaatctagagtacctagtaacaacatgaagcctggagagagtgaatatacaaataaatggaaatatgccatgatcctggaaaccaccagaattcctctatttaatttataaatttagttcatttgcaatgaaaattttaataaaatgtgataaaattattccagtgtttttgtggtagaatattgatgagataataatggacagatagaagaatgcaaaaggatccaatctcatccaatgtttttacattacaaagcgagaataattaaacattatgaagctaaatagtgtaagaatttgttattatcaaagactaacttgaaaataccacaggaatagccatatcattggaagaaaagtaggagctaccccataagcatgtaatgcatgacaaaataatgaggaaggaaattccacatctatatgaaattatatatatataatatatataataatatgtaatatatataatatatattttatatatataaaataaactggttgtttggaagcaaaatcagtttatattcattcctagtgtcttgaatttctattactcattctcgagcagaataatagggtgaatggctgcaagaaaaggagaataagctgttgtctagcaatttaaatttataacaggatatcttattttatgtatcttatttccaaggctgtggacagctagttttaaaaattgcaatggtgtggccagggaaagaataatttagtcaaagttttctgggttggctaagaacaatggtgtttttaacctgtactattttgtactattttattgtaattttgaattactggttaattattaactgatgaaattaatagaagcttgtgtgcagtatacttcagttctttattctcctgtaccgtataattgtgattatgcagagattacaatcttattgatttcaaaaaaactttttttttctaaaggtcttttaagtcttttactaggataattatgaccatttaactttgaaaatacatagcaaaatattaagacaaagaaattctggcattctatctctggcctttctgatgtataacttaaaagatatatgtttagtcaatgtgttatgaacttttgctttgttttttgttttgttttgttttgtttttaatatcaggctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggtacagtaaaagttcaagataaacatggttagagatcttccactctgaagattaagcttcctttattatttatttatttatttaattaatttattgttgttttgagacagagtttccctctgttgcccaggctggagtgtagtggcgtaatctcaacttactgcaacctttgctcaagtgattcttaggcctcagcctcctgagtagctgggattacaggcgctcgccaccacatctcgctaaattttgtattttaagtagagacgggtgttgctatgttggccaatctggtctcaaactcctggtctcaagtgatccgcctgcttcggcttcccaaggtgctgggattacaagcatgagccattgtgcctggcctgaagattaattaagctttctttaaaagtgggattcagatttgtacaagaaactgatttctgtagaatttttaattctttgatataccagtggttttagtgttagcttaaatcaaatggatgagaacgggttacaaatcaaatggatcaaatggtttagaatgtgtttctcatatcactgacatcagttgacacaatttaaaacttaaaattcaccagtttaccgagtccttgatttttagaggacatttattatggacagaaagttgctgcttctacaaatcagttttccttccaaatacagtgccttccttgaaaggtatcttggaggccttacactagaggatgttgacatgccctccagtggaaccctcctgatctgtgtcatcaggtctggtgagtggctggttaaagtgaggaatcaaataatagcatgtatgtctgtatctttgtgtgcacacatgtacagctttgtatctgaatcattttacataaaatccataatttttgaggagtagcttaacaaattatttctctctgagtgctcagtacatggtttccaagaactttttcaatgtccaagccatctgttacctgctataaaactttttatactgctagtgtttgattaggagcaaggctatttattgctttgagaacaggtcaaaaaatggatgtctcagccgggcacattggcttatgcctgtaatcccaacactttgggaggccaaggcaggtggatcacctgatgccaggagttccagaccagcctgaccaaaaggtgaaacccatgtctactaaacataaaaaattagccagtcgtggtggcatacacctgtaattccagctactttgggaagctgaggcaggagaatcacttgaacctgggaggcggaggttgcggtgagccgagattgcaccattgcactctagcctgggcaacaagagtgaaactctgcctcaaaaaaaaaaaaaaaaaattggtgcctcagacatctttcttcaaccaaaatgggtgcattttgcactgtctataaattgtagtttcagattatttaaaaaggagcaagaactacaaatttgcaaaataatttgactacaaaattcttctcagcctttatgattgtctccccaaatctttagtgattgtctcactgatgctcattttgataataatctttaagcaacttatttttgtgtttttccacagcattcatcttaattttagagaaaagtccaacttttcccttattttatcatataaaattaaggtgaaataaaatacaatattaaattatataattacagcaacaaagcattactagtttaaaaaaatttggaaaataacacagctgattctttgtaagaagtaaagttcctagacaacctggaaggtagactaccacgctgcaagatttcagtgtgccagttgcctgtcattattcttacagagagaagggaaattgctggctaagtagaggatggtacagaaggcttaaatagacttttcttccttgatccttaaagtttgaaaaattaacaaaaatgtggtgcgtgctttgacttactatttacacaatggttcttagatcaggtggtatgctcaaatacaatttcagtgaaattagcccctctcctccccttctttctcctctttaggaaagagtgagcttgtaccctttccagatccacagcattgcactgtcaacctttgcatctttaattggcccatttggaggcttctttgctagtggattcaaaagagccttcaaaatcaaggtgtgtgtttagattctttgttatattattagagaatataattagagaatgtaacctagttggaatttggtccgctcatgatctacattaagcccctaggccacaacttttatatcctatttgtttcgaccccacagaaatgctgccacgttgatctgaatgtattctttctttttaggtttgtcataccatgttaatacattttaagtgtcatgtcagcttcctttatagacatggcatgtgtcctttagtgttggaatagacccagaatcttggtctttcaagtgctcacccaagaatccagccgtgaatcatctaaagtttagtgttttactacagtctcacttgaagggacatgcagaagaacctttggctatgtaactgtccattctgctaagtcaggtgtcatcacactctttctgtaaagggcaaacaatacatttattaggatgtgcagaccatatattctatcaaagcttctcaaccctgaaccctgctgttacagtgagaaagccccccgtggacaatatgtcaatgaatgggcatggctggatttaataaaactttatttataaaaataggttgtggcctggatctgatctgtgggacatacttttctgacccctgttccagagacctaaaattatccctgtgtattaggttagatcatcataaagtgacatgttatctcagcaatttcatctcagcttccctcacatggctgaggcaccatctggggttagaaagtggctatggaagttggggtggtcagggaaagcctttctgaggaggtggcacttaagtagagatttgagaaaagaactcctccagagaaaactaagaagagagttccagagtgtacagaggagtggaagaggttaattagcctgttagaaggtgagcaagaacagtgtggctgtggttgagagtaggagatgagaccgcagagtttggtgggaccagatcacacgcggcctacggggtcagggaataagtgaactcagcgagcatttgccagtgggaagctactatgtaaggtgcaatgcagtatacaaaaatatacaagatgttgttcctgttctaaagatgctcaccacctactagggcagacaatacacttccccagagaactacagcaacagctgtgcaggataagtatcttgcgaaggctgtaatagcagagtggcattgagttactgtggctcttttatgctttgactagtaaggaagagaaagagagaaatgggttggcaaaaattaaccaaagactttttcagtaattattttaaaaagaaaaatgttatatttagaatggtattttctttaatggtctccaatccaagattttttgttaaatggtgagttttttttgcatgttggaaaccaaacagctattgctgttgtagtttagatatttttagggtgcctgagtgaactagaagagcagttagtcatgtccatttcctgggcacccagacatgtgaatctacctgtaaagggtcagtttgcagaggcttactaccattccctcagtgtggccatttaatggactaatgtgtcccatatgggctcactgtaattttattttttactctaacacttaaaaaaagaagaagaaatgtttatcatagtagtaaaatgtttatttcagagtaagaactattaggataaacaagttagaaccagttgtacatcttttagcagcactaaaatagctccccaaacagcttgtggttaaaaagaaagctaggctgtaacaaaattagattagtaatagctaagataatttttatttagaaaaagttttattaacgaaaaaaagtaagtgctagatttaattaacgtttgatgaatgaatgctgtgggtcaattcagaaatcattctaaaagaagcatgtatttggaagatgtggttttaatctgctggatgtgttctaataagtttttatttagtgaaaaaaatccaatagtaatgtattttcgttagagtgagtccatgacgccaaagagacacagataggaattttatagcaggtgattttttgaaaatttgctaatatatttgtttgtttctaaaggattttgcaaataccattcctggacatggtgggataatggacagatttgattgtcagtatttgatggcaacttttgtacatgtgtacatcacaagttttataaggtacttttacacttgagacattttttagatgatttctttgagttctcatttccatcaacattagtttgagtaagttaactttttccgtcaatggtaatctacaatattaaagtgaatggtggcccctggaattagagtcttgagcaagatggttaacttgtaattgttttacctacatttgaacaacttaaaaaaagatagtatttgtcatggtcctggaccacattgaagacccaattaatgtggatggtataggatttgaaacttgaggagatttgatttctcaactgtgggcattgcaatgatcatgaatactaagagttaaaaagggagataacgaaatgcatccagtctaccaattattacttgagtgcctgccatattgtagaatgttctagggacaaatatggcagagaacaaaacaaaccaaatctctgcccccatagctacttgtttggaagttgaagaaagaatgatgagaaagagacaataaacaaataaatatagtttgttagatggttgtaagtgtcacacagaaaaataaagcaggccgaggggatcatgcctgtgtgtgtaggggctggctggtggatgggtggatgaatattgccattttagaaagggtggtttattcttgttattaaaccttaatgttttggatctgccttgaaataccagtgtgagtgtgaaggcttaacatcaactgcatgttaactttattttctgtggtctctactgggggcccagaaggcagaatgcttattaatagtacctgagctgtagaaaacatggatttccttcatagtacttggaaggaaattcatatttagcaatccctaaatacacattttaaatatgtaccacagtagtgtgagaatttttatattaactatttttgagagacagtcctgatagcgagtttatcaatttcattaatcttttcaaaaatatcaactccaggctttgttaattttctctactgtaaattttttacctcattgatttctcctctcatctttcatttctctgccttttttaaatgttcaatatgctgttctttttttaattctggagataagcttagattattgatttttagccttcttatctaatttatccattgaagactattaagtatcactttatcctcttcctgcaagttgtgatatttgtattttcattatttacatgttttctgatttccagtattatatcttctttaacacatgggttatttagaagcatattcattagttttcaaacaaatggagattttttcactttcctcccttaattccactgtggtcggaaaacatactctatgatttgagtattttataatttttgagatctattctgtggtacagcatgttatctattctagtacatgctccatgggcaaaggtgtattctgtagttttgggttgtagttttgtctgtgtcagttaggtgaggtttaattaaatcttctgtactgatttttgtttatttgtttttgtgtttgtttggtccgcttgttctatcagttactaagagagctttgttaaagtctctcattgtgattgtaaatgtatttttttatttgtagttctaccaatttttggtttatatattttgaggttgtattaggtatgtacaaatttaggattgtcatatctctccattgaattgatccttttgtcattatataatgtctgtctttactgcttgccttaaagcgtactgtgttgaatattaaaatagcaatatcagctttcttttggtcagtgtttgcatgttatttctttgtctctccttttatttttaacattcccttttccttatatttaatgtgtttcttttttctagtaagcatatagctgatttttttccctgttttatttataagacagttgataatctttatccttttaatgggactatttaacttatttgcatattatttattgatctatttgggtattagtaattagtggttaaatccttaaaactttgttttcagaatatggcagctttttagggcattaactcatatgctttctttaaaaaaaaaatgctgtcctctcagtagggaggtgtcatgctgagccatgttgtccaccatttgaaagcagctatttagactgttagaagacactgagagtgccaggatgcagctagctgggagcacctgctgacacaattttgcatttagctgaacttgctaaagcagccttccttttctctgttggtctctacttggggtttatgctgtgaagttgctgactcttttaaagaaatgaaataaggcgaacagtgtcctgacctgagtgtgaaagttttttggcagatgagttgagccacgtgcatgaagatgacccttggtgggatggctcatctgggctcttgtgcaatttgttaagtcaaagattttcagagtaaatagttcctctgctcatcctcattgtggtaacactaaatagcaaacatttctttgttgctgggatttctactttctataattcaatgtgaacaatctttactgtaaggcatacattatttacccacataaatgtctttcttagaattctatgccatctctatacatgacttgtatgttgctttttcccattggattttaaagcagatctgcttttattttgttttttatattggagttcacctaggactgtctttgaacaaagtccacggcacctgtatcactggtaaggggcttcagtgctaggctcaggacttttgtgttctgactctgaatattcataactccctggagatatttttcaacaaaatacctttcatcatctgaagtttcttggaagttaaaaatttcaattatattttcatgccctctttttggtttgtcctatgttcaccaggctcctttccttacagaatagtttttgtgtctcattcaatctcaagatttgccatttatccccacctttaactttggttgccctttcaagagcttttgtagaacttagatctgcaccccttcaattgacttacattgctcttgtgttttgtgtttgtgcattctttctccctctctgctgtaacccttgacactaacattgcacattaaagtgagctattatcaagagctattttaattctgtaaagattcctactctacacttaaaggaatggtttgttttaaattggaggtatgtgcttcacttatccctattaaaataacacgaacttgtcttctttgccttttatcattaggggcccaaatcccagcaaagtgctacagcagttgttggtgcttcaacctgaacagcagttaaatatatataaaaccctgaagactcatctcattgagaaaggaatcctacaacccaccttgaaggtataactggatccagagagggaaggactgacaagaaggaattattcagaaaaacactgacagatgttttataaattgtacagaaaaatagttaaaaatgcaataggttgaagttttggagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcataatttaaaagactggtatttaaaagagtcaaacactataaaatgagtaagttgacgatgttttaagattgcacctggcagtgtgcctttttgcacaaatatttacttttgcacttggagctgcttttaattttagcaaaatgttttatgcaaggcacaataggaagtcagttctcctgcacttcctcctcatgtagtctggagtactttctaaagggcttagttggattt

SEQ ID NO: 36793 - DNA, 19668 bp, Homo sapiens
gggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggtatggcagcttgcgggaagatcggcaggaccgcaagggatggaagagcttgggcacggggcagggaggaggagatgggcgcgggggcagatgtggggtcgcagggcctagctgggcccctggcccgtcggaggcgccgggtagcgggggctgcaggaagcggctctgaggtcgggcaaggtgtgcgcagggccgggctccggcggagcaaggtcccgcccggttccctgaggtcggagggccacctgggacctcgggactgcggcctgagtccaaattgacgtctgggcggtcttgagttccctcagctaatcagcacttcctgagcttccacttccactgcaagccaggcccccagtctcagggcctgcaaggtgacgggagcctgagcaatagcccaggggaaggttaagtcgtgctttttgtccttgacgccctttgaaaccctgtagtgctggacagagtgaccctttaagattcgatcgagtcagagagcgcggccgtcgagcacctcccgtgttgcagacgctttgctgggtgctgcaacagcaaaggcgaacatcctagatgcctctgagggtggttttggtgcagaagggaccgtacagatctgtctgagggcggggaagggaaggacacctagcactaccttgaaaccacttgctgaaaccgtaaccctgcaaggtcatgaaattgcccccaggtcctgggggaggagttcggtgggcttttaagtggcatttgttaactgacatgcaactaaagggtgccacgagcctcgagaattttaaacattagttccgggtagggggacctgggctgggggaagtgcatattagaaggcccgggaatgggcaggtaaaagttggtttgtgggtggtgctgttcagttttgaagcttgacggaatctggaagaattccagacacgctgctaaggggattctaggctgtgtcgtagcaattccctgctcttaacagtgtggaggatttctaaggcgctacagtgctaaactagattttcgtatcctaatttatatgaagggaccataaagcattagttgaaataaataggtttttcattaagcaaataactgatagtaatatacgagattttcagaatgatatctgatgtgaattagccacataaaatttttggtggcttggccttggaagtcagatttttttttctctaatatggaaaaagaacattcatgggaattaaaaggtcactgtagttgaattctcagttgtatagattgtcccacttgttaaccactcagcagacattagctgagtgcttccactccacccggtggtacttggaaagtgcccaaatgtgatggtgagcaaatagataaggtctcagtcagtttcctgggacagtgcctggcatgcagtggtgctctgcgaacatcagctctcctggccttaccttcttgccacgcattaatgttatctgtcagtatttttacaaccttagtttctaagttgatctttaaaaaagtggaaatagtttctgaaacaaagacaatattttacaaaaaattttagaaatatctttttttaaagcacctgtaagataatttgaagctcttttagtgaaggattgttttaaataagagctctcagttcaagacaactactgttaggagcttaaatcggaaccacaatcagcatataaaggtcctaatcctgaccttaatccctttggaatattggttttataaatcatcaatcaacagtgttccactatgaaagcatattctgtcttcttcttttcatgtattccttcactgctggtgcttaatgtctttccttcctcttctgccatttctctttccatgaattataattgccttttgaattcagaaattaaaaccactccacagaattaatttggaaggggaagaaaagacctttgtcttaacgaaccatgaagaggcatatttccatgcttctgtcttgattactggaagttttttaaagtacaatttgttattttagtttttgttttcagagaggctaccatgctaacataaaaacattaggcttacttaaattcacagtggttattttaatagttgttagggtatcggcaaaatactctaacgttttgaaaattaaaccttttttttaaagcagcatataagaaaatggaaattaaaaatttgagagaaagaatcccggattttactgtcttcaaatttgggaaaaacatttctatttcttagagttcagtagtctctaaaatggaactgttttttaataacgtgtcagtagtcataaactacagataccgataaggagatggcatttcaggagagaaaagacaaattgtcatctgagaccatgagggcagatatttactaataaatgtaaaaaatgtgaggcagcagagtgtagtactgtatgaagagagagactctgtagccagccctgaagggctgcattcagacggcagggattgaattctgattgccacttagcagctctgtgaccttgggcaggttactcagtgtctgtcccaccagttcctcatctgtcaaatatatgcaataaaagtgcacaattcagtgggttagtgtgaggattagagtatttgcaaagcatgtaggacaatgggggaaatgctgatagggatccaaatgctgtatatcagtagagaaatgaagagtttttaagtacagtttctacatcaaatgtaatgtaagaagattgcttggacttgcgaaaagaggaaaagaagatgcagtcgggctaggcgcagtggctcacgtctgtaatcccagcattttgagaggccgaggcgggcggatcacaaggtcaggagatcaagaccatactggccaacatggtgaaaccctgtctgtactaaaaatacaaaaattacccagacgtggtggtacgcacctgtagtcccagctactcgggaggctgaggcaggagaattgcttgaacccgggaggcggaggttgcagtgagctgagatcgtgccactgcatttcagcctggcgacacagtgagactccatctcaaaaacaaaaaaaaaaagatgatgcagtcatgggtgtgggttaggtaagtgtgaaggagtcagtttttgctggtggcaggtaatggacttttacacgcttaatatcagaattagagtcacttcataattttcgttgagaattagccaatattgcttgctttttaagtttttatgtatcttaatatactccttaaaaatctctcaaacaatagtttcttggaagggtgtcattcctgactccctcctccactgccttcgtcagctgttataacagcgctgtggaatcatggtagatagtggtaatccacggtccatttgattctccctccactgtgtttcttagtctcccgaggatctcaggacgtgcaatgattcagagctttatctcctcatttgcaaaacttttatatttaataaaggaagctatccctaaagagagttcaattagctcatcactgttcttactcaaattgtacctaacaattaaagtagtaacatagacgtcttcagaattaaatgaaagctaaacatgagagtgctttaaaacacatgaaattagggcaaatgcgtagcattatcacaaaagatgctacctcttcatacctctgacttggagtacttaaggaaaccaaaacattctgtgtttgtccaaatatggtattcaattcaaatttataccatatggtattctctgactagaaacttgtgtcagttgaagtgtctgcctaaaacaataatatccaagagtgacttgttataaccaataaattttgtgttcagggagaaaagtcattactacaccaaaaaaggaaggttgaccaaaaactggtattacttttcaagtgtgattatgaaaagctgttgtagtagaacagtcatggcaggtagtttgtgctctgaaataacagagcttgtcaggatttgccagcttttatcttttcctttagtagattcattcttaaaaccaaacctaatatttttcgtgctgtagtgggagaatcacctgagcccaggaagttgagactgcaggaagccatgatcacaccactgcactatagcctgggtgaggggagtgagaccctgtcttcaaaccgcaaaaaacaaagatccactctttttgttatacagttccacggatttggacaaatgcataatgacatgtatccaccattacaatatcatgccaaagagcttcactgccctaaaaatccctcctctactctccccaaaaccctgacaaccacttctctcaactattgctagatcctcggcttttctggcatgtcacatagccagaatcatacagtatttgctttttttcagatggccttctctcccttagcagtatgcacttaaggtttctccatgcctttttataacttaatagctcctttgtggttttggtgaataatagtccattgtatggatgtatcagagttagattatccattcatgtattgaaggacatctgggttgcttccaacttttggcatcatgaatgaagctgctttacatgctcttgtgtaggttttatgtggacataacatttcatctcagttgggtaagttaagactaggtttaggtttgtaaaaagctaccagaacatcttcccaagtggctgtgtactattttacattctgccagccatcaatgagagttccttttgctccacatcctcatcatcatttgctggtcagtttcttgggttttatccattcttgcaggtgtgtagtgatatcttactgttttaacttgcagttctctaatgacatgatactgagcatcatcttatgtgctttttgccatctggttggtttttgtttttgttttttgagacagagtcttgctctgtcatccaggtggaatgcaatggcacgatctctgctcaccacaacctccacctcctgggttcaagcgattcttctgcctcagcctcctgagtagctgggattacaggtgcccaccagcacgcctggctaattttttgtatttttagtagagacggggtttcaccatgttggtcaggctggtctcggaactcctgacctcgtgatccgcctgcctcggcctcccaaagtgctgggattataggcgtgagccaccgcacctggccctgccatctgttgatcttctttggtgaagtttccagatcttttgcccattttttttatttgggttgtttgttctcttattgcattttaagagttgtttgttttggatacaagtcctttatcagagatgagttttagaaatattttctcccagcctgtggattgacttttcattctcttcacagtatttttcacaggacagaagttctaaatttcaataaagcccaactcatttttttctgtcatggatcatgcttttggtgttgtgtttaaaaactcattgccaaacccaaggcacctggattgtctcctgtggtatcttgtagaagttttatggtttggcattttatatttaggcctgtgattcattttaagttaatttttattaaatttgtaaagtcattgtacagattaatatttttgcatattagtgtccagttgttccagtgccatttgtttgttgaaaagaatatccttttttccttgaattgcttttgcttttttattactgtaactttagaggaggtcttaacgtcaggtagtgtcagtcctgacaatattgtttgacttttctaggtctttggccttcctatataaccttgaaaatcagtttattgatatccacaaaatagatatcaactaaaatcaaacttgctgagattctaatggatttttaaaattgtaaaacacatggaacatgaagtttatcattttaaccatacaattgtgtgcgggcatttttaacttcatactccagtagttcagggctgctgcagaggaatgcaactagctttttatatacactaaccttatatcctgcaaccttgtcataaatgcttattggttctaggaggggctatttttattctttgggattttctacatagataatcatgtcatctatgaacaaaaacagttttattccttcccttcaaatttctatgcctcttattttcttgtcttactgcattagctaagacttccagtatgatactgaagaagagtgatgagtggggatttccttgtcttgttcgcaatcttatggggaaagctcctagcctctcccattaaatcagagattttgtgtgttgttttttttttttttagcaggttgaggaagttctctattcctagtttgctgagagactttttcatgactgggtgttagattttgttggatgctttttctgcacctattgattgtatgattttttctttaacctgttgacgtaatagattatattatttgattttttaatattgaaccagctttgcatacctggagtaaatcccacgtagtgatggtgtataattatttttaatacattgttggatttgatttgctaatacactgttgaggatttttgcctctaacctatgctcatgagagatattagtcactgtccaccaaggtcattcaattagagaaaccttagatcattcttactgctttcctttctactacgaatgtacatgtgaagaagttaaatgcttgcaaatctagtctcctattgctttgccagcatcttcatccaggttcttgaggtctctcctgaggctgtggcagcctacatccccatgtcttctgtgttcatcaaaactccaacctcattttacgcttgtcactgccatgtgagatactttgctgaaatactaaactgatttgtgggcttataaacattcatttccctattaacctacaaataagatttaaaccaatttgctttttttgatatttaaaaatattaattatttaaagtaacaaacccaactcatgtgtccagtttccccttctccatttctcactctttcctgatcatgaatgctcttaaaatgacattctgttcccgagaatcccctcctcacatctctactttgtgcacacatttcatcatgctcagttctcctgtgtagctttgcctgcaaacacaggcactttgtatggatttgaaggcagaaagatcatctaatattttttagcatgtcttcccccattaggccaggaattctctcatattcatctttcaccaacatttcatttaagcctaatcattttgacttctgcacattagcatttcaattttaaagacttgaaaaaaaatactaaatgttatgtaaatgtaattttttatgaaccttgtttacaaggtaacaatatgtcagagaccatgtcgtgtttaccagtgcctggaatttagagcatcttggtaaatgtttattgagctaaattgaaaaagttaagaatcagtttatataaactacttttacacgtgtagtcatgttcgactatatcattgactctgttactggaagaggttgctgtgaactaaggaaatttttagagtggctggccttgattcgaagtatagttgggcagcttaacaaggggaggggcttttctgtcatggaaacaagataagcaaagatatggaggtgggactagagcatgtgtgagtcaatagagcatgttgacttctgggaaggtggtggtacagacaggccaaataaaaggaggccttcaatacagggatttgcgccactactaagggatttaaatatatgtctattcatatacattctgagtcctgtatttgatagattgtttctttatggggtattctttaaataaatatatattaactgaaagtttttcttgtataatggaactatttttcaaaaaactgaaacatttttaaaacttttatcctcaggattcaagttcgaaatatggcaactttgaaagatagtaagtatgttgtttgtctcaatatgtgaattgagaaaaactaaattttgacaaatacaaatactttcaaaaatatactgctttagcccattgtgtatttgatcaaaactgaccaaatggatttccattgtatgtttgggacattggacttgttctgaaaagaccagtaagaaaggacacctgagacagctatgttctgttgtttgtagaatgatcatgatataactagaaaaaattataccagtgttggtgtaggtgggtgtatgtgtgggaaggggtaaatcatgttatatataaataatgttatggaatatgtggttaaggcaactttcaataccatttaatgttttaaatgtatattattgtcttatgttgccatttgcttgtcctaagtagtagctagttttgccttccttttattagtactatttctattttttttttttggagatggagcctcattctatcacccaggctggagtgcagtggcgccatctcggctcactgcaagctccgcctcccgggttcacgccgttctcctgcctcagcctcccgagtagctgggactacaggcgcccgccaccacgctcggctaattttttgtatttttagtggagacggggtttcaccgtgttagccaagatggtcttgatctcctgacctcgtgatccgcccacctcagcctcccaaagtgctgggattacaggcgtgagccaccgtgcccggctattagtactagttctaatattaagactggtttagcatcgtgctgtttattgtttatctaagcgctcattattctgccttgcacttcagaaaaatatgtcaataaattcacaaggaagttatactgtaattcctttgtcttaacacagtacttctatttttcagtcaccaggagactaaagtccatcaaaaacatccagaaaattaccaagtctatgaaaatggtagcggcagcaaaatatgcccgagctgagagagagctgaaaccagctcgaatatatggattgggatctttaggtaagggaagagtgtaattcacaaattaggaagaactgtttcacacaaggaagactactgatgacttacatttagagcttacagtgatgtcaagcctatctgagcacttgccatgtacttatttttcatctacatccacttgacacgtaatgataacaacccgtgtaggtagtacaggtagggactgttagaatccctgctttccagtgagaaaaactgaagcacacagaagttaagtaacttgcctaagatcacatataaaaggatgaagagcctctgtttggacctatgtggtttggtgtcgagtctgtgtatttgttagccattatacgtgaccatgttaacttttaaaatattctgaaatgttcccagttgttaagtataccatcagaagaacttggaaaccgtgcgttagatgtaagggcttaatttcatcctatgaccttgtagtgtggcattttaggactgcagcgggggcgggtgaggggcagtgcagtggagagctggccttgtggtcatggatatgactcatgatggtgttttgagaatccgaacgatgttgaagcaggaaaagcagctgagaacctccattttcaagatacttaatcaccattcttatcttttcaaaagcatgaagacatttttccttcagaaatttatgtaatccatccttaattagtcttcttaatggaaaagagatgagatatgacagtttaaaaagaatttatattgtgtttttagatgcttttatacttgtttgattatgaattcatcttggaaataaagttgtaaagagctggaaatgggaaagaagtttctattttaacttgtaattacattctttctcttaacttttttatgatcatgctgtcttatcctgagttgaggctatctaaaagaatttttaacttaaggaagatttatgcatatttgatagtaaagaagatcatgcagtgaaccccctatttatctaccaaatcctcagtatctcaactgacagctgtcctttgtttttttatgtgtgtgtgtgtgttttgttgttgttttttgtttgttttctttttgtgtttttttttgagatggagtctcattctgttgcccaggctagagtgcaatggtgcaatctcagctcactacaacctccccctcccaggctcaagcgattctcctgcctcagcctccccagtagctgggattaacaggcccccaccatcacacctggctaatttttgtattttttttttctgagtcggagtctagctctgtctcccgggatggagtgcagtggcataatctcagcttgctgcaagctctgcctcccgggttcacgccattctcctgcctcagcctcccaagtagctggggctacaggcgcccgccaccacgcctggctaatttttttgtattttttagtagagacggggtttcaccgtggtcttgatatcgtgaccttgtgatccgcccgccttggcctcccaaagtgctgggattacagacgtgagccaccgtgcccagccaatttttatatttttaatagagacgggatttcactacgttggccaggccggtctcaaactcctgacctcaggtgatccgcccacctcggcctcccaaagtgctgggattacaggcgtgagccactgtgcccggcctcagcttacagctgtcctaagaacacctgcttacactaggcagttgccagctaaatttaaatgcgtattttggaaataaccaactgctttgtaaattagagatttattgtatttagtgtattgcatataaaaaaattactgcttttgtttgtttttaagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggtaatttaaatatatattgtttattttcataaagatgtaagcacgaataaatcttctctcaaaagttttgacaaactctcaaaaccttcatcaataacaaggtatattcttcagggccttttttggtatattcacaagggggtgtttgtttcctttttcttttttccaggatatattggaacatttctgttttccttcccctgttttctacctttgcttcttcatccggatcataagttgaatgccatgtgaatatcaaaagctatcagcattaagccaaatgaggcatctgaggagctgttacagcctggaaatgttagcaatagttcattaggattagaaggagaggaataaaggggaaaagaatataaaacagacctcatttttagttcttagttctttgcaggtgctgaaggaaaggaatgatgatagtgtgtggaacaactcaggaaatcaccaccacccataccccaaaagacctgatccatggtgacaatgttttctcctgcctgtcccctgtgctctttcagcagaaatcttattaaactagctatgtgagctcttgcttttcttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggcaagacagatttagaaatcaaagcttttttatgttcatgcttttgttcatattttgaaataacagtttaaaaattattttgagatttacatttgtttttgtcaattctaggtctgtcatctcctataagacagaagaaaagcccatcttttcccttaataccgttgcaagtgctggtaagtagtttttctatgatacatattttttggcatatagaatggagagatttgtacactaaggcagacagtgtcaagatatctggtggtagctatagcaaatgatttggggctgtttcttttttagatggaatcttgctgcctcccaggctggagtgcagtggcaccatctcggctcactgcaagttccgcctcctgggttcacaccattctcctgcctcagcctccctagtacctgggactacaggcacccgccaccaagcctggctaattttttgtatttttagtagagacggggtttcaccatgttagccaggatggtctcaatctcctgacctcgtgatccacccgcctcggcctcccaaagtgctgggattacaggcatgagcccagccttttatttttttattttttattttttgagacggagtctcactgtgtcacccaggctgaagtgcaatggcatgatctcggctcactgcaaccttcgcctcccgggttcacgccgttctcctgcctcagcctcccaagtagctgggattacaggtgcacgccaccacgcctggctaatttttgtatttttagtagagacagcatttcaccgtgttcgccaggctggtcttgaactcctgccctcaagtgatccacctgccttggccttccaaagtgctgggattacaggcatgagccactgcacccggccgatctggggctgtttctgagaagtgccatctcttgacttccatgatacttaattcagtcattgtttgataactcctgctctattctgtcattaattgaaaagtcagtatctattgaggttcatcattagatttttttgtcctcaaggattgaagagcgtagctagaaactggctttgcaagttatgtttgggacctctaactacaataaaacagaagctctagaatagagagttgaacagtgttcacagctaatttacattgactgactcaattctcttgttttattgttggaataaagtcatcattgatcattgaagcatcctggaataatattctggaactgattttagttttctaaggcttttttcccttgtatataccatctattttctaatacttcatttattttcaagtatgtactttacacgttaatgtttctgaaattgagatggctctaccagccaatggaacatcatttataattgagtacatttttttctctcttaatgagaaataaagtaggtgttacaaccagtaccatttaatgaaatatagtattttgataatatatagtactgtgtcaccacttgaccccaatgaatgaattttgaaatgtacttctaaatttctacaacattaaaactacgattcataccaatttctagttctcccactctttcatgtgctttgaaaggttttccctctctcattttccagattgatacattcagatttcttcagtaatcaaatgactaagttggaattactgcacaggttgagtatcccttgtgtgaatgcttaggaccagaaatgtttgggatttcagaatattttcatatttataatgcagtatcttggggacaggacctgagtctgtacaccctatacacatagcctgaaggcaattttatgcaatattttaaagaattttctgcatgaaacaaagtttcaaatgcaccccatcacacaaggtcaggtgtggaattttccacttgtggcatcacgtcagtgctcaaaatgtttcagattttggagcacttcagattttggactttgggattagggatgctcaacctgtattacactaaattcgtttcaattcattattattcttttttactggaaaaagcattgagtgcttgctggctttgtaacaggcacatgctaatgctgtccagagggcttcataaccacgagatatagtgcagttatttcaaatgttgacctaatttttctaaagttacacatgtggagtagaatatcaaatggtttatttacacattatattttgctaaaaatatgctatcatctgtagtgtggaaatagatgacattattagaacagattcatttaccttatctagcattaatttctgctctgtaattataaaggagttttacactgaaaagctgtttttgatgaattactattccttccatataacttgaaagaaactcatcacttgttttaacagacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttgtaagtacacagtatggacagtgccagcaggagtgcttgtgagcacacagtgaatctcagctgagaggagtccgtggccgagagtagcatcaacaacattaacatgatattcctgtacctgtaagaaagtatatcttgataggtagttgatttgcaagtactgtgaaaaggtatcctatggaagatgtaaaaatatcttcataacattatttgagaggccaattttggtatccaaaaatttcttacttttaaattaagcaacagaagttagttaacaagttattctactctagtttcagattttttatgtagtgtttttgttttgtttgtagctgagatgattgacaaattgacattgacattcaaccgtacccgccaagctgtcatcacaaaagagttgattgaaattatctctggtgctgcagctctgtgagtaattgtagattgtcgccttcagagaattttttttcctcttgctgtgtctgcttgtttggatgcttaaaagtttttcgtttttttcttttgaagttgaaactcattgctgaaacttgcatcctaactcttaggctataaagatgtggtaaaaatgggacctctttgctttatttttattgtttcagctggaaacactcgggcttagttttcggttttctaaaggattaggaatgggatgtggataattcagtatcatttatgaaatctttttttggaatttaaacaattgtaagccaagctttctgagttacagggctagtttcagatttggttttacataaatctataaaccattgcatgttgggaaggtccaggaattttttaatcattatgttttttaatcattatgttttctatatcagtaccaaaagatagtatagccatccctcagtatctgcagtggattggttccagtactcactctcacctcccccaggataccaaaatctgaagatcctcaagtccctgaaataaaatagcacagtactacatataaaaaatgcacatcctctcgtatacttttaatcatctctagttataatgctatgtaaattgttgttgtattggtttttgtttttattattttatcattatttttgtcttttttccaaatattttacatcggctgttggttgaatccatggatactgagggccaactatatactgctttcctcaagaaaatttcttagttgttgaaaaactttaatgtttatgaaaaaaaggttaagataatgggaattttattcaaaaagttattaagttgaatacccactatgtgcacagtacagtgctagacacagtgttaaggatgtgattctctcttttaaggcacttatattctaataggataagaaacatacaagtaattgtgattagataaaacgtgtagtaagttctttttgactcgttccttcttacctcctgctaatcagttaccatgctctttaagttttaccttctaactatctcttgaatcttcccccttctttatgcccacttaatgcagatccttgtcatttctctcctgggttcaaaaaggtaattatttgagtgccccttaagtgtcaggccctgtgctagacactgaggatacagtggtaacagtatttgccttcagagagctcagtcttcacagtaaaggcagacactaaataagaagtcacagcagaacagaggttgctaaactgtggcctggagctaagaatgggttctgcatttttaaagggatataagaaaaaggagagtgatagcgtgtgacccacagagtgcagaatacttgctgtgtggcccttcaccgaaaaaatttgcctattcttgtgacagtgttatgaggaaaataacaaaatccattctctgttatacactcattctgcagaaacactcgatgtatgtgatcctatattttctggtcaccagcactcttcccagtccagtctcttaccattaccatttctcacgtccttgaacctcagccaccttgatctacttccagatctacagattcgtcactctttctcgcggccagggagtggcatgtgctgcagcctgaaaagccactatttcttcccttgctcccttgattcttcatctgactgcctcctgtgtatccttccttactcagctgggggaatcctttcttccagaaaacactccttccttcagtctgagtgaggcagccttctgcagcatcctgtcttccatttagcttagctcttacagccttgtatgaggaattggctttttatttgtctgtgtgctcctcgaggctaggatgggaccatatcttattcacttttgtgtccccattgcctggtacatacctccttcgtgaatgttgaatgaatgaatgaaatgccatatgtattcagaactggaagttcagaagagggacaaataacattttattgggtgtatgaaaatgtgggtccatggttttaagagtcagggaaaagttcatcactatttaaagtgttccttaagtgttacttttcaagggcagaaactgggcagaatgccagagagacacaactagaactttttgagccaacagagacctttgtgtaagttgttagttggatccatcagcctcgctatcctaagcattcttctcttattttactttctaagcacagctgtgttaggactaacccattcacagcctggtcaccaatgttctatcagcatcacagaatactgtctcatggtgtctagcttgatgaacttggttaggatactctctctgttactcagctttgtcatctgtaacatggggactaatacaaggactaaaaccttctattagccattatccttcttgccatctaccccatgttaaagccaggctgatttgttcttggatcttaagtgtgacaaagcctgcgggaaggaaccacattctgaaggtttgtgggctgtgtgagatccagagaacccaagggggtttttttgctcttgacaaacgaatgttaggtatgacctatgatgatacaacttctgcaaaattgaggaccagcctatttcttcattagaaatgcaggaaacctggccgggcgcaggggctgacgcctgtaatctcagcactttgggaggcagaggtgggcggatcacaaggtcaggagattgagaccatcctggctaactcggtgaaaccccgtctctactaaaaatacaaaaaattagctgggcgtggtggtgggcgcctgtagtcccagctactatggaggctgaggcaggagaatggcatgaacctgggaggcggagcttgcagtgagccgagattgcgccactgcactccagcctgggcaaaagagcaagactccttctcaaaaaaaaaaaaaaaaaaaaaaagaaatgcaggaaacctatttaaaagtaacagaaacagctgggtgcattggctcatgcttgtaatcccagcattttgggagaccgaagcgagtggattgcttgagcccaggagttcaagacaagcctgagcaacatagcaagaccccatctctacaaaaatgaaaaaattagccaggcctggtggcatgtgcctgttgtcctagctactcaggaaattgaggcaggaggattgcttgagcccaggagttttaggctgcggtgagctatgatcgtgccactgcacaaaaccaagaatttagaaaaaggaatccacataattggaaattgagtattaagtttttgcttcctaggaaggtagtctaaatccttatacaaaaacttagctatgcagtgccaaggttggattgcttgtgaatgggtttgcatgctctgtaacctatcagttattctgaatcaagacttgaatatttaaacatacttggaaaagaaaaagatcaaaaaacaaaataaacatatttggctatttagtaatataattaagaacatgagtaaaccatagtattcgaggtccaagtattagttgccagcctaaaaactaaatatggccaggcgcagtggctcatgcctgtaatcccagcactttgggaggccgaggcgggtggatcacctgaggtcaggagttccagaccagcctggccaacatggcaaaaccccgtctctactaaaaaagtacaaaaattagctgggcgtggtggcgggcacctgtaatcccagctactcgggaggctgaggcaggagaatgacttgaacccaggaggaggttgcagtgagctgagatcacgccactgcactccagcctgggcaacagaacaagactccatctccaaaaaaaaaaaaaacctctaaatatattgtgttaatttatagaaaaattgtaatttaaattacatattcatagtcttgcctacttgcatgagcatgtttttattgcttctaacctggattgaaatctatgactttttataacagtcattgagtctgtttcaaaggaatcttgtggtaagtatttttgcatgatgtactcaaggtatcaagtttaacaattgactttttttcattggaaagcatatgtgattaactagcatggattgcttcttgacctgcttgttttgtgtttgtctttttcttctaatataataaccagggattaatgaaaatcaagttccatcctcagacaagaggtaaagttcacacattcttcccatgtctgttcagaaaagaaacctattcagatataagttaagctaatttagtaatcctagaattgtcctctgagagatttagatggatgggccacttcacagtagcagccaactcacgggagcacctgggcaacgctagtggacttttttgtagtgagtgtgttgatcatagaaaatgtagatataaggaaataaactttgaggatagagaattaacattattttgagatattatatataggttgtgaagagtggtggttgtcacactttatggtctctggaccccttaatgtctgattcatgtagcagaagccagctagattttcatctgtctctattcattttgttgtgatgtcatggatcatgtggcctctggaaaactctactgtatactcgagaatgagaatataacaggcaaaataacattatcatgaaaatagttttgacctcatgaaccccatgaaaggttccccagaccaaaattttagaatcactggtatagggtaacactttattgtgtaaattcagttctctgtaccccacttaaatatgtattattatctcttgacattattttcccaaaaaatgctgtttgatttcttacttgttctgtactttgtttttcaggtaaagaaggaaaattcagccagttgattttgtttttagcttactgctgcctttgtccgaagaaactgttcctccattatttgaattactgaagacagcaagatatttgtaaattatcttaaaataaacaacttaaaat

SEQ ID NO: 36794 - DNA, 29155 bp, Homo sapiens
cgggaaacggcaaacagcgagatatccgagcgagagtcccgccctgcatcagtttgcggaaccgccttggtagaaggagagaaggggagtggaggaagcacgggactggagggaccaaagttccccgatggcggcccaggggtgcgcggcatcgcggctgctccagctgctgctgcagcttctgcttctactgttgctgctggcggcgggcggggcgcgcgcgcggtggcgcggggagggcaccagcgcacacttgcgggacatcttcctgggccgctgcgccgagtaccgcgcactgctgagtcccgagcagcggtgaggcagtcggccgggtggaaggggagccggaaagaggcaacggtggggagggcctggggaggggaaaactggcgctaaagttcggggtgagggggcaatgagagaggccttgaggggagaggtgagtgtggagacagcgatggtcctgaacgatgggggcgagtgaggagggggctgtgaagtgtgtctgcaggtgaggggtgcgctgtgcggggtctagagatgagtgtgtgtgtgtgcgcgcacacacacactgtagaggtgaggggtgtgtgcgtgtgttctagaggtgaggggggtgtgtgtgtgcgcgcgctctagaggtgggaggtgtgtgtgtgctctagaggtggatgtgtgtgtgtgtgctctagaggtgggggtgtgtgtgtgtgtgtgtgctctagaggtgaggggtgtgtgtgtgtgttctaaaggtgagatgtgtgtgtgtgttctagaggtaaggggtgtgtgtgttccagaggtgaggtgtctgtatgtgtgttctagaggtgaggggtgtgtgcatgtgtgttctagaggtgaagggggtgtgtgtgcgtgcgctctagaggtgaggggtgtgtgtattctagaggtgaggggtgtgtgtgttctagaagtgaggggtgtgtgtgttctggaggtgagatgtgtgtgtgtgtgttctagaggtgaggggtgcgtgcatgtgttctagaggtgtgtgtgtatctgtgttctagaggtgaggggtgtgtgtgtgtagtctagaggtgacaggtgtgtgtgtgtggtctataggtgagggatgtgtgtgtggtctagaggtgagggatgtgtgtgtggtctagaggtgaggggtgtgtgtgttctagaggtgagggggtgtatgtgtattctagagctgaggagagtgtgtgttctagagatgaggtgtgtatgtgtgttctagaggtgaggggtgtgtgtgtgttctggagttgaggggtgtgtgttctagaggtgagatgtgtgtgttctagagatgatgggtgtgtgtgttctagaagtgagaggtgtgtgtgttctagaggtaagggatgtgtgtgtgtgtgtgttctagaggtgagttgtgtgtgtgttctagaggtgagatgtgtgtgtgtttgttctagaggtgaggggtgtgtgtgtgtagtctagaggtgacaggtgtgtgtgtgtggtctataggtgagggatgtgtgtgtggtctagaggtgagggatgtgtgtgtggtctagaggtgagaggtgtgtgtgagtgtgaaggagggtggagaggtatccctctagaagtgagggtggggtagaggtgaactgggtaacagcccattgccacccagcagatgtttagtctgaatactcagaacccagaatgtgatctcaggttggaattccttgagtccagtccttccagaattcaaatttcagatcccctaaatctggaggatttctgaagtttgggtctttcttgccagtgctgcatttcttactgatttttgttccttctgtggccccccttttcttatgtttgtgatgtctttcttgtgctgatcatttttattgtcgcacatttcaggcaaataagaaacagcagagaaccacctgtgttacacaccacccagtatgagaaacaaagttacaaatgctatgggaaatattttttgaaaactagcatggacctcaagaggggcttgcactggagggtgcacctgctttgccagaggtggaagccttttgcagcattgggcctccctcctaacactacacatcctgctggctggcctggcctcacctggtccccgagctccacactggaactggactatgagactggccccaccgttaggtctaaatgaagaggcacctgctgtatagttgactgaatttgtcacctcctgctcggtgccatttctgcttgtctccgtgagcctggggcaaggctgtattccttagctctgagaaatctgtgcagtgccttcagagagacaattccagtgtcagatttctgaatctgtcacctaagccatgacaattcgttgtcttttttgtaagcctacttctgcagttactatatgaaaaatctcttgtaaagctcttagacaaatgggcatacttcacaacacattatgatgtgcatgtgtgtgttcttcccaacttgtacttttgcacaggaacaagaactgcacagccatctgggaagcctttaaagtggcgctggacaaggatccctgctccgtgctgccctcagactatgacctttttattaacttgtccaggcactctattcccagagataaggtaacaccacaaccatcttgggtaaaactgtgttctctgtctctacagaaatggatggtgcatgggccaggttgacattagctgtcccctgcatcctgcaatgtcacagaaacatcaggcagcacacataatgtgtgtgctgagctctctgtgggaagctagctttgtttctgtattagtccgttgtcacattgctataaagaaatgcctgagactgggtaatttacaaagaaaagaggtttaactggttcacagttccacaggctgtacaggaagaatggcaacatctacttctgggaggcctctgggagcttttacttcagcagaaggcaaagtgggagcaggtgtcttacatggcacgagcaggaccaagggcagagggaggtgccacaggcttgtaaacaactggatcttctgagaactccctcaggagaacagcagcaaagggggaaatccacccccataatccaatcacctcacaccaggccccacctccaacataggggattacaattttacaagagacacaaatccaaatcatatcagtttccaatagtgattgtagatctcccgctggttgtgggcagaagaaaatttcctaagttagcaagttagtgtgagaatcaacatgaggacatcaggacatggccatacctgtcacactgggcctccacatctggccagttctaaataaccttcatcctaactggcccaatggcctgaaccttgagtaattcagaaaactctcaatctcagtatcctcccgggagaccagtctctccatttaacgggtcttaagattatatttatttagtaccagtttatttaagaaaaccacatatctatattctgtatacactctcaggtctaataaaatgaaaataatgagaaaatttccataaaacccttgcttaaaacaatacctcaagtttaaggaatgctagacaccatttttgtttctgtgacataaacattgttaacctgattttttccattgtgtgttatttgtaaaggcaagtaaatggaactgtgaggttcaaagatagaatagactgaaaacatgatttttgagtatatgctgtcttttgaaccttgctgccctcctgtcactaaaagtggggaagctgactttttaaccttctgtttcatagattcggtgctagttgatgaactcagtaaatacttccggggctatttgtttgccagtcattggtgctaagggttaaggatgtaacagtgaaaaacagccctcacccttggggaccttctagtctaaatataaactgattggactactgagggtcagatgaaatagtgactgggggatttgtgttattgttatataaaaacactatggtggaaactataaagtataatataaaagcaatgtgtttttgaggcacttgacactttaggaagtgctttttgtgactgcttattatcctggccacagctctggaagaagagaaagggctcatgctctgcattttccagaagtagaaactgagaaacagggagattgcatgccttgctcaagattacatatctaatacatgacagagccaggattccagcccagttcccttgatcatttttaatgtaggggatcttaccacatgcacgtatatttagtactagtgagaaaatattccattaacatttgcatgataccctgggaataaagggaggagagatgctagcagtctttgaatgaataaataaagacaacgaaaaagaacgttcagttgttgtgcagcaggtcagagttgaatgagaactggattgcccaacttgccttgatgatattgtgcctgaggagtcggttttgattctgttttgtattttgatgttttgtttgtctttccttagtccctgttctgggaaaatagccacctccttgttaacagctttgcagacaacacccgtcgttttatgcccctgagcgatgttctgtatggcagggttgcagatttcttgagctggtgtcgacagaaaaatgactctggtaagactcctgcacaaatcacaggagacttaagaactcctatttactatgcattaccatttgtgctaaatgctttcatatgcatttatttcacttgatcctctccaagtcctctgagataagtggcaagaatagttaataataacaatactagagaatacttaactttgcaggtgccagtctaagcactctctctctctctctctctctatatatatatatatatatacacatatatatacacatatatatacatatctatacatatctatatctatatatacacacatactcatttgatgcccacaacaacctcatgggatcctatcataatccccattttgataaatgaggaaactgaggcacagcaagattaagaaatctgctcagggggcatagctagtaagcagcagacagtctgactccagagcccattttctcaactttgcacaactctgccttactatcctcatttgtccagagggggaagctgaggcttagggaggttaaatgactggaagtggtaaggctgggtctcagtcctgtcctgatggattctgaagcctgtgctctgtaacaccactccaggccgccggcagatatttcgagatccaagtcacaaggaaagttagagtcacaagagctggcctgaatgttctgcaaacactcctcattcatccaactgtggtgctaggagctggagacacagcagtccccatcttcagggaggttatagcctcatgggggatatcagctcgagtgatatgggctataatgcaggaaaaatggtgttcgaggagtagcagagtgagacaccagcctccaccagatcatcagggaagcttcagaagggaggctagcaaggaaaggaggttagggagtgtttccattatgaagactggagatccttcctgggtatcagagttacttcaaaagttaacctaatatcaggccgggcatggtagctcacgcttgtaatcctagcactttgggaggccgaggtgggtggatcatttgaggtcacgagttcgagattagcctggccaacatgaagaaatccaaactctactaaaaatacaaaaaaattagccaggtatggtggtgcatgcctgtaatcacagctactcgggaggctgaggcaggagaatccctcgaaccctggagaaggaggttgcactgaggcgagatcataccactgcactccagcctggatgacagagtgagactcggcacacacaaaaaaaagagttaacctaatatcagttctgtttatttctcctccattcatttgtccatcaaactaaaatttatagtgtctactatgtgccagaccctcatcttctagacagtaggaaaacagcagagaataaaacatgaaattaataccccatgcttacattataggagggcagataagacaataaacaggcaagtgaaatatacagactgccttaagattataagggctatggagaaaattaaaacaggtaataaggacaaaaaagattgagggtggagggccagggaaaggaaagtgttgcatttttacctagatgccgagggaaaacctcactgataagctgatatttgaacaaggacctgaaggagatgagaaagagcattttctgatgggagaacagcaattgcaaaggccctgaggtgggagcgtgtgtgacatatttaacagcaaagaggacagtgggcaaagaggaaagtgtgagctatgaggctagaggaataaaggagggccaggtggcacaggatgttgtgaggcctctgcttttcactgtgagtgagatgggcagcattgcaggttccacgtcaaatggacacagccattctttcaatggagaacttccaggaagcttttgtttgatgatgctgcagagggtggggagaaggaggggaggaatgtgatgaaaaacacataaagaaagggagagccttccagaaaaccaccagttatttcttcttcacctcgctgcccttttctatctatgccctcctatcagggctctttgtttcagaaagaagtgaagtccagcagttcaggtcagctaaataaccatatgtgtatgtcatggaatcctgtggggccagcagcaatggtgatggggttttttatttattgacccagaaaggggcatgtttttaagcaaaaaataaatttacataaccctgtgattggtatgaggctattcaaataaaaacacatatacacaatacatctatgtaaataaacacagaaaaaagtcaagaaaatagcaaagccaaaccattgacagcagctcttttttattttatttatttatttatttatattttaaaatcattattattttttgaggcagcgtctcactctgccacccgggctgtaatgcagtggtgtgatcctagctcattgcagccttgaactcctgtgctcaagcgatcctcttgcctcagcctcttaagtagctggactacaggcacacaccaccacactaggctgtttttaaaattatttttgtagacacatggtcttgccatgttgcccaggctggtcttgaactcctgacttcaaataatcctcctgcctcagcctcccaaagcactggcattacaggccacagtacctggccttggtgctttttttaattttaattttaattttatttttgatttactcaaaaaattgtatatatttatggcatacaatgtgatgttttatacatatatacattgtgtaatgatcaaatcagggtaattagcatatcaatcatcttaaacatttactatttctttgtggtgagacattcaaaatcctctctactagttattttgaaatatacaatacactattgttagctatggccactctattgtgcattacagccccagtacttattcctcctatgtaactgtaatattgttgaccaacctcttcccatctcccttatccattcccctctccagcctctggtagccactattctacccccaacttctatgagatcagcttttgaagattccactttcaagtgagatcatgcaatatttgttttcctgtacctggcttatttcacttgacataatgtcctccaggttcatccatgttgttgcaaatggctcaatagtattgcattatgcatacatgccatattttctttctttttttttttgaaacggagtctctgtgtgtcacccaggccagagtgcagtggcacgatctcagctcactgcagcattcgccccccaggttcaagcgattctcctgcctcagcctcctgagtagctgggactacagatgcgtgccaccatacccggctaatttttgtatttttagtagagatggggttttaccatgttggctagtctggtcttgaactcctgacctcaggtaatccacccgcctcagcttcctaaaatgctgagattacaggcgtgagccactgtgcccagtctattttatctattaatcagttgatggacacagattgattccatatcttggctattatgaataatgccattaatatcagtttttgctaggaatatgaggtcaacttgtagattagaaattttttttctttatagagtatatggtaagtacatcccacatcccattgatctgctagggtctttagtctgtccttaaacattgtaaaatgtaatacattttaacattttatatatttttcaattgtataaaatttctgtttctggctaagcattatcactttcttaatcctttgtttccttgcatttactactaagataatggctaacaatttaatttttggagacggctcttctcccaataaagcaaaggtttttgttgttgttgtttgtgggtttttaaacattgttgagaaataacccagctaatacactgatgctcagtggtcagctagactcactcactagccagctatttagttctctgccttcctcacatttgtgatgagcaaaatgaccaacatctttagtatcatggacaaggtggtccctcaccaggctccttgtggattgagtgggaagaactgtggatgttaaacttgtacacattgtacagaatggaagctaagtatacatcatggaactgggatatattgtaagttaattcttctctgagatagataatctttggaataaaatgtgtttgtctacttaccccttaggactcgattaccaatcctgccctacatcagaagactgtgaaaataatcctgtggattccttttggaaaagggcatccatccaggtaatgctgggatgatatctgagtggttgagcatgtgtgggacccatagagatggaacatagtcattcagagtctgggccccaggtcatcactcaacttctctgagcctcactttccacttttaccacatcatgattcatgctctttgctatataaagttgtgagaatttaagggaataaaatacttaatgcagtgcctggcacggagaaaacattctgtaaatgttagctatacatgagggttttaattagtcattattatttccattatgtcctggttatcattagtatttcaaatcaatgattttgattgctacataaaatggggcaactcctgctttatggaagaccctaggatgctggagatcaatttgtggggatcagaaatgtccacaagactaatattaatgggagaggaactgataggagatggaggataagctggagacacagaaatggtcccctgaaggtaggtctgtttcccagagaatgatgtcaccagagttgatgacagctatctgtagctataacatgccagtgactacagctgacactctctgtcatgagaattagaatagagattacaaataaagagggttaagttcttagttcagtgcctggcaaagagctgttgactataaaacattagctaggttgaccaggtggatgtcaggccccttccacccaccaccgccaaccccctttcaggactatccatgtctttttcagtcccatcttctaccctagatcctcaggtatccactaggttgattgttagtcagggtgagaaggaccttggccaaatcctccatggtggctgcagtttggagctaagcagggggtccctcccagataaaacatattctgtttattattgtgctctgctgcccaccccaagagagcaccatttgctcccactacctgtaggtttcatcttgagcacagactccagtcagttggcagtggctgccagggcccctcattgagaactgggaggctacagagatgtcatcatctgaaagtgggatcaaacagtaactcaggggagatgtcaacattacatgtaaaggaaccatgtattttacccagtggatctgccagacttccaagagtgtgctacaaaccaccaccttatacttcctccaattctataatggaaatctcatactagtgcccacattttttgagaacttggcatttgctctgtagtcgaagcaagaggagaggtagtgtggtatagtgatgggaagcagatttgaactttagcagacaagtattcaataaatgttagcagtcattattttaaatattttcatctttttttttttttttttttttgagacggagtctcgctctgtcgatcttggctcactgcaacctctgcctcccgagttcaagtgattctcctgcctcagcctcccgagtagctgggactacaggcgtgtgccaccatgcccagctaatttttgtattttcagtagagacagggtttcaccatattggccaggatggtcttgaactcctgacctcataatccacccgcctcagcctcccaaagtgctaggattacaggcgtgagccactgtgcctggccaaatagtttcatctttatgacaattctgtgaggcagagacttttaacacccttattttacagataataaagtaaggtacagagaggtcaagaagctttaccaggattatggaactgacaagtaggggagctaggatttgaaaccaggcaggctggcttgagatcagactttcaaccacgacgttatacagccttattgcattggcatactttttatttttatttttatctttttttttgagacagagtcagtctctgtcacccagactggagtgcagtggtacattctcagctcactgcaacctccacctcctaggttcaagcgattctcacacctcagcctcccgagtagctgggactacaggtgcgtgtcaccatgcccaactaatttttgcatttttagttgagatgggtttttgccatgttagccagactggtcgcaaactcctgaccccaggtgatctgcccacctcagtctcccaaatggctgagattacaggtgtgagccacagcgcctgactctgcacacattttttttttaatatttttttctttttgtcagtgtaatagctgctcataatagtgaatgacacatatagaaaatataaattaatcacccacattcctgccacctaaaggcaacccgtttagcatagtggtgatcaggtattggcatttaagaatttaactatgactgttagcactatttggaagcaatctatgacatggagtgtattgtttggtattgtgtatcactttgctagggagtgaatccagccacctatacgtcagtgccacatatttcacctctacacctccttcattctagtataaacattttatgagggaaattacatgctccagtagtattctcaagtggagattttggaatttctgtggacctgtctcacccttgggaattcctggacttcagcccatgtatttttcacacagtagagcccatgcccctcaaatgactgttgaattttgctttgaaagcaaatacttcctatgctattgcaaatactttgtatacagacttttactaatggctggttaagatttcagacccttaagtatcatagtttacttaccattcccttgttgttgagtattctgtattagttacaatatttcagtattatgaggaattgctgcactatacatctctgtgcacagtgctcctggtagtccttagtgctgtttgccaaatatttctggcttgtcttctgagcccacggtttgcactccctgcctcatgaaattatttacacgtgacttacactggccaatcagttgcgagcgggagtgtgacttttgggtggaagcctttaagaagtggtctatgatttgtcactgtctcctccctttcctggcaatcagatattttgcagatgtgtcccagaatgaggacacttgaaacaaaaccccagtgggcctgtgataaacatgtagtgtgagcatgatataaatcattgttgtttaaagccactgcagtttcgaggttctttgctaagggagcataagctagtttattccagctgataagatactgtgtattttctattatcttcttagggtagattcccagacatggattactgagtctatgagttttttgacatttcaaggcaatttgctttccaaaataaaccagtttgcatttctactaagccatatgaaatgccacatttatcatatccttgccattatttagaactgacaatttgtaaaaaatgcacatttcatagcagaaaaatgtcacgtctttatttgctaaaaatacttggttcttctcgtagtattccaaggatagttctggggtgatccacgtcatgctgaatggttcagagccaacaggagcctatcccatcaaagggtaagaacaccagcacattcaaacacaagagagaatgccaaaatatttatttaattgttttaaatagaggctaaagaaaattatcctagtccccatctcatgcgtgcttctgtaaattcaggtaaagcaaaacagatgaatgacctggtgatcagagccatgtctatagagttaaaccattaacagctgatgaatacaggaataaaaagtaacctaaaaataaaagctaaagaagaaaaacttctaaaagctctttatttttttttaagaaaggtaatgtgtaaattaacaactgaaatggaaaagatatcatattgctttagggcttcaagaaatgtttctcagtttttttgcagattatgaaattccaaacctccagaaggaaaaaattacacgaatcgagatctgggttatgcatgaaattgggggacccaatgtgtaagttatggtgatattgatgatgataattgcacaagtttgtttttcttgtatataatatgataaagttcgtttaacattttcagtttaggggaaatgacagccttctttgcttctaatggggttggtagagaaagacaaaagcttgactttctgggaatgccactagccagtcccgagcccagagagaaagcctcctttatctgggatattcttctcagccagcgaagacagtgttcctttctgaatgaccttggtagctttggatgggtgagttccttatgcatttgtgagggtctaagccagtttctccttctggtcatttgaaattcaaaagccctcaccactggttctcagaattaacctagggactctataattaagacgtcattctcagagaacaaccagctcttcaactgggtcttgaataactggttgagaaagcttttatgatccacattttctgggaaagcacgagtttacatgtaaatgcaaacttaaactcattcttctcagcagtaaagagcactgctggcacaaactcaagataaaaaagttaaactgatttggtttaaagacaagccaacaaggccacagcctaaataaagctggacagccatgatggagattcagaagcaagctgaggccttgtccttcagaacagtccctccgtgctacatggaggaaggtattactaaccccaaggagtgcaggtcccattgaaagtgtttaggagaacttcagtgaattccctgtgtccgtgttggcccccaggaccttctaagactcaccatataaggggttatttttcccgtctcttaggcaatagattgtgataaatttgcaaactacttaattacgtaagttataccaagatctgcattccccttctcagaagacaaattatacttatttttgcatgcatgaaaaacgtgtatcgttggtcttatttttgtgagaagttgctctctctggaagttatacttgcttgttgttttaatgtatctatcttgttgcccaggctggagtgcagtggcgagatgtcagctcactgcaacctccgcctcccgagttcaagtgattctcttgactcaacctcccgagtagctgggattacaggtgtccgttaccacgcccagctgattttttgtatttttagtggaggcaaggtttcaccatgttggccaggctggtcttgaattcctgacctcaggtgatccacctgaggcttcagcctcccaaagtactaggattacaggcatgagccaccatgcccgtcctttatagttattttaacaacacgttcacttatctctgtgtccaggtgtcctgcagcctagatgtcgttgcttactaaaaagaaattctaagtagtgagcctggccccgagtaaggcattttcccgggtattggcaaagttctaaaaaatgatgttattcaacactgtgctttcttcattcctataatgcctggaattccacttctgtaaaaatttccaattgctcatttcctccctgtacactccccctctattaattttatggtggtgaggctgtttaccatcccatttcatgtaaactcagggtcctgcctgtaatataccgtgcctaataaccacagctggtggtgttgtgtatctacctctgtttgcgtttgtaaattctccctgcttaattgtgaccattagtgaaagtgggcaagaatcactgttggtacgagtgtgggaaattgccactctcatactttatcagggtgtaatttggctgttcctataaaagccttaaaatggattcaaatctttgatgctagaaaacctactttcatgaatttatgccaagggaacaaataattaataatgtgtaggaaaatgaagttccaattagtgactgggctggtggcatgggaggtaagaatttaccaagacagttgtaggtaaagaaagatagatttattagagaaagtatgaaaatatgttgcaaggatgcaactggcaggtcagcaagagactagctgactgcatggagacaaaggcttactgggcattttgcagaatggtgcttgtgctgtgtactgaagagcacttgtgcagttctgataatgccaaggttgcagtgagctaacttgcctttttctatcagctgagcgtctggtgataggtgggcatgggaaggttgtgagttatttgtgcaggaagcctatgtgtcctggaccatgaagaaggtagacttatagcttatctgctttgtctttttgctttaccctgctcctgccagcctggctcctttttcctaattaggactccacagcaacaaagtttgttgtagtgtaaatggtatcgaaatgaaagaatcaacctaggtcttcaacaagagaggacgggttccatgagttatggtctgtttatgtaagggaggccatgctggagctaaaaataatggcagagaagtgtgtgtgtgtgtgtgtgtgtgtgtctgtgtatacacacacacacagagacaggagctaaagcagactacaaaacacattggatagcagagaccctttgctttatttttaaaatcttgcagaaataaatatattctaaaagactagacctatatacaccaaaatgttaacagagctatctctaggggtgtgagatttggggtaattttttaaaatttttgtttatttgcattttctaatattttaaaatttgtatgttttggtggttacttaaaacttcaaatgaatatactgtagtgtagggtgaacaaattggcaggtagcattgtgtcgagcccctggagcacattgcagatatgtgtcactgtctggggacagactgcacaggtggctgacaccacgcacatgcactggccctggctctcccagtgctcctggctgcccagcttcaggcccggtgctggggtcctcagagcatcgtctcttgggtcctgcaggtttaccggaagcagccctttttaaaccagagacattccagttttctttctgagagtagaatatccaggagcacatggtcaaaagaaattatgtttaacccagaaacaacttcctcttcctcctcttatttgcttactttttaattatatattttcatgttttagggaatcctgcggggaaggcagcatgaaagtcctggaaaagaggctgaaggacatggggttccagtacagctgtattaatgattaccggtaggtggcctatatatcaatgtgctcttgtagaggtggtgtatgattttggaggaggtgggctgccgaaagggtattgatggctctcagctctgaaggccatggtgtcttccgggtggcttctcggtgtggaggcaaggagcactttctggcctgagtttggccagggccccacccactgctgtccagagtccatcttcacggcactggacgtttaaagaacacacagagcagcactttctcatttgctcatgcccagttctctcctcactgtgcttactgtgcagcgagatgctggagtacagggactgaggttcctatgtctttggatctctgtgggatccctgtgcatgacaggtgctaaggtgggagcttgtttgaggtatttacagacacatcttgaccacagaccaataggaaaataataataactaccacttggtgagcagctatgggccagacactttatatatttataatcaggtatcatttgtgggccttgttgcttggacattttttttttaaaaaacttggctcaagccctaaggtagttgcaagccatctctggactcaaacgcctgcctctggctctctctgccccagcccctaagactgtggacctgctgattctgcaaggggctggaatccaacattgcaaaaactgagtggttttcttgaacatttctgagtgtcgctgggtggaaatgacgtcagtggtcttttgttgcctaacacccttgattatcctgcttctctgccactctctgccttccagcagccccatgggctggatcattctcccagctgagcaaagcaccctaaacgtgtgaaccactccctcccactccatgcctcctcaagacaaggagcccctcaaggctgttctgttatctgtaccttttactcataaattattgccagtgctctcaaaagttagatgttgtttatcaccccttttaaatacaaaacaaggcaaatgtccttttctggaaatataatctatgtacagaaaaatatacaaaccatgagtacacaggtggatgaagtttcccccatttagtgcatacctgcaaccagccctcagaccaataaacagaacatactcagcatccccaggggctcccattggcctcttttggtcaccacccccatagtaaccactctctagatttataatgccattaattagttttatctgtctttaagctttaaactcagtgacagagctgagttttgaacccagctttgcatggccttaacgcacgctctttccctcctgctaccaagctcttccttccttaattgaagctccagtagtacattttaaaaaacattcaattcttggccgagtgcagtggctcatacctgtaatcccagcactttggaaggccgaggcgggcggataacaaggtcaggagttcgagaccagcctggccaacatggtgaaaccccgtctctactaaaaatacaaaaattagccgcgtgtggtgactggtgcctgtaatcccagctactcgggaggctgaggcaggagaatcacttgaggcagaggttccagtgagccagggtgacaagagcctgggtgacaagagcaagactctgtctcaaaaaaaaaaaaaaaaatcagttcttaatccaaaacagctcaatagccaagtgcagtggcatgcacctgtagttccagctatttgggaggctgaggtgggaggattgcttgagcccaggagttcaagggaacagtgagctatgatggtgccactgcactctagcctgggtgacagagcaggacctggtctcaaaataaaacaaagtaaacccctagccatcgccccctcaaaaacaaacaaacaaacaacaacaacaaaaagctcaatgatggagaaaattgtagctaaaattgttgcattcacaaccactttgctttgtttttatgtcattgggctgagttataatagccgggccagagcccaggtctccttgcccctcacggctgccctgggtctgggcttatgtgcttcctctctattgtgtccctacctcagtcagcctcagggctcttctcttccaggcctgactcagtaaagaaatgaggaagctcccatttctttattgcccataggctgtttctgtgttagtgtcaggagcagagaggatataatgaaaggtataaatgggaaagtgatgagggttaacataacaaatccaactccaacccagatgtgagaaactcctgcccctcacaattcaggtggcattgccttctgccccacatcagtagaaagttctccctgaggttcttgcccattttggagggggcttatcttttcatggcctcccttaccttctggttggtttctgccagtactgtgttgaatcagactcagtgaaaactccatacctgtttttgggcataaacaatgacagataactacttttattaaaaatatgtgcatcacatatacaccatggaatactatgcagccataaaaaggatgagttcatgtcctttgtagggacatggatgaagctagacacaatcattctgagcaaactatcccaaggacagaaaaccaaacaccgcatgttctcactcacaggtgggaactgaacaatgagaacccttggacacagggtagggaatatcacacactggggcctgtcgtggggtagggggaggggggagggatagcattaggagacatacctaatgtaaatgacgagttgacaggtgtggcacaccaacatggcatgtgtatacatatgtaacaaacctgcacgttgtgcacatgtaccctagaacttgaagtataataataaaaaataaaaatatgtgcatcaagtagacactactgaaaggtagctgagtcaaggacagaagacatggcatgccatagagacaacaatatcacgttcctgttcttccatagtcccctgcagtgatcgtgccacagagatcctgtctaggcttgcctcctacctaactccccgtgtgccaccaagacctggctcctgtcttcattgctgcttcccttcccctcctggtggcttggaacttcacatcttctccctctgttgtgcacagcaagttagctttcctctctgatgcctgagcattggccatcacccatgtggttcaagtccaaccttctgcccaaagtacttatcaggtcatacgagttgtacgtgcatacagaaatggttagaagctcaggccctagagtcagcctgcatagttcaagttcagcccttcaacttgctactgtgagaacttgggtgggttattgtggtcagctttctcaattgtaaattggagaagataaagcacctattccatttggttgttatgaggattacatgacatgatccttacaaaagatataatcaaatgtcttggtacgtaggaagtgcttgataaatgctggctaatattttcatttgttttagtttttctagatacaaggcctcactctgttatccaggctggagtgcagtggtgcgatcatagctcactgcagccttgaactcctgggcctcctgcctcagcctcctgggtagctgagactataggcatgagcgtctgcacccagataatttttagatttttttttttttttttttttgtagagccaaggtctcgctatgttgcccaggctggtctcaaactcctggtctcaagcagtcctcctgcctcaacctcccaaagtgctgggattacaggtgtaagccaccgtgctgggccactaatatttttagaggaaatagtttgtgtattatttgaggtcagagactactgtatctccaggacttttcaggcaagccataaatggttgatggatgaaagttatttaaataatcccttaaatattattttctttctgtagaccagtgaagctcttacagtgcgtggaccacagcacccatcctgactgtgccttaaagtcgtaagtaaatgtcttaacccaaatcgttctttccaaagataaccatctcctttcagaagttttcagttcacaaacatgaacatattatcagaggcagatgtaagtgtgctcattggattctggtttggccttatttttatttatatgtatctgtcttagtttttgtacaaaaagcaatcacgctacacataacgtcctgctgtgagctttcttcacttgctggtgtaatggggccaccctttaaagtttgttcatacttctgtcctagtctgttagtggctgtagagcaatctgtaggatggtcacactacctttttttttgggaggcggggggcagagtctcgctctatcgcccaggctggagtgcagtggcgcaatctcggctcactgcaagctccgccttccgagttcacaccattctcctgcctcagcctcccgagtagctgggactacaggggcctgccaccacgcccagctaatttttttgtatttttttgtagagacggggtttcaccgtgttagccaggatggtctcgatctcctggccttgtgatccgccttccttggcctcctaaagtgctgggattacaggcgtaagccaccacgcctggcccacaccaccttttatgtaatcctttctgagtcatgggctggcttggttgtatgttgttatagtagttgttttgctattataaacaatgctgaaatataatccttgattatatactttaagctgttgtgcaagtatttgtgtaggatagattcccagaaattgagttgctgagtcaaagaatgtgtgtgtattttaaattttgatatgttctgagaaattttgatatgtttcaaaaaggctgtgccagcatacacttccaccaccagtatatgctaggagtgcccattctccactcctccacgctatgtattttctatatccatatctgtatctgtgcctgtacctatagcctatcattttagcccatcttaggggtaaaacatagtgcattattgtcatttcagtttgtgtgggcaggaagatttctgatccctccacttgaattcttttccgaaatctatttactaacatcatacttatcctgacaatccaactcaagtgttctttgctctgtgaggctttcctcattctccacgttgattgaggaactcccttctctttgcttccaaggactttgtacacaacctgatgacagtgctttactcttcctagccctgctatcgttcattctgtaccatctgcctgcctcactctgccttcctctttgtgtttctcttagtatttttcattacagttgcacatagtaggtgcaccatctatgcctgtaggatccgttcttccatctacaagggaagagaactaatcagagtgcacagtaactatatgctaggcatttgctgtgtgcactacataaaatagtatgtttatctgaataaccagtacattaaagagagtcaggctgggtgtggtggctcatgcctgtaatcccagcactttgggaggctgaggcgggtggatcacctgaggtcaggagttcaagacctgcctgaccaacatggtgaaaccccatctctactaaatacaaaacattagccaggagtggtggtgcgtgcctgtaaccccagctacttgggaggctgaggcaggagaatcacttgaacccagtaggcagaggttgcagtgagccgagattgcaccagtgcactccagcccagtcaacaagtgtgaaactccatctcaaaaaataaaataaaataagagagagagagagagagagaaagagagcacatgcactggtgagctggcttgtcatccccatatagttcttattctctttttcatttagtaatagaacccttgaattttagatggttcatggctatcaagaataatgatcctagcctctctacccactgtggccaagtgacatgtgcaatttctgggtttagcacttgaaaggaagggacttacattccctttctccttttatgctggctggtatatgggcccacaagatgtggaggtgagcgtcttcaactgggcgtggcagagtaacacagcaaaaggaagccgggtgcctctgtaccatggcatcactctaccagccctgaagagttactgagagagaaataaacatctgtcttctctaagccactgtcatttagacagaagccagattttatttgatccaatgtgggtaggttcatattctcccttcagaagcaaagaaactctggctcagagaagtttatgaaggactcacccaagaccacccagctagtgcaggcagaaccaggatctgaaggagtctgagaactgtcaaaattcactctggcagatgtcttgctctttgggctggaaattaggacaacagacccatcatctccagcatgtattctaggagccaacatcccagggttcggtgatggatttaagtcctctcctcattctttaatgctattcgttccctgtgaatttggcatgcatcgtttctgagtcctttcacaggaggtaaaggatagcctgtgaacctgggtctttcctttcctcacctgaaaatgaagtccaccctcatgtcgctgctgctcaaaaaccttcaaagttacctactaccaagttcagacttctagtcccatcttccaggttcatcatactctttccagacacgtcacccacagcttctcatctggaatgtttatttcaaggctagttttgatccacttcccataagatatcatatgctttcctgctcatcagcctgtggaaacaccgttttggcagtagtaagcactctgttcttactgagttagtcagatgatctgaaattgtcagttttcttatctacaaagcctccatgaggttaccctgatccctgatctcaatatttaaaatcatagcctccatctcacaactgtggctcttcaaaaccctcatgtgactgcattttttttcttttttatagtgtttatcttctgactgacctacttgtgaagtgcggtctttttttttttttttttttttttttgagacgaggtctctctcctctctctgtcacccaggctgtagtgcagtggcacaatcacggctcactgcaggtttgacctcctgggctcacgtgatcctcccacctcagcctcccaaacagctggggatacaggcacttaccactacgccagctaacttttaaagtttttttttttttttttttgtagagatgaggtctcactatattgcccatgctggcaaattcattctttagcgcctcccacctgtcagaacatgagctccaggaggtcagggactttgacctgtttttttcactgatgatggtattctaaggacctaaaacagaacttgcaactcggtagacacttaggaatgaatgaatggatgaatagatgaatgaacgaatgaatggttggattctaccctggaaaggcatagatttaagaagaacgatgttcaaaggtgctgggcagccagaaggaatgacaaatgctctacaacaccttcagagaagtgcccagaggctgcatatgcataaggtctacattttgattgcaagaaaaagaatccttgtgtggctcacttatgtggaaaagggggaataaagttgttgcaaagattagtggtatagactttctaaggagcctggaacctcataagtcttggatagggaagtgtctgtggtgttagaattacttaggtttgtatggttttactctttgtctcattaatcagactgtcaacctatacagaaacagaccatgtaaaattccttgttgtaaaacccactgcaccctacaccaccattcctgaaatgggcaaatggtgccatcctagcaccagtgccttgggttagctcccctgctgcaggaagaataaggagaacgagggtagctcttctcacttttcctcggtatttttttttttttttttttgagatggagtctcgctctgttgcccaggctggagtgcagtggcgtgatctcggctcactgcaccctccgcctcccgggttcaagcaattcccctgcttcagcctcccgagttttcctcagtatttctgagcactttgcagtgtcaggcttccagctggcactctggagtcatcatctcattttactccaaccacattcctagaaggaagacagtttgattgtcatcaatgatgctgaggttcagaaggattaagtgatcatttaatgttactcagaggccgaagcaaaacggagatttgtctgtgtgtaaagttctcattcttcctaccacaccacactgccttaaaatgtctctgggtctcacaccacagcaggtaagtaaggggtttgcagttcctgacctgttcttccctgtgtgtgggcattctttcagtgactgttggtagacatttttgacaattctggctgattcctttgaatgtcaaggataaaactctctttcactctgccaagtttttcaccaactttcatcaccctggcaggaatttttctaatctattttttaaacattctagctgtgaatagtcatagataatttacaaaagagaaaccacaaatagcaaatatacaaaattatttaatcactctaataataatggaaaacaaattcaacaaggtgtcattttcacctaaactttcttggcatacattaaaacatagcagaaaaatgttttagagatgttattcaatgcttgatgtcactgtaaattgataaagtgctttgggaaaacaatttgacaatatgtgtcaagaattagaaaaatatcacagtctttgacctaggtcacactttagggtacttttggtgccctattccaaacaagtgatttgaaatgcacatacagcctatatgctcaaatatgttctccagagcattctttataatactgaaatactgggaactggactcaaatatccactgacaagtaaacagttacatcaaagggtacacttactggagggagtagaatatagcccttaaagacaatggtaggataatcatacagcaagcagaagaccccatgaataatccaaggggaaaaaaccaaccttagcgcttataggttataatattggccaaaaattcagtagacttttaatctgcaggattggtgatgatatgagaaaacagacatatagtactggaatgaggactcagtgtggcactaagggccaaaggcaaacatcagatcttttaacttagctggaaggctctatcctaaatgccccaggccacagagacaggactactcatctctacttgtttaggaatagtggggtaaagggcttttaatctgcaaaggtttcaaatgaaataaacaactgttgatgtaaatccacccattttattaatagttttgtggtaaatttagggacaatctgtatgttttggtatttaattattggcaatattttagagaatgtagcatataagaacagctgttggattaaacctgtgatgccagtatatgggttactattaagtaactaattctttttctttttttttttttttttttggagacaggttatcgctctgtcacccaggcatggagtgcagtggtgtgatcatggcatattgtaacctcaacctcctgggttcaagtgatcctcctgcctcatcctttcaagtggctgagactacaggagcaagccagcactactggaaaattttcttttcccttccttccttcctttttttttttttttttttgatggagtcttgctctgtcacccaggctagagttcagtggcttgatcttggctcatcactgcagcctccacctcctgggctcaagtgattctcctgcctcagcctgccaagtagctgggcccacaggtgtgagctaccacgcctggctgatttttgtatttttagtggagatgaagttttaccatgttggccaggctggtctcaaactcctgacttcaggtgatccttctgccttggcctcccaaagtgctgggattataggtgtgaaccaccatgctcagccaagtaactgattttaggcttgggatttttagtaggaagttataagagaattttactaagttttgaaccagtattggaatttgtaaaagaattaagattaaattttatacatttattaggtttactacaatcaagtaattgagaaagttttgctaatttaaagtcatttaaaatattttttaaaaaagatgtaatattttaatatttaagttgaaaataacctgaagccttgcccagtggctcatgcctgtaaccgtagcactttgggagttcagtgcgggaggatcacttgaacccaggcattcaagaccagcctaggcaacatggcgagaccccgcctctacaagcaaacaaacaaaaaattggctgggtatgttggtgtgcacctatggtcccagctactcaggagtctgaggcaggaggattctctaaacccgggaaggtcaatgcttcaacgagctgtagtcatgccactgcactccagcctgggtgacagaatgagaccctgtctcaaagaataataataataataataacttaacctgaaataacttgagtttaaaacatcacaggaattaagtaagtgtgacaaatccttaagagttattgtcagagttcaccaggtttttaaatagaacaatgtgatttataaattaaataaaagggcatgggaaaattaggcttttgagtatataaatgtaataacaagaatcaattttaaaaatcaaagtaactgcaaatagtgcagttaccccctcaagtatagtctcacattgacaagaaaaggtttttaagctacaaagtgagaaaccaatgcacagaacatgaaccgagacatgtaaaccagaagaaagcaaaacagcatgtttctatttgtgcatgataatggatgtaagtgatagaaataggtctgagaaagtaaactccaagcacctaactgtgggttccttctaggcaaaggaatagaaactggaaaaagatgaagggaggctgtcattattagtgtatctaattatgtgttattttattttttaaaaaagtaaagaaaaatgtaaccttatgttaattagttaattatttgaaagcaaaagtaattttaaattttgagtgaatcgagtctgggacattaactgcatcacaggtgcaattgtagaaaatgtccggtaggtggagcactaatacaaacctgtgggtcagatttctttagcaaaaaagagaggaccagcattcaaatggagtcaggaacttttaaggacagggccactagtccagagccatgggatatatttccaagccaacattagatggtttcataattttaaaattcatcttttagttggtttaaaagaattcagtaatttctgtttttacaaacccagtggccagatactgtttactatgaatagggtccatattttgggcaggccctctgttgatgtcttcatgtcaggacaggtttttcttcaccacttaaactctgatcatgtaatagccatcagtaggaaacctggctaacactgtgttccatccgtacaataagaattcatccacaaggaagaatgagttaactccctgtgtaccaatatggaagcatgttcaaaatatgatgttaggtgaagaacgcacgttgcagattccatttgtgcttagataaaaggatatctaaagacatctaaggataatttgcagggcagcagcaggtcctgttgtctagagaagctttttgctcaggaaagaatgtcttgagatggtatttcaatgacgtgtgtgctcaggattgcagaaataggaattagttatattgagcaggttcagcatgcatgtgttcattgcattcctggaaagagaactcaaactatcaaagttggttttctatggaaagtgcaaatggggagactaagagacttttactttccactttataacttcctatatactatgtacatttctccacagtgtgcacaatttgctttttttttttttatactggtagcagtagaatttattcaaatgtgccttaatataggcactggggcttgcctatggtgctctcgatatataaggcccggacattctgccagtttttctgccagtttttcttgagcaatgtcaccaagaagttgacaggcaggtgactgttacacacaagctcattgtctgtccttttcacgtggccaacagccacagccagacataacaccttcttcatgtggaaattgattacggacttcatctcatccactttggccaccatgttttccttgtgtgtgagcagggaggggcaatttcctgccttatttaggactgggccgaggattcgtgggatctgcttgatcagagactctgaggccaaaaatgcatcatactcttggccagtttcttgaccagtttcttattcttgttgagttttttcagtacctcgttttccatgtggtggaaatccacaggcttggccttgtcacggtgctgctggttacccaggacacacatggagaacttggggcagggagtggacttaagcctgacggtgcccgagaagcgcttgtccttctggggagtcatagttcttgaagctgatctgcaactccaccatctccagaaacttggggtgcttgcgctggtttcggtgcaggacttcgcgcaccgcctcctacggggtgtcacgggagactttgctgctcatggcttctcgctccgcgctaaccagaaaagagactaatactgcacatatatttttgagcgtagattccatacaccaatactgacactttctctatttccttgttaatttgcagggcagcagccgctactcaaagaaaagccccaagtctttatacagaacaaagggcgggtcttatcattcccctctttctggtgctggcttccaggactcaactgtaactggaaactgtgttgctctaaccctcctccagccctgcagcctccccttgcagtcatcattcgtgttctgtgtataccaaatgattctgttatctaaagaagctttttgctgggaaaacgatgtcctgaaaatggtatttcaatgaggcatatgttcaggatttcagaaacaagaagttagttctatttagcaggttaaaaaatgctgcattagaattaaagcaagttattttcttatttgtataatgacacaaagcattgggagtcagactgcttgtatattatcaaacattttaagagaattctaataaagctgtattttacatc

SEQ ID NO: 36795 - DNA, 118867 bp, Homo sapiens
cgagaccccagacgaggaccaggattcatgaaatcagtcgcaggggccggggcaggggcctctggctcccgacactggccgagaggtgggttccggggcgggtcgctgctccttgaagccgggcggggacgcgctgcccccgccctgcctccctgtggtccacaccccctttgggctccggagccgctgggcaggaatagtccggggtgcgcgcgagcaggcgctgccaaccccacttctgcccgggattccaatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcagtaagtggatcctcctctcctttgccatgggaacaggggtgggggcgggaggtgagggagcctgcgctcgggctgcctggaaagaggaaggaagcctggcatctctggacacatgacccccaggctcttttttggtgctttccgtgctccttggcagagggatagcttcatgactctggcttttcgtgataattttgccaatattttatcagcggcgccggccgcctctcctgggaaggctgctcgtctccttctagcactgcctgggaaggcctaggaagcagtgtgtggccattgtctgactgtgggggctctgaggagaactccctgcacacatctggaaaaccatggagggccctgcctgtcccagaggtgggaagagcagggaggctggcctgtgggcaggcgggagggtaggtgggtgtgggcaggcagtgggctgggaagccgcagtttgataaacaaataatcgccaagccacctttgggtctggagattgtgaaagatccagctcccgagtgcctgcagcccggtgggcccagggctggtttctctatgtacctgcaggctggttagctatccttgagaacaagaagacaggaacagccctttggccaagggctctaacatgccagaggcaacaactgcttgcagagccaggaccagatattttgctgccaggtagggcctcagctactgagaatgcagtccgaaattcaagaaggcacagtctgtttctcttcaatgtagcgctgtgacctgggagggcatatcttggttccagactcactctcctgccctcttgtcagcttggcctgtctaggttattccagcatcgcatagggctgttgaaccagagaacccctatgaacagtcacttccctgggtctatgactttgttatcagtcccctctctgcatctcagactgctcatctgtatgatgagaggggttgaattagaaagccttctaatcggccaggcaccgtgttccatgcctgtaatcccagcactttgggaggcagaggcaggtggatcacgaggtcaggagttcgagaccagcctgaccaacatgatgaaaccccgtctctactaaaaacacaaaaattagccaggtgtggtggtgtgggcctgtaatcccagctactcaagaggctgaggcaggagaattgcttgaacctgggaggcagaggttgcagtgagccgagatcacaccactgcactccagcctgggcgacagagtgagactctgtctcaaaaaataataataataataataaaagaaagccttctaatctaagaatctacactttttttcttaaaaagctagagctgagcaacaaggccagaactatcaagaccttattgaagctgtatccagccaaaacctactatttcctcacacaccccaccccacccccacctcctagcatggaagagaaaaaaaaaagcaaaagctactgagatgaaaataaaatatatttatttactacgtatttgtatgattcatctctctgctgtcttcctttgtgtattgcatatctatgctaagctagcgagtgtggctggactccctctgcctcttacagccaaagaattttgccttttgattttgacaggctggaatggtgttttggcttcataccaggctcaggaaaagaggaaaatcctgtagcctctatcagctagtgggtcacatgtttgcatttgcatgttttcaggcaaataaagatgtgagttgcctgtcacttctcactatctctaggaaaaaaaaatgtatttatgagagtcctttcccactaagtgacagaaaagaaagatggctcatctatttttcaaggaactaagaaaagaaacaggcaactgactctgcccttttctctctctggaatgctaaggaactcttgtcctattagtaacactgagtattcctgaaagaaggaaacagactatccttcttttaagaaaaagaaagaaagaaaagaaaaaagaatcaatagagttggatactgcagaatatgaggactggcaaaaatgccactactttttataagcagggagagtgtgtgaattttgcagtaatggaaaatgaacagaggagaatggctcagcagccttggaagccctccgggttccccccaggaggaagtgcttctctaaacagacacctgggggacacagcaagcacagagctttgagggcttaactccatcatcatggaggtacctcccaaacccacgagtctgcaaatgcagagagtagacatcagacctcacaagaaaaggagtaacagagccatagggtgatatggatagggcattggcaggaggtccttgggtcacctgactaagcaaaaaagctcccctttgagatgtgaaattcttaacttgatcctcatgcctgatattgtccctaatagaaactcttgcttagtttttctttcacttctatttatttagtccttattctccaccagccaccatgctaagcactcccctgattgagctcaccagactgtcccacccaacctgtgagatgggtgtttttactcattttatgggtgaaaatttgaagctgtgttcagaaacgttgtagttaatgctcagtggcttcttcaagtcatgcagttaattgttgggttatgaaaggtacttggatgtgtaacacatttgacactgagtacaactcctaatcaatgattcaaatgtcaacactgaaatagaggcaaagcatgagattacaatcatccctttgtacacatggggattggtaaaactgtgcatactaagtcctgcagtcagccctgtggaacctgcttatacaaagagtcagccctcagtgtaggcaggtttcaaattctgcaaatactgtatttttttaaatttcaacttttattttagattcagaaggtacatgtgcaggttttgttacatgggtatattgcatgatgctgagctttgagatacacttgattccatgacccaggtactgagcatagtacccaatagttagtttttcaactcttgctctcctccctcccttccccctctagtagtgcccagtgtctatttttgccatctttatgtccatgagtacttaatgtttagctcccacttataagtgagaatatgcagtatttggttttatgttcctgaattaatttgcttaggataatgccttacagttgcatctatgttgctgcaaaggacatgattttgtccttttttatggatgcatagtattccatggtataaatgtactacattttctttacccagtacactgttgataaacacctaggttgattccgtatctttattattgtgaatagtgctgcaatgaacatatcagtgtgtgtatccttttggcaggatgacttattttcttttggatatatatccagtaatgggattgctaggtcaaatggtatttctgttttaagttctttgagaattctccaaattgctttccacagtggctgaactaatttacattcccatcaacaatgtaaaagcatccctttttctttgcagccttgccagcatctgttgttttttgactttttaataattgccattctgactggtgtgagatggtatctcattgtggtttggatttgcatttctctgattattagtgatgttgagcatttttattttttcatatttattcgccacgtgtatgtctttttttttttgagataaggtctggctctgttgtccaggctgatgttcagtgtaacaaacatggaacactgtaggctcagcctcccaagctcaagcgatcctcccacctcagcctcctgagtagctaggaccgcaggtgggtgccaccaggcccagttaagttttgtatgtttattttggtagatatggggttttgccatgttgcccaggctgatctcaaacttctggtctcaaatgcttcagcctcctaaagttctgggattataggcatgagccactgtgcccagcccacttctatgtcttcttttgaaaagtgtctgttcatgtcttttgcccactttttaatggtttttgggggcgtggggtttgtttttgttttgcttgttgaattgtttaagttccttatagattctggatattggtcctttgtcagatgcatagctttcaaatattttctctcattctgtaagttgtctgtttactctgttgatagtatcttttgcagtgcagaaactctttagtttaattaggtcccagttgtcgatttttgtttttgttacaattgcttgcaaggacttagtcataagttcttccccaaagccaatatccagaatggtgtttcctaggttttcttctagaattcttatagtttgaggtcttacagttaaatctttcatccatcttgagttaatttttgtatatggtgaaaggtaagggtccagtttcatttttctgcatgtggttagccaactgtcccagcaccatttattgaatagggagtctttactccattgcttaattttgtcagctttgtcaaagatcagatggctgtaggtatgtggctttatttctgggttctctattctgttccattggtctatatgtctgtttttgtagcagtaccatgctgttttggttactgtagccttataatatagtttgaagtcaggtaatgtgatgcctccagctttgttctttttgcttaggattgttttgataatttgggcgcttttatgagttcacatgaattttagaattgtttttctaattctgtaaaaaatgatgttgctagtttgataggaatagcattgaatctataaattgctttgggcagtatggctgttttaatgatattgattcttccaatccatgagcatggaatgttttttcatttgtttgtgtcatctctgatttatttcagtggtgttttgtagttctcctcgaagagatctttcacctccttggttacatatattcctagggtttctctctctctttctctctctctctctctctcgctcgcttgctcgctctctgtgtatgtgtgtgtgtgtgtgtgtgtgtgcatgtctcttgtaaatgggattatgttcttgatttggctctcagcttcagtgttataggtgtatagaaatgctactaatttttgtacattaattttgtatcctgagacttcactgaagtcatagtttttatcatgaaggggtgttggattttagcaaaagctttttccatatcttttgagataatcatatttttttgtttttcattccgtttatgtggcgaatcaatttattgatttgtgtatattgaaccaaccttgcatcctgagaataaaccctacttgatatggtgaattaacttcttggtgttctgctggatttgatttggtagtattctgttgaggatttttgcatctatgttcatcaggaatattagcctgtcattttcttttttcattttgtgtaaatactgtattttcaatctgcctttagttgaaaaagatctgtgtaagtggacctacactattcaaacctatgttgttcaagggtcatctgtataagaaattcctaatcactttatctggagaagaggagcacagggctgtggtctttgagcagtgataagagttgatagagtgcaggccctggaatcagactgttccaggttccagttctcatttttttatgtgttagatgtgtggtcttcagtatggttgtctcatgagcaaaaaatgaaaatgatgaggcatacctcagctgggaatggaaaccaaatgttaatgtttagtgtagtatgcagagtgtggtaccttggctgtgggcacagctggcatcatgtcagtgatgggtggtcacactgtcatgatcactgtgggcatcattgtggctgtcattgtggattttatgacactagcaagcaggtcacgcaacctctcagacttcagtcacatccttctcatgaattgagaagcacacctgaagtgtgattttttaaggattaaatgggattatgaggagatgttttataaacatttgtaaattgtttttactaataaaaaaatgcttagattacaaaaacaagagcatgcttagtcagtggctcttcagagtgaattttagtttcattagaatcctttcttctgaaatctagctgaatattaagaaaggggtaattttggagatgctggagtgaggtggtgggcagacctaggtagagcacagcaggtggggtctggtccttattcaggagaaaatagacaccaaacatgtgagcaggacaccccaggcttggaaaggcctgggctcatactgagtcagtacactcgcttcgctgaaggacttcagaggaaaggagggaaactggccaatcattgccactttgtcttctgtagggtagatccaacatccagcctttctttctctcatgaactctcaacctattccaaggatctctcatttgtctcctgacctactgaggcagcctctaactggcctcctttcatccatgccagcccccttcagcgatcggccgcatccctactctgtatcacactctgcttaaagtgaggctcccatgctcccagggtgagaaaggaaactcctcagcaagcctgtaaggcccgatgtggcctgctcctggccttgctgaccagccccatcttgtctacagtgcacagttctcagtgtccttgtcacatgtgccttctcccattccctctaagggtttgctcctgctgactttacatgcatggttccttctgccgagaaagccctttccccactagcaccagcccctctgcccagccccacacttcacacttcaccaaggctggcctcctcaccctccagagcatcaagtgcaccaagatcaatggtaccacatactgctcctactcattttataggcttcctcctgcctctagcccctttgttggtctttaccatggatttgtatgctaacaaattacttttttagagtagactttgttctgttgaagagagtattgaagggtcaaataactcccacaaagatgtcatgggataagtagagaccatgctgggacagcaagaacctgagctttggggtatggattctcgagttcaaactcaagatctatcatgtactctctctgtggtcttggacagaatagatcatgtctctgagctaaattttaccatgtataaaatatgagcaataaatgccaaggtgcagggttcttctaaggattcagcgaaataacattagaaactcacaggcattgggtctcagtgaatggagttgagtctgaagttgagttgactgttgagtaaagcaaagttctggaaagatggtgtcattaaaactaaatcctctgattaaaaattagtctgttcttctggtattacagtaggtgatggattttctacataggaaactcatagctcccgggaagcctacaggaagcttattaacctggcattgtatatggcatgggttgaaaaagggaagacaggaagttaggatcccaattgtcctagttcagaaaacgtctcgggccaaaatttggatggttataaaactagaaataaggggaaaaatcttttagaaaataaagactgcatggcctagccactgattgttttataaggcaaagaggaaaaggaggattctattaggtagggtcttggcagagaacagattggcagtttgagaggagttaaatggaaggactcttcacaagtgtgtgagaaggacattaagaaacaaacaaagagaagcaagcatgacccagtaccaggagcctagtaactgtggctcatgacccactgctaccacaactgcccctagctggacccagagacccagctggctatggggtgaaggctgcctgacaggaactgtggctgtggccccaggaaggcagccagcctagttccaaggaaagaactaggaggataaatatcctgatcctcctcttctctctccctcagatctcctatgggtacctcccattggtcaaatccaatcaggagccagagggcaaggaaggcatttgataggttcataatggtcagcagcttcccagggcacagtccagagtagggaagcaggcagaacggatctggagaggtgagggagttcagaatagaagacacccagcacacggggcatgatgaccttcctctgctaatgccattgcccagatcaagaaatctaaggatccctgaagacaggatcctgacacacaagaacgcagtaggatgccctctctagaaattctacatctgcaaaacagataaagtagaagtgattatttactccacaaggatagagattgttttaaaacagtacttcccaaatgaatgaagcagttgttgacagatgattacctgaggctaagaaggggttagaggaataacgtaaggaacaattttaaaatcacccaaaatgactataacacatctcagaaaaatcacaacgtgatttcaagagcacttggattgcgtaaaggaagtgatatcaattctgaactccagctttcctatctggcaaaagctttatcttgctgagatagcatctgctgtggtgaacggtcaacaactggctattacccaactttaggcagaaaccattgtaaaagtacagaaaacaaccagaagtatctgaacaccttcgactttctgggtattttgccagataaattcttcctttgcagttcttaagggcacagactgaagttaggttgctggactcaaattctagccctgcttgtactttctgtgtatccttaggcaagtcacttaccttctctgtgcctcacttcctcatctctaatgataattacaaggaggcaaataatagtgcctctgtcagagaagagatataaagaataaataagttagttgtgaattccttaaaacagtgcatggcacataacaaaggtttctgaaataaatagtatatattagtttgctagggctactgcaccaaagtgctacaaaccgggtggtttaaacaacagaaatgtattgttttatagctctggtggctaaaagtccaaaacgaaggtgttagcagggttccttctgaaagctgcgagacaaatgtctactcgaggcctctcctttgcttggagatggctgcctttctccctgagtcttttcacatcacctttatccatgtgtttctctgtgtccagattcccccttccacagggacacccgtcacattggattaggacccatctaatgatttcattttaacttgtttatccctgtaaagactctattgccaaatacggttatattctgaggtactgaggggtagggcctcaaatatgagtttgtggggacacaattcaatccataatagagtgtttgttaaggaaatgactcctcaaggagattttcttgtgttttggtttcccctgaatgtcagccactgtccacactagcgtgagatgctaacagttggttactaaatgcaagtcactaagtttatctatctagtcttgatgtttaaaccctcattttgctatccctgacccatggaggtagaccctctcttcctaagaatctgaagggaagtgctcttacataggaggtccccacatgggaagaccccagtaatttagtatgtccacagccagtctgtttgccacactttccaccccacctggtcatttcttacaactgtggtgtttcaatagtgtaagggaagttagtcatgacattcgtttccaatcttcctagttcctgggcctgtccaacacagggaataagaattggattgttcatttgtttattcatcaggtatttactggacaccagctctgcactaagcataatgctggagatacaacagtaaatagaaccaatgtggcctttaaaatcatgggtcacacagctgggcaaaatgtgcctcctggtggccaatgtaaagggacacgtcttatttgccctacaccaggtttttagtgaatttgaattatttgccaacaatgggaaattgggaaatcagaagtgggatttctggctctcttaaaaacaaaatgaagtcggaggattttgcagccctgacccaatttttcttcctaacagcaatcaataggattgcctgctttggatggggtatatacttagtttctggcttgccacaattatcacttcctattaaattacacagtgacagcttaatatttttatgtcaccttgccactgcagtccagtagatgatccataaaacatcaaatatgtagaagtgattcttcacacagagatgtggaagctgcagcacatctgttaatgattatgggagaaaatcctgtctgaagttagcaattgattaacattgccatgatattaatgtcctcatgaagtgagcaaaaccctgccacatgtccttattcccccaactgacccattcccagaagggtgatgtcatatcctgttggatacagttaggcaaataacagggcaaacaatatcctgccctgacctcctggaggtcagttttgttttcagagaacctagtaaaagagagtaggacacagaacaaaggagggcaattctggataactgatcccagatctgggtaccttttctagcccaaaagagggcgtctgaggaggctgaactgttccagagaatgttctgacatacgggacatgcctggtccagttgagaacatctagtcaacagcatgagctctgtatgggttgggtgagtttgattacccacccagctaagggatgactgctgaaaggccacaacaatgattgcatgtggctactcacaacctttcctctgtcattatagagtcctcctgcttgagaaagtagatcatgccaacataatttcttctgtttagggcagattcttccttattcctcaggaagaaatcaaggtagcaaataattcacagaaagcaaagcacagtgtctggcacatagtaggtactcaaaagataattgatgagttaacgcattcatgaaaagcccactctctctaataagccccaggataaagatagataaagatctctttcctaagctctagggtcatctttctgatcatctgctaagatggctactagaatattcccaaggcacttcaaaatttaataaatttactctcttaagaaaacaaaagcaaaaagcctaccttagctcttacagtcctggttgatctatagaacctctatctacccagtcataagtcagtgattagaaagcagtcttctgagacacttccctttcctccactctcctgtgttccatctgtcaccacatctggtcatttctacctcccaaacatgacttgaactcttcccctcctcaatgaccatcactccctaatgtctcctacaccaggcatggcagccattggaggaagaggttaggggagcaggagttggtctcaagttcagaaagaggcaactgagcagtacggcctacaggaaaaaatgtgatttcaggccatatggacaggaggtgagagtcccactctgcagaccctgatcaggctctgtttgaaacattatattcagggaagacagtgatcagcccgtatattcccagaaatgagtgaccggaacagtggaaggacttgaaacatgctggggagaggatgttgaaggaacagtaggaagacgccaggcagctccacatgttggttttgtgtctgcctgagagtatggatggtccctcagtgatttcagattaggtttcacctggctccctaaacatctcttaggccttttttctaagggtgtcaccagacagacaaggagaacatacaggctccacatgccgccctgctgttcccaggggctgtggtggctgtttgtgtgcctgtgctacagccccaccttctctcgcagcagaatgctactctctagtgcctctatcatttccaaagcttcgtcctcacatctgcttaattttgtgcaaagcacagatctttctccatgggctgttactcttgccctcaccaggccagcagggccgatgaagcaactgctttgcaatagtctaatgacacagctgatctattttaagcacctgaagcacactctatcaagtgccaatcttcccgctgcaagtcacgctcagcttgcagcagcaggggcagcccaaggtctattcctatgttttgagatatggggaaacagcccagggatcccagccctgcccgtctggtgatagtctaaagcaaccataaaattagatatttttcacagtcagcatgagttgttctcgaaagagagttgcctgtgatgttagcattatatggtgcaggaacctcaggtgattataaatccccctttcaactggcagagacagagcctgggcctgttacatgtagggagaaggaacttgagaggcagcatttcaggaactgaagctcaatccccatcagaaattccttagactcagactaatgttttctcctcctcctcctaatccagagactcttttccaactgcagcctgagtgcaaatgttttacatctattattttatttaatccttacaacaatcttacatgggccttccttgaattctgtgtctagggaatatccccatgttatatttgctctcactattcttcacagagcttaccatagtcagtgattattttgttcattagctcattttctttgtttctttctctcatcctcctttgactataagccacatgatgattgtgtgacaaaccctgtctgttttgttcactgctgagtcctgcacactcaacatggtgtttgatgcagagtgatgatcacttataaaagcatttcttggacacatgaatgagcccacttacgcttcacaagagtcctagaaagaggacactgacattgttctcattttacaaagaaggaaattgaagcccagagaagagatatttggctccaaatcacaaagttaagaaaagtgatggagccttgagtgaatatgtggatggattcatttaatgaggaatacttcaatatcctcattttacataaaaggaaaatgagattcaaaggtaaattgcctggataaagtcacatgagctaggaagcagaggagcagatgtttaaactgtgttggtctgaccctgaggcctcctttccctcctccctgctcctcctttttaccatctttttgtatttttactgtgatggagatctccaggggaaacatggattgggatggctgatcttcccgttggatgccccagcactattcactcattcactcgggcagtgaaacaaatcttcacgctgtgagacagtgacattccatattctaggcaccatgaaatcaatgatgcacaggacagagaactggacctcagactgcttccatccagcatcttggaggggcagacagaagcatgcatgactgtgatgtgagataaaccatggcgggtgctgagagggaaggaaagagtacagaggaagacaggccaaattcctctggaaggcctgggaatgcttgttggagaaggttccattcaatctggtccttggggcagggaacaaacttatgttgtgtagggttgaaggaaaagaaagagcagtctagatgggcttactcattcctaggcaggcattccacacaccctaatgcacaattcctgagtcctgggcctttgtctgggtactgggatggagaccgaaataaaaagacagaaagccctcatcgggaactgttaggaagtccagtttgtatacgctagagaatatgagtatgtggacactgagaaaacgctgggagttggtgaggatcagctctttgagagggtcagatgccacgctaaacagtatttgttacaatctacagccaatgaggagtcaggagaggtttggagcccagtagtgacctgcccagagctgtgcattatttaggaagatctccccagcaacacatacctcatgcatcagagggcctggaggcagtgagaggcagacctagtgcagcaatgcagttgtgagtggatgcgagggagagtgtggggatgcagggagaatgagctcccagttgttctgcagccaagctgtgcatttctgcaactatgcccatgggtgggcttgctgtatattctaatacctgggactgtgaaaactggtactttgaaaactaggttattgaccaaactgagaaggctagatcgtatatttgataagaagttgagctatagaatcagactgcctgggtccaaattccagcttgacccttattagctgtgccgccttcagagagttgctttttaccagacccccaaacgtcaggttcctcttaagatggggatgataggtgaactttaagtgagtgaatatatgtgagatgcttagcacagtgcctggcacatggaaaatactcagtaatgattaatagtgataagtaatggaacacatttgaatgtactattttgggaaaaccccttttaaagatacaaaataaccaacacatgctattgttatgatgtagtcaccacttggtcattccactaggaaagaagagtggtatatatattggtaacacaggactttttaagctaacatttaaggagcacttattacatgtaagaccctatgcaaacattttgcctgtattatctctttcagttcttggcatgagtcaggtgtgaaatgaatgttggagagggcaattctgattaagcagggaacatgtcacattagtccagggactggcaaacctttcctgtaaagggatttgcaagccacacagtctctgtggcatgaaagcagccatagacaatgtgtaaagaaatgggtagagctgtgtaccaatcgaaatgtatttagaagaataaaggtgaagggtgatttggcccgtgagccggtttgctgacccctatactaaatgacctcgaaggtcttttgcaactttgagattctagtctgagattctagtccaaaatgatgacaaagaaatgttcaatccttctaatttagtttatctctgtaatcacaaggggtgttacttcaaataagatagagaaggtcattgggaatagacacagagaggaccagaaagcgttccattctttgtgttgccttcatagtcagcacacctcattaactcacactctgatattatatgagtcttctcaagtggccattaaatgacaagctgcacaggctgccctgggatctgcagagtacacagttcttcagaggcagagaatgatactcagaccagagactttcacatttgggaaggaacatacaggacaatattccatgccaacacttcagtatgcggagcaaatcctccccctttgctcccgattcacatttcctactcacagcccacatgccttgtagcctaatatgatagccagggtgtctgctcagcatgttttatccttcctccttctgattctttataagaatttctctccatctccttgtcatactaatggactgtcaccatggtgttctgtcccccaccccccgcccctgagaatgacatatgacttatgctagccaatcagagtttcccatccaccttggccacaaggatttgctcatcagtggaaattaaacccaagacaggccaatcagagtattccctggaattggatagggagatattcagaagaagaagtgtttattccattgagattgctgagctaaggagaaaagagtgtgggaataccagtggccatgattgtcaaacatgaagaagccatctgcaaaataaagtcttagctctgaccgtataggaaagcccctaatccagccatacctgaaggcagagccacctcagaccccagacttcccagttgcaagaaccaacaaactctctttttgcttaaactggtttccactaggtttctgtaaagtacaactgaaagggtaccaacaaaggcactttttaaaaagcattatttccagttggcagttgcccttataatgacctcttatttatcaacagcccagccatctttaggcttaaatattcttccaccctgctacctctcattcactcctgaagtgattttattccctcctctgaagtccttggcccttagtttaaaacattcttataattacaggtcatttgctgtgagtcaacataatttattcatgtgcatttcttagtgccctctttcagattataaactccttgaagatagaaatcacgtgtctatggggtataatgtatttgttccccaactgcaagccaaagatcactgtggagccatggaattattgctggagcttacaaatccatgtgtgctcctaattcaaatgcataatgcctgtcaaatgaatgtgtttgaaaaaagttaatatggcagaaagctaacatgtaagtattacttaaatgtaatactaatatacagaggataacaaatattttttatgttaaaaaaggaatcctcaaatgatctaaatgtggttgcatggttgtatatatatgtaaaacactttgagctgtatatttaagatttatatacttgactctatgcaagttatgccacaataaaaagtaaaaaataaaataaaaataagaagtccttatacttgacaagtctagtcaaccatcactagtactgttacaagatcaataccaatacactaaaattaatccaggatagatcactgacctaaataaaccaaaagctaaaattacacagcttctgcaagaaaatgtaggagaatatcttacaacctcaagggaggcaatgacttcccagaacactaaaatttgtaaaaatgggcaagaattctaacagacacatcacatgtacaaatggttaataagcacataaaaaggagcttaacatcattagtcatgttaaatgcaaattaaaaccacctttttacagcctcccaaatggctaaaattctggtgaaaatgtaaaatggcacaacaactatggaaaactgatacagttttataaaaattcaacatacacctacctatgatccagcaatgcctctcctagatatttccctgtgaacgataaaaacatatatctgcaaaaagatttatgcaagaatgttgctgtcagcttgattcaaaataatccaaagctggaaacaacccaaatgtttatatatagacaaatggataaacaatctgtgattatatttacacaatggcatactattcagcaataaaaaggaacaaactattgacacatgccaaaacatgaatgaatctcagaaacatgctgagtaaaagaaatcacacataaatgagggcatactgtatgattccatttatatggaattcaagaaggcaaaactaatctatgtggacagaaattataacagagtttgcctttgactgggggaggggtgattgattgcaaaaggttgcagcaaattatctagagtgatagaaatataccttatcttgattaaactgttgtgggctatacatttgtcaaaacttattgtatttaaaatctatatgtttcattaattgcaaatcatgcccaatttaaacatatatgcgtgtatccccttaaacagagtatgtgtgtatatacctattcccttagatagaataggcttgcaaacagaagaactaacttgagatctcagctctcctgctaactctgtgacctctgaggccagtatccttatcagttctatggctccatcctatcagccttgcttacctcaaagagctgtttcaactatgtaacacctgtaaaaatttttggtaaacctttaagcgtcgtacagctcaagaacctcctctccaacttattttgtgcaagcatctccctggccctgatgttctagctgcactggcctccctaaactcaccatgtgctttctagcctctggacccttccttgcaaatgctgtttctccatctcatttgtacttatccctggttttccacaaacagccctctcccatccttgtagtctcagctgaaatgttttacctttagattacctgtccccaccccttatttatttccttcattctacttgtcacactttgtaaatatctgtttacttgtcacagacccttcccacagaatgataaactcccaaagcatagcaaacattagcaaacaagactgttttattcactggagtatccccagttcttagcacatagaaattacccagtaaggctaggaacagtggctcacacttgtaatctcagcactttggaaggccaacgtgggtggatcgcttgaggtcaggagttcgagaccagcctggccaacatggtaaaaccccgtctctactaaaaaaaattacaaaaattagccaggcatgttggtgcacgcctgtaatcacagctactcaagaggctgacacagggaatcacttaaactggggaggtggaggttgcactgagccaagattgcacatctgcactctagtctgggcgacagagtgagtgagactccgtctcaaaaaaaaaaaaaaagaaggaaattactcagtaaatattgatgaataaataattgtgccaacaaacatgaactttggtttataaactttgtaacctacttgtgctgatttgggactttctgcttggagccaggtcttccctagggcatggtgggtgccaaaaaatgaccccaggttaaagttggtgtcactgtagtgtgctcactcaggaaaagctttttgtgtcaagggactcaggaaaggcttaggacatcctgtgctttggaagacagagacactttctagttatggctatacttgatggcccatctgttgggctgtaagctgggggttctgtgtgcacctccaggctgggaagaatctgaagtacacacaggctaactgtctaacatgggggaattgtcctccatctccagggccctcctcatcccaggcccagcagtgggcccaagagcgagtagaatgaatgcccgtgttcatatcatcttattcagctcctttcccatctctcggccagccatggggcttcttagccctaatcccctccctctatctcttcccaataatcagaccaccttctttcttgggttttccgggtgtggatgtggctgccctcacccaggccatttctgtcctttgagttagtcccaggtccggagcctgtcctctagcccagggcacctgggcatcacccacagctcatctgcccgcgggagctctctgaaaccttctgtttacagtggaaagtgtttgctgacctggattgttttgggtctgtgacatcagtgctatgggaaatgctccttagccagtagcaaagtccacttgagggtacacacttagagaatgatccgggaaagacttagggactccgagctaggtgagaagtccacccttccctccacctacttcctccatggccaaaattctgccttccctctctgcctggctgtctctcttgaaatctgtattcttttcagcagataatgtcaataagccctttatgtgagtaggatttggagcttctctgtttctcatctgaaaatctgccctgtgccagtgagtttgggcctctggcccacacgttaattattgtaccaggattcctggagtcgactggggacagagtgcctctttggttagaagaggggtattctggcagtatttcttttttgaggcattaatctagcttagagaggctgagcaagtgaaaatcgttgtgtgttcctttgatattttttcctttcctgtttgaatgccacacttagctggggtttgggaatcaaatgttaatgaatctcttggggtttcttgaatttaattgtaatagtcattttttctgccattagtaccaaggaaaaaagccaatattttagggcacagaatggtagaaaggggtctactttgtgtgtgtgtgtgtatgcgtgggctgtgtgtgtgtgtgtatgtgtatgtgtgtgtgtgtgcgcctatagagaaaagaaagcttactgaactaggagtcagaacacctgtgttgaagtttgggcacattccccaattccccaagcctcagtttgctcatctataaaatagccggagtgatccttgcctcacctgattcgtggttggtgatgatcaaatgaggcaatgaatgagaaagcctttgcgttagcctctgttttgctggttattaaacagatgccttcctcccttgactgttctttgagaataaagccagaaaagatttgaattgctttttttattacttttggttgctggctgtgtttctttcaatcattaaaatttaatacaactcgacacagaaattgagcacaagacaaacacagctttattggggttataggtaaatggggcaaggtaaaaagactcagttcattgtgggtctagtgtcctcatatacaattgtcttaatttcaaaatatttcatcccactgttaggccatgcatcccttcatgtgtttcagtatctcattccaaaagcatagtctctacaactaaatgatgatcaaaagagacacagaatagtgaccataggatagaggctttgcttcttctctttgtgtctggaagggcgtgagcaatccagaccagaaagaaagaaacctttcatcatgcccgtcagagcaggtgactcattttggccgacagacccacaatttcacctttcagttccttttacaactcccagatgaatggtgctgtcaccaggattcatcagtatctagattgggaagaacatcctgtgtgcccctccgtaggcctcatttttttgccagtcccctcactcaatgcttttgacacttttcagctgctgcttagacagtttctcctgatggctaacctgaccagggcagtggggcatgagcaggcaggacttctccctgctgaaagccacctgcctcaaaatgtgttttctaggacgcgtaacccagctgaacaggaagcatctctggcgtgtctgttttggagtgggaatctcccagtgtggagagggagcaggatgcattggaaaagaaaggaggccagtgaggctgctttctcctgccggaggggagcagggtctgcgacaggctgggcaggccaacaggggccagaacacacagggccttgtggaccatggccaggagtctggctttatcccaagggtggagtgaagtcattgaatggttttaagttgccactggaggtggtgggagtccgggttaagcatcatcagattgcattttgaatgtatccccctggctactgtgtgtagaatgagtgaggaaaggagaccactccttacaacatgttgggatcctctaagcagcagatgatggggctgggacttgggaagatagggcagggcaccttctactccagggccattgcatggtcctgattccctgacagcttttatatcctttatgctatttaaaataattatttacagtctatcttagttagctagagctgcataacaaaataccacacacggggtggcttaaacaataggaatttattttctcacagttctgggttctagaagtccaagatcaaggtatgggcaaggttggtttcttctgagtcctctctccttggcacataggtgggcatcttccccctgtgagttcccgtggctgtccctctgtgcttgcctgtgtcccatcccctcttataaggacaccagtcatattggattagagcctatcctaatgacctcagtttgacttaattttctctttaaaaaccctattgccaaataaagtcatattctgaggtactgagggtagggacttcatcatgtgaatttggggggtgagagagacagggacaggaggacccaattcagccaacatggagtccctcctcacattttctcttcccctaatttcaagtctgtgcttatccatcactgtctggaggtgtctctgcttcctttgttgctgcttttagggaagatggtttttccccaggtgagcccttcttgttggtcacacaacaagtcaacattttgtatttccaacatacttttttattggatttcctataaagggtatttagatagtctttaatatttctattattttttattgcccacccccctaaagcatggtaaccatgttatatgtagtaaaagttgcataaccatttgacgggtttcatttgggttttgttcttccaccagaatggtgggcctgactgtgttgtgatttccattacagcgttgtttagccacagaaatctcctgtgctggttgtttcgtgggaacgagtgtgttgcatttgccttccttgcgggctcaagaatacctgttgtgagaaacagctgtcacatttatgctgaccaaaaacttaactcctcagctcaccccataggtgtgtccaaatgtttgttgagtgcccacaagaatactccagggtacagagaactgagtagcatccctcctcaagtaatttgaagtctgataaagatataaaacaaatgaaaaagtaggtacattataggtaaactatgctgtaggtcagtggttctcaaaatatagtctccagacccacaggatgaacatcatctaggaacttgctggaaatgcacagtttcagtccttaccctggaccccctgagtcaaaaaccctgggtcatgtgttataacaagacatccaaggattctgatgcatactcgtttgagaatgcatcaggattgagaatgcatccgtttgagaaccactgcttacccataagaagcgcatgacatgagatttttaaagaaagctcatatttggagagggaggaggggagaagcaggaagtatttctagaagtatgttgcatatgagataggccttgaggagtgggtaggatttttatatttatatgtagatgatcatatttactgtaattgccatctgtatgtttatgtatttcttttacaaaagtaattaacagcctggactctaacttgaaagatctgctagctgtccctttcttgcattttaactggctcactgtgaatcgaggcttccatcaacatatgctcagttgtagaactggtaattatggttggaggctttttgttggaggacacatttcattccaaacatagtttctgaacatagcttgaattgaaagtagagattctacctctatatacttaagacaaaatcaattcaaagcatccttgaatctcacagtgggaaggggccttcaaggtcatctagtctaataacccaggcaaataacctctgagcaggctttgtaaaataggtataatcagttcttctctagcccactgaatgattctgtatacttctctagcccattgaatgattctgtagcaagagtggataaactatggctcaagggtcaattctgacacactacctgtctttgtatataaatttttattggaacacatttttgggaatacatttatgcattgaattgaatacatttatgtatacattttattggaatacatttatgtattgtttttggttgttcttgcactataatagtgcaaacctttaatctcctctttaagactttgtattagtaagaactcttagagtacaagtaaccaaaacccagttccaactagctcaagtgaaacaggaatctattggctcctaagcctttgaagtcaaaagaagatctccctgaagtagctgttcacttgatatcatgcatgtggttccaaatggattgtcttttgtatgtacgctgccctagtcatgtctactgcacctcctggaaagacctttctccctgctcactcattctgattacttctcctcccttcactactcatgtttatttcattccattccatccactcctctaagtgcagatctttcttctgctgtggtggcatcagcagctgtcctgtgaacactaggctgagagtcacaagtaccgggtgctagtcctgactatgctattgaataacaaaaatatgagatatgatgttaagatactttgaaaatcaaaaacccctcaaagggttgcttttatttgcttagaatctaagcatatttaacctggcaatggcaccaaagtttattttgtcctcatggcctgggtgagaaaatgatccataaatgtgttttagttggctcacatagtattcttttcgtttattttttaaatatttgagccaagatataaaaactgggagttttactttaaaatccatatttctggtttcactgagcccatgtccccacctggtaggaatcagttggaactgagtaggggctgtgcctgtttagtcacaatctcccactccctttgtcttatcccaactgatgtcacttacttgcatgacctacccttgagcacttagtcagtgctccctgacttaatacagtcatgcatctgactctcaaaggtctgattcccatctgtcttggcatagtgatcatgcagcctctgccagcttcccacatggagaaagctcactacctagagaagcagttatttcatccctgggcagctctggccattgggaaattttctcctgtatgttccatcctcttcagcattccaaaatgggtaagtgacttgccccaagtctcccagtatgttagagaattagaagtctcagtatggctcaccaagctagtggtctttttaccccacctgatggaagtatgttctttcccacctttcttcctcactctttaacccccagtctaatttagagacaaagagtacatttaagaagtcatttgacatcaggtttagtttttactgaactctttgcctttgcaaacattctaaagaataaaagttggcaaactttctctgtaaaggaccacatggtgagtatcttagactttgcagtcatgtggtctctgttgcaactactcaactccactattgtagcctgaaagcaatcatagataatatgtaaatgagtaagcaagactgtgttccaataaaactttatttacaaagacagttagtgggacagaattgtccctgagccatagtttgcttattcttgctgtggagccattcagtgggccagcagaagaggtgtttgtctatgtggggtgtcctgatgccacccatctttcaagagccagctgagatggagcatttacaagcaacttgctctgattcctcttcaaggtgttatgtctgtagcatcaggatttctagagtacaacagcttttgaagatgttccaggaatccctgaaagtccctgagaccccttgaggagtccacaagataatactatttgcataataattctaagaagttatttgcctctgtcattctcattgttttactacagtggagttttttagaggtgatgtgtgatgcagccatcaccctgatggctgttggaatctgtgcttgtgtatttttgtttttaaaaaatatctgatatgatttctaatatgataaatatttatagatgtaacccatctaaacagaagctctttagagtttgcaataaaacttaagagtacagaggagtgctgacaccaaaaagtttcagaactgctaacattgcagtatcctgactatgcttttcttaccctacaagacacttctcatcttgtggtatagatttttcagatggtctcaacaaggatgtcattttcttacagacaagagctatactaatcattgtgttttttaattgcacatgaattgtacaaagtaaattattttttaaatgtttcttgtaaaccacagtgtgctaggtattatgctcagaattaggactagagagataagctcaagagataccgtccctgccctcatcaagcttagagcccaatggaggaaataaacattaagcaaataagcacaactaatgatacaaacacatccttgattgcagtgcaatcaacagagagtacccaggactatgggaaccaatgaaagtagggtttatactcctgagggaagtcagagaagggcctttgacctgagatctgtgggatggaggggatccatggaaagtaggatttctcagcttagcactgtgaattttagactagataattctgcattaaggggagaaggaagaactgtcttgtgcattgtagaatgtttagcagcctccccagcctctacccactagatgcctatagcacacgcacacatacacacacaccatttgtgacaaccaaaaatgtcttcaggcattgtcaaatgactgctgggcaagagataggggtcagggaattgtccccaatagagaactggtgaactagagaagagatgcggtagaaggctactgtggtagcccaggtgaaagatgcctgttgctgggctatggctggaagagatgaagacagtaggctgagctcaagcgctctgtaagggactggtctatatggcttggtaatgagtaggccaggaaggggaatatgaggggccaatgatgaatcttaatttgtcatgttgaaggactgactttggtttgcacaagtgacaccatcacatgctggctctgaaatctgaagggacagggctcggaagacacgacggagtgaggaaaaacacctttgcccatctgcccatctctctgccagcatagccacctgtgttgttcatctctgcctgatgggagatggctttaataacagaccaaaaacagctcttcctaaaaggaacaacaactttagaaaagaaaaaccatctgccagggctgagtgcataaagtatgtgtttaatctagctgtattgggacattttttcaatgccagttgacttttttaaacatttgtgaaagttggcaaacacatcagagaaaatatactttgtaatatttgaaggatattggcacatgatatggtgacagcgcttttgatacacattagtatcagatatcaagatttctaaaattctgtcagtgctgaagactgtgtgaagatcttctttctagtctagcccaggatttcttgacctttagtgagaaaaagaatctccagaggagcttgtttaaaatgtaaagcccaattcagtaagtctggggtggggcccaggaatctgtattttaacaatcccgctccccaccccggtgattctgaagcaggtgataccactttgagaaacactcatacagtaaaagcaccttgaaggaatctgttccagttccttcccaccactgactttgctgtaggacccccccaccccccgtctcaccctaactctccttggctaatttgttcatatccagagctggtccagaaagctttcctaactgcgtagacgctagaatgtttgcagcgacaagcgacagcccccagctaaaactggcttgaacaatctaaacacatttatttgacgtaacaggaaacccagagagggccagttccaaggtaggctaattcagagactcagcaacaccatcaagacccagattccttccatcttaaggggatctcccctcagaatctatcatggactccagggctgcagttccagcatcacatgtggataacaacctccatccaagaaaaccttcccaggaccctctcccacaccaggggacctccctggtgtctcattagtcaggagtatttcacatgtctttgcttaaattaaatcattagcaaaggaacgagattactgggatcaattttcgccaaacaagattccctccccaagtcaggaaaggtcacaacctttctcaaaagacatggctgctcaggggagagtaaacaaaaattggttcctccagtaaagagagagtctgttcacagaagaaggagtggctgctgagaagcaactgtgtctgccacaatactcctcttcctctcccaccattcccccactggagggtgagtcacatgagagcaggggccatgttcacctggttcaccattctatcttccacaagatgctatggctcatgttagatacaggaggtgtatcagcatgaagtggtcctgaaatgtttgtttaatttaaattaatggaagattgtgattttgatggagaactgtgagtaattaggacataaattagtttattccaagtgaaaaaatcctaactcaaactagctcctatctctttttttaacttttatattaagttcaggggtacttgtgcaggtttgttatatatgtaaatttgcgtcatgggggttcgttgtacagattatttcctcacccaagtattaagcctactacccactagttatttttcctgatccttcctcccaccctccagtgtactatattggtttgtatattgggaagcacagtggcttcagatccaggaagatccacagacttaaatgatgcattcattcagggttctgtttctctctctctctctctctctctctctctctctctccttctccctctctctctctctctctccgtctctaataggttctctcaacatgtggagcaagatggcaaaggagccccagactacctcctcttggcttagcaaccaggtggcttttctaagagctcttgcagaaaagcctcagagagaattaggtcatatgcctgccaatcatacggaaaggggattgggctgttctaattggcctaaccactactcgcccacctcatactgggacaggccccacccaaaccccatggagtggtttccctacaggaaagaggttctattgccagatgaagcagagagcagatgctgagcaggcaaaacaacagatgtccactacatttgtgggtgaaaaacgctgtttgcagggcattatacatgggccaaaccataattgagaactccttgctgatactcacagagattaaatatttcccccagactacacaaattcagtttgaaactttgaatgatgctttgtttcctaaagataaaatggaatgttcgtccgttgatttggggggaggatctttaaattctcttatctcaaagatgtctcaaaatattccttatctttcctcctactgtcttttggtctttttcttctgtatttttcttggttacttattatgtcttgacttcttagtcccatgtgtcatgtaccaacaacttcataaaaaattaaaatgccatctctccatggtactttccctaatttttctttctctctcctccccttcctaatcaggaataattcataaaaatcatctcacttcatgtattgtcctctctgattcttttaccaagttctaccttagattgtagctatttgtgggtataatttagtcatttagtcagtcatttatttgaaacatataaattgagtgcctatagtactggacttagcattagagatgcaataaaaagcaatctcccctaccctagcctggaacttcctttagggtagaaagtgttttttctttatctttacatctccacactgtttagtctcattttattagtagtattactatcattatcattattattatagtaagccttttcttattacttaccatatgccagaaaatgtgataagtgctttatgtatattgcatcttattctttcaaaaatcttgaaaggaaggtaaaatactactatccccattttatagatggagaaactaaggatcagtgatacaaagcactttgctcacacttacacagactgagaggtctgtgagaggcagagcctgcatttgaatccagatctgacaggttccataccctatctgctctccaggtgacataagctttcccataaatgcctggtaaaacatggaaattggcttctgctttctgtgaaggttaaggttaggatctgacagcttgtgtatggaacataggatgtggacttcgggttgagagtcctgtagtgaggataaatctgcaaagcccacatcttatcctgactgctttagtgaccactgacagacatccttgaggcttcatcagtttggccccaatccatgccttcccaatctcaaacatatctctttgaagggccttgtgcctcaatttcttcattagcaaacagtgaaatttggcatagaccagatgtccaatagaacactccatgagtttctattgtccactattctattctatttctgcattgtccactagagcagccactagacacatgcggatactgagtacttgaaattggctagttagactgggggactgaatttttaagtttaattaatttttatttaaataatcacaaatgactaatggctaccattttggacagcacaaagttagaagaatttttatcattctttgacttgtgatcttttacataccctagttttaaattatgtgtgcaacccattgccagatcctgaaatcaatgtattggggtgcaaataacattttttaatgaaatggcataaaataatgaaacagaatggaataaaaaaagaaaataaaatatcagtacatatcatatgcactacaaaattctgattgtactaagttttgactatgaaacttttgtttcacatattcgtgtactgagtcattatgcaaaattaatttcctccagtgggtcatggtcaaaaaacgtttgaaaaccaccgcctgcccctgagtaatgtcaccaagaccttgagtgtgtcatgcttctgtggtgcaccccaatccacccaggggctctgcaagacctcatttcagaatattctgttcttccagatcctacacgcatgtggtgagcatgtgacttccctcagatggtgattaaaagtgactttgtggtcatctatctgtctggatgcagagaccccaaattggtggcccacaggcaggatccagcccccacagataggcctccttggaactttgacctatttgtgcatggccataatcccctgaggcccagtaattttttcccctttaggtggcccagattctccagattggtccctttgggtcaatttttccatttacattacctgcctggcctctaaaaacatgtcatgttgtgacctgtgtttaacatgcatagaaaattataaccgaaaggaaacagagatgacagaatgcaactcttgtactttgtaaatgggaaaacaagagcctggagaaggggagtgtcctccctgaggcctcacaaaaactgaatgacagacaaggaagtgattctctctcccaaggaagaaccagatgttagcaagaattgcagtatgacagagaagaaagaagaaaggaaggcagaaagggaaagaggggaggagagtgaatgaacagggagagagaggagcaagaggaagggacggagttggagtggtggtcaggctgtcctcacagccctggggaatggggccctggccagcagttcagatttctgtgggaagggttctgtcacatggcgtgatcacttccaatgagcttctagtgagcagatgactgcggaggccatcagtgggtagtcccgtaggactttgagcaatgggaggagcactttggacacaaaaaggggcctccagtagacctctgccccataagaatggagggtgcttgcaacggcttcaggaatttcctgacttgcattgtctagccttcattttggcctgacctcaggcaagtgtccctgatctgaaactggaacttccccaatgtttcctgcttgtcctggtgtggccagcatcatagagaccctgagccacagggctgcatctgtcaagatgggaaagtggatgagatggggcagaaggggacctggaagcttccctgaggtgggatggggtcacaaggggtggcactccaggccctaccccactttagtcgctgcggctctgcattcatctgcctggcttccaggtggggctcatagctccaaggccttaaagtgcctggcagtacaggagagaagctggccaggggtaaggcaaaaacaagaagtaggaaccgccgggcgcggtggctcacgcctgtaatcccagcactttgggaggccgaggcgggtggatcacgaggtcaggagatcgagaccatcatggctaacacggtgaaaccccgtctctaataaaaatacaaaaaaattagccggacgtcgtggcgggtgcctgtagtcccagctactcgggaggctgaggcaggagaatggcgtgaacccgggaggcggagcttgcagtgagccgagatcgcgccactgcactccagcctgggcaacagagcgagactccgtctcaaaaaaaaaaaaaaaaaaaaaaaagaagtaggaaccatggtgatctgcaaggatgtaaaaacaaacaccgggccatccaaataaagtgtgtctgggagccacatccaatgcaagcaacccctggtctagggaatttccctgaacgatgaccagggtgtcataggtttgcattccatgcgtggtttgcaacagaaacagtataacctaaaggccatttcatcatttcatttcaagaaagtcttcatagctttaaaaaaaaaaaaaagtttggaaacctctagactaggtattttctatattccctccactctgatacttccctgccatgttgaggaaagccgggttcacagttaagattccttggatttccccgcaatacatcagtgcatgatggcctgccagcatctcaggaagcaaatgttgtgtacatattaaaacctctggctcaaagaccaggggactgagtcactcatagcacaaagacaattgctggctttctaaagttcctctatttccaacatagtttccaggtccccaaacgaaacccaaatagtatttttcagataagctggagagatgctggaaagggcaccgcaggcctccagtgcaaggcaaccccattctccctgctggggtcgaggcagtccctcctctttccttcaggatacactgggcagaaggaggccttgatggaacaccctctggaaagagaggagatgagaagaaattgagccccttctagacctactgatgcctgtctgaaccctaactctaaaacttacatgtggtgtaacttcaggctaattaattatcctctctgtgcttcaaattctcacatataaaatggagatcatacagtatctgtctcatgaagtcatgagcattaaatgagaggatgcttaggaagcgcatagcacaatgcctggcacatagtgattgctccattaatgttagttgttttagctatttttacaggctcctctgtgttactgactgggggctttgtaaagatcacaaggaactgactcagcagtgacaagagagtatgtggtgattggcagaagcccattccaaagtggaaaaaatgcccagactggtagacaccctagggatgtttccccttctctatcaaatcttctttattcctcagatactttttataccaccgtgcattaaaacccatgaccaagtgtagccggatggtatttttgaaatattaactgggatttcctttacccaccactcttgtgcctttccctctattcagtgagcaaggcctcagactgggatgggcagaaaacagggacaaaatgggtggcttcctagcttttgaattttaaaatcctgtccctttagaagaacagaaggatttatcacaaagctaaatattctagagaaagcataagttagggagggcagaaagggcttctttatgcccagctaataagaatggttccctggcacatgggtagggaggagaatcttggggaaagaagtgagaacacagatctacttgactactttgaaagaggccctgtgctgagcccacggacacaggcacagtcaacagcagaggaggaaagaagagaggaaggaggggcgggcaatccggcagctgaaacttcattttctcttatcttggaatagaaaccagttgaaatataagaaataaagaactctgcgatgttatgggctgccatttagtcctccttgcttgtgaagctcactgcagtgaagacccctttaggtctatctaacccaaaccctttatgctgtagctgccatgtggcagctggctgtcagacaagagcagtctggctggccaagagcatgccgttctgacacatgtcctgacaacacgtttctgaagaaggcagcacgagccgtgttgccagcaacacgccatgaccatggaacatgctgatgagcctggcagagagaagctgcggaggagtttctgttgcagcaaaggttttacaacatcctcctgggaagacaggctgtgttactgacctgctgacatgggaaactgcagccaggcccgggccatctgtgaaaggacccaggggttcccagaggactcgtacttccaccctgctgcagctgccaacacctgcagcacttgcatctctctgggacccagcacacacacctgtcaggctttacctgcccatgccagggatgctgcccaaagctgacatccctggccctggagcagcaatcactgcttcttcatcacctgccagggatgctgaattgctcttcctatttcctggcctatattctagtcacctccaatcattatttttacatcttcttaaactattttttaaaacaactaggtaatggatgactactattggggaaaagttagatacacctttacccctgcttcccacttcctccccagaggtagccattccactggcactgttgcattgcaggcagttgagcttagtggtaagagcccgggtttgaaagtcagactgcttgggttcagattctgcctctgccgtttactaactgtgtgaccttggacaaggggtctcaggtctctgagtttcattctcctgtaaaatgaggataatagtatcccctcttgagttacgagggctcaatgagatgacatatataagtggctgaggacactgcctgacatagaggacccaccctctaaatattatctattatctttcaagacccttccttatgcattaactgctcctattacttcatgcatggcgtcacttccaaaccctctcctatacttctgcatcttggaacatgcacccccagcccactaactctaaccctaaacctcagcatgacctccagacttaggataatgtagcctcttatgaactcttcccacctcaccctctctgattggcctctctcattttgtggtccaagaacagatacctccatgccctgaggcaagcaagcatcagttgctgtgtgagcttttcttgtcctcttctgtcttgtcctctgggtctcagctttctcatctgttaagtgaaaccgctggaccaattcagccatctttttctttattctgcaagtatgaatgaaacaatgacacaatgagatgggcactcactgtgtgcctggcactgaggtgtaatggtgaactggaaagacatggtccctgccctcatggagctcacaatctcgtgtatacgaatagcctcccaggccctttctgctctaaagcctagtcccaggtattcatacaatgaatgcagattaatgccacaatgtggtgacacctgcatggtccttggagttaccagaagcagctcttataatctccctatcagagttttcagaaaacatatcactcacttattttaagtaagcacacacaacaaacacactgatgcctcccctggaaacagcagatgcatccaaaatacaatgccctaggataacatagatcataacccctcttcctcacacagggaaatgcccaattcacacatttctctgcaggatatatcaaaagcatgtcagccacctacctctgcagcccacacaaacccataaacaaagagacctccagagatagggggagaaagaagaggttgcttatagtggtgaatggtctgcagccaaggagtttttttcttggcagtcagcaaaaaggaaaaactagcaaacctttgctggacttgtcagaaaatgaatctgagaaatatttgagcaaagctcagtgggtagctgataggggtgatttagaaagaatccctgcactgggttgggggtgaggagacatggattcagagatcctttaatattaattattgcttattgaggccaagcaatgcactaagcacttttctataatttaagtaatttaatactcacaaattgcttcagttattcttactctagagatgaggaaactgaggcggggtttatgtaaattgctcaggatcacacaaccagcaagtggcagggctggaatccaaacccagcccagtgactccagcatccattccttacccgctgtgtcgtgtgcttcccacccctttcagtgcaacgatcccatgactctgtggcctcactgtaggaaacaggatcggcacctgggccctggctcaactctgaaatcaaaccggaggcccctgctgtgaagtaccagatcctctcatgtacaagccccacctttatgtttcaggcagctgctttctacctgcaaaatgcctggacccacagttgggtcttctttggtatttagcagatgcctgtgaacactctgagttttgggctctaattgagaagccagagtgaaagcggctgcaccctgcatggttatgtgtggcatcccctgggccctgggctgctgtgtgctcattgctgaaccagtggattctctgcttgatgtttcacctttcaaccagaagttccactgtttatattacacttccagccaattattcacagttgttacgctgtctccaagtcagttttcccactcttttaattatacaccagcatagcataggtgctcctaccttttaaagactgctttaaagacactctattaaaatgtgggaacatttttatctacaaggtcaagcgactctcaggagaggaaaacccatgtgcaggcagcacatcagtgaaagaacataacttaggtcacatttttataggagaggaatcgtgtcattcgctgtttttaaaagagactgataaatctgataacttaaagcaaagtctagtttaaaagtgagaccagttactggagaggagagagtgtggagggagaggaaaaatcacagaagaggacacacaaggcagaatcatgtaacaagagggactcgtatggatcactttgttcaacctcttccaaagagggaattggggccaaagaggttagatgacgtgcccaaaattagaacagtaggtaacagcagagagggaattggaacccaggttaccccagccacacggagacaaagaacaacagatgagagagggaggaaaagtcaggtggagaaactggatgctgaatttgtttactgttgtgttcaactcccatgctccttttcatttacccggaggtcggtcacacctccccttccaatatgttgttttgctccaacaacttgaaattatctctaaaatttgggaagagctttacttacaaatttagttgtggaattaagatgcactttttcatagaactctaaagatttggtatgcatataaaagagggcttaatgtttcagatccctaatttttaatctcaggggcattaataagctgtttgtttgtttgtttgtttgtttgttttgtcttaaaaaattataccgacagccattggcaactgatttacttgcttttattctcggaaagattaggtttgttcagtctttcagtgcctgaaagtgtgtgatttctttaaaaatcagcatttatttcactgctcatgatcttttgtttccagatcaaattcaggatgggtgaatgtgtaattggttcccattgcaaattgtttaagtacaactttagaactctttagggataaaaatgaatcattttagtctgagatgatattcctaaattaatttgtacatttttttttttatttctaggattcaaccaagtttcatttcttttccctctgcctggtgttttgttgtttttgttgtcttttgttgttgttgttgttgtttttaactatcaggctgtactgtcattatggtagccactaatcacatgtgactatttagatgtagatttatattaattaaaattaaatttaatttaaaattaagttcctcagtcacactagctacatttcaagtgcccagtggtcacctgtgactattatattggacagcatagatgtctagaacatgtctatcatctcagaacgttctagtggatagcactaagggctagtaactgggaatgtctgtcttgggcaccctttattggccagtaatgttaaaagaagccagaggttctctgcatacatttcagaaatcaatcacataatctataaggtctaaatgtggcagcttcatggattatctcacaagtgagcacagctaatgtccttttaggcttgtgactggtctcaaatgttgctctcaagggtaggcagtttctaacataagaggtagttcaaatattcacgtgtaagtcaatttggaattcaaaagacattcacccataagaaaaatgttataaatcatgtgactgaaactttgcattttctgaaataaaaattagtggaaatgataaccagcagaaaatcaacaaattttaacatttcagggcagttatagattggtaggaagaagtaaatacacacccccaatacacatgtacacatacacagaacaatgttagattaagtttctgatttaattagccaagaatataaaatcttactggaaatgagttggcttccagggcaggagcagggatgtggcatatcccagcctagcttccattgacacccagagttcctacgtccagtctgcatgaggaacagtcttgccacacctgtgagctcaaatcttgctacaccactgttcttttataatcacagcttacatcagcaatctggaagaactcacaccaactgtatgtattttttcatacagttgtatggtgtatgtatgtattaatacaccaaatgtatgaatttttgcttatgggactatttacaaacatcagagctctggccacacacagcatcagcaaagcagcatccttctcttgaggggatgcagcagggttagggctggggtcccatcactactgcagccccagaaaattttattttcctaatccattcccctcactttgattttacacttttttatccgggtggttcaaagactgagttctgttggaagaccatgctcacaaatccactttcccagaaaatcaaatccaattagaaaaaataaaattgatcttagaagttggctcttgaacaataagacaggttgaattagaggaggtagatgaaagtttgtgcaatgatcctggagggactgttggagacttccaagagcactcagcgttaatgatgatgattgtactattcgttcttattttattttcagactcacagctttgtttcccttggcaatggtagatcaccacactgctcatataaacagaatctatatttttctcacaaattcagggcagaagagagagtgaagtattttccagggaacattgagtaagaatcagaaaaagaaaagagaataagattaaagagaatgtttatgaacattctggggggtggggaaggattgctcagagctgtaggggggatgtgatggccatgataccagtgaacatttgtggagcacttaacgcagtttttgaaatattttgcatgtattgacctatttaatgagttaattaatgatttagttaactagctgatttgtttgatttttgtcttgaatttaagacagagaaaaatagatgaataatgtgcataaactgcatgaaagaaagattgtgagaagtatattattctcccaccccagttagcaaagttgtcagaagccagtttcagtgctaagcaatcagctctttgctctatagcatccttgggattcaggatacctgtaaatgggagatgatcagaagtcctgatttcctgttcctctttaaaaggaggaggacagatgagatcagttttggagatcatagatctctttgagaatatgaacaaaactacaagataatgtatgtaacacttaatttaattaaagagaaatgtcagatccgaggttatgctacagtctcagaggctatgacaacagagatttgttcttgctcatgatagaggtttatgatgggttagtttacagttctgttccatgactcctcaatccggatccaagctgatgcatcctgcacaccatctggggtaacattcattcctgagttagggaaaaggcaatatagcagatcacatattggctcctaaggcttccaattggaagggacatgcacaatttcagttcacatttcactgccaagcaagtcaccatgtgcaatcctccatgtgcctagaagaaaaggttcaaatttccagtgaacagacataactaccacacagggtcaagaatccccaaagtaggtgacctttaaattcctttgtggttcaaggttgctgtgagtccagattaatttatgatatacttattcagagtttatccaggaagtctacatatataaacgataggtaccaattccccttcaatcaggtggttatctttataaccaggacaagagtgagccttctcctaataaggtatgagcagaagtttttggactattccttcaactttgagtgagaattgaagaaatgagtaattctctccccagtgccacaggggttttctataggagagaagagtatgtttctcagtggcaaagttacctcaacagcttatgcataatgagatcagaccagacagctaccaacattccttccaaccctgagatttttgtgctgtaggcaggtgcctaatgaaatatcagatgactagattttagaatagccaagccaagtgtatctcaggaaaagggtatctagaaaagtagccatgaaatggtcttagcagtctcactttggcagcacatatactaaaattggagatggtcttagcaagagaataacagacccaataagctagtagaactcttaagcatcatcaaatgctggccactcacctgcagctcccagtgacttcaaccctttcataatctccaccagcatttttttcttaattgtatacatgtaacattttcccagttttatggaaagtgctgttcaaaggtagctttgagataagttcccttgttagcctccctccagccagagtgcctccccttcccttcatgccttccttataaaagtctttgctacctttgaccaccctcatttgatagacatgaaaattgaggcccagagaggggctgtaactcacttaattcaaaagccatttggaggcagggtcagccacccacttctttgaaacttctgagtcaattgcaagtcccaaattcccttggacaagtttggggcctaattttaatttaaagcttactcaaaagatggtatttttgatcacttactttgaaatactctatgtcctcttatttgtcttcattcagggatttggcttgtgttcttgcaaggaaaggtgatgctcactcaaaagtccttgcctgcttaaggagggctatggacatgtctcataccactcagtgctgccttagcttggcagtcatcctgatgatgaattgaagatactttgcacatcatttcttccccttccactttttcttccagctacaattatgataatgtcttgcagcagactttgtaaagaatcagggcctctggatagtgatctctttgtttcttttacagttccttatcagcagaatccttacaatccacggggcagctccaatgtcatccagtgctaccgctgtggagacacctgcaaaggggaagtggtccgcgtgcacaacaaccacttccacatcagatgcttcacctgtcaaggtaggaggctcagctcccccactctcttcttagattcctgaccattcttgcaccatcaggtcatgcctcaggggcagaaagaacaaacacaggtggctggaatatctataaagacctaaagagactttccctgagcctcttcttatgagattctcccttagaatgagggcagtgtattggtacgtgagggagacaaggatcctggtaaccttggaggggcaggtgctgaaccagaaggaaaaagactaatctgcaagtttaacttactcatctgaagagactcctggtttgtgcctataaatcagtgtgagagcaaatgaaagtgcaaactatcttggataaaattcaagatagttttttttgtttgttttttgttttttggtttttttttttttgagatgagtagctattctatgacaatgtagcaatcttcaaaggttaagtttaacaagggagaagagacatcttgaccttggtaaggtttgcaatttgggagcacatagctgttaggtcatctctcattgttacagcttacacagggctaatttatatactcctagactcaaccaagctaagagttcctaaagaagacagataattagcagcaggaaaagggacttggctgaaagagcacagagagccctctggcccggggcaacacacccttccacaatgtctctccagcctccacatcttgacctcctcattcaggcttccctgctccacagagcagccattctaatgttggattgccctgtgggtttagaaaatgacccaaaatttgtaacttttttgttgatcttatatttgtcctcataaagtctgaggaatactttgtattcgcttttccctttgactgctcttcagatacttgtatccaggttttccccatgtcaaactatatcacaagtccttaaattgggtctcatcttaaatgattccaacagtgtcattgtcctggagtcttcctctttgatccattctagtgtgtcactgtcgttcttaaagtatgatactcagaacagatcacagttttcaaggtctagcaaatacaaaggactacatttctgttgatgtaactgatattgaactgacttcctgaggagccgcttcacactactggcttatattgaatttaaagtcggttgaaacccgcggttctttttatttcagtaactgcctcagtctcatgcacctgagagtgacttcccctgccattgtgaaaatcctgaacttctttcttcatgatctaactagactctgcactgagcaaacaaattacatatacatatttcctaatttgtttatagatgcatatacgggatacattttaactggtgtgatttgaattttatattgagtattggcaaacccctttagtataagttgaattgcaagaatatcttggtgagtgattatttttacaccctctgaaattgaggcgggacgaagggtaaagacaaggaaattgttacaaagtggtaaaggatataattatgtgattatattcttaagagaatgtatcagttaccttttacttaagcaaaaacttaatagcttaaaccaatcgtttatttagttcatgattctctgggttggctgggaagtgtttcccagtttctagctctgcttatctctactggcctcatcatgatgatatgcagttggcgggtgggtctgctggcagtggttggcaagctgctaaccccagtgtctccacatagcttttcatcctccaatgggctggcttgggcttgttcatatggtggtctcggagctccaagtacaatgagagaacaagctttaataggtaagaccttttcaaccctcagcttaatgtcctgctgttggccaaaacaagccaaatggccaacccagattcaaggtcacggagaaataaactttgccttttgtagggagatctgcagcatcagatttcaagggtgttaatacagaacggaataatttggccattttcacatttaccacacggagtttgtagaatctctttcaacagagattttaaggggaaaaaaatagaccaatatttttctgaatattttcaatgtccgtttgcttaaaggtaaaagaaatgagaggatttttatttccaacagcaatcaacatgacaattaagtaccctattagatagctttctcatctaaagaatctaaaaattgttatgaatttcttttacgactcttttaacatgcactaccatgctgacatgaaaggaaggaatctacgaaggctaaaaacggaaacagaaaccctgctgtgactcccaatgccttatttcatcctgatagtttatcttaaaccttggagaccttgagcttttactctgttgtctaaatggatcatggagaacaggaggcaaagcttagcatctagtcaaagtgggaatccaataggagacctatgtataaagctgtttcccctgaaaaaaatattctcagcatatgatggatgagaaataaactggctctggagagggagagagcaaggaaacttgcctgttccaactttggcactgagtagaggggaataaaacagtggctcactcctgtaatcccagcagtttgggaggctgaggtgggagggtcacgaggtcaggagtttgagaccagcctggccaacatggtgaaaccccacctctactaagaatacaaaaattagctgggtgtggtggcaggtgcctgtagtcccagctactcaggaggctgagacaggagaatcgcttgaagccgggaggtggaggttgcagtgagtcaagatcacgccactgcactccagcctggtgacaaattgagacttcatctcaaagaaaaaaaaaattatgaaaaattacttatgaaaatatctgtccataatccaccctttacatggattcatgactatattcgtgttatatatttgttataaataaaaatttataacaatatataaaatatgtaatagagtcaagcagaaaatttaagttacagcggtctcccacttggcaaatggcaaaagcaaatgatactcctctttggaggaactcaactttattccaggcctcaaagactttccacacatagtgttatcaggaaaatgagtaactcacagtcagtcaaaaacatacaaattataatggaatgagagccagcagaaacaatggcgagcagaatcagaacctcaacaactttgtatattgaaatttcctgtcattacataataactatattgatacatttaaacaagctagaaaatatgagcaaaaaaaaaacaacagtgcattataagcaatagtgcagaagatttgaaaaggaaacaaataaaacttctaaaaatagaaatatataatctttgaaattaattcaatgtatcaattaaatagcagattagatgttgctaaagaaaaaattaataaaacagaagatttcatccaaaaaaagttatacagataatagatcaaaaatatgagaaggtggtaaaaataaaaaagaagctaatatatggagaatatagtgagaggtcctgacatatatatctaatcagagttctggggatagataatagagaacatgagtgggaggacaatatttgaagagacaacagctatgaattatctagagctgttgaaagacacatatccttgaatccagaaaacctaataaattcctgcaggaaaatttaaaagaaatccacctacaatatcagagtaaaacctcagatcatcaaagagccgatcttaaaagtagccagggagaaaagacaaatcatctgcgtataaatggtaaatggccagacaactgacttttcagtagcaacaagcaaactagaaaacagcagaagaatatatttaatgtactgaaagaaataactgtcaaggaaagattatgtattcagcaaaactatctttctataacaaagacaaacctacaactaagattatacttaatggtgaaagaccgaatgtttctgttagatatgagttctaaatttcttttcaaagaattaatacgttagtatgttcaattctttgccttctacttttaaacttaacttcctcgtaaagcaacatttttcaattacctactccaccctgactcattccgatttcctaccccaccctgactcattctgattacctactccaccctgactcattctgatcacatgctccaccctaactcattcagattacctgctacctgctctgccctgactcccgccaaagcactcaccccgtcattctctttaaattagccagtcggaatttgtttagcctgtgcggtctaaccctagccaatagggaaacgacacagcagcaggggccacgtgcctcagggataagaacctcttcccctcccttgtccaagtgcaccctcacctttgctccatctgtaagggcgcaccgttctatagtaataacttgccttgctgagaattaaaaagaaaattttatattctagtgctattccttttgcagcaccgaaattttatatataacatttccctgtaagatcaaaaacaagacaagaatttctgctctcaccacttctatttgacattgcatttcaggtttgtgctaggttaattaaggaagaaaatgaaataaaaggcatccagattaaaaaggaagaagtacaactaatctctatttgcacatgacatgatcttgtatagcaaatcccaaggaatactaaaaaattattagaactaataagtttatcaaggtttcaagatataagatcaaataccaaaatcaattatatttctataccatagcaataaacaatctgaaaataaaattgagaaaacagttccactggcaatagcatcaaaggaatacataggaatgaatttaacaaaagaagttcaaaatgtgtactatgaaaactacaaaatgttaaacaaggcctaaataaatggaaaggtgtcccttgctcataaaataaaagacttatttattattaagatggcagcactggcttgcagatggccgccatcttgctgcgtcttcgcatggcagagagagaaagggagagagggacagccagcaaactctctagtgtctgttgttttaagagtactaatctcatcatgagggccccacccttatgatctcatctaaacctaattatcacacaaaggcccatctctaaacactaggatgttggaggttagggcttcaacatatgaattgggggtggggacagaattcagtccatagaaaatgcaatccctatcaaaatctcagctggcttctttgccaaaattgatggtctgatcctaaaattcatatggaatttcaagggacggacatagaatagccaagcaatctttaaaaagaacgaagttggagaactcacacttcccacttttaaatatgctacaaggctataataaacaagatagggtggtactagcacaaggataggcatagaaatgaataaaatcaaaaatataaacataaacttatatttatggttggttaattttcaacaaggctgttgagataattcaagaggggaagaatggtcttttcaaaaaaaggtgtttggaaaactgaatattcatatgcaaaaaatgaattcacactctttctttacacatacataaaaattaactaaaaattgattgaagacctaaatgtagaaggtaaaattgagaaactcttaggaaaaaatataagaataaatcattgtgatcttgagttgtgctaaaccttcttacatatgacaccaaaagctcaagcaacaaagaaaaaatatatcaattagatattatcaaaatttaaaacttttgtgcttcaaaatacaccatcaagaatgtgaaaagacaacccatagaataggagaaaatatttgcaaattataaatctgaaaaaatatttgtgtctcagctatgtaaagaattcttacaattgcataataagaagacaaataacctaatttcaaaatgggcaaaggatatgaatagacatttatacagagaagttatacaaatgtccaataagcacatgaaaaaatgctcgacatcattagccatcaaagaaatgcaaatcaaaccacaatgagatgccacttcacatctactagaatggctataatcaaaaagatagataactagtgttgatgagcatgtggagacattagaactctcatacattgctggtggaaaggaatgtaaaatggtgcagcttcttgggagaatagtctggcagttcctcaaaagatgaaattagagttaccgtatgacccagcaattccaaattccactcctcagtatatactcaagagaaataaaaatatatgttcacacagaaatatatacatgaatgttcatagcagcattattcgtaatagccaaaaagtagaaaaactcaaatcttcatcaacaaatgaatggataaataaaatgtgatctatctccacagagggatactatttagcaataaaaaggaatgaaatactaataaatgctccaatgggaataaaccttgaaaacacgtaaaagaaaacagtcacaaaaggctacacattgcaggatttcatatgtatgaaatgctcaaaacaggcatattatataaagacagaaagcagattcatggttatctagggctgggggtggttggaggaagataaggagtgatttgtaatgggtttgtggcttgttttggaggtgatgaaaacgttctggaattagatagtggtaatgattgcacaactttgtgaatatgctaaaaaatggttgaattgtacattttaaattgttgagttatatgacttgtgaattgtatctcattaaaactgttaaaatgaactgggtgcagtggcacacacctgtaatcccagcactttgggaggccgaggcgggtggatcacctgagcccaggagtttgagagcagcctgggcaacatagcgaagcctcttctctacaaaaaatacaaaaattagccgggcatggtggtgcatgcctgtagtcccagctacttgggaggctgaggtgagaggatcatttgagcccaggaggcggaggttgcagtgagttgttatcacgccactgcactccaggctggtggacagagtgagtccctgtctcaaaacaaaacaaaaactgttaaaataaaagacccaaagcaaagtaaaaacatgtttaaattttttaaaactgaatttaccaacaacaaactctcattaaatgaaattataaaatatgttctgtaagcagaagaaaaatgatcccagatggcagaactgagatgaaagatggcatggttagcaaaatcttaatgaaaatcagaaaactcttgaaaccgaaagataacaaaaatgctatgtatcaaaaacttgcattacaaaatgtagtttaaagtggtactcagaggaaaatgtgtagccttaaattatcataatagaaaagaattaagttcaaaaaccgtgaactaagtgttcaactcaaaaagtttgaagagcagaatgaatccaagtaaaatagaaggaaggaaataatacaatagacattaatcaaagaaaaaacgcacagtggacaggattagcaaaagttgattctttaaaaatacaagtaaaatagacaaaattctggcaaaattattcaagtaatgggagaaaatatacaaatcaacaatattaagaattaaaatagggacatcgctgtagttgctattaaaattaaagacataaaaagaaatattataaacaatttgagtaataaattttaaaacttagataacaaaatttatcaattcttgagtgcaaattaaaacctactcaagaagaaattttgaaacctgagtagtcctataatcatccaagatattgaatttgtgaatttgtagttaaaactcttctacgaaagaaacaaaaatcagcattggaatcaagttctacaaaacattcaaaaacaaatcatctatgtcttatagaaagtctttcagagaagagaaaagggtacacttcctaactcatttgagccagcacaataccaaacaaggaaaaataatcatatgtccatatcattcatgaacatggattttaaaatcttagacaaaatattagcaaaccaagtttagaaaagtgtgaaaaatatagcataactgaccaagttgagtttattctagaaatttgaaattggcttaatattagaaaactggttaatgtattttgctataaagataagaaaggataaaaatatttgattattttaatagagtagaaaaggtgctagataaaatttaacacccacttatacctagttatttttatttttatttttttgagacggagtcttgctctgtcgcccaggctggagtgcagtggcacgatctcggctcactgcaagctccacctcccaggttcatgacattctcctgcctcagcctcccatatacctagttatttttaaaactaggaggaattgaagaaagctgtcataattgatagattatgtatacaaaaattataaaggaaacatttaatagtaaaatgctgaaggcattctctaagatcaggaacaagatagaggtgctcactgtcatgacttctgttcaacatttggcctggagggtcctagacaatccagcaagatatagaaataaaagttatatggtttgaaaaggaaaaaaaaaacctattatttttagattatataattgtctgcatagaaaacccaaaagaatctacaatttagtaaaatcaataagaaaattagtctataataaggagaaaggaaaagaacccattggtcacttttagataatgctggtgaaatcattattttgaaacaaataatatgggcaaagaatcaaaactttaacctattgtacaaactgtacagtacttaactgtaagcaaagggttaatgaaagtttctatctacagaaacactccacctacggggcgcctgtagtcccagctactcaggaggctgaggcaggagaatggcatgaacctgagaggcagagcttgcagtgagccaagatcggccactgcactccagcctgggtgacagagcgagactccgtctcaaaaaaaaaaaagaaaaaaaaaaaaaagaaagaaacactctgcctaataaatgaagaattaaataattagaatattttaattttgcaaagctttaacgaaatagtgtatctagcaatgatcatcaatagccatttctactcaccaacaccaccccccaaatcatagaagtgcagaacatcaatgtagtattattcctaaaaagaaaaaaataatcagacctgaatttcaagtctgtagatataaccaccatttatagaaaatgtaaaagagaggagaacaagttaatcaacaccatagggatacaatcagcaaaatccaaactgcagaaatgactcagtctctttaataaatacattgcaaggagaaaataagaaggaaaaataactagcaattaagggacttaagaggtacatcagacaaatgcaatgtatgaaccttgatagatttttattcaaacaactggtcactaaaacaaaaaaagaaaagaaaaaaaggatgggataattggaaaacttgaacacactgacttgataatgccttaatagacattattttcagtgcttttagattattgtggttggcttttttaaagagtcctaatattttagagatacattctgaaataataatactaaaaagaaagtcaataagaatttattaaggttactaaatacagaataaatatagaaaaaaattgcatttgtattcaccattaacaatcaagacgccatttacctgaacaagaaaaaaagtttaatttagaaataaattttataaagttgtataagataaaaattataaaattgttaaatttatagaatatcataagaaagacattaaatacctaaataattttttaatatgctaaattctctgatagaaagatagaaatatcaaaaagatgacagttctactctggttgaactatatagtcaaaacaattctaatacattccataaggttttccatagaaattaagaaatcagttaaaattatattcttgacaaaaggccaggaataatcaaagcattcctaaagaacaacaaagcaagagggcctgtcctaccagatatcatcatttgttattaaaacctattaagaccatgtgatcttggattaaggacagataaaaagaccaatggaactgaatatagaaccaaacacaaactttcatacatatggaaacttgctttttgcagatcagtggggaaagattagactgcttaataaatgatgctgagatgattaattatgcatgtgggagaaaatcagatccctactgtatatcattccctaaagtcaattccaggtggatttgctttactatgaaaggcagctcaataaaatttttagaagacaatataggagatacctttttaggatttcagggtagagaataatttctgaaacatgacacagaaagggcaatccataaaggaaaagattcacaaattcaacaacgtaaaaactgagaactttggttcatccaaaaacaagaaaaggggagcaaaagcaagccccaaattgcagaagatatttgtaataaatgactgaaaaaggattgatttccaaaatatattaagaatttctacaagtctaaaatgtaaaaaatgagcaaaaaacattagcaagtattttaacatttgaaaaaaattctcaatttgattaaccattagggaaatgaaatttaaaaatcacaaaatgataaatgatatcatttcacatccactatgttgaccaaatatgtcagatattactaagtactgttgatgatatatatcagtgggaacagctggtgggaaggtaaataggaaaagctctttggaaaacagtgaggcattacctcacaaatgcaagaatgtttagaacagcatttccataaaagcaaaaaactgcaagtagctcaaatgcccttcagcagtggagtagaccaactgtgatgtattcaggcagtggaatacagcacagcagtgaaaatgagtgaactgcagttacgtgcatcgacgtggatgaatctcaacacacaatactcagggaatgaagcaggcacgggacaattgcagtatgactccatcaacataaagttcaaaaagtggccaaactaaacaaaatattgtttatggatacatcacaggtggtaagactataaagtaaagcaagggaatgataaacacataattagggacggtatgggacagaggtgctcttaaggagaggagaacaggcttctaaggaattggtgatgttctgtttcataaactcggtagtgggtacatgggagttattttattattcttctttaaaccatacatacatattctatacattttctctatgtataatatatttcacaatgaaatgttctgaataatgaattagatcaccctcaggggcccttctaactcttggattttgaaatttcataaaatccagtctcattcaaaaagttgaaaatcactaaaactgtatgacagagtcttgcactttctgttctagatgtgtcctcagttaaccacccagccccttcatcttacaaatgagctccagagagctgggataactttttcaaaatctcccagcacttgagtgctagaacaagaccacagacaaaggtccaataacctacaaaacatcacattgttcactgacgcattctggggctgtgtgcaagtcctccttctgggccttatatttacattgagcatttattccggatttgctcaaagcagttttaacgttcaatattgcgtttcactcagcctcagatccatctgtcatgctggtccagcttgccttccatccctgtgctccccactgtatttccaggaacccctgagaggcttatcaacctttacatcctttctaccaaaagcttcctccttcagctccttgggggcaatggaggactgattgttccaagttttcctatggtggcctggatttctccactgggagaggtggctctgggggtggagttggcaaaggagacaaaggagagaaaaaaaaaagggaaaaaaccggagctgtttccaatgaggttgtaggccatgacctaattgattccgcagccatgaagtcaattgttccaccacctgcacggcccagaacagcctgtgctctggtttgcctgctcgtgagaccagacattgtttgatgtgatgaattttcataatgcctgatggaagatgaacccttcccagacttctgccaccaccaccatctccaccacactcctgcctcttcgtaggggtggggtcgggggccacaagcaatgctccacactgagtttaaaatgtttaggcgtatagtaagcgctaaaggaagcttttcttctcatagacttacagcatgtcagttctaaaagaaaagctcagcctcttcattctgcgtacaagtgaacagaggccccagagaagtgagggtaaagttcactgttgtccagagactcagtggcagtgatgagaccagaggttgggtggtctgactatcagaccactgtgtctcccactgtcctgagctgttccctcccctcatgcagtgacttctgaagctgccttctcctcactcagcctcaccccttaagcctccagtccccaaaggtgaacaaacatttatgaaatatttctggcattcacctggcagtctctcctatttttaacctggctgcttttgcaaaacaacttcccctgttaaaggtgagatagtatttgctggggtgttttcactcagttccaggttgactcttcagacttacagtcttgctaactatcttattggttttcccatcattgatcacccttgagaaagctgacttgtactaaccaactcctcagaaaactgatgtagaaagcccgaatacctgttcatcaatgtggatgagaggtgtgaccttgagttggattgtttcatggtggcctggccagcacctggcctctcagaggcaatctaggtggaaagtcagtccatcagacagcagcctcagaaccaggggagctggtgacaggatttgaatgggcaccgcagttgccttcctctgattgctaatcaggccccttcctcgctggtgcatccttgctttagctgattggtacattcagtgggtttctacagttctggtggccctgtgagccatttattgccttggaagaaattttgcatctttctgctctgcccatcatgtgttgatttcacaacttaactccttacaagtaaatctcatatttctaagtccttcagtgggggtggatctcacataattcaattgttgaaacacctataaatctacttgtttttctgttttgtcctacatttatttctccctattatccaaaagaatattccaaaagactaggaaatgccttgtaaaatcctgttgcatctctgttcaaaagccatcgatgcaattgatcatttttgcagctgagtgatggagaattattacaatcttctcccatttttgtatatgtttgagatatttttctaaatttttctaaactagggaaaaaaacgtccacggctcttcagtatcctacaaaacctaatcttcttaaactggattcaggccttcctccaactggtctgcacaatcttttcctgcattacttcccaccacttcctacaaacaccacccctacttctagcctttacacaaatatcacttgcaccttcctgcctctgtgctttggctcattcattctgttcctttagtgttcaactcagatgctacctcctctgaaaagcctcccatgatcccttgcaactgacaaggcttccttcttctacctcattcacagtccttactgcttgcaccggttccgtggaccatcaccgatgatatgggacattttttctatatgatcttctctctgcagcatttttagctctttgagattcagggattgtgttttattcttcctgcctgagaatagacaccccccactccttatggctatggtgagcacagattctagacttcaaatcatccatcccattgccatccgaaggtgtctccaggttgggatttggagcatatggtcctcacactgctcttcacctggcacagaatcatgcacataggaagtacccaggaaatgtttaactgaatgattcttttattacattcatatttccaccagctgtgtggccttgcgtgagccacatggcattaaacttttcattcatgtattgggaggattgtacaccaccagtgcttcttagtgtgcatcagaatcagcctatccgggtgagggaatgctgttcaaatgcagatgcccaggcctcagtcccatggagtctgattcaggcccgggcatctggattataagaagctctcggggtgatactgatgctagtggcctactggccattctttaaggaatactggccccaaaggcctgtgaagtctgacatgctaccattctgtggccacttctttaaggaatactggccccaaaggcctgtgaagtctgacatgctaccattctgtggccactcatgacacagtgagacaccagcctttcccccagcgaggaccttctgcttacagaccctccctggactcaacctgcccttgttttcctccttgttccccaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggtgagtgggcgaccagcagggcctgggaccctctgcataagcccccggggcaggggaagacctggctttttccaggaagttctggggtttacaaggtttgtgctgcacatttagatttctggaacctcaggtgtggagggatctgatgggccagtggttttcaaacactgtagcatctgaatctttcttataaaatacaatctgatctaaaacactggtttgtcctgtgatagaggcagagtgaggatctgtacctctaaactcagcctcccaattcctctcaaaaggcccccaaagaaaccactgattctctcagaactcagtttggaaactgtggatctggcccatcctcccacaccctcatccacaggtgggacagggatgtctgtacatagccttcctccatcatcctggcaccacctcatgctgttggagtgaccctggcaagtgacccccacctctgtaagcctcagtttctccacaggtaaaatggaggtcaaagccattccaacctcattgggttttctcgaagatcaatgagatgatgatgcaaaggcattagctcagtgatcagtatgtgagagtgtctgtttttattatccttttcattatcatgatgatagtcatctatcttctctcaggacatctccagggatggagagctcatccctgcctcctgctttaccttccgcatcaccatcacttgttaattcagcaagtgtacgttaagactccactgaatgccaagcaacacattaaggagatgaaaaaatgaagaaagctcagccctacccacaaatacattaaatgttaatggacagctctgattacatcataagtaaagcatgattagagtatatacgtattttttaattgggaaaggaatgtatggattaattattctccgcataaaataaccaccagtcacttaccagttagaataactagttagagtttctgattgagactaatgacagagtgtgtaagaaaacataatcccctcgtggaattcattcatctacccagctcttaaaacctgagccctgagccctggaatcccagacccatcagaggttagcacagagggttcctatggtacaagatgaggtctctgtcaagccaggtgactccccaagatcacgcaatgtctttctaccaaaagctagtggctgagccacgataagaacatagctcccccgactctcaccctggtgctccctccatcgtgccacagtgctaatacaagggcaatggagcccctgggagccaatgttaggtgctgtgctgagagtcctcataacaggcatcccactgcatgggcgagaacagctcaacagtaggcgtggtggtgccagggattctgtgtatggttcataatttagttggggaggcagagcatgtgcaaatttgagactccccagctgtggaaactgaacaaatccagatgaggagagtaaaagattatttacagacttacaaacttcctcttgggaagggggattttgaaaaatgcctgagtagtaaaaggaagaaattttggtaagtttgtgagttgaatgaattcttaacatatggggataaatcaaattgggatggaaaaagtccttccagaagagagaacaagtatctgaggcgttagtaatctctacttcttacagcctagacaagtaaggtcagataagcatcatgatctgcccaaaatatacaaacagcctaactgggctccagttcttgctgccaggcccctaattgagcagtttagttggcctgtcactgtgaacagcatttgaatttgcgtggtgctctagaagtcaagctgtatgtgttaccaaagtgctttgagcacatgtgtggtcagctacagaatccctcagaagagggtgtgttgaatttctccctcatcccacttgcaggaagcctttccccattggagacaaggtgaccttcagcggtaaagaatgtgtgtgccaaacgtgctcccagtccatggccagcagtaagcccatcaagattcgtggaccaagccgtgagtcctccccacgggtatctccctgtccatgggtgtgatctctctgggctcccctttcccagcactgccaactgctcccacgggcctggagggaagtgggagaggttcccaacctggaggcctcctgcatcatgaccccattggcatgtggcccagactcacaagcttcacaagcacaatgcagggaagaggggctgcctggccataaacagtggtagccagtgccaatatttgccacatggtatgtctcctctgggacaagctgagttcctgatcttatgtcccatggacgcctcaatagggctgatcaagtgttttttcaccagtggctctgaatttttaccaactccactaataagaattggcagacatggcttacagaagaggtagtatggggtgccctgggagcaaaccacaagagctgtgttggtgcctcttagagtgttccatagaccactgcatcagcttcactgtgggacttgtaaaaatgcaaatgtctgggctcaccctgcacctctagggatggaacctaggaatcaacattcccagtaagcttcctgggtgattcatttgctgttcctgagattcagaaccactgtctagggataaaggcagcatctgtcatgccatgatgaatgttatgttttatcaccaaccacagatttggagggaaactgaggaccaggagcgcgcctcagaatggtcattctaatttgtgggatgtccatcccactcaagtgtgcctagtgataagatatctaaatcactgttcccagatgcagttggcaggctgctgctgcacatgcccacacacacatagaccctgcccccttggtcttggtaagccacactaggctccagtgttctttcatgttatatgacactctcactggcctcgacaagaaaatcaatgaaaattccattagcctcctgtgctgcatcactgtgcgggtgcagggtgctgttggccatggcaccagcagagtcagcatgctgggctgcatccagccagagagagtgagcacagatcaccccgagtcagcagggcttagctcccaggggctccccgggagtccatccagctatggtgagctgaggagaaagacagtgggaaggctccctcccttgcctgctcttcctttcagccaaatcagatctgttcctggaatgtgcggagccctttctttggcatccttgatgatgctcaagaatagattgctgctccaaccaggtttccatgtcaaggtgactgagtgcatacagtgttatccttcacagctccttgaaagcatcatccagagtgacagaaaaacaaggaggctgggatatgggaccacgaccctgtggccaatgctgctgaggacctccgagactgatggggccatgtgtgaggcaggagagggagaagtgagcctgagtcgggaggctgccaaacttctgcatgctgcaaagcagtcatgaagcctccctgagactcagtttacccagttatgaaagagggatggaatttcctatcttcctcacaggagcgttggggaaagcaaatgtattagttcagggatcaaactaagatacattgcttatataaaatgctctataaatacagagtgagggatgatattggcatggaggtttaatatagaaagcacaccaaaagaggttgagaatgagactcctgggtcggttgttatttcccctagtttggattgtgtgttactgtatgcatttgtgctacacctatcacctactctttaggtgggatatttcttcagctgaatgtgggagtctcacatgtgagtatgttttcaaagagaggctcccaaatgtgtccaccataatttggatgattaggaggtggaagaaggtgaggaaaaagtgagtcaagaggagcaaatgagcacatggacagtttccagtgggggcatacttagtattatagcttatcttgttactcacaaagtaaagacatcaatccgtgattgatcactgattgtctatagtggtatgttttatagaggtattttctccaaaggtggtcactattcatgctgcaaatgcaaagtagctcctgactagatggggtgttggaaggtcttctaagctcccatgggatacaggaaaccaaagccaggtataagagattgctaagaaaaagaacatatcatggaaaaggaaaagaagaacaaaataattggggttttttaagctacaattgtgatgtttcatctctggagagtaaataaagatattctggaaagtcaggagcagtgtctactccaaagagaccaagaaaaatactcaggaactgtcaagagaaaataattctgttacttaccacaggaagaagaaatgtttcctcaccgacctcactgagaagaatcagcaacagtagcagcagaaaccccaccaccacaaccttcaccatcaccatcaccacaataatcatcatcattgcaaacattgattgactgttactatttccaggcactgcacagacctcagtgagaagaatcagcagcagtctcagcagcagcaccaccaccgccatcaccatcttatcaccaccaccaccatcatcactaacatcaccagcattgccatcacaccaccaccataaccatcatcatcactaacatcaacaccatcactaccattgccatcaccattgcaccactaccctcaccatcatcatcactaacatcaccaacattatcattatcatcactactatcatcatcaccacaatcatcaccaccactatcttcaccatcactaccatcatcatgaacaataccatcagtgccaccaccatcatcaccaccaacaccactgccaccaccaatacaatcactaccatcatccccaccaccactacctccatcactactaccaccataaccaccatcattgctaacactgattgactgttactgttgccagatactgcaaaaacctcattgagagcaatcagatgcagtagcagcagtaccactgctaccaccatcatcaccatcaccttctccaccatcgtcaccatcatcatgaccaacaccattgacaccaccaccacaatcaccaacactgtgtctccaacacgatcactaccatcatcactaccatcaccaccctcatcaccattatgaacaacaccaccatcaccatcaataccattgtcaccaccaacacaatcaccaccaccttcgccaacgctaccataatcaccactattaccactatcgccagcaccagcagcatcaacaccatcaccaccattattattaccaccatcatcactgtcaccatcatcaccaccaacactgtcaacaccaacaatatcagcatcaccaccactaacatagattattactattgtcaagcacctcactaagtgttttatacagatatttcatttaatcattacaacaaccctatgagggagataagagtaattattttatagatgagaaaactgagactcagtgagcataaatgacttgcccaaagtcacccagataatgagtaatggaactagaatgtgagaccagccagtctggccttagatcctattcccttaacactctgtaccagagacatgacttgcaacttgggaagtgtctagtcttcctggattagttgcctaaaacaaggtacggagcttgctatgactcacaaaacccactcatttctgctgatttaaatagaatgaatgacacagtctaaaaaggataaaaatggctgtctagcgtctttaggaggcctcagtttataactgagggatctgagagggacaggtggtagcatcatacattctgccagctgaagattgtaattttggaatagagaggaacatatggaggagtggacagctggctctgcagacaccaacttggaacagggtgtggttttcctgattctatttattacaccagacccacgggctcctgggtggcatgcctgaggctccactggtggtcaagagtgaaaggaggaagaagagggcgaaaaggtcctaataaataagaagctgatataatggaggagcagcagtataatataaaaagaaaagccacatggagaagatgtcccagaattctcacggggaatcagcaggcttccctacaacaggactatcgctcctggcttcagaacagggattgggtaatgcacagaatgtgggttaaaaacaggagaatgtaaaataataatgacaacaaccacgtattggattcatatgggccaagcattgtgctaaggcctaatgggcctgattttaattaaccttcacaccagtgttttaaggaagatattcagatgagcaagtctgggcttagagagcatacaactcataagaaaaggagctgggattctctcctgggccaatttcccactgctcactccaactctcagcccagcctctaaccactgcgctgtactctctcctacagcttaactcaaggggttaaatttatctcagatgtaccactgaaagtcgaagagataggattcatttctagagtatggccatgaaaggatacagctatgcaataagttttgttgaagaaacagagaattgtgttgtttgccaattacatgtctttctccatggaatccacaagtgaatttgatcactggatgatcatgtcaagcaagaaaaagtgtaaggaataaagaagagagaaactatagttgtctttaattctttaaaagaactgtcgtatgggaaaagaggtggattattcttgatgcgtaagaatgggagcagtcacgggagtcaagtctcagctccatataaagaagacagtcatgacaatcatacctgtccaagggcagagtggacttcctcaccaccccttcctcaggaggggttaaactgcccactactggaggtgattaagcagaggagggtgcccacttgtcgagaatgctgtaggttactgcattgggtgggatgtttgaccaaatactctgtgaactccaaacccctatggaatttttaggccctgctggggaggcccacagagatacaagttcagtattagtgacctagaaagcttgaccaggtgtctacagtccttgggttcctctatactgagcttgggcaagtcatttcagacccctgtctatctgtaaaagagaagggggtacctgacctctctaaactattgcattctggagtctaattattgggcagggggtgcaagtagacttatagacttaccccaggagaatagaaaggaagagagataaatcccgaaactctttattctctcagcccccatctgaaggcctggggcttgaagcattttgcaagtagagacctttctgcccccaacttgtactaagggatgttagaaaggcacgcaacagccaagaggcggagtactgtgggaactgactcatacaaacacttcatcaaggccccagaccctccccacagccggctggacccaccacccttcctagatttgcagacacatcatcttttcttctaggacaggctcccagctggatgtgggggctgtccagccagaatcccctaactttacatgcagtttctgctctcctcactactcccaagtgtgcatttgtcttatggagccaacagggaagtttgtcctctggtcaactttgccccatgaccctttcctccgccaaagtgggtcatccggttggctaggcctgaattcccagcagtttccaagtgccttggacgttggctccatttccggaccctcctcagacattcattgagcaacaagctgatgctaggcttgtcccacattctcttggccccaactcacattccagggtgaccgtgtcagggagtgagggcacctttctggtttgggacagtctcatcagaccctgtaatccttgccacttgggaaggcacatgttcgatgtgtgaagcacaatggggaaggggtgggtgtggtaattctgtttgttgcctgggtaccatcaggcccattcattcatacacatttggcaaatatgctttgagttactgctatgggctgagcactgtgctaggcaaaggaataggtttaaccacaaaatataaacacagcccttgccaatgtgtatatagcctaagggtttgaaaaactgtatacttagcccatccccaggagcagtgcttcttaaacttttactctgcacggaggtcttgttaaaattcaagaggtctgggtggggtctgcaatgctgcacactgccagcttccaggtgatgctgacgctgcagatggcaaggtcacggacagcagcagagcttagttagcaatttgaggagggctggaagcagtgcagggtccactttcagtgaacaatgtggtcttgatgacaagcagggaggtctttctttctctcctacaccaagaccccttgtcaagaggccaggactccagtggctttttctctcccctgggagagcctctgggaagcttccagtgtcaggtgggagcaactatgggaacactggcattcagggaggggtttccttgacgtgggcctgagatagcgggggttaaagggcccagggtgctttgctcagcagtgtcctcttgtcttgcagactgtgccgggtgcaaggaggagatcaagcacggccagtcactcctggctctggacaagcagtggcacgtcagctgcttcaagtgccagacctgcagcgtcatcctcaccggggagtatatcagcaagtgggtccccctgctcctgccccagctgcctgggcctctgcattctgtgaggcctgccccattgagcccatgcctacatctccagcatcatctcccttcctttccgtctgctgctgcattctggccaaacagcatctttcccagcagcctctttcccccgttggaccctcccgggggggtttccctctgcctgagacaccctccctgttccttgcacgcctgctgccccttctctcccttctggtctcggtccccatgccttcccctccggccgtctctcatttactgccccgttttgggccctcagagtaccttgttgtttccttcacacaggctaccaccattggtaattacatatttatccctggtaactttgtaataatgctaataatactatctaccatttattgagctttaattatgtagaaggaactcactactttgtatgaagtatcactttaaatcctcataactgcccctttgaggaatttatccccactgaatactcagacttgagagagtaaataacttgctccagtaatagtgtttaatctctgtacccaccaggagaggggctttgttttaatcactgctatatcccctgccctgagagcaacacctgacccacagtcaataatatagttgctgaatgaatttaatggatatgagaggaggtgatgggtgcatagttatccagaggggccaacctccagtgacccacacactgcagtattagacaagtgtcctcttgttgctgggccccagtgaccacatttatatactcaagtacctaaaagtaattatcagcacagatcctttgtcacagctttgacatcatatgaccccagacccttctaggtgccactctctggcctgatgccaggcagtggcaagcacacagagctgcagcacacatgcttctgctgtcaagaccctgcagtctaatacgggaaacagatatgctgcgttcatgaagaattatgacaccaggaaatgtgtgatcaggagcccagacaagctttattctttaagacctttttgatcctaagtgacagaaaacccacctccaactcaattaaaagcaaaaataggagtttattaactcacagaaatgggaaggccagaggcacactggcttcagacatggaggaatccaggggcttaaggatgtcattagtacttcagaagtctctgtctttctctatctatctttttgtctctctctctctctctctctctctctctctctctcaatttctctttctctctctctgtctctctttctctctctctgtctctctctgtctctgtccctgtctttctctgctgtcttcatggtggattagttctcaatctggccctccccaagtgctagcaaagaagattgccaacactccaggcttccataccaagcctagcagaaaaagaggcctctttcccaggaactccagcaaaagtcccaggtctgcctctgatttggccactgttaggccacatgcccattcctgaccaatcactggcccagaggatctgaaccctagagccagagagcagcctcttgtgacccacagggacctcaactgggaaggggtggcttccaaagggaaatccaggcgaggtactattatcagcagaaggggaaatggatgctggccaaacaacacctgcctgtgtccaagataacaaataaagggctgtgaatattcagagaaaaaaaggatgactgctaactagcatgaagtagaatcttgaatctctgagagttccatggaaggtgggggtaagattcaaaaatgcaaagaagaagagcttctaggcagaatggccagcctgggcaaggccagggcagtaggggagtgttggacatctccatcctgtataggagctcaaacatgtgcccaggtgaagccagatcctgggctgcataggtgagctgaggtcacatcaccgagagctctcgatgccatgctagcaggagtttggcattcccctctatgcccaccaagcaaggagtgcccttagtacattgccagccaggagtgcttgagtctggaagcctaaatcagagttctctagggacttaagggattgttcagagctcctctcaaggaggcccagcccagattgcccaccacacctggtacctctgcagcatagctctgggccccttacctggctgctggcagagtggcaggggctcagaggcactggctcaggcatcagatgcccaggatagaagcgcagcctatgtgaccttggcaagggactccactgctcagagtctcagtttcctcatttataaaaatggagagaagatgatctacctgtagggttgtgtaagggctcagagatctgtgcttagcacccaataactgcccagtaaatactcattttaccatcctcttttagaattgtgtaccgctaattccccaagagaaggatggatccaaaagagattgtgttggcatttatactcaaatcttgttggctcatcacatccaccttctgacaaatgactttttctccctgcagagctaccctcccgcacccacagagtgagaacctgattgagcgggggaggagggaggagttgaaagggttgggggaggtgtgtctcaggggctcacaaacaagtccttgccttgtgggcacagtcacacctccagaccttggtcggacatcttcagaccttggtcctcactgctgcttctccaggaaaatgctgcccagggtgggcccccagcaacctcatcagggcaacagcttcgagatggaaaagtgatgtgcctctcctttaggtctctcagtgtctgagccaagttctcttacacccaaaagtgaaagaaatgtttctcctcagagttcagacttggtcattagagcgaggcagagcccgaagcaaagctaagctctccgatgcccccaactatctctacctcagtcctagagaactgagaaccaaatgtcctcctcaaagactcctctcagcaatcatggccattcctccagctgccatttgctgagtactcagtatggctaggcactgtcctgagccctagggtacactggacccatctcctttaatcctcatgacaacctgggtgagaaaccagacaacctgggtttgaattccagctctaggtcatcctgggtggcctgggacaagttactaaagtgtgctatgcttaggttttctcacctacacaatggggatactaataattctgactcatagggttgccatcaaacaccatcaaagagcccggcgcacaccagcaacaaatgttagtggctattagtcatagggggtggtataagaataagggataacaatcttatcactgtccgccaagtgataaacattgggtaaaaaatggagcacacaggaggtggtcccaggaggcttcctgtcatctactgatctgggagcacagtcagatgattctttcatacagatgaaattgtttattaaaggagaagtatcgaactttggctcagtcaacataggctgcaggtccagaatctaaatgccatgtgcaccctcactgatcctccctaacttcctcatcctatgtgaacttcttcttgcagggatggtgttccatactgtgagtccgactaccatgcccagtttggcattaaatgtgagacttgtgaccgatacatcagtggcagagtcttggaggtgagtgggtataagtaaccgtgaagatgtggcagggtgatctgtgcctccaaaaagtcatcacagaagaaggagaaagtcatcccatacctttttttccatagcctttacctcctccacctttgcttgctacatgaccttgagcagataaccttgctgagatctctgggaaaccccaaaatgagaaggtagacaaaattcttcctggttcaaaaaatgctgtgctgggaaaatcagttgtatctttgattcggacccagacagatttctaaagagtgacattaggattttcctcccagccctgccggagaaaggaagtcttttttatttatttatttatttatttatttaattatttattttgtttgtttgtttgttttagtatttggtaatgtgctgatttaagagccagcttgtctagcagcttgctccctaagcccttctttggtgggtccatcaccatggcaacgcctctccccagcctttgatgtatgactccttctgcagtgacagacaacctgcaaaacccttgctgaggccttgctgagcccctgtgcactggtctttccggcctttcttcctataccctgtgggcctggaagctatcttcctatactttgggaccacccaccttgatgaattagaaacagggaagggctcagtggaaaggaaaaataatagcctaacaggaataattgagttctagtattgactctactcctgctcagattttgagtaagtatctttgcttttctaggcctcagtttttccatatgacaatagctagaggatcagattggatcaggtattgtcagcagaatcattaattctgccaaatctggccagttggttgtggttaccatgagtgctttgttgagaacaagtctgcagccacatgtagactcagcaggaggggatgtagcaaccaggaaggaactctctgaggacatgcattgaagcagagccctgaggatgaaagaactatccctgaagggccctgaggtgggaaaagatagaggaagaatgagcttgacccattcaaagaacagagaacccacacagaattgtggctgcagaatttttctcaacacaagcactcatggtaaccacaaccaagtggccagatttggctgaattaatgattctgctcacaatagctgacccagtctgccaatgtggctgaattctataaattgagggtaggggaggatgaaatataagagtatatcatatatggcataccatgtaggactttgtagaccatgtttagaagtttgggttttatactcagtgcaatggaaagccattggagagttttaagccaaggactaacatgataagatcatgtttttaaaaagatttctgtggttactgtgtggagaattttcagagagagtcagagacaatgagatataaacaaatgagcagagctgggaaacatttaagcatctcgagagctgtaaggagtgcgatgcagaggacaaggcatgagtccaggaagggttgttgggggtgggtttctgagggcctgggataccagggtggagtttgcatgtgactcactgggcaagggagcattgtggagagactgggaaggaacgtcctggttagagctgggcttctgggaggatgacgtgataatgtacacaggctacatttgaaggaaggaagctggaagggatgagtgaggaggcccctgcgtgacccaggcaggaaggactcaagaggtacagtagcaatggagagggaagccacccttgtgcccagccctatggaagtagaattccaatcactctgcaactgaggggcagcttgtggacatggggattgaaggagaagcagctaaaagttgcaccaaagaattatctatttctgagggataggaagcctggtgtcattggcagaactggggatgacaggggaaaaagctgatctggcagaaacatggcgagtaccatttaggatgagttgtgattgaaatcccaggagtgtttccagaaggcagtcagaaatacggatcagaggctgggagtggtggctcacacctgtaatcccagcactttgggatgccaacacagggtgatcacttgagtccaggagttcaagatcagcctaggcaacacagtgagacttcatctctataaaaaataaacaaaactagccaggcatggtggtgcacgcttgtagtcctagccattccggaggatcacttgagcctgagaggtggaggttgcaataagttgagattgcaccactacactcccgcctggacaacagagcaagatcctgtccgaggcaagaaaaatgagaaaagaaaagaaatatggatcagagctcaggaacaaagctcaggcctggaggagccaatcttaaaaacgtgaggctttgaataatagcaccaccagagtcctcaggatttccaagacagaggaaagagagcaaggaaggaggctgacaccaaccttggcgagcagctgctcacagtgaaagcgactcagaaagagactgaggaggtagcagaggaagatatgggaagagaatcgggcattcagtgaaaggacagagcttcagaaaacatggtgaggtcagagtgttggtcaaactctgtagagcagtgaaggactgcgtgggctgcggaaaagctgttggatgtgggaaaggtcaccttcagaagagtcgtttgttggctttgcagaactgtggggaagaggcatccagagtgtagtaggttgaagggtcaatgcggtgggagatattacaaaaggaaacttttctttccagaaagaaagaacttagattacagacagggccacagatggaaatttgttcagcatttccaagctgctttgaaatcctgttggtggcagctgccgtttccccgagagttaccgttgtttagcattgcggtagactgttcctcccaggcagctgttgtgactgagtttcgattgatcccatttctacaaggctccattagcatcttcgacttattgattttttttttttcttagagctggaagagacttttagcaatcaactagttcaacctcttcattttacagatgagaaaagtgagaccaagacatgcagtgtttttccaaggtcacaagcagcatttctggtagagacagagctaaaatctaggactccaggctgctgtatctaccgatacccacagctctcagccacttgggggtctttgaggtagcatgatgtcaggaaatagacatggctgcagtaaaacagacttggattcagattttaccacttctagccctgaagccttaagcaagatatgtcctcttagtctgtatctatcaacagacaatactactgtcatttaattcctaatgaacacgttagtcaagactttttgggctgcaacagagaggaagtttctcagctcctataacaaaaagcccaggagctggatccagtgcttaagcgaaatcatttagaatccccagccatcttggcttactttcttccaagttaagtttattctcaggagggcgttcttggtgatgggaaagttggacaccagttgccccaggcttagattctatcagccggcacgcccggtggaaaaaagaacttctcttttctaatagctcagcaagcattctgggactgactctcattggacaatctcaggcccatccctgggccactaattgtgcccacaaagttggaatatgctcattggtggggtcagcactacttaaccctgtggactgatatggagaagaggtagccccaccaaggaaaggcttgggactgtttctggaagaaggaggaaagaatgatggccatgcaggaacaacagtcgcccaagcacatcgtctggcacactgcaggcattcaattaagttgtttctccttctcttctcatcctgtcccttcccatttcctccctaggccaccccatggtcccttcctcagtgacagagctcaatggctgtcagtgtcactccttccatccctgtctgtttcctcaccaaaaaggaccacaacctggtttgcttgttgctacatttttgaacctggtttgctgttttcggtcctctcaaatagggctctgttttgagggtaccaattttttgccatttttctttactattttcctgatttcagttcgttaatagacaaaatggttcatctcagctagctgacgtggcttttccttactctgggtgcaggctgccctacctccctttgctcaaactgttttcaacaccatccaagactggggctgctgagatgggcacaaagcctctttcagctggggtgaggtagtggggcatgacatttaggaaaatgctaggcttcagttttgccaaggcactgttgccacactggaaaacaggtctataatcaaaatgataaagagacacagagtaggaagaggctgctaattaaactgattatccttgtcatggtacaagggaatcagtcccacacattccagcttaggaaaatagcaggctccttccaaagtttgaacatattcgctttgatgatgacaaggacactgtctcattggtgcgaggccatataaacaaacggggggaaaaaggaatattggagatttttttctttttgtaaaaatctgcctttcccacattcttgctaagtttttagaatagagataatatctccagaataggcaagcccatcccaacaatcttccactccccccacataaaaaaaaaaagaaaaaaaaaactaagtttggaaataggtcttcttattatgcaattataatttttgaattggaaggaacccattagcatcagatcaagtgatggcttggacagggacctttaagaacccctaacatccatcagtttcccctgggcattaccctcccccaaagaaaaccctgccctgacgttgcaaaatatttcttcaaacaaggcccacctgccaacccaattgctgcaccaagctcctgcatatacaaatgctggagccgccgctgaagttcccttttacaagccctcttggctgggattttggtgttagaattgtgactccagaagcaagtgctgagctggtgactgactcacacacatccggacccaacactgctgctggcttgcagtgaacccttgaggcacaaccttctcaggggctgtttcttccccccatggaagtctttgcagctgcaaattattttcatttttaatttaaatagtgatggggaaggaaagtgaaaatagggaaggcactcaccaaagtcacactggggtgagctgcggtagggctggacacaccagggcaaaatagtcacaggactggcctggggatctggggctctacagtgggtcctaaatcacccactgagccctaaaaatctgtcctttgtgtgccagtctcacaatttttgccatgtctgtgaacctcgtgagctgattcttccataatactttaagtgtcttgaggttggctcccttatatgtaaggaaacttatatacgacataacaggaaagcagtatcacttgccatattgcatgtaacctgaaaataaatagagttctagctagattctattgcatgtggaggttccaagcctcacacctgttctcattctttaaaaggcagatttgtaggttttggatagatgttaaagacacataagcaccgaactggtacttcgtccttgacaaaatcagaagaatgtatagaggactgaaaagatcttttttttttttccattggtccaatgttattaaatcccaagttcatgtaccacttaaaatcatttcatgtaacattagtggtaagggcctctcacttggggaaatgctgggatgtcctcaaagcaagcctgtttcctcctctggaaatgaggaagttggaccagtggcctctcaagtgtccttcccagtgtcagaatagaagagcaggtattcagggaagtcccctgaactgccatcagggatccatggagtgaatcacgaagcttcccggctggtcttttagatggttgtggactcccttgggtagctccaaccaactttagggccatgaagatgcaaacaacactaatgtacccaggaaagattcaaacccaatctgccccactagacagcagccctggctctgacctcctgtttcatcttttcatttccataggcaggagggaagcactaccacccaacctgtgccaggtgtgtacgctgccaccagatgttcaccgaaggagaggaaatgtacctcacaggtaagtaaatctgaccctctgtaaggccttccgacctgctcatgactggaaaggagatgcgatcttcaggttcagtgttatcttggcttcaggttcagtgttatcttggcttttgccttgtcctcagaattgcaattaattggcccctctctgggtggattgggaaggttgccggtgtggctaatatgaagtgacatgtaatctgccttccgtctctgtgcacctccacccgctgcccagctggactgcttccctggcagtgctctgagcagactctcctggctctgccttgggggtgggaagctgagctgcacaggcccaaggggtcagagaacctcagagggatgcctgggttgcaaagtgtctatagcatcacagcctctactctacctccttctccccacatctcagagcatcatgccaggctgctgctcagggcttcccagggactctcagaacacacagaggaatgaggagtgccagtcgtccccacaaagctaaccagggctgctttccatctgctgcttcccagccctcttaccccaggattcttacaacagtcccctaattagtctccagattctgctcagtcctctaccctctgcccagcccaccatcccagggcatcacgtgctcttggcactgccctgctcttcagagcccctccctgtctgcctatttagctacaaacacttcagcctagcatttaaaatcttgccaaggtcccaggcttcctttgtagccttgaacatacccgacacctaagctaccaaagctaacttttgatcatttattcatccactcaatgattgtttcttgagccctgccatgtgtaggctctgtgccagcgtccatggtgaggctcacccagccctacagtcccctgaaggagatgggcattaatccataatcacataaataaacatcagctgtggtaagtgttatgaaggagagaagtgtgggcctttgagagcacataacggggtaggaggagccccaggagggctccctgacgaagggccaggagctgagatccagaccatgagtgggtgttaactgatgttgtagttcatctgggctgttataacctcagcagactgagatacagacagggcagcttataagcagaaatctatttctcacagttctggaagctgggaagtccatgaccaagggtccaatagatttggtatctgatgtggacccactttctcagagatggcaccttctctctgtgtctccacatggtggaaggggcaaggcagctctctggcgcctcttttataaggacactggtccatgacctaatcacctcccaaatagccctacctcctaagaccatcaccttgggggttcgaattttggcatatggatgtgggggacacaaaaacatccagaccatagcaactgaacaaaaagtggaataggatgcaccaaaatgagaggacagagcctgcaagactctgaggtgggtgaagaaatggcgagtgcataagggcaagtggagcctgtgtggccagggcgcagacagaagtgagatgcagccaggaggcaagcagggtgtatgggctgggccttgtggagagactttgtttggacttaaaatgaactcatggccctttcccttgtcttcctgtgcccttctttggaaatcctatcatttgaggcccagttcagtcactacatgcttcataggcacccaggatttccccaaccccacccacaatttaacacagtcctctcttcccccatccccacagccctctgtctgcccctggtcccctccagcttgtatgagagttgttggcctcctccctaaggtcctgtgctcctggcacttgtccctcagccctgaccctggcccatgcatactccctccacaggtgaatgtcattggtggaatcgctgtgattggatagccatcttgagaaggaattagggcccttcctccaggtagatctaaggccagggcagcagttacagggagtgtgtcagtatcagcttgtcctagccacaatgcccacagccatgagttccctcaagatgcaatgagtccccctgtgcctacagctgagttccttagcctcagcactggtgacactgtgggctgtcctgtgcattgtagggtatttggtaccatccttggtctctacccattagatgccaaccacgtgcttcttcccactgacaatcaaaaatgtctcagatattgccacatgtccctagggggtcaaaatcatcctcagtggagaaccactggcccagagctacccaacagaaacttgtgccatctgctaagaatcctggagcaggaattcctatgttggattaaacaaagtgaccatttctaagatgctgtctacttacttatatgaactgatgctggagtggtaaggatcccagagtcactctaaactgtaaagtgccaaccctcattgtagagatggggaaaatagacccagagaaaagaagagacttgtgtgagaatgggagtgcgtcagggcagagcagggcctggccttgcgtctcccctccagggttctttccactttacccctgggacccaggccctgcctgatattcaggtccctgtcccttcctgtgcacaccaatccctcattgcctgggttcttgagtgattcctgctgcaggaaccagtgttatgaggctcagcaacctgcaccctgccttcatcctgaccaccatgggaacctggagtttgcacttggcttgaaaatttgttgcacaatattcctctcctccttccctggtgaacaaacctcctagtattgaaactgccctcccattctcatccctacctggatatcactagaataaaccacgtctttgcctccctgcctgaattcctaatcttaatctttccctgttgggtgctttcacccagagtgcctcaggggggatcctggctccactgattactaagtttttgaccttgggcaagtctcgtaactctctgaaacttggctgtctaatatgtaaaatagaccgagaacagttgctataagatataggtgtagtaatttcgtgacacatgggaagctcccatttcaatcattcatttagcaaatatctattgaggatctactgtgtccccgctgctgttctcacaactgaaggtgtggcagtgagcaaatcagtcaaaggccctgccctcatggagctcacagcctcacaggttagtgctttcattcttccaacttcccacaggtgctaaaagagttaagcaaggaagtaaagtgcatagctttgtgatcctgagagagaatgcaccattaaacctacagtggaaatgcctccaagggtgggagatattcttagtaatgaagatgagcctgtcaccttctcattaattatccccatccctctcctggctcctgggagagtgggagtaattgcagggcattcaaggacctgcctgaaaggatgctaagtgatcctggaatgagggggaccaggccaagcagtgctagagtcacgctcacttgggctgtgagtgtcttgtgggggttctgctaccactgagatctgggccttggacaccctcaccaagtggggacaccaggattcaatatgatatcccccagaattggcaagaaaaccctgctcctgggtagctcaggagtgtaaagaagtggctgagagccaggactcccgggttcaagcgtcagcaattccactaataggctgtgaccttgagaagtggcttccttctctggatctcttgcttcacctgtaaaatgaggataacatcatcgtctttcattgatccactcaaactgggggccacgctatgtgccaggctctctgctacatgttgggcattcagagatgagtgaggcaagcatgcttgctgtcctggtggagttcactctctggaaagagaaaccaacagtgccaaatagaagtgtaaacattcaatgacaagctgtgacaagtgctgcacagagaaagttttgaacaatgggcatgtgttataaagcccctgctctagtctgggaagccagggaaggtgcccctaaaaagggatatttcaagccaagaccttgaaaatgagtaggaggtgggaggctgaaaagggcaggaagattgaggaggcagtgagaacagtgagtgcaaaggccctccctgggtgggtggaagcagaacgaggtggagaaactgaggcaggcccacttacctggcacacagagagcaaccatatgccacaaggtcctcatgaacattagaggagagagtgaatgtgaaggcactggggactccataaagcaacttatataagagagagagagtgttgggatgcctgcaaagcttacaaacccagccttgtcagttctggagctggacacagcatggtactggcaaatggtccttgggagattctttgggtgagtttgtttgtgttttaattgctatgtgatggctttctgatgggctctaattgggagaagtctgacgtctgtctggaggagaacttctggggccccaggagacaagagcaagttttatttgttttaagttctgttgtgtattcaatcttttaactgtgtttgtaaagatgccaaatatctaatctgtttgttatccaaacccttcatttgggcttcaccaggaaattaggtcactcattttgtgcagcaaaataatggccaaaatgctgcaggttcagggcaaaacttatactgaaatcccaaaggttgcagttactagatcagtgagagtttttttaaaatcccaaatgtggttcatgagacaaattttgctcttgttctaaatgtgcctgtacccaggaaaagggagaaaatagactcttcttctacccttctgtctacaccaaataccctcctgttctaagacctgagacaataaccctggaattacgtaagttcagctgcacattttaaaacaattcgctgttatcatttgtatatttaactaaaacccacaaggcaggaaatcatttataaaatactggacaaacctcactctgctaaagaaaagtattataacaaattataggtctcaccaataataatgataataataaaaatattaataataataaaatgccatcattttattattattattaataatataattattatttgttggtatactttgagcatttactatgtgccaagtactgtactaagagtttgaaacacagtatcccattttatcctcacgacaaccctgtcagctaaaaactattaatgtcctcattttagaggatgagaatgaaagtttcaagagcatacgccacttagccaaagtgggcctgtcttgctagggttcttggaggcaattttcttacatctatattaccagaattcttaaactggttcatggtcagccttttgaactctatgagtcttctgaaattgcttgctaaattttgcatgctaggtgtgtttctttaggcagagggtccatagctttcatcagattttcagaggtgtccatgggccaaaataaagtgaagagacttggttctgtgttaacacaaatccgaaacggagtctcaaaagcttgttttgataattacaccaaaccccaaacccttctcttgtgtaactgaatctatttcagattacttttttttttttttttttttttttagctcagaggatacaaggtcctggtttcaggagctgtgtatttctggcatggctgggttgtaactcagaaaaggtgcactaagctgagagatgttcaagtgagggcctcccattgttatgggttgtggaacgccagccctcagtcatcatctacgcatttcatgaaaccaccctctaaaaggcactactgtagtattggttgctataatttcgtagtttagcattattactttaaattggatctctctactgacagcttaggttgtaggagttatgcttaaaaactttaaatcttatgtttccccaatcctactacctaattttagatttttcagacatattctgttactgtactaaattgatacttcctgaagtctgactctactaagcatatttcattttaaatagagtatattttaatttttggcgagctgccatttttttttttatttagattttaagggttaccaagcatcttgaatcatatagaaagtattacagtgtagtagcttaaggtttgtatttctaaagtttgtttccagcttctcctctcaggtcaccacagactcatgccgatgtggccattttctcgcctgtcacatgtcacatcgacttcagcagtcaatttgtccatgttggtcagaattaggtctagagtagcaatttcccggcttacttcctctattttctgagaaacaaaattgcctgctgggcaagtcaagaacttgtcagatattcaggttttagctcgatgagacattttattagtctagacattttaggtgacagaaacctaactcaagctatgttaggcaaaagaagattgatcagctcacagaactaagaagcgtctaggagcagcacagctgggtcgaggggcccgtgagcaccatcaggtggttcttctccctgtttctttttgtgtttggccccatgctctcctgcccagactggctgtctccatgcagtaggacagagggcctggccagccccctgccaccatcagtacagagaggcagcatgtcccgctaagctcagcagagaagttccagagagtctgaggacctgttgcccacactcaggccagggtggggagacagagacggacaagcaggttagacatccaagctccctaacccccaacttcccatctgtaaagagggatgaggctaggctccatctcacaaggctgttgtgaagattaaatgaactaatgaatgcatggtaaagactcagcacagggactagcattgctggttctgccagtctgagctcatgataatcagccagttatatagaaatggccattcccatgttgcaatgcagtagtaagtgcttgctgttgtcaatattatcagcatttttaagaatacttagcataaggtgcagcatatatactcaataaatggcagttattattttttatatttaagcactattgttataaagtgtgtgacacaaggcctggtatcgacactctataaatattagttataatagtaacaataggaataataagaatacttagggcctggcacatactaagcactcaatatactttaattactgtcccaactgttattatcagcacctattatttctcgtgaattacaaggcacctcagaattgccattttccccttctcatcctgcccgatatcctccatggtaaccagcctcatggtaactaaacacttttctccctccaacctctttattaagcttcaggcccacttcatcatgtcagctccaggcaagtaggtctttcccacttctcccgaggtgcccttgtccctgggcacaagcccaacctcccaggagggtgcgctggcaaccaagccaggcttctgttcagtgactccacctgcatagccagcctgccatgtgctgcagccccctcgctcacccaggccccagctccctgctcccctcaagtctcccttttactgctctccccttacccaaactagatcctggcacacagattatttttgtaggtggaggagaggagacaataagaacaacaatacccaacacttatatagtccctgacataggcggacaccgttctaagtgctgggcatggattaactcattaatcctcaaaccaaacctatgaggcagatactgttgtcatccctgttttataaatagggaaaccaaggcacagagaggcaactgacttgctctagacaatgcagctagtaaatgatgtagccaggattggaaccccttaagaatattacatgaaatgatgcacagagtgcctgataccagtaaagatttactaacacccaagattataatgatcacactgttgttattacagggcagattcaacagcagtgttcactcctctctctggccgagtttggcactttcagtagcaaaggaggaacagagtgccttggtctacagaagcaattcacctgctgggaggagaggagtgggaaattttttatgttaatgtaaaattctcataacacaaaattaaccattttaaagcgcacaattcggtagcttttagtgcattcacaatgttgtacaacccccacctctatctagttccaaatcattttcatcacttcaaaaggaaacctcatacatgccattaagcagtcatttcccattcctctgtccccgaacccctggcagtcaccaatctgttttctgtctctatggatttgccaattttgtatagctcttacagatggaaccatacaatatatgttcttttgtgactggcttctcaccctgagaataatgctttctaggttcatccgtataatagcaggtatcagcaggtcattccttttatggctgaacaatattccatttttggatctaccacattttttatgtggatgaagattttttaaaaaaatttttatttccataggtaattggggaacaggatggtgtttggaagttcttcagtgacgttttgtgagattttagtgcacccatcacctgagtggtatacaatgcacccaatttgtagtcttttatcccctacccctttcccagcctttccccctgagccccaaaagtccattgtgtcattcttatgcttttgcatcctcatagcttagctctcacttatgaatgagaacatacaatgtttggttttccattcccgagttactttacttagaataatggcctccaatttcatctgggttgctgcaaatgccattattttgtttcctttatggctgagtagtattccatcatatatacatatatatatatatatgtatgtatgtatataatatgtgtgtgtgtgtgtgtgtgtgtgtatatatatatatatatatatatatatatatatatatatatatatcacagtttctttatctactcattgattgatgggcatttgggttggtttatgtgcatggagattttaaaggagcagttccaaggttcctcccagtctattgccacaaagatagtgctgctgtcataaaggcagaggtctgagaaacctcatcctgctatggtgaaaaaaaaatccagaggccaggcgcagtggctcacacctgtaatcccagcagtttgaagactgaggagggtggatcatgaggtcaggatatcgagaccatcctggctaacatggtgaaaccccgtatctactaaaaatacaaaaaattagccgagtgtggtggcatgcacctgtagtcccagctactcgggaggctgaggcaggagaatcgcttgaacctgggggcagaggttgcagtgagcctagatcacaccactcccctccagcctggtgataaagcgagactccgtctcaaaacaaaaaaagaaatccagagaggaaacctgccgtaagagaatgccctagctagggtcaaggccaaaaactccaatgcccacgtcaaggagtgggaagggctgggagtcagaaagtagggagggtcactggtgacctgcagtatctaaaaaccttcagactcagaactgtttaaaatcatgcttactaaacagaaccgtccaatggaccactttcaatcactgtacttgtaacctctagaatgccaacattctagaagactatgataccaactccagctttggcattaaaaaacaaaaagcattggccgggcatggtggctcatccctgtaatcccagcactttgggaggccgaggcgggcagatcacctgaggttgggagtttgagaccagcctggccaacacagagaaaccccatctctactaaaaatacaaaattagccgggtgttgtagtgcatgtctgtaatcccagctactcaggaggctgaggcaggagaatcacttgaacccaggaggcagaggttgcaatgagccaagatcgtgccattgcactccagcctgggcaataagagcgaaactccatctcaaaaaaaaaaaaaaaaaaaaaagccttggcaaatttaacatcagggtgtagcagagaggtgggtggcttccccaacattaaatcagccccaaatgttacaggtgtggagtgtgctataaccaatcagagagataagactgactgctgactctgctaacgattaaaaatggccttaatacctggctgacagatagttttggagattaacatctctatctctgagtcagctgatacagaaatagctaatccttcacttccataaccttcatagtaggttttaactgcagagcctggaattgtgggtgacaatctcagaggacaggaggaagtgactcatggaaccaggagttgaacaagcagaaaatgttgtactcttacaaaaagctagagctctgccttataaaattggtttctttatcacataacattccaagaaaataaatttagagtgttatctggtatttagccctgtggttctcaaattatgagtcataaaatcacctggggagcttgttaaatcacagattcccaggtcccacctccagggagttggcgtcagtggcttctgcaggggggcccaggaatctgaattttaccagactgcaagacaggtgatccacaggtcacagtttgacacaccccaatatagtgaatatgtttgtagactcagtctggagttgtggctgtctaatcagagtctagattgtactacttgtccaaatctctgggcccaagttagagaagccaactgcctaagatagaatgccatgtttcttttgtttatttattcactcaatgagtatttattgagaatctgcagttcctgcagatatatctgtaggtataacagacatgaatcctctcctcatagaatttacattcttatcaggataaatgggtggggcaaataattatcttctcggtacagtaaaacctgttaagatggaaacagaatctctaaggatttgggggctggtaaacatcccttagtgtaagtactgtgtgctgagtctccttcctaatatcactgctgagcatttatatacccaatgtgtacttaaacacttttagggacaagggcttactgtcagttgaataaggccattcagttcttaggtgttaaatgttccttgcctgaaccttctgcccttagtcctagttctacaaaacaaatgaatgcctcttcctacagagagtcattaaaatctgtaaaatcagctttcaccattctgttaagtctcttcttcagggtaaagacccagccttagaattgcatttgagtccccttcctaggatagtcaccatcctctcatgggtgcattatacctagtatctttttgaaaaaaaatacaaaggtagggtccaatgagtcattcacatgcatttctttgttaaacacacatgggccaggcactgtttttggctctggggataaagtccactgaagagaataaccatcttcttcaccatgatgttatccttctgttaatgtcacattgttgagctattggcctagggaataagctcagaagaccgttatttcacagggatcttcatgaacaaatcatcttttcttgcattctttatgtaagtttattgctagctaccaactaactttttttagcctcttttatttacagatatactaccaactcctaaattctgatttttttcatttctaattatattttttttcttgtttgatcctcctctccttgtttcttatgtaaatatgctttccggtatgcagagtgctgaagttaatggccatttttggctcagttttatttcagagtgaaatgccaatgttatggggttagaaagcaaaagagaccctctagtctgaccccctcgcttgacacattatttccttgtatgaggacttctgccctcttgatctttcctatgtctctttaacttaagttcatgacctcctcagacctctgtgtccatctcatccatttcctacagtgacctgtaacatgtgtttcctgccacagccacagtcataaacaattcctgatagattcggaagcaactcagagaggaaccggaaacgctctctctaataactccctaaagtaagaatcccaacacacagcttggtagtggacacaccctgtgattgctggatcaagccacagactcagagtccctctactgggctctgagaaccattgcattttactttagaaagaattaaacccagttgaataataaggaatacccaagtatgtcggcagacaaaaatcaaagattcttgttccacaaaagacaaaactgcccgtaaaattagaaacttggagatgaaaataatcttcaaggccacccaaatcccaccttattgttcttcagatgaggaaactgggacccagagagaggatgtgttaggggctgagcagagacaaaaaacacaggcctcctcacttcaggcctctcttctctttttcactccgatttattgacctttcaccaccatctcatcccttagctagtattccggtcctgggggttccaggcaacaaagcataatataaagtatatcctagagacaaagtcagacaaacaaatgccatctggatgctcaggaatccagccattgctggcttctttccttttagggctggttacaaggggaatggctccagagggataatatgttcctatttttccttctaatccaggacacctgtcccttctttggggaatgtgtcatatttggggctgcttctcaacatgtgagcagccacctgttgctcatgcctttccaaattggcctttcgggtttggggctggccaactggacccccacccacaataaaatgtgggcgttagcagtatactaaatttgaagagtctggagtctctgaggaattagcaggtcaaggcaatgctctcaagcggaatatacaccatgacacctcctcccccttaaatgtgatagctctggtagacagtcataagtctttaagagaaaagaaagctggagttcaccatgctctgtcactcttttttatccacactgtcatttattcattcaacaaatatttattgaccacctgctatgtgtcactgactgccaatcatgcactcacctcttcaccccacaaacatgtacggatctcttctaagagcaaagtcccgtgctggggactgtgggagatgtagcaatgaataaagctcagctcccgcccagaagaagctcttgatttagtgggaaatgaaaaatccataagctactgtgccttaaggctgtatgtgtggaaagagacacaaagaactatggatcacaaaggacagagaagtcacccccaactggcaggtaagaaagtttgcaagaggatgtcatgtgagccctagacctttaggaacaggtaggatttggacacacagaaaaaggatgtgagcggtcgcataggtctgagaggtgccaggagggagctgggaaagccaagagggcccttctggcagatgtgtaagggacatacgctgaccacggagtgaatcaaggtgggacatggggagagtgctggagggtttgaaaggtctgagtcttcgttattttcatgaccccttaggttccgaggtttggcaccccatctgcaaacaggcagcccgggcagagaagaagttaaaggtaagcaagctagtagattccagaccagcactcctgctttgctactttctgccacaggctaagggagctgtgctttgggacagggtcagcattccttagtgtgcacactcccaaatgtgtgcctatgtccttggattttcctaacggtaacacctgccccatggggtttttgagggggttaagacatcggatatgaaagcactctgaaaactgtaaagcactgtattcatgagagttttgtgtttctggggtgaggctgtaactctaccattgctgaccaagatggcagcctcgctgagaagctctcgccatggtttttcccagcctaaggtcactcgttaataataatagttaataatgtcacagtaattgacagtttacaaagcatcttcacaggcactgtctgattttactcctttaaccctgtgaggcagatgggcaagaaattctatctttgccttgcctgtgagaaaaccagttctaaagaggtgatgatgtgcctgcagtaacaaagcacagccgacatccccaggtacgcgctgggccagctgaggtcctgtgtccctctgaattactgtgttctgacaaatgtcaggaaggcttgtgaatctgggttcctgatactgcagagagggattgagcctcccaggctgcaggaaggatccggcttctgggtctttgatgatgtagaggagacacctggggtgtgtgttgggggatggggaatggggcctttacatcctggcccccggatatcaagttgaccccttgggactctattgtgttacctgctagagtctatccaactagaaaagcaagtgcacaatttctgaccagctagttaaacatgtcttccttgctatctcatccacttaatgaaagttttctgaaagagccagtttattgatgcataattatgttttaagccctgaatttctttccctgtttcttgcaagaccctctcccatttaaggtataagacctaattgtccctttcttcattttcctcccctttggtggcatttcccaaacttcagtcatcgtctacaaccctgatgcctgttgccatatctgtgcaccacctgtttcattatatgcttaatctttttctttacatcaagtcactactttttattaactaaccttattttaaaataaaactttatattgccacgtgaaaaccagtaatacttgctataaatagaaggtaatcataaaataaattcaatgataatgaaataattcttaagaataaatgtttaaaatcctagctagacaatgttgtctgcactctctttgtttaaaaagggaaattgggctgggagtggtggctcaagtctgtaatcccaacactttgggaggccaaggcgggtgaatcacttgaggtcagtagttcgagaccaggctggccaacatggcgaaaccccaattctactaaaaatacaaaaattagctggatgtggtggcacgtgcctgtaatcccagctacttgggaggctgaagcaggagaatcacttgaaaatgagaggcagaggttgcagtgagtcaaaattgtgcctctgtactccagcctggatgacagagcgagactctgtctcaaaaataaaataaaataggaaattgacaattgttgagagagttgttgaaaagaattagcaccaaactgagacggcctccttgatctatcaaggggattgaaacgttagattttactctctaactctatgattcagtattatcaaatgttccaccttcatcttcccagaaccaccgctagttcacagtccacaatttaggaaactttatagccccacttagaatgctttaaattgtaggatgagaaaactgggagagaatcaagtgatcctgaagctcagcctcttcatttcacagatcaagaatccaagatgcctaagaccacatacttcacctgtgggtccttgattcctaatccctttacatcaggcaggcaccctcttatgcattaagactggcatcatgctgctctgctaaggaagctattaatccatcattgccattgttcagagacagttttttttttaagtttatcacttaagttgatgtcaatttgcaattaatacactgtaaagaatcagcatattgtgcaattacgtgaaatttaacccacttttacattttgaataaacaaactcccaaggaatgaatgctaaccaattttattttttaaaagaaatacattattgactgggataactcaaaatgaaaagttttatgagtaatttcctatttagactgctagctgcaaatacgtagaaaataaatccatattccacccctaacagcctgaagtccttgcatttttggtcgcattcatactcagaccttgacttgaaagacagagaataaaaaggaagtacagaagtagccagagagtactttaatggtattgctaatgttgcattcttaaccccctgtctcaccctccccaccaagctcaggttgcagcttctcaccttttctgtcttcatctctctcacagcatagacggacatctgaaacctccatctcaccccctggatccagcattgggtcacccaaccgagtcatctgcgtatgtatcacttttctaccaccaaagggccttctttattcctgacctggtatataaagagtcactaaggataagggagctctcaagttttcatccagctgacatttgatgcatgctcttcatgtgctaggctctgtaccaggtcttgaggatccagtggggtacagggaggacatagatcccgccctcatgaagcaaacagtctagtaaacccagagtttcagggataatgcagagttccatggagcacgagaaagaaagtacaatgacagcaagagcccttgctgagttctaaaaccaatgcaaggtgcctcatttcccactacttaactgagagcaagaaaaaactgaggatcaaagtggtattctgaataggtattaggtggaatattgatgtggagatagtggtgggtgataaagaggcagaaaggagaaggaagccacatacacatgtggaaacatggctgtaaagaatttgcaaacataaggaagaggtttctaatcatgtgggaagtccagggatggagcagacccacctccatgtgtctgagctcccatctccacaggcattcaaacacagagagactcatcatttgccagggatgtagaagaagagacagaagttgagttcaatgacctcagaggccccttgtatatgtcattcattcattcaacaaacatgtgccaagcatttactctgctaagcacagtgctctgctctggggaaatggtgatgaactacacagacttgatgcctgtcctcatgacattgaagacatagtgccatgaatcatcaattgcagttataaattccaggaaagaaaagcacagggtcctctgatgatactacagataaacagagggacctgacaatctaggactagttgggagaaggcatcccgaggaagaaacattaaactcaaagcagagggataaacagaaataagctaaaggaggtgggaaacgcagagccagggagagctgaaacgagcagaaaacctcaatctgattgactctggactgttccagccttccacaagccaaaggagccaagaagaccagaaatgtggggaaaatggtctgtaacaagaaacccattcctgacaagaagctctagatagagtcagcaaaccagccagccctggccctgtccactactgccagatcattacttcaaatccacatccagtctcctctttgatccctggataatgcccattgatgggactatgggcacctttcctttcttctctggtcaaatggaaaaaaagaaaaacacttaagagttatcactgactgaaatttcaatatgggtcaatactaccatgtggctgtcaaaaaagacaagctgctttgatcacaggctgtactcatggaagattcctttctaaagcaagaaaggtaatagtctccctggcactgtgaatggggccagaccacagcaggattaatgggcttagtttccaggcatgcacagtgagaatgttattgacaaatatgagtatgtttccagaagagagttactagaataggagcactcaggaagctgctgcactgtaatactgttcatcacaagctggtctcccggtgctactgaggggccttgtaaacctttgtgaaataagttaagccctgatgatgttcaccgtggagtcctggagaaagattcccagaattgcccctgtgatgagcaactccattactgaatggaatttatgatggcagctaggaacacctgcgcttgtgccttccaactaggggcttacacattgagatcagttgtccctcacatcctagcagaggcatgtgtctccccttccagcctctcctgctctcaccgtttatggtgcctcatgctcagctgctcctgggaatgactgaacatgtcatagaagccctgttttcagtgagcccatcccaagcatggctttcaaatttggaaaaaaattcatccatctgctttggatagatgcaataacaagcataaagatggattttaatttagttttaatagacatttgagattttagattcaaatagaattatcagtgaacctgaaacgagcaggttctttcaaactttcaaactttactccatctccactgacttctagaatcatcttcaggtggtttggctttgacccatgtgttctcttccttccttcctggctaattatgttaggatgcctctgatcaattggtgtgtccagacctgaggctcatttatagccctgtaaacaaagtggctataggaagaaatataaatttagtgtttttgaggtttggggtaaagtgccaaaatgaatagttatgggtcgagatgagtttggaagatgccaagagctctcaaggtcaagatctaacagccaggacaaaaggcagcaattacttcagcaagtggactctcatctaataaaggctttttttacccacacacccccagaactggtgcagatgtgagtgtctgtaccaggcaggctctggcagaaatcaggtggcctacctcaaagagttcaactgaggaaggtttcatgacggagttgtgggcagggttaagtggacccacaggagacagtgaggtattcagggactacagcaacataatgttgttaccacactggacctaaaaagatgagggaagggaacagcattaccaaagctggcaagagctggggaagcccagcctccagagagagtcatgcccagcccacagccagccaggaaggttgccaggggaataagtgtgccaacctctctctccattcaccctctagtctctgctggtgcatcccattggctaaacccaactgaaagtcagagagcaaaagagcctgtgatacagcccaggcagtgttcaggacatagatccaggcaaggaagggtggacactgggtctaggggcaacagagaataagcaaccctgccctaattgcagtgctgatgtggcagggatacaatagtggaagggctttggtaggttttcaaaatagcacagcttataggtatttatgaatggtgcttcctataaagtagtcttggccctgagactgtacttggctcctatggcattgggagaatgttatcagactaatacagtctctgaattctctatctagcagcctctgttgtaatttgcagcacctcaggaccttgcaagacagatcctggttgatcatagcaaacaccaggtcacagagggaacagctggaggacatggccgtggaaaaggcatggcttcaggggccatgagatgcgggctgtcacatgcaaggggaagctttctttcaatccatgcagctctagagggatgaactctgccaaagtcaagcagaaggtagaggctcatttcagttcaatggaaagagcagctttctgaatgcagccttctgacggtgtaagacagtgaactccccatcccgagaagacaggagaggccgctgaagagggcaagctccctgtgttgaaacttgggctcttgcaacttggacaagttaattgatttttctgtgcctctggttccttattcaaaaggaggataatgttggtgcctactactagagttgtgagttgtatggatgaactgggttaatctatataagggacttggtacagagcctggcttataataagtactcaccaaatgttagctagtgttttactatcatgattatttttgtctttaccatcttcatcttcttcttcaaggatgctgtgaattgggatgtcctcactctgtgggatcggaaggcagtcagtacccaggctgtgtagttcaggctgaattcaaatctattagcttagtggtgcaaactgtataaccttttgagcctccatttcctcagctagaaaatagaaatgatattgacatttacttcacagaggcattacaacatctagaggatataattattataaagcacagggcttacaaacaatatgtgctcaataaatgttagccctgttggaatggatggcctctaagaccacttttattctaacattctactattcttcaatttgatcctaatctgtttgtggtggaaactggagaagtttgttccttctgtatcttgtttttgtttcctctctccattcccttttccctcttatctttctattcctttcctgtccatttccctcttccctaggctaaagtggataatgagatccttaattacaaagacctggcggctctccccaaggttaagtctatctacgaggtacaacgccccgacctcatttcctatgagcctcattccagatacatgtccgacgagatgctggagagatgtggctatggagaggtatcgcatcttgcccttctctctggggctattgtaggaaaggagattgctctggggtccccagccctctccatcacagacagtttggcctccacaatgctggctcccagactcttctacactgggatttatggccaacgttttttaaatgaagagatttcatttggctttctggctcttcttgaaaaatcagagccgacaaccttaaacctacatttccaccatctggagatgggaagcagcaccccctatagacaggacatgagctttccattccccccagtcccccgactccctgttaatcccagcattgaagctaagagcctgtgaccacttattactcaagctgttgtatttcttatactgtaggaatttttcatgtactcagcccaaggcgctcatctcctgccaggctcagtggccatttagatttataatccctgattataacatgtctaatcagacatgttctctggttttcccacctggcctttagccccagtgtctcttcaaaggaagagacgcttttataaagactcagtaacagatagcttttgaaatcattaaatggttgctaaacaagagaaagtgttttctggagatggcagcagggttgggggcagaattaccctggaggtcctggcagtctatatcctagaagatttctaaccttatcccagaccccttgagttaatttgaggcagcagaagcctgtcctggtgggcagggacccaggttcttgtcccagctccaccataactagcctcataacctcaggcaagttcccttcctccctaagggatttgggttccatttggttgaagagcccagtgctgagattctctggtttccggcccctgaaatgcaccaggagaggaggatcaagtgtttagtagaagccgcttgtccttcagttagagatggcaaaccagggcccacaggttgcagccagccctcagatttgttttgtttcactcacaaagtgtcttttgaaaatgcaaactagttgtcaacaagtaaacactgggagatttcatgtaagaatctgcacttctgtctttcttggaaaattaagatgctgtgtaaatgctgggcaggcattccagctgctggagctgaggaactgctgccctcttcagtcgagacatcccatctccagctgctgcaccagccaccagctcaactcccttgttggtggccccagcctggcccctgcttagccagggtgctggctgctgggtgccctgccctgggcatcgtcctcatgaactgtagaggggtcatgaaccagtagagagacaaggaaagggtggtgacaatagccctgagcatgcagcacagaagcctgggtccaagtcaagtccctgccacttctgccctgagtggccgtgagccttcgtattctctctctgggccttggtttttcccttcctaaaaggcgggcataatctcgaggtttcctgcctcctgtcagtagtctgaccctctggaattcccagcgaggctgttatctggagaggggtacaaaggaactgctgcaaaccctctctgccgagccatctaaccatgctctgtccttcgtctcgtcctcctctcattccttctgctcgttccacaactgccttcaaactcttcacttctaagtcgctgggaacattatctccctactcccaggtaattcagctgatagagaattaagttgatatataattgtgcccctttatgtggacttcacccatccccagccccccgaaggtgtctgagcccttgcccaaggtattccctgcaagcagggaagtgctggagagactcgggtgcatgtcctggaggaagtggtagtggcatacaggatggaaatctgcccttcctgcccagagatggcctccctcaggcttctgggatccctggtcaggattccagggattgaccccatagattccattcaagggcctgcaagtaatgggggaaagccctggaaattctctgccatcttcctcgggctgtgtgtgtaactcagggaggaggggggtctctgtattcacacctcaaacccgagaatcccagattccatgtcatgcccacctgcctgctagaccctcgggccacaggcccacttaacagccagccatgctcacagccccatttcctctcccaggacatctacgagaacctggacctccggcagagacgggcctccagcccggggtacatagactcccccacctacagccggcagggcatgtcccccaccttctcccgctcacctcaccactactaccgctctggtaaggaagggggaggacctgaagggagaggaagagccagggagacaatgcagtcacttggggtccctgctgcagagggcacaaggctcccccatgatctccatcacagtgtggccctctggaggcctatggccacccaggtgaccagctgggcctctctgagtccctgagatggcaggggggatggaggagtgtgtggcactgagaagcagcaggaaggtgggtggtgaacttccaggagagggggctggcaggtggccctgtggccctggtggaagaagactccaccatcctcgtggcctgccccatccggagggcagaaccaagagaccagaaatatggctatgaactggccttcacccaagggccaccccagccaatccagtcagaccatccacagtcaccctcaggttgggggtgatgccagcacttggatggaggaaaggagcaattaagggagcgtccaaaagggggaggttcaaggatggttggggagataagaggttcaaactaacatgccttcctggagctcagtagagttgatctttacatctcacaaaatctgactttgggatcaagccaggaagcaaagtcaagcttgtttctgccaacgtggtgcatgagagcacatgctgcttccgccccggaacctgagcacgctgagacgccccagcccatcccccatctctgctgtcatcacctcaccacttcctaaactgccaccgcgttaatgcctgttttctctgtgcctctgttttctttggcgaccacttcctgcgtgctccagggcccgagagtggccggagctctccataccatagccagttagatgtgaggtcctccactccaacctcttaccaggctcccaagcactttcacatcccaggtaggcactgccagcccagaattcctgggatggatgcatgctccatggggtcacaggtgcctgagtcaccccctcgatgccacacaggcaccaagaagctggttcctgagggacctccctaaccaagcacctgcaccaaccctgtcctccaaccccaacacacccacgggcttcagattatccacttgacagaaccagcctccattaggacctcaaagaagcagtcccgggaagaaaagaggcagggagctcgagtgagataccgtgagtgcttgagggctgtgaggggcgcagcaggggcacacagcggtgaaggctacacactttggcttcaaagctcttgggatggaatccgatgcagctgcttataagctcatgactgtgagccagttacttggcttcccaagccactgttattccttctgtacagctaagcactgttctgggctcagaggttgcaactgtgctcaacccagcccagatcctgccttcatggtatttggtatttacgtactaatgtaggaagagagataaaaatgagtaaacaaataggtagaggataatttcaggtagccataggtgccataaacataaataaaacaggccatcctgagagatgatgaggctgagagaggccaggctagatggggcggtcaggaagagcttcttggaggaggtaacattaaagctgaaagatgagaaggggcctggcgtggtcgctcacgcctgtaatcccagcactttgggaggccgaggcgtgtgggtcatgagatcaggagttcgagaccaacctgtccaacatggtgaaacgctgtctctactaaaaatataaaaattagctgggcatggtggcttgtacctgtaattccagctactcaggaggctgaggcaggagaattacttgaacctgggaggcggaggttgcagtgagccaagatcgtgccactgcattccagcctgggtgacaaagtgagactctgtctcaaaaagaaaaaaagatgaagagccagcctatgaagaagccaaggaaagacatcccaggcagagggaagagcactatcatgtcatgtgaccgcaggtcatgacaggaattgagaggaagacaggggctacaggactgagtgggtgtagtttggacaaggtctccctctgagtcacagcagagccagggctgaacctcagtctcctgacaccaagctcagtttttcactccccactcacgttcccctcaagagctcatgctgctgtttcatctacaccttcctcagctgccctagaggggtcccatcctgtctgtctttgagggagggggagggaggtaagctgaaattcggctgcagcatcctgggaattttcacatggaatgaggtgtggccactggtggaggcagtggacaccttcctgcatggggctctgctgagcacacacacccctgtgcctgcatgctcacccttcaagccccaggtctcttcctcggcaccacttggatccatccattcctcttcccgcaccttacttggaacctgttgggacgaggttgaaagttcaactttggaagaggaagtcaccaggggaaaaagatggtggccccttggaaaaagttgttgcccatctctctcttctgagatcaactgaccaagtactatctccttttctcccttttctcctgtctctctctctcccctccccactgtcccttcctggtctgtctggcagctggagacagtaacatctaccggaaacccccgatctacaaacggcatggtatggtcagaggtagatagggcttggccacacaaggagaggggggaggttaaccatctatgcagatggccctgcacaggccaccaggagccacaaaacacaaggctgcatcttggtccttcttgttgactgccccatcacccagggtgacattagggcagagtttggtatcatttcaaaagaacaaagtcctcatgtcccctcagttctttcccaccacctttgcaatctcccccttacctgctctctgtcatcctaagttccataattggtaaaacctttgtaaaacgcacatgcccctgggagagtcacactccaaggcattaatacttgaaatgttcattagaataacaggggatgcatacagattcctgggccccaccccaggcttactgaattcgaattctgtatgtgtcacggtttctccaagtgattctgatactcagcccaacttgggaacccctgctgtaagttgttctcagtcacagtctcctgagagtggatggagacttgcagaggagatgtagatgagtaaggttgcagagggtgacttccttctttcattcattcattgatttagtgtttcttaaagaatgatctatggaccatctgcacctgagagacatttaaaaggcagattccctggccccttccttgccccagactcccttaattataaatattgagagtgtgaactaagaatctgcactataactggctttgtccatgattcctccctgcacttagtatgagaaccaccaagtcattcatcactgacaccacctgttcacttttgcaaaaagtacttactaagcctcgattgaaggagcacatcccttccattgaagctgcagaggagcagctgccaccctgtgcacccacacttgcttaagggtctagctggataacaaaaggaggcccagaatcggtggagcttggagatgagcgaagcagtcctgcaccaggttctgaactaattagctggtggaggggacaatacgagtttaaacagcggctctgggtgcctaagattctacattttatacagacatccttggttccagagggggctgagcaggggggtccgaggtgagtctgtgagcatgtgcaagtctgtaccagcttgtgaaggacatgccatgtcccctgagtactcatagaaagacaccaacatgacaaaggtagtttggctttatacctagaaaaggcccccaggtcacaagcttctcaggactttgtgggattttccaggtgggccctgaggggtggcactaaagcagactcaagaggagtctggggtggaggtgggttgcttggaaaagagggcggaggaaaaagctaaatgcagtcagccaggaggggctgcccaggacccaagtcaaagagaagaatttgaaagctttggaagcaagtgctgttgtgggggctgcatagcccagggctggctgaagctgatccaccacgctctgccactctggctccacagagcacagagcttgtccctaaagcttcctgtagctgaccatgagaaatggtcatgcagccacacacacttccccagcccctctctctgctctaccagcctgtcacccacgtttgggccacgagaagtcactgctctgtaagtagttgtgactgcagtgggtctttttggtcacccctgtcctgggcttacttcaggtggaagcttgaagctggatggcagctgagccagcagaccgattctgacacttacagatgaggaaactaaggcagagatggtaggacctgcccagtgttacagctgagtaaagtggcagagctgggaccagaacccaggtttgctgactccctgtctagcactccttccttcaggctatgtagtccctgagcagaatgtggcatctcaggttgtgagaaatgatggagttcaaatttataacaaggaaggcttctaaagggctaggaaggcttctaaagggctggggctcacctgggacctgtccagtcttatttgaggagccacacccttagaggtcattctggaacagacctgggaatccatggaatgtgctggaaagagccctgggctgggatctggtccagttctggtgctcacatgctatgtggtcttaagcaagccccttcccctctctggtgctccaattactaaatgcaaaatgagggtttggccccagtgcttttccagctccgatgctccatggcccagttctaacagagagccctgatcttgaagtggactcactcccctgggctggagcctggtaaagataggaaaagggtacacagtcccatcccggtcactctgccttcctgaagtgctctccttgggtcctctgcaggtgatttgtctacagcaaccaagagcaaaacaagtgaagacatcagccagacctccaagtacagtcccatctactcgccagacccctactatgcttcggagtctgagtactggacctaccatgggtcccccaaaggtagtacccccataggagcctgggtccagggccctaacacctgtgccaaggacacgggtgttcagaacagttgcccactcctttatacaatcattctgaataagagtgcttagagggtttataactaagggtgtttattcattcaacaaatatgtactaaacactggccatggaccctagcaatacactggggagcaaaacagaccaggtccctgcccttgtggagaagacataggccccagccatgagagggaggtgatgcgcagaaggtaggagagctgatggcaggggcctgctgtccagcctgaagatgacaaaagtttctcaatgcagccactcagctgccatcaggagggtggcaaggatgtaacacagcagagagtgtagaaatacttctgcaaagacccaggatgtgagagaggattccactggaggaaagaaaaggctgtccacttaaccttgaactcagagaggaagagaagcagtagaggtgagggaggaggtcccccagggttttgagggttgaggtaaggattttggttgttatcctaaacagtgagtggcatgatcacattgaaagtagtggcatgatcacatttgtgcttttgagagaccactttggctgtagggtaaaaaatggttgggaggatggagaaagagaggatgtggggaggtggaaggctcctggtaaggggtctcagtggtcctcagataccacctcacccaatcatacaacccaagctgttcctttcaagtatggggggaaatttttccccccatcaagatccactctgattcaatgtctttactaattcaatgtccattctgagcaaagcttcacagaagctcagagatgactctttggtgctgggcacagtggctcacgcccgtaatcccagcactttgggaggccaagttgggaagatcacttgagcccaggaaattgagaccagcctggacaacatagcacttcttctctacaaaaaaatttttaaaaattatctgggcatgatagtgtatgcctgtagtcccagctacatgcaagcctgaggcaggaggatcccttgagcctggggacttgaggctgcaacaagccatgatcacaccactgcactctagcctgggtgagagtgagcccctgtctcaaaaatttaaaaatttaataaaaggatgactcgttcgctactctcaaagaagtcttcatttagaaaagaaggtaagacacaaatacgactataaccaagtgggcagtgatccatccccacaggagaggagtgttcagagaccacaaaggcagcagagaccactttcagctgatgtggggcttagcttaaacgagactgtttccattgaaaaataagattaaaaagaaagaaaagtggcttttcttttttaaaaaaaaaatgccttaagccaggctgagtggggtgcacatgccggagctgatcttttctgtcttttgacagtgccccgagccagaaggttctcgtctggaggagaggaggatgattttgaccgcagcatgcacaaggtgggcagagaccacagcactgaatatgatgcttagagcgtatatcactgagggtcttttcatttacaagcaacaaaaaacagattcaagcccacttatgatagaaaaaagaaaagcatagctttgcataactgaaaaatcaaatggtggaattagcttaaagtatgactagatccaactgctcaaaaaaatgtcataggaaatttgtctcttcacttctggggcttgcctctgcattggcttcatgctcaggcaagctattttcacataatggtaagcaggtgcttgcaacccttgttcattgctggtgaaacccttgtttcagcccctgtggaaaacaatttggtggttcctcaaaaattaaacataaaattaccacatgatccagcaattccactcctagatatatacccagaagaattaaaaacaggacttaaacaaatacatatatactcatatccgtggcagcactattcacgaaagctaaaatatggaaataatccaaatgtccatcagctcatgaataggacaaaatatggtatgtccatacagtggaatattattcagccatgaaaagaaatgaagtaatgatacatgccacaatgtggatgaaccttgaaaacattatgcttaagaaaagaagccagacacaaggtcgcatattgtgtgattccatttccatgaaatatgcagaataggcaaatccatagagacagaacatagattgctggttcccaggggcacggggagaggggaatggggagtgagtgcttcatggatatgggatctcctttgggggaaataatggtattttgaaacgagatagaggtggtagttccacaacattgtgaatgcactgaatgccactgaatcatttcctttaaaatggttaatttgaagttaagtaattttcacctcagttaaaaagaaaaaggtggctatctgcccattgttgaatcaatcactgtgccaagacaatgggatcctgtcactggccaggcttgcttttttgtgcccaccaccagacccccacccagaccacaggacaacttgtggaagacaagatgagattgcaacaggaaacatgggtgccacaaggtgggagggacgctgggaaggcaaacatgagagcaggctgctatggaggatgtgatcctcagccttgcccaagcccgttccatctcagtgtcctttgttttccttctaactttatcttgctcttccccgaccctcagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctgtaagcatggctctggaagcccaacggggcggggacacctttctctgtgactagctggcagtgtcagctgtttgctctgagccaggctcccttgaggcacagcccatgcatcctctctcttcttcctcacagcagccctgtggtgggtgacttgcccaagatcactcaatttatcagtaatggagcttacttcatcagcttccttgcctgcttttataaattaggttctattggaatgtagccagccccgtctcaatcccctgggctaacaaaagaatcagaagaggctggccacaaaggttagccccaaaccctgcaatgccccttctgggagcttcattgaggtctagaatacagatttggaaaggcgctctatggggcactatgtaagaccatgctgccctgagcagtcactcccattgctttggggcatctgaagctctgacttccagtcagattcagtataaagaaaaatggcttggctgggcgcagtggctcatgactgtaatcccagcactttaggaggccgaggcgggcagatcatgaggtcaggagatcaagaccatcctggctaacatggtgaaacccggtctttactaaaaatacagaaaattagctgggcatggtggtgggcacctgtagtcccaactactcgggaggctgaggcaggagaatggcgtgaggcaggaggcggagcttgcagtgagccgagattgcaccactgcactccagcctgggcaacagagcgagactctctctcaaaaaaaaaaaaaaaaaaaaagaacgatgtcttataatcatcggaatggctcaaagatgtaagggatggcctcctgaggtagtgagtctaccatgatttgaacttatacaagcaggggctttattcaaatacttcttgaaaatctcattgcaagctcctcctattcctggacacacacacacacacacacacacacacacacacacacactctgtctgcctcctccttttcttactcctgtgagatgcagtcctgccaggaaatctcatctcggatcaatacattatggataataaaatgcaccatttattacacttctatgtgccaggcatttgtaggaatgttacactcctggtagagctgcaatgtagagggattattatcacccactttatagatgagagaactgaggttaagccacttgctccaagtcaaaagccagtaagtgactgagccaggatcagacccaagttggagtggccccaaggccatgagctcttccctcttccccatactacaccttgactctcagtgagattgaagatgttggtgttggcggcaatatgataaagccagtcttatggagtgttatagatgcgtcaggcactatgctaagtatcttactgtattgtgtcacatattcttcacaataatcctacaaaggaggcactatcactccccattttgcagatgagaaaaccaaagcgtgattaattagattgtctgaagttagaaatctactaatggcagagccaggatgaactgctgagcctgttttcctgcctgaccactgagggccactgtttccaagccctggctgcggggtctgtgcagtgcaccagtgctgtttgcaattcaaccttgttcaaccacatctgtgcaacaaatatcacagagcacctgccctgtgccaggtgccaggctgggagctggacagggaagggagatggggtgcaagtgcaacaattaaaaactgaccagttcaggaggggctgcaggaggccccttttcccagccagccagggggatcgggtatggaagccacatctctttgtccccatgaattgtcttcaccatgtttgtctttcctcatgagcaatgaccttcagcttttctctcctgcagcccctcggtcgcactacctggctgacagtggtaagttctacctgccctaccttcagcccatcatgtcccatgagggacagagctgtgtcagctgcagttctccatagttctaatgaccatacaatgtggatgtcccagcccactcctgatctcaaatagtctactccattgtatttgtcagattgtgggtctgcatttgggtttctggaactaggattgccatccccaatagatggtcccagaggaaaaaaagtgcacacacctcttccaccacctgggagccttcctacctgagttctgagcttgacttcaattccagggcctttgtccagagccagcctgtggccaggacacaggggtctatcacaagaagatagagatgtgcaggtcaaggatagaagagtgtatgagtgggtgccttgggcaggtacctagaattctgctagagtgaaatgcccccagagatggtcaagttgcaaatctggagagcatcaggaagagttggtggcctctggcctccaccccttcctgctaggttgggagcagtgttggccattggtagccagatgacctcagggagagggactcatggcttgggactcctgataattgctctagatccttcttttcagatcctctcatctccaaatctgcctccctgcctgcctaccgaagaaatgggctgcacagggtaagaagctgtgctggaggatgggggaggacgttgtccccaaaatgctaataaacccaacattagcttattgtaaggtgaaacctgagcaaaggtcctggggctagtggtgggttaactgacacaactgtatggcaatgacttgctcccctccctggtgaccccttcgtgaaaaggggcccccatgggaggggcttgggaacaactagtacttattgggcaataaccctgtgccagggactcagctaaacactttgcaagcactaatttgttttgccttcacaacccatggaggcagttactatcatttaccctactttgtgcatgcagaaaggcacagagaagtgaggtgacttacccccactcttcaacaagaagtagtagagccaggattcaagcccaggccagctgatcccacagcccacccccaactgctatgctccactggcctctaacatggcctgtacattttctgagctccctgagcgtgctgttatggaaaaagaaaagtgatgagcagggtaaggaggattgagagttcatggaaggagtgacttgcaacttccagccaggttgtcagggcaaatctcctagaaaaaggggtgtttgagcaatgaaagaaagcatgaagtgaaattcaccaaataaatggatatatattgagtagccaccatgtgccaggacaaagcacagggatatagcagcgagttaagtttccctaacttgagacagaggctgctgagaaggccctatgtcccacaagcgccagtccattttctggaggtgggtgagtgcttcagggaggcagaggtgagcttatctcaggccagccgtggttctgtctcttctgcagacacccagcgcagacctcttccactacgacagcatgaacgcagtcaactggggcatgcgaggtgagtgcaggcctgcagggggtctgcagggagagtgcctccagatgtaccactcaaaactgcagcttgaccttcggcaaatgatggctacagattctgtccccacgctgggctgtgtccaaccctgagttcttactctctttcacttcccaccccctcccttttcccctgctcttccgttatcctctcaagtcctggccttgggtggtctccaagccacctgtcccatctgggttcccagaaccatcacagagttctgctctcttctccctggactgtggaccgagggttgcctgccagccccagtggagggaagcactcagagccaattgcacactgttcccagtaagaattccatgagcttcctgctctctgccagtgatgctttcacaccaaactcgaccagctcctatgagcaagctcaggcagaaggggcccacatcagaaccttgaaggattccccacagaagatagaggatcttgtccatgcgtttcagatctcagattcttctaatttctattctaaatatctctaaggccattttttccttagaaccatctcaagatcagcccaacccctatcttcagccttccactgtgctcataccagccttgattgtccttcagggtgaattcagcaaggacaaggtctctgatggtcaagagaaggagacaatagaggccagaccccctgagagagtaggacagaggcctgtgtagtgatgcaaagcaaagactgatgggctccattctgtgtgtgtgtctctttttctctctgcagagtacaaggtaaaggatgtgcatagaccctgggggtctccaggattcttggagccgctacactggggatcaccaggaggatgacagcactgtctatgtagggaagggaacatagataaataaccccaggggtcctttcaagaccaacatttcctgtcccttcttggcccacttttcctgaatcctgccctaggtctcttgcctactgaaatcagatactctccctgggcttcagagacactctgttggcttgccagtcaccaaatattagacacttacattcgggaggtcatgtgcccatattattccatgggcacatggcaaatacctccaagcttattcctagtagtattaggggactctcttgggccttgtcttttgagagaaggtatcttaagactgctgggcaaccccaagaagggcagatccagctcttcctccagacttaatttctggccatttctggatagaacagagagcccagacacaaaatgtacctgaaaggaacaagcccaccaccctcacccaagctggagaccacccccctttctccttagatctacccttatgaactgctgctggtgactacaagaggaagaaaccgactgcccaaggatgtagacaggacccgtttagaggtaagtctaaaaaactgagcaggagctcttgggttggaagaaatttcagaagttgcttggtataatccagctcaagagggctgggtggaatgagtggctttaagatcacacagcttattgaaaaagcagggacttgaaccaatttcctcagcccaaaacttccccatactattccccaaaactgtcccatgctgttcccccaaaactgccccatgctgttcccccaaaacttccccatgctgttccccaaaacttccccatgctgttctttgctgcctcctcttcaattcagttagtgtctgtggtgcacagggacagtaagtcctcaactagggccaatgcttctgcagaattgcagaagagctagatttgctccctgcccccaaggggccctctgtctcaggattgtgcataaaacttgtgcttgtgatgggggacagggggaggcagcactatgtggaaggaaaaaaagcataagtaagtcttgagtcaaactccctaggttcaaactctgattctgccatcactaggttggcagctttaaccaagcgacaacctcactgcaacttggttttcttctctgtaaagtgagggtgattggtgtgcttcccccatgctgccaagagaagtgagtgagccagtacccataaagcccttagcatggagtctggcaacatattgagtatgaagtgcccaatgaacattagattactgttgtgcaggggagaccactaaggcctgaggcagtcaacacaggtttgcagaaaaaggaaggatgtagacggactagaaagacaagtagagtttgtgattgagagatggagaggagaacagcataaataaaggtgcagaggtgggccagaacatggtgctgggcatttgagcagtccagaccacctggtgtggagttccagttcctgggctcctctggtgctggagcacactctgccccttacagcctgttgccactccctgcctctccctctccccagaatgcctgtattagtctctaatgcggctaatgaagatatacctgagactgggtaatttataaagaaaaaaaggtttaatggtctcacagttccacatggctggggagtcctcacaatcatggtggaaggcaaaggaggagtaaagtcacatcttacatggcagcaggcaagagagcttgtacaggggaacgccctttataaaaccatcagatctcatgagacttattcactaccaggagaacagtatatgggaaactgcccccaagattcaattatctccacctggccccatccttgacacgtggggattattacaattcagggtgagatttgggtggggacacagccaagacatatcaatgcccttcgcatctcaccagcctccttgctcctcagggctccgcactagtaatccctgtgccccaaagcctcctccaaccctcctataggaggggtcactccccttgtcctctgacctcctccagctttctatccaaagtacatcaagcacctttcactctcctgtgtatcagatcatggatgtgtccatttcctctgcctgaccctgagtttcttagggacaaacattgtctgccctctaccacagggtctgggctgggagaggtgtcagaaaacgtttgtgggattgagtgcaggcttctgaaataggaggctcagcacccctcaggaaaagcatatgagctgcccttgacttgatggcgtggaattggcccagggtagacggttggggcagaaggaggggaatgtacgttagccaggaagctctgtgagttcttccagctctagcatgctgggttagcaccccaggaagtgggtgattctcctcacatttcaacaagggcctcctcctttcactgtctccaaatgaaagtgtccaccagtgctgaaggggacagctcccagggcagctcagtgaagccagtttttagggatggaaacattctccaggacatcagaatcacccagggacctttttaaaaataccatacaggggccccacagtagaccaatttaatcacaatttggggaaggagctcaggtctagaactttttaaaagcacccaaggatggctaaaatgtagcctgagctgaggcccatgggctaaagacactgccccagcctcctgcactagttctaggaggggactgaagaaggaagactatgaccctgtcctcaaggagctcagagaatagatattcattcatccaacaaatatttattgaatcatcctcaccttacagaggagaaaataaaggttcagcaaggctgtcatttggctaaagctgatcacctagtgatgacagaatcagagtttgaaccgagggagcttaactacacagtgctgcctccactctcttccaccatcacaagcactcgttttatgtacagtcctgagactgtgggccccttgagggcagggagcaaatctagctctcctcctatgtctgcagaagcatctgggtacggttcgaggtgcttgcaatatatcaatgaacaaaacagagaccgctgccctcttggaacttacatttttgtgtgagaagacataagatgtgtctcctttatttgtgtcaatattgttgacacaaagaaaaaataaatgacaccatgtgttagaaggtaataagtgctaaggaaaaaagttaaaggagagaagagaaggggattaggagaggaagaggtgagttgcagttttaaatagcatcatcagatttggtctcattggatgcatgacatgtaagcaaagactcgaagtagttgagggagtggggcatgcttttataagaaggaagaactttctgggcagagggaacagccagtgttgagaccctgatgcaggagggagcttgttgtgtttgaacatagcagaaggttagtgtgtctagggtcacaggagcacaacaaagatgaggaggagaagatgaagtccaaggaaactggaagcagatcacacaatgtaacaggtgcatgaaaagatcaccatgatagtgaaagtgaccagactgagtgctttctgtgtgcccttgagtgttgagcacatgacctgtatctgctcattcaccctcatggtattcatggtggagacactaggatgctcccattttccagaaaaggaaattgaagttcaggaggggttaggtaacttgtccatggtcacatggccatttctccctggctgtaagagctgcactgttaaccttcctgctttaacgcctttctgtggcaaatgtcagatggacagtagtggcattaggggccttgagaactggagggagaaaggaggccccagctggcccttagaggagagaagccctggtctccttccagtgtgtcctgcttgtgaacacattacttgagggtgagtctaccattcttttatatcaagactcataacaaagattttttaacatgatagagaaactcaactggagaaccaatacagaccaccaccctccaacaacaataacaaacgattccaaagtgcagtttccctctgtctttactatggaaggagcagagaaggggactctcctatccaaggtgtctttcagcactcacttgagtagcacaaacatggacaagtcaatagtacaaagaaagaggcagggtcttagggatctaacaagcaaatgtgatgtgtaggcactgcctgggtcctagttcagataaaccaactgtgaaaagacattttcaagacaggaactttgtaatggacaggtatcagggaattctgaagaattcctgttagattttcttgagtttactcatggcattgtgtaaccacaatgtgagaaaatattcagtgtgttttgagaaacattctgaagtgcataggaatgaactgacacaatgtctaggctttgctttaaaatatttcagaaaataaaataggtaaatgaagcaaatgtggaaaacctcacaattacaggatctggatagtggacatgggctttgtcctattttctctcttttgtgtagttttgacatttttcataatagacttacttatgaatttttttaatggggttgaccaagaggggcagtgagaatgtaatgcattttgcctggacttcggtcccagctctactacttcaaaaattattgaccaaaaattatcaatattacctttgtttgaaattctgaaggtatggggaaaatgttagttcacatggccatgcgccgtggcttacgcctgtaatcccagcactttgagaggctgaggagggcagattgcctgagctcaggagttcaagaccagcctagggaacatggtgaaaccccatctctactaaaatacaaaaaaattagcccaacgtgattgtgtgcacctgtagtcccagctacttggaaggctgaggcaggagaatcacttgaactggggtggtggagtttgcagtgagttgagatcatgcactgcagcctgggtgacaaagcaaaactctgtctcaaaaaaaaaaaaaaatagttcacagtgacaacaagccagagaactgactgtggtcacataaataattttcactgaatctccttcagcacccaattagctcatgtaattgctaccaacaagccagctcaagtgaatccattaagtttgtaagcagtatatatgccatatatttctctttgtaaacttaattttaaatttcattttgaaaaactgtagctatccaggaaagtttcaagaatagtaaaatgaacatccatctaccattcactaaatacaacaattgttaacattttgccacattttaagtgctgtatatttctaactctaaaagcttttgacaatgtatcacacttttaaagctgcttagaagggaggaagggaaggagggcagaaagaggggaaaatccactatagaatgcagacaagggtttgattataaagcatatttgttttcatatcagaaaaagataaaaggacattttggtgaatcaaaaattaagagcagaaatttttttcattgactggcctgatgaacagccttccagatcatttgttaaaacatcagtaagaggaaatatcccctaaaatcttggacatggctcctttttctctcaacggggagtgggataacatgaatccacacacacttctggatgcaaatacatggatcaggcatgcagaaagcggaggggtcaacaggggactccaaggggtgtgtagtggaagcggaagtcccacttgagtcataggcaggggaggcctcttcagccaaatcagctccagagtcctccctgggaaaatgttcattccatattcactcattcaacaaatattcatcacacattccccaggctcaggcaccatgcaaggcacagggtgcccagagggaacatgcagcacccactgctgcctccagctacccctgcatcttgcatcctcatgctgctctctttctctgtccccccacccccgcctgccctgcctccttcagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatacccccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccct

SEQ ID NO: 36796 - DNA, 398085 bp, Homo sapiens
caggaaaccctggtactggcagcagccagcctctgctgtgcccacatgacccacaactctggcagcggacccggcacttccaacattattaaataataagaaagcggctcctactccaggctcaaacctccctgcagaccaatggacaccttctaagagtttggcgagtcagtgactgaagcgcccgtccattccaaggtgtgtgcacggcgttttcttctttgacagctccggagtgggggagggcgcgggggtggagggggtccgtgtgccgggcgaggagtgggcgcgaggccgggctgccgcgctgcccccggccgcccggtgcagaggagcccgccgcggggcgggaggtgcacatgacgcgcagccccggctgcgcagggaccgcagccgcccacggcgccggggcgcggacacaggcggctcggcgctggagcaagggcaggcgccgcgcaccgagcaaagtcaagagtggaagcgggcggagagcgccggcgggggcagggattcgcctcaacgcccactcacggggttcccacctgtgcgccggcgccggccgcggctagcgcgaagcatgtgccgggcgccgcagccaggactgcggcgcggcgcctccccgggcggcgggcggcgcctcaggcccgcggggcggcggtagcggctgctgcaggatgtccggcccgggggcgcggggccgcgcaggtaaatctcccccgccctcgaaggccttcgcagcgccgcagcccctgctgctgccgcggcgccgctcggggggtggctatggcagccggctccttcgcgtcgcgggttgagttgttttcgttgtggtcgctgccctcttggtcatcctctcgggctgagctggtgggaggtggagtgtctacctccattagggatgatactcacgtcggggaacagtctgaggggtactgactgggacatccgcgttgggttcctttgcagccagcggcgtcctttcgtgttgcagtgcactgcggtgcccgggccgatgcctgggtgggagtgggctccgggccccggggacggggggcggcgggggcgggtgggcacgggggtgagtgtcttcggcttttatagcctgttgcccacttcgaagttttctgctggacagagggcaggcgggaggttcgttctggtatccggagtgggagttgaagagaggtgtctgtcaaaagaccaaagccaaagagagaagaggggtggcgacggcgaggctgggactcagtggtaccactcctgggacttgaaggtaaaactttgctgtttagtaggcttggggtatggctttggaaagataactgtagaacttggccgtgaggggcgcagggggagggggcaggggaggcgcaaatattggatgtgccttgcagtgaagcttaccatgctttacatttattcttattctaaaaaaattgtcttttgagttgatgcttatgttttcctgttatatgtcatcacttggcatttaatgtgtttgtatttccttttgaacctcagagatacttgtattgttgaagtgtacagttactgatttctttaaaaaataatggttttttttttcttttgcttattccaaaggtggaaactttaggaaaaaagtgttccacatgttccacggttctatatggcttagatttattcactgtcttaattcttagaccaccaagggagtaggtaatgttattaaacaacttttgcaggtgagaaaatccgggcacagagagataaaataacttacccaaggtcatacatttattaagtgttaggagtctagttgggcttttcatgcgcccctaatcaactcattatacctaaagtcttctatactgaccacatctttctatgaagatgaaccttaataggtatgtgctgcatgttcagaacaattaactctttttctactttttcttcttctaactttcaatactaaaattatggcaaataacgtttgagtagtttcctttcagcacaattaaccaagtgtcctacagtaattaaagttgcatgtcctacaatgattaaagttgcatttcaccataaagttgagattttcagccgttaagatgtatcagcaaagtaaattattataaagcaaatggctaaagctatatgtttgtttgcacttaattttaaatttcataggttattagtctgttctttgttcagatcatgaccatcgttttcttcagaacaccatcttccagatttttgaggaagtttagttatatttaacccactcactctggcgagagttgggcggttttaaaagaagaattgtgcaattctctttcaactatcagtgattaaaagcaagctgtattttaagggcattcgagtctgtcatgtcatttagccaattgtatgtactttatacagaattgtgtagcggtgaagactgaaatcaaattttctcattagttctaagttgaaatacttttaaaatctccacttgttttaaatgaaccgtgatgtgaagaaaggtctcaatggggtgagctccaacttacttagagaattactctcacatatttagagaattactcttcatttgagcttatcatagagctttcacaatattcattttattgggcagatgtctcttaattcttcatctgttatttttttcaagtaaattttaattgcttcttcacataacgagtttcaaaattattttgacattcatagatttcctttaattctcatctttcactttaattaaattcaatatgtataatttcaaactcacacttactcaacattataagtaaaaagagagtggaatccaactaaacggcacggaaacatgatctgtggatatgagaaaaaatatttggctcttcagtggttaaccatcccctccctgcaacacacacacacacacacacacacacacacacacacacaccagaattatggctacatctttattttgggatgctacagtgcagtcctgtggtcagagtggttgtatgctatcagtcacaaatgtttttgatattgaacttgaatttgatttttccaagtccatttatatatagtgttgattgttatcaagacataaatcctgtgatacatacatatatcctttcttaactcagtgttccagttttctagcgtctgttacttattttagagacagcttgctacttttatctcacttggtagttttgacatgaccttttcctttcaagtcccacacctctagtttgaaagaattgtactgcttctgcttctacagagcctcttttttccaggtgtggggtgcaggagtggggctcaatagtgagcagaaagatctgtgagccctgactgcacagggggacaagttttaataaaataattataccaataaatgattacttgtaagttgagctaagtttcctgaatgaaagaagttctatgagaatatctattaaaggattctggactagacatggaggtcagaacaagatgcctgaaaagccacatatttgtgcaggaatgacacgtgagaaggtgtgtactaattccagtaatcttttcctaaatgcttgcatgttaattttctgaattatgttctgaatcagagatgtgtgtcactctagttacttctgtattcaccaggagacatactatttcacctcattatccatccatggacatggggaggtttacaaaactatcagtacttttttttaaagcacatggaacatgtgctacctttatgtggttacttgcctatttgcaaagagttatttaggtttaatgtaatatagtcattttctttcttttccttggcaactactttcaaactgaaagaagtagttctgtgtggtttgggaggtttttttgttgttgttgtttttgataaagtgccaggatgtctcaaaatagaactttaattgatttatcacacagtccctgagattgtctcaactacccaaaagaagagaagaggcttcatagtgatggagatgatattgagtgctgaagatgctggggaaattcatattaatgagttcaagcaaacataggagtgactaaatttattgaacatgtactgtatactgagcgtcattctgtggtctctatataaattaaatgacgtactcttcacaaaagccatgtgaggcttgcatatcattatctccattttatagaagggaaaaatgaaacacaacggggagagtaaccttaaccactgtcacatagtttgagatggtgtttaagacaaaggattctgattctgtatttcatactattaaatattgatgtataatacctggctcagaatcttactgctgaattaaatttccattgctgttgaaaatcataacaccccctaatctgatatttccattgtttaaaaaaaaaaaagtggaaaaaatagaacttcctttatatgaatactttttgccccatattttatacgtgaaaaatatacaaaacatgaagatatgtgagtgctagacaaaaacagatgactaatagattatgagaaatgtttcattatattatgtattttttaattcaaaaatggtaaattgagcaccatttgaaactattaaaatttttaaaatcaaaagtacaagagtatctatattagcatttcaaatgatcaggaaaatatctttaacagctaaaggttctgtgatcattaattaatgtaagaattttaaggctgggcacggtggctcaagcctgtaaccccagcactttgggaggccaaggtggatggatcacctgaggtcaggagttcgagaccagcctggccaatattgtgaaaccccgtttctactaaaaattcaaaaattggctgggcgcagtggctcatgcctgtaatcccagcactttgggaggcttaagcgggcagatcacaaggtcaggagatcgagaccatcctggctaacacggtgaaactccgtctctactaaaaatacgaaaacaaaagattagctgggggtggtggcaagacctacaggcgggacctgtagtcccaactacttgggaggctgaggcaggagaatggtgtgaacccgggaggcagagcttgcagtgagccgagatcgcgccactgtgctccagcctgggcaacagaacgagactccatctcagaaaataatataataataataataataataataataataataataataatttaatcacctaaaaatgatttattcctcaatttaaaagtagacttatcaataactgatgctctcactcttttccagtgagagttgtatttagtcaaggaataataaaagcaatgatttatttttgagtgaatgcatgtggtagcctatttgacagcaagtgaaagtctagaacagtgccaatacctgcccacagcaaccaaattgggttttctgaacagatttgatagtatcaacatggtacagaaatcagaacagctatgtgcgtatcttttcttgtcacataccccaaaatagacaaaagtataatttctgctatcacacattgctataaaaagtatgcaaacatataaatcatactatacatttattttgcattgccaaacataatctgcataattagaatatattcaatcaatacttttaattaaacattttattttgagataatttgaggttcatatgcagttgtaaggagtaatacagagatcccatggtccctttacccaggtttccccagtggtaaattcttgcaaaatgatagtacaatatcacaaccaggatgttgacgttgatacagtgatgaacaaattccagcaccagaaggataattcctattgctcttctatggcaacaccaacttggctgtaactaccacccacctccaaccccttaatcccttgcaatcattaatatgttctctatttctataattttgtcattgcaagaatgttatataagtggaattatacataatgggaacttttgggattggtttttccactcagcgtagttttctggagatttatctaggttgttgaatgtcccaatagcttactgcattttattgctgaatagtattttgtggcatacatgagctatagcttgtttaaccattcacctattgaaagacatctgggttatttttttccaattttttggctactacaactaaaactacgatagacgttcatgtaaatatttttgtattaatgtataatatgtattaatttctttgggataaattcccagaagttacacgtttacttttataagaaattaccaaacttttccagagtggatgtgccattttacatccccatcaacaatatatgagaaataagtttctctgtatcttcgctagcatttggcatttggtgttattgctgtgctgtattttagccattctgataggtgtgtagcaatatttcattgtgatttcaatttgcatttccttaagactaatgatggtgaacatcttttcatgtgcctatttgtcatttaaatatcttccttagtgaaatgtctcttcattttctatttggattgtttgggagttttttatgctatgttttgagaattctttatatattctcaataattgttctttctaagatatgtggtttgcattgggaatatttgtttggatttattttggggttacttattctttggaaacatattacatagttttacatgtaaataactattgaactcataatagattgattcctcccactttgtttttctttttcaaaattgttttagctattctaattcctttgccttttcatataaattttagaattacctttagaattatcttgtctatattaacaaaaaagtcttaatgggattttgataggaattatgttaaaactgcttagcagtttaaggataattgatatttaatccatacatgtggcatgtttctccatttatgtagaatgtctttggtatcttttaccagtgatctgtaggttttgggattaagtctggtacatatattactagacttacatatgaataatttttaagcaatttaaaataataatgtatttttaatttcagtgttgaggtattcagtgcaaatatattgaaatttaattgatttttatgtttatctagtatcctgggaactcctgaactcacttattaattctatgtgtgtgtgtgtatgtgtgtgtgtatatagttgttgttgtttgtttgtttgttttgagactgagtctcattctgtcgcccaggctggagcgcaatagcacgatctatgcccactgcaacctccgcctccccgattcaagcagttctcctgcctcagcctcctgagtagctgggattacaggcacccacccccacgcccagctaatttttgtatttttggtagagagggggtttcaacatgttggccaggctggtcacgaactcctgacctcaggtgatccacctgtatcggcctcccaaactgctgggattacaggcatgagccaccacgcccggccagttctatatttttttgacgaatcatagttgagtatgttaatgaggtacaatgtgatgtttctatatatgtattcaatgtgacatgttaaatcatgctaactaacagattagctatgtagaccaccatcatgtaatctgaaaacagaaacaattttatttatttataatctatatgccttttgtttccttttcttgtcctattgcactggctagaacttctggtactatatagaataaaagtagagagtgcaagcatctttgccttttgctaatcttcagtggaaagcattcactctttctgcattaagtataatgttatctgtaagttttatgtaagtgttctttatcaaattgaagaatttcactttgatttccattttttcctgagttttaaaaaaaatcacaaataagtattgatttttgtcaaatgcttttcttcaccaaatgatgtgatcatatgatttttcttctttagcttctttatatgatggagtacattgatcaatttttaactattggaccagccttgcatccttgcaataaactccatttattcattatgtatgattaattctttgtatgaattactgaattgatttgccaatattttgttaaagatttttacatctatattcatgaggaatattgacttgtagttttctttttttggtactgtttttggtattagtatcaggataatactagctttataaaatgaatagggatgtgttccctcttctattttctgaaagagattacataggattcatgttatttttttctttaaacttttggtagaattctccagtgaaatcacctgggctgggagatttcttctttagggcttttttgtttttagttacgggactcgatttctttaatatctatattagtgtgctagggctgacataaaataccacagactgggtggcttaaacaacagaaatgtatttcctcacagttctggaggttacaagtccaaggtcatggagttggcatatttggtttcttctgaggcctctctctttggcttgcggatagctgagttctcactatgttttcacgtggtcttttcctcagtgctcaagcatccctggtgtctctctgtgtgtccaaatttcctctttttgtaagaacaccagtcagattggattaggccctaaacacaccctaacagctacattttaatttaaactcttttttatcttaatcactttctttaaaagtcctatctctaatagagtcacgttttgagttcctgggggctaggacttcaacatatgaatttgtgggacgacacagtaatgatctgtttcatattgtgtgagttactgtagtttaagttgattcaggaattgttccatttcatttaagttgtcaaatttatttgtgtagaattactcctaatatttcaaattattctttggatgtctgcatggtctttagtgctatcccatgtttcattcctgatgttactaatttatgtcttctctcttttctgtcagttttgctagaggatttcaattttattcacttttaaaagaacacattgtttcattaatttttctctattatttttctgttttccatttcattgatttctgctcttataattgttattttctcctacttttcttggagaaagataataatatctttttctatattcttgacagggagctaagattattggtttgagatttttcctcttttctaatgtatgcatttagtgctatagatttccctctcagttctgctgtcactgtatcccatacatttttgtatattgtattttcatttttatttagttgaatgtatttttaaatttccttgagatttcctctttgacccattggatatttagaattagagtgttcaatttttaaatgtttgaagatttttcctgctttctttccgttattgacttttagtttgattctgttgtattcagagaacacatgctgtatgatttcaattcttttaatttgttgaggtttattttatgtcccaaaatgtgctatgccttggtatatgttccaagggcactagaaaagaatgtatatttggctgtttcggggtagagtgttctataaatgctgattaagtcatgttggttgatgttgctgtcaagttcttatatgtctttgctgattttctgtctagttttcctattaatgaaaaagtatatgccgtctccagttataattgtgagtttgtctatttctcgcttcacttctgccactttggctttacatattttatagctctgttatttggtgcatatgtatttagaattgttatgtcttctgttatattgactttattattaaataatgcccctctctgtatctggtagttttatttgctctgaagactactttgtctgatattaatatagacactcatttttcttttaatgggtgtttgcatatctctttttccatccttgtactttccactggcccatattttatattttatttgagttccttgtagataaaatataattggctcattttttttttttttttttttttttttgagacagagtctcactctgttgcccaggctggagtgcagtggtgcaatctcggctcactgcaagctctgcctcccaggttcatgccattctccagcctcagcctcccgagtagctgggactacaggtgcccaccatcacacctggctaattttttgtatttttagtagagacagggttccaccttagccaggatggtctcgatctcccgacctcgtgatctgcccacctcagcctcccaaagcgctgggattataggcgtgagccaccacgcctggcctagttggctcatatttttaatgcactctgctaatatctgtcttttaattggtatatttaaaccatttacatttactgtaaatattaatacaatactttagtgcttaaatctgccattttttgtttgttatctctattttggatttcactgttttttttttcctaccatcctgttatttacttgagcatttacagaattccacttctatatgtatagtgtttttaagtgtatcactgtacagagtttgtttgtttgttttttgagacagagtctcgctgtgttgcccaggctggccaggctggagtgcagtggtgcaatctcagctcactgcaagctccgtctcccgggttcacatcattctcctgcttcagccttctgagtagctgggactacaggcacccgccaccacactggctaattttattttttttctttcttttttttttgtatttttagtagagatggggtttcactgtgttagccaggatggtctcgatctcctgacctcgtgatctgcccacctcggcctcccaaagtgctgggattacaggtgtgagccaccgtgtccggccaggtatttttttgttttgttttgtttttttaatcatcactctaagtattacatcatatacacataatttatcactggctactcccattgtcattttatcaatttgaatgaagtatagaaaccgtacctccctttacagcctccatttataatatgattgtcttaaatatttcctgtacatacatttggaaccacatcagacagtgttataatttttgcttcaacaagcaaagaaggaaggtctgttgcatttattcatattttttgcttaccatgttcttttttcttgatgttctaacctttcttcttttattgtttcctttttgttttaagaactttctctagccaccctttgtgagcaggtcagatctgctggtgacaaaatattttgttttcctctagctgagaatgtcttgattttttctttcttcctgaaggattttcactggacataagattctaggttgagaggccttttcttaaagcaattgaaatatgttgtgttacttcctttggactctatgtattctgatgaaaatccattgtcattctaatggattttcttctttggtaaagtagcatttctctcttgctgtttataaaacttttttgtctttaattttcataaatgtgactatgatgtgtcttgacatggatatccttggaaggttttttagcattcagatttactcaggtgtttaaatctgtaggtctatgacttctgtcaaatttgggaagttttcagccattttttagcaatttttcagcctcgcccaatttttcctttccttcaggtctccaagacatgaattttagaccttttgttattgtcacacattgtattgatttcctatggctgctgtaacaaattaccatacagtgcatgccttacagaagtgcacatgtactttcttacagttctgaaggccagaactcaaaaatcagtttcacagggctaacgtcaaggtgttagcaaggctgcttccttctggaggttctaaggaataatctattactttgctttctttagcttctagaggcacctgtattctttgactacaatcccttccttggatcactccaatttctttcctctgtcatcgtatctcctacttacttttctgcggccagatttatctctgctctttgcctccctcctttaaggacactgtgattacatttaggagccacctggatagtgcaggccattctccttatctgaagagttgtagaataatcacatctaccaaatctcttttttccattcacagcttccagggattggagccattctgctgaatatctttgggagccattattcagcttaccacacacaggtttctgaggctttctttctctctctttttattctctaatctgttttctctgttattcaaattgagtgatttctatttttctatcttgtagctcccatgttcttttctgtcactcacattctgctcttgagcccacccactgatttttatattttgggtatttttttcaattctaaaatttctacttagtttttccttatgtgttctatttcttggccaaagttttatatttttttatttatttgaagcatgtttataatcattcaattgaaatgtttttcttatgactgctttaaaaactttgtcaaataattctaacatctctgggatcttgcttttagcatctgttgattgtcgtctttcattcagtttgaaatcttcccggttcttggtatgatgaatgattttcaatggaaacttggccattttcttatatgttaagagactctgaatcttatttaaactttctgatttagccgagttccactaacatcacctcagtgagcatcagtgccaggtggggggtagaaattaggttcctcactcagtctcccttgacacctgaggggacttcacattactgtagggcaaagtgggtcttcactgatacttccagctatgaagggtagaagtgcctcctttatgttccccatgtggtctctccactgacacactagggggacagaagagggggcctaatgactgctgggtcttagtgacagttctgactctccattaagccacctgtgacaccatcccaggagagaaggagaagggagactcagtactgcaaggcaggggtagaactccaggatcctcccaccattactattgacaacatagtgggggtgaggaatagggggggtctttattaccactggtgaaaatgaaagtcccagctttttacttggccttctatgacatcatcacggtggggatgggagaagttggggtgtcttgttacagcttggcaaggatggaagtgtaggtttcccacacagcttgtgttggcataggtgtggtggaaccacaattatttctttcttctgtggctacaatagagcagttattgcctaaatttgtttttttatctagctatgatgctcctttcctgttccttaggccagagagagtatggttttgttggcacccttttaaaagttgtgcctgatggcatttctgggtttccagtttctttagccccaagaattggatatgtgaggcaacacacgattccagggaactcaccatcatgtcattccttgagctctgaggtcccctagctgatttgtcttctcttctccagctttcagtgtctttgtatgtttatttaatatataaaatacaggggtttcagttgtacttagtaagaagagtaggggaaagtgctttttctccttcttcacagaagcaaaagcccaatctatatgttttatgcaagcataaactgaaaaaatatcactcccgttgattctcagaggataaacctcagagggttactgcttatctgtttctgaataatcaacagttgacaggtaagtgggatgagtgaatcctcaagtggtgttgcagatagatgggttcacaatgcagtccatcattgtaggattcatggaccacaggcaggtacccttactcccccaaatcaattctctctcccctcctggaaagccattactgtaggctgtggcatagttggagatttcccccactctcagagatgtcttttctggtgggatgctggaaccacaccatcccagctcttgctctactctcactaaatgctctttgtttccaggaatatcatccacctgaaatgtagttttggaccagtacgtgcatgggaaaatgtttgtaaactaagaaatagtgaatgcagaatctatatttaaatctaactgaggagcacctcctagaaattattattattaatttcttttgatgtaaaaattatgcattaaaaataaatgttctgatttgtcaagttgtttgatcactacttggtaggttaagtacaaaagatggagctaagaattctctgcttgaaaccaatatgctgagggattacagttgacatggaggagatcacaaaggacaacagtctagggaaattcatgaaaaagacaaatcaagttattgacattgtagccaaccttgaaattctcactctactagagcaatggttctcaaagtgttggcctcagcagcatcagcacaactttgaaactctttgttaatgcaaattctaagtgtctatcttggacccactgaatcacaaactatggggattgatcccacaatctgtcttatagccagctatacaggggattgtgctacacgctaacgttgagaaccactgcactagagtaatccctccaaccattgaaaaatatgctaaatttatgctttcagtgatccttgactgggtttttggaaaatgtatttattatatttaacattttatgtgctcatattataaatgtttttcaagtaaatatagtaaggaaattaaaaatgcattacctaaaactatctccttggttgatacatattaatgattatgcaattattttctatccttaacccagatctactccatgtctgattttgtggttgacatcaaaaaaatgagccaggcctacacttccctccatttgtttctcatagttgccaagtcatacattaatggattttgtagctgtttttatgttcttttctagagatgacacccatcattaggtatttggaggtgagagtgggggtgtctctgcattatttgaagaagatgctttttaggagatcttgtcacatagtattgttagagacagatgcgtatgtggatgtccaaattaatcattgtcattactacatcagctctaccatgggggatttactgtttactgtatgctggcatttttctctggggtcatgtgagattaaaggacatcttggctaaaagcctgtcctgaggaaagaaaagctgcatttctatatagatattttataactgagatagaattccaaaccccaggatagggtaagacaaaatcaacaagaagtaaaaggttaaaaggttttaaaatgttttatgatggtgctgaaatatagacagatgcagatttgagaagtagtctgtggcttccagccctgaatatgattcagtttcattgtattttaaggacagtattttatataattttacactttcaactagcaatttgctaaactgagagggcataatcggtattcacatagtatccacctcttctgatgaataatattttagcttttggattaggcatcacattttactgtgtataattttttaagctgaattttttagtttctgtaaatcgtatgtttcaattacatataccctttatacacttttttgaaaatgtctttttctgtgtgagctgaggaaatctgcttttcatttaagatgacacatattcttggtttagaaaaatattactttctatcctttcactgttcctcaccaccagttgtcttaggctctttttattccttctgtttcatttgtgcattcaatttgatactatttatcatttactcattttgcttgggcgtttaaatggttgtgcctctgcagtgttttggggataagacttttccaaaccttcattatacaatgtttgctcaataataccatttgggcaggttggaggaaccactcctttaggaacagatttttaaatggtatagcagatgtttcctcttacatagagtcatcctttctaaaataaaggcccccagccatggcaatactaatcagatgtcttctttcttataatcattacttggttgacattttttaaatgtggtaattaaatcagcaccaaaatgctttgataggaagtacacactgtgtcttctgtgggtagtggtccagattttcccctactgtgttcggtgctatttataaacacaaaatgtgtcaggtgattttttttccacatgcagataaattctgcctcctccttttaacccaaacactgtaaaaataatgtttatcataagagtgtatacaaaataatgatttttgctaatgatgctaaataccctttaggaagtgatatatgagtcagattgattttgaaaatttgatcaaaatatgaatcattttcaaaacaggaaaacatttcaaatcatctagctgttcttttattgtttgcctcagtgtcaacatagtgcttaaacctttttttgtttctgctttttgtttgcttgttttggatttaagtttttgtttctgtttgatgccttccttactttccaaacatatgatgtaacagctaaaaataaaagttctctaaatacctttaatatttcagattgagcttagatatgagattgagagttgtcccatggttatacaatttgaatccttgtatagacaaggaggaaaaacaactgaagtgaacccaaaggaaatggtattctattaccagtctgccatggagtggttataaaagcaaaataatctaacttcactcacccaatagtagtttaagggataaaaatagtcctgtggtttcatgtgagtgagtgtaattttgtgtgtgtgtgtgtgtgtgtgtggtttttttggttgttgttgtttttttttttttaagtctgagcttggtcacaggtgggagaaggtgacagatatcagcgtttcacttctttcttagctttgactgctcctgcccatttatgaacagtgctaatctatgccaattagattttttttcctacaaatttatctgttctctccatctattttgtttttgtgtgtgttctctgtttttctctgagttttcatccctcagtaccccgactagcatctagcatctagttggatggtcatgaaaggagatgtgctcctagcatagtgaaattgaaaacattttggttccttgcgtgtgcttctcgaagctttcaccaaggccgtgacaagactgcatatttcagctttccctcctccctgttccatcagtcattccatattatttactaggagtcagtattttataatcagtggcagagctagtcttcggcataggttatccttgccacgccttttatgagcccctgtggctcaatgtgactaggacactggccattcttttttttttttttttttttttggtgcttctcaaatatatttcaaggaccacctgcatcagaatcatctggggggtttgttaaaagtacaggtatctaaaacccattctagagccacacattgaatcagaatctatctttatgagtttagaattttaaggctaatagtaatgataggggctagtccagatctgcatgtcacaatccagggcaacttttaaaaaatcagaatgcatggatctcatcccctagtttcccacttaaatggccttgtgtgtttaaatcatgcagctgacggtaacaaccagaaatgtgctgtagaagttgaaatgtaagaatggagattggtattgacagaaaagcattactttcagtgaattcatgaaagtccatggatttatcctcatttataaattcagaacccagatccttctctgaaagacaaagccacattaagcttatagagactgagctataaataagaatttgcttaatcacaattagaattgtcattgttactaggatcagcatgagtaaggcattcttaccctactggctgatccccacggaaagaaaaattattataagttttctcttgaacctggagtcagactaaagaaagttatttgaataaaaatggtgaatatatacttaagacccatctgttatgaacaattttaaacatttcatctgtattatctcaatcctactcagtaaccctttgtgctagtattattagctctaatttctagatgagaaaaagataggaaaagtgatcctatgtaacttgttgaatatgacagagccaccaaaaggtagagctgaaattcctgggctctatgacttagttattagtaaaaaaagaagataacttgagagttggctgggccttagcatctaagtaagcaatcaaatggggccagcatagctcctagttggtgaagaagaaagaaatgtgcaaactgccattcatatggataggatgctttcaagtcatgtgtaactagaatgaatagcccctgggtggatcaagggtgatatcatggtcagaaccttgtggtttgtctaacttaacctctccagaactgtgattaagtgaaagatatacagaatcagagtctgctctcaaagtcacatttggaaaaatgaatcacagtttatagaaatagctagtgtaaatattaatatataataatagatgcatatttaaatatattaggtgagtatgcgtgtatcagtttcttgaatgtccccaagtccttaggtcactttgactcagaaaatttgagtgaaattggcttgagcttccactagctccaactcaagcatattttctgttatttggggggatttttatggagcttgcatttctcctgtgactctgttctgagtctctgcatctgttgaatgcccaatcattactctgagttttatttcctaagcacagtgccaacttaggtcaccctgctggttatatgcccttgattcttttaatcccagaagtcccactggctctaggctgtgtgtttaggagactttgttataggtttaggcaatggagttgtgttatgggacagcaatgttagatatccctagtattgaaactccctcaaccatttttttttctaaaaaaatttatatagtttgcctttttaacttaagcttcagtaccttactgtgtgagaaatggggttatttataaatgtacaaattcatctcagaacagcaggtacacactagtaaatcatatttctggctgttttcctcagtctgctaggaactatcagattgttaactactactgaaatgtaacccttactctctcagaaaggaaaagtgaatggccctctcatctatgaaataaatgtctgccactagcagtccctgaaaactcctcagcataaacattaaccttccatcttttatggtggtgaatccagcagatggatggcgcagtggcagtgtgtgatattgcagttgatactatgggattcttttaagtaggagtgcaaccgtaactccacaatggtggtggtgttactgttctctgaaaggtatatgtgagaattacataaattgctgagcatagaaaactttagggccctagtcataaaaacatggtatatccttgcattgatatctttcagaaaacaaccctttccaatgcttacataagcattgtttgcatcttgcaggttatagtttaccagattttgcatatttggtcaaaaaataaaaataaaatttttccactgtgatgaaaagtaaccattgcattgtggaatacaaattagcaaaccagtatagaagaatactggtttcacataagatgtgaccactgctataatcaagatgacaacagtgaatgaagtttggttgcatgaatctaataatccatggaaaactttaatagttgcctaggattgatggtaaacctaacagcagcactgttttagattgtcatgtgttttcaaagacatagcttttagagctccgtttattttcccaaagccttttgcctcatatccattaaaactgccaaggtgcacattactgtgagctggatttgttatgctaatttccatgtccatgaatccagaaaacactggttgagattgatagaaatctataacacaagcagaaagcttaattaacaacacctatatgctaatagtaaacttgacatagaatagttgcaaaactaaatagttatggtcataacatgtgccagtctttacctagcgataggctaagaggaaaatatggcaaatttcaaatacaaaagtaatgttttattggtaacatcattttctttagcaatacctaaaatgtttctctggctctgccagatacaaagctgataattgaatgatttgctctaaattctcattagagaatccatcggtctgctgcaaggtgacatctcagctgtctaggtgacccaatgtgagactggaggaagatgaaggcatctgctcatcagtgtctatgtacagttggatcacactgagcagctggagacaccactcccttgtcctcagggagcttacattctacttgggaggtgcaattaagaaacaatgaaacaacatgagatgaagaaagaaaaaattgtatgaaacatgagaaaatatctaaacattctgagaagcaagaaggctatgaggagatatgtgacaacattttagtggctttcttgaatcaacaactgcatgaacaagtagattttaccattaactactacctgcaccctacttcaaatctcttcaatagaaacctaaacagaacttgagtcctacttggatgcttccacattgtaagttctttgcctatgcaggtaacgactctgacaagatagatttccctacctgtaggaaactgggagaatggaccagaaaaaataaaatctcatttaaattgtgcacagaggttctagtggtcagaattcactccacagtggctatttaaggactctaaagattgctcttagttatctgttattttattaggctgaaggatcaatttccatctttaaggaaatctatgattttattatctttgtcctaattccacatcagctctttgtgtgcatgtgtttgtgtatgtgtgtttgtgtgtgtgtataaatgtatgtataaaacagtagttcaagcttttagcatgcctaagaattacctggttgttggggggagtgaaaacacagcttgctgggcttcactgccagaatttctgattaatcagtctggactgggaaccaatatttgcatttctaacaggttgccagacaatgctgacactgctgacccagggaccaaactttaagagtcatcgatatgacacataaggctcatggtgaatcacagtgactttattaaaaagtgaatcatttaaatgcaatatctaaggcagtattaaagaagaaatggggtactgaagtgtggccaaatgagtgtgtcttagtctgttcagactatagcaaaatatcataagctggtggctaaggaagaacaggaatttatttctcacagttctagaggctggaaagtccaagattaaggcagttttggtgcctgttgaggtcctgtttactggctcatatatggcaacccttgctgtgtcctcacatggtggaaagggcaaggagtctctcttgggacttttttcataagggaattaataccattgatgaaggttttgtcctcatgacctaattacctcccaaaggcctcactcctaacaccatcaacttgggtgttaggatttccacatgtgagtttcagggggacacagacattcagaccatagcaagatgtgtgttttaatatgaaactcaccctgtgctggccttgaaattttgcagtgtgggtgttgggagggtagactgagtttttgggttgataaagctttgggggtttgtttagttcagctattagggtagactccccttgcttgatgccttttaaaattcttgctcagaatattgcaaaacagctggctcaactcattccacctgactttctctaccctaacgtcagctctgacccattccaaacaggatttttcacttctcttagtaagctcactggttttgtttggcttgttagatggcaaactcccttgagttttcttcccttgaagaaaaaactcccttaatttttgtttggactgttggtcagctaatccttacagttttaattgttgctcaggaaatctgggtccttgtgcatctccagttttaacttcctacacagacctttccttgaaaaatactattacaatgcaaaagggtgttagtaccttggtcaattatttcgaaaatacttgcacacacatacacacaaacacaacaaaaccattcttaaaaacatcttactattccatagtcatagttgtatttgtgaaataagccttgtattcgattgtattgtggggcatcctgatcgctgtaataaatgaaatatgttactgttgttctctactacttgtgttttaataggatggtgctgtgttacgtttccagttttgctaagaaagtgttcttaagcactgttcattgcttaatgtatcctgtttccagagattagattttctcgtaaccaacaaatgctgtcccaaaaccaccttggcgaccttaccaaaaggaaagattctgccattttcttctaaccaggtcccagtgatatttttcatattcttctgtcaaactcagctcttatcctctacttttgtcttaggatcatgacgtgcttgtggaacattaaaactgaaagaagcagaggtatcatttagccccaccctttcatttaagagagaagctaaacaaactgctcaatgtcacacactaaattagtcacacagaaaatgactaagggtcaagaccttttagccaatctttttctataaccatgcttgaaattttaactaatacagtgaatctcagctattgggggaaccacccccaataattcaacgtaggttcttttctattttccctaagtgttggccggtctgagaaataaagggaaagagtacaagagagaaattttaaagctgggtgtccggggaaggcatcacatatcggcaggttccatgatgcccctcaaactgcaaaactagcaagtttttattagtgattttaaaaggggaggaatgtatgaataggttgtgcatcacagagatcacatgcttcgagggcaataaaatatcacaaggcaaatgaagccagagcaagatcacaggaccagggcgaaattggaattgctgatgaagtttcatgtcccactgggcacgcgttatcattgataacatcttatcaggagacagggtttgagagcagacaactggtctgactaaaatttactaggcaggaatttcctaatcctagtaagcctggggactctacaggagacccgggcttatttcataccttatctacaaccatataagacagacactcccagagcggccatttcagagacctccccctaggaacgcattctctttctcagggctgttccttgctgagaaaaagaattcagcgatatttctcctattcgcttttgtaagaagagaaatatgactctgttctgttcggccccttaggcagtcaggcccaatagttatctcccttgttccctgaaaatcgcagccatccttttccttttggatgcccggattccatattgttcaaacacacatgctctacaaacaatttgtgcagataacgcaatcatcacaggatcctgaggtgacatacatcctcagtatatgaagatgatgggattaagagattaaagtaaagacaggcgtaggaaattataagagtattgattggggaagtgataaatgtccacgaaatcttcacaatttatgttcagagactgcagtaaagacaggcataagaaattataaaagtattaatttggggaactaataaatgtccatgaaatcttcacaatttatgttcttctgccatggcttcagctggtccctctgttcggggtccctgacttcccacaacactcagccatccacataactgttgcataagattaaccaaagcagctgctactgctcaaaaacttgttggaacgtcttacactgaagctgccctaaatttctttaatactcttaaatgccttctgtgtttaaaaactttattttcagataattacagattcacatgcagttgcagtaaataatacagaggtcccatgaacttgtcacccaatttacccaatggtaacagcttgcaaaactgtaataaaatatcataatgagaaaattgacatgggcacaattcacagaccttattcagatttaataagttttatatacacgtgtgtgtgtgtgtgtgtgtgtgtgtgtatttaggtacatgcaatgttatctcatatgtagctttgtataaatatcactaaaatcaagatagagaacagttccatagtgctgctcttttatatccatgctcatttctcttcccctctccatccctccatccctaacctctgacaacctgtaatctcttcatctctataattttatcattgcaaaaatgttatataaatggaattttgctgtatgtaaaaccctttgagatttttaaaaattcaacataatttcattgagttctagccaccttaccccctgtgtccatagttcattccttttaatttctgagtagtagtccaaggtatggatataccacattttgtataaccattcacctgttaaaggacatctcagttttttccagtttttgaatattataagtaaatatgctatgaacatctgtgaataggtttgtgtgaaagtaaactttcatttctctgggataaatgcccaacagtgcaattgctggatgtttagttttgtaagaaactgcaagctatatttcagaatggatgtgccagtttacattcccataaacaatgtgtgagggattaaacttctctgcctttgccagcatttaatgttaacactatgttttatgttagacattctgatacatgtgtagtaatatctcattgtggttttactaagcgtttccttaatgactaacgatgttgaacatcttttcatgtgcttatctgccatccgtgtaaccccttttttgaaatgtctcttcatatcttttgcccattttctaattggattgtttgtctttttactggtaggttttgagagtccattttatattctatatgttggatttgtggtttgcaaatagtttctttcagtgtgtatcttgtctttttttcttgttatctaagtctttcacagagcaaatagttttgattttgatgaggaccatttgataataatccatttttattttaatggtttgcagttttggtatcaagttttaagaattctttacctaaatctctatcctgaagattttctttttttttcctaaaagtttcattattttacatttaagtctatgatctatttggagttaatttttgtataaggtctgagatttaggttgaggcttattgttttgcctatgaatgtccagttgctccaacaaaaatgtcttcaattttgacttaccgtttttttttttaatttggcaaacgtgtgtgtgtgtgtgtgtgtgtgtgtgtgtgtgtgtgtgtgaagctactatgtgtgagacactattaggtagtaaagacgggaacattaatagaatgcagcacctgaaatatctcctggtatagtgggggaggtacatatagcaatattttcaaaattgtaggttaaattaaaatatagaataatgcacagaggaaaaggacttgaacaatacaagtggatgcaggcagagtaggtgtaagccattgcaatagcttaatgagagataattaaagcaggagcttacagacagaaaggagtgaatagatctgaggagtatttatcagagccttgcagagaatggtttagtgagaaggaagagtcaaaggtaaacaaagtggatggtgatgttatccaaaaggataaaacaaggaacaggtttggattgaagataatgattttgttttaaacttcttgagtttgagaaagccattaaacatccaggaggaactgtcctagtaattgttttccgatatgaagctaaagcttgtgggagaatttcatggcagacaatttttgaaaatcaccagaaatcacttacagctaaggaaagatgttataaatttaggttgtactgttttaagtcaaaaacagaaatcataaaactctagaaggaaacattaaggattaatgtagaggttgtgagctttggtgcacttcaggtatgaatctgaaatagagtgattctgattacaaacttcattaaataaataaataaataactcttctgagccacaatttcatcatctgtgaaatgggtgtattcatggccctagagcttttgggactgcattgaggaccaaatgagatgacaagcctaaaattcttgtcctgtaatgaaggtttagcacatgttagttcctttattcctacaagatacttttgagattatttactataatgtttttcaagctactttttttaaaggaagggaactcttttttcaaatgaagtctcatacagaactggaaaacagttaaaagcaaagcagtctcctctttacccaagttttcaattgaagcaacaatgtggcaacataagactcttgtaaatcacgaagataataagatcatccatttaaagttaagaacactgtgatctaagaaggtaaagaaagttttctcaagtcacatgatttgctggaggcacacccgggtttaagcccctaggttctcgtccctttttcatattctttctgaaataccatagtacctataactcacattgtaatgtttacttgcataggtgactgtaggtacagttctagaagaagctgatgtcttaaatgttctttgaggtacagtggcatttctgtgatttgtggcctccaatgcatccttctgaaaaagcctctttttgataggtaccttctgataagaaatgagctttgtgggcccacttgatataaaagacaatcatgatattctttctgtcctgctctcttaacagccagtgttgacaaacatttcccattttggtttagaagactgtgtccttgggtgttggtttcaaacatgcagttatccaaagaacacttttaaataatagattctgggatggatccttgaagattgagtcacttgacccaaagtggatctttactatctcatttaaaaaatcttcccagggccagatgcggtggctcatgcctataatcccagcgctttgagaggccgaggtgggtggatcacctgaggtcaggagttcgagaccagcctggctaagatggtgaaaccctgtctctaccaaaaatacaaaaaaattatctgggcatggtggcacatgcctgtaattccagctactagggagactgagacagaagagttgcttgaacgctggaggcaaaggttgcagtgagccgagatcttgccattgcactccagcctgggcaacaagagcaaaaaccccgtctcaaaaaaaaataataataataaaaaataaagttctttccaggtgaggctgaaacatctgagaaccctttctctattgtttatctcaggcctcttgaagttttcattgctgttctcctgccatttccttcctaggtaactactgcttttgaacactttatagttgtcctcagattttctctctagttcagaactagaacatgtgctgatagatgttttaaacaattcctaccctatctgagtcccccggctcccatatatcaaactccttcctaaagtaacatcttagaggcaaaagatggtgtcagtttggtagtaacaataacaaccacaacataaaagccatcacttattgagcattcactaggtgacagatgtgtctttagtatttggactgtattttctgatgaaagaagtctcaactatagacttttatttacagctgcttactcaatatttcaaacaactcttgattactccttttcctgatacatgctcctcctccaggcttccctcatcccagtatgtttccagcagtcatcaaatgctgagtaggtgttattcttgtctcccatttcccctgacacttcataaccagtccatcagtaagttctgtcagctgtgccctcaaaatatgtcccagtctaaccccttcttactccaccacgagccattcaatccaaatcactattatattattttggtagctggatgactgtatcccctgctcctccttcggcttccatggctagtccttcagaatgaaccaagaataatcatgcaaaagtataaatcagaggtaatataattcattgacttaaagccttcagtcatgtcccatcacacttaggttaaaaatcagttcccttgcaaagcatgacctgtaagtcctaggtgaccttgcttggacctccctctctagcttcatctcatattactctattccttgacttccgtccctctgcttcactgctgttctctgaataagccaagcttttgcccagctcaggaccattgcacttgctctgacccctacctggagcacttactccacatctccgcggcttactctctcgcttcacacaggtctctgttcacatatcctcagtgacgacttctctaccattctgcctagtagagcaccctgtccctctttatccacttttcttgctttacttttcctcatagccttctttactacctgacactgaagcatacatatattgggctgttcattgtctctctcccccactacaatgtaagctgcacaagggaagggatttttatctgtttcttgttcacctttatatccctagcacctggcacagagctgaggttcattaagtatttgttgaatgaatgaattagtaactatagcagttgtcactctcctgggttcttctgcagcagtgcctttgatgcttatacatgaaattcctaaaaatttagatgacatgtcttgatctctgtcagtcactttattcatgaccttgtttgccttttgtaactgcactttaatatttataaagaacggagccatgcctagatcagtttagtccttaaaatatttcactgttatccctttattataaagtcctgggctttgcatcctgttcttggctttggggctttcagatttaggttgaaagagggctataaagagggcatgctatattgggtcaacagtgatcccaaagacagggaaatactctgagtacacgtattgtctcttctagacttttatagaaccgtatgagatagggaaatgtacttttatgtgggatgacaaaatgctcacactgggactttcaagctaacattgcttcttacctctcacactaataatagataaatggatcattttcctcctccttttgtccatggcctccttgaccactctgagccatttcctacaggaagttttgcatgtgttctatgttaactgatgcctgatatattagtgcagctctgccctctttttattcatgctaggagcatttgttttatgacatatgagagccaacaagtgtggtcaagtgcaaatagacccatatgtatgttgggtggaagggctccttgcagaaagctagctctcaccacagtatacccacacacagacccctaagaaggctggccgctctgctgaagtaagatggaccagcttgccaatgggcactttgccatcagagcagatgggcccaagcaggggcaggcagcagagcacgcatgtctgttctggacacatgcatatttatcatttgtgtctttcatttacaggagacaaattcttgaacagaaaggctgagttataaactaagcgtcaggaaagatgagctttcagcccttaattaaaacattcaagcaaagaaatcaatgtttcagtcccactttagaaagcttatgaagtaacttgttagagaccctctttactcccaagtcactcttcactaaaggggatgctgtgtcttgctcaagcagtgttttcacttgtacatcatgaggtaacctaatattttccaaaaaaagaccagagatgtaggagaatcaccaatatactccttttttgaaaatattattagaatttttccaaaactattcttctcttttcaattttcttgttttaataaaatgagaactaaatttaatttcttttcctgctaactgctgaaggtgactatatatggagataggactcagcctgtagcacaggcaaaaacatttacaccttgaaaatctactttaatatcacctgtgtagtgttccatttgcccaagtggaaaacctgaaaaagattagaataataataattattaaaaagtgtgcagattaccttagataatttataagcatcatgtccatctaaattataaaagaaaacctctcacaaaccctacataagattcatgggcattttctaataatatttcacatttatatttcaccttgcacttcccacaattttcatatatattatctcctttgaacctctccataaccttgtgaggtaagtaaggcaggcctgttggtctctcttcagttgagggaaataaaaattgtgcaggtaaagtgactagagctcaaacttcaagatcatttgtcttttatcatattaattttaattcgaaggctattttataatgagacaatatctagtgatggcttttaatatcaaatgatcatagtcttttacaatcttgctttctatttttgattttgctaattaaatctggcaatggagacttaagggaaactcttatgtttcaagtgtcttggacattgatggaaattcagcatccaagggctgctggttgacttctgtttatggttttgacaacggtaaagtcctctagggatttgagtaggtcactgtgttgcctagtgtgtgttaaattattgagtaaacatgaagatggttgttcctgatctttggtttgctgtattctttatagtttctcttagagatattaaaacaatattactgctcttcaaaaactatgagttggaccatattacacataaacacaaatagtgacttttgtgtattaataaaataacagcaataaatagaactccatagtaaattgctgtgctctgtgcacctctgtatgaaaatataattgtaaaaatataaaagtattttgtactacttcgcatgtgattattttccaactggaaatgctatgttcttattttgacatgtgacaaacaatgtgtgataattgctatttatatttaccgttaaaaatgacagatttttgcttttggacataaggctgataatgaaattttccagtcttgagaaccaatcaaaaaatcttttggaagtcagctcacttaaagaaacccagaaaaccactctcctcatgaaacttggtaggatatcatctgacttctattataaatagcctgtttgaagagataagagtgagttaaattacaaactgttttccaagtaattgatatccattactggatttggacagagcaaaattattttttctggtgctggtgctctggtatgcaaacatagtatgtcttttctgttgtcacacgcttgcagagaaattataatttttaaaactttttagagacacaagaggatttttttttaaaaaaaaggtttatgtgtttctgaatatctaaaagaaaaatattcctggaagctgtgacaacccaaacatttgtgtccaaccgatagaggactaaatttaataacttgtgcagaaaaccaagcacttgaaagcaagtgagtttggggcatactggagctgtatataaaaggtgaattatttagcatggattggatgaaaactgaatttctaaaacccactaattccttaattctgctttgagattataaatggagaacaatattcaaaacaaatttgaaagaaatcagacaaatttttgaaagaaatcagaactatgtatgttctttacagtacatatagaagtgatcattcatctggggactgagatgaagttctttgttgttcaaccttggaaagtctccgtgactcccaaagaataatgagcaaagtgggagtgaataagtactccactctctaggacatcaggggccccagaggttcagggagatccatagtaattgcttctggcctccaaaatcaggggaaaatatgctgaacaaccagggcagaggtgccattcctctgctaccattcgtttctccactgcccttcagactcttccatctctcactgtactttctcgcacactgtctttcctccagctttaattcttcctttgccctctgctgccctttcagctccttctgtctgagccccacagttcatcagtacttgtcttatactattgtgagtgtgatctctccctgctggaggaaatgtttagatctttggttcataagttttgaaaatgcattgtaagaccagaggcttttctttgtccatcaggtttttctcttaaaggagagtatattccacaatagattgttttatagtgggaggttccacaattcaagtaaaactactcctctgacgctgagtggtagaactagaaataaataattcctcaattattttattgatccagaaaaagccaaacattttccaggaatccaaagagaatgtgacctatttggacataatgaaaacaaaacagaaattgattgtctactcaagatgtcttctaggaattttaaattatccacaaatctgtcttctcattcatgtatttaccctggctgtgaatagattggtatcatttccacatcacaaaactgaaacggggctcaagtcccctgttgcctagctcagtgctctttcttgtagtttacttagtgtcctagaattgtaagggcaggtacatccctgaactcaccactctttcggaacacgaagctatggtctttagcagaatatttgacagtagaaaggagtggctggtgttacatgataaaacagcacggctacgtgtgttctggttagaaatcaaagatccattattcacttgggcttttgctgttaggctcttgaaagattagcaaaatttcataaaatgttgtttcactcaaatgaagtgggagacttaaagaggaatcgttgtgatttaatgacctttgtcttctgcagtatgctgtccttacaatttttaggctaagattaattaatttaaaaataaaacactcttaggagtcagtatcatcattaggagtagggattctagacccacattgactgatctcagatattagtctcaattgcgtgcttttgggcaattaggttcaaacattattatgtctgaaaatagggataatgatggtacctctatcaagggttttggtgagtatgtgtatactaaatataaaatactgataacagttcctagcacatattacactaagtattacctattactgttattagaattaatgaataacagaaaacggccgtgtccctatacttacataatcaaataaatacttattctaacaggaatatgtaaaattatgatttggtggacctatacttcatagagggagtcagtcttatgcaaataatgtctgactatcctcagcataagaagttgacccttctattgtttaagaatgcatgatttgtgttttttgctcattcttaaaattttgatgttttctcaatgagcaagagatgagaagccatttttatggaggctattactttttttcagtttacgttttcatttaaagctgaaacacatcattttgcaagtgtatttggttttcatctgttaagaggtgcaggcaagaattttcaatgctgtgatgatttgtgggttccactactaaggaacagacactgaaatcttaggcagatcctcatgaaaactctctttgcttttcaggctatttttctcaggtttgatattttttaagcattcgacaatcattttcttcccactctgttctctctctctacaattgtcctttctgtaacaccttaaacctcctttacctcatgtgcaaacacacaggtatatgtgtgtatggaaatgtgcagtatgtgtgtttccatacttggatctagtaggtaatatctctctgctaaaagagtgcaacagtaaaacagattagactagagctcaaaaggtaatttagtcaaatccttttatctcaagtcatacttcccacaaaccaaagagaatcgcctgctcgtcaagaaatagatttcctatcttccctttgtcccatacaaaagcatattttagtggtgcaccagatgctgccaaaagttaataaagaatgacattttaatagtagacattccagatatagacagaaacttcagcaaaatgagacaatgtttcattttatttttattcaagtccctgtgcctcctacagagaaggtgaaattgtttaagtggcaaaacaaatctgtatttagagttccaaaatatgttgagatatcactgaagacattgttacttgtttaatgttttcagttttgttacttgtatatttgatctacgattttttagagttatttgtattctatagaacaaaaataaaagccagagaagcaattctgtggaggcaagtgcctagttccaggtcagagaaaatcattggtaagaccaattttcagttattaaactgttacttaaaccactaagtcatgataaatgagtccagatactgcagttaggtaaaatcctaagctttgcttgaacccgtatcaagctcaataaagtcacctatttggggaaattctctatgaattccttcttaaagtgaaattacttacacctctattgtccattgaaagtgcttttatgcccagcctttagtaaaggactgcaacatcagttgttttctctttttggagtacacaggaatgttaatatacctgctactgtggttgattttttatttaattctatttttatatcttattttaatgagttagagtctccatgcttctgtttttaaaactccatctgtttctaatacatggcttctgtgaaggcatgccgttgaaacctggatttcctgtacaactattatgcattgtgcaggaccttgaaattagacaattgactggactcaaggaacttctgccaaatctgttagaattaattgttaaagttacttggaactgaagaagagaataacttcatggcttggagcttgttccattaaaaattctagaattgtcacctcagctggtagtgcctcctacagacaatcatgggttattcctattagctcatgcaagagggtgtggctacaaaacaaaacatgggaatttcagtaaaaagaagccatagaggtagtgacctattattttcaccttcagcaatgcatatatatatacacacacatatatttttttccgacttaaataaggctaagcaaatgaggatatactccggataactgcgagtgtgttaggttgaaatgctttctaaagaggaaaaaaaagaaagaactacccagaactaatgcattagtgtcatgtttcacagttggctcaagcttctggggtacagggcctgctaagttgtctggaagaaaatgcctttccttcatttttttttacccctaaatcaaatcactaattgtgtaaatgcttctgttttttaaacatgagcctgcttttcctagaaaatagataatttgacttgaacttaaacttacagttgaaaatttgccatatttacatagttgataccagtagcataatttatgttttcacacccaatacctaattccaaccctactcactcacctgaccctgctctataggttgtaaatgttacagattattttttctgatctcccttataagtatgggtgacagtgcaactcaggcatagccattgatatgtaggtggctgtccactggcactgcctctgcccctattcctttcattttgctctaataaacagcaaaattagtggagctgcatagccattatgtcaacatgaggaaaagacgtaaaggatataagagacattaaatccaacttgtttgagcaacggaacccattctagtgactgcttatttttagaattcttgttatattagaactctatatatttatataggctgacatatgctctgccttttatcctagtaaatatcatggtataacttatttattattagaataattgattcattcattatgttacagtatgtgattgaagtcagcgtataatatggcaaggtaaactaaaattttaataaaaagaaatataagttgaagacagtataatggtagaagagtaaaataaagccaaaagaacacaaaaatatatctaaaagatttatatatattcttcaagatcaaacaaagatttgcctcaagatttccagcacccagtgcaaaggggaacacaagatgaattacacaattcacagtgtccataagagaataacaaacaaatcagttgcttagcagaaggccgactgctactgactaggaaatgatagagacgttttccccatggagagtcacaaagtggttattgtggattgtaatgaacaaaatctatgtaaccgttgtcatacagttatatttttatagttttttaatgtactgtctcttaatataagctgatattacagtgtcaaattgcatgttagtaaaaacaacttgataactcaccagtatgatgcagtataaattcatgattctctggaagtctggtttaatccagggtagagcaaagagtatttagaaaaatggaatgtgagaatatgcttcagaagtacctcagttctcttaaccaaagttttagtagttaagaaacactgtcataaaatattttttaataaatgcaactaccaggggctttcctagcttctttgaatacatagatatgatagtgtgtacctttcattctatgagattatatacaaaggccagagctgcgtagtccactgtaagccactttatccttgagaaaacacttggtggtgatggcattttgtactcctgctcatagctgatacagatgagctggtcaggcagcccactgtctgcccgggcagagcaactcccacagtggtcagtcaaggctgattcccaaactgaggatttaaacgtcttcatcaagtttaacttatcctaactggggactgtaatgaatggtgacactgtaataaaaatggtaaatcttttaaagggtccttttactcttagtcctctctgttcatgctccatcattctagatccccctgaaatttactctagttcttttttcttctcctttgaggaaaataaaatcattctgaaatcatgagcttatggtgtgttcattcctttgaaatcagtctccaaatcacttttagtctcttctcacaaatacttgtctttttctttagttacttatctccatccccacccaaaccctcgtttctcctttctatcatattatacatggaaaagcaaaattaataattctatactaccactaataataatagctaaattagtggggaattatcaagtgccaaaatctgtgctgagtacttttgcatatattatttaacccctccaacagtgctttgaggaagataactatttttatcccaatttgctcgtagggaagattgcttgaagtcacactaaatagtagagccagaattcaaaccaaagctatctgatccagttcctaccattcttaaccattctgctaatttccagaagtccagctgataaagtgtaaaacaaaagttgtttgttgctgttaccaagaaaatatcagggaatgctttctactaatacatcagcagcctctcttcttcttcccctctctcctcctctctccacccagttacaagctacaggtgcttcaagcatcaaattggacatttctgtgcagtcatagaatagctggaacttaagatatttatttttctggaaaaccactgatgtgaggtagaggtgattacacagtcacttaggtcaagagatttgtctgaatgggaacacaatattaaaagtgaaaatggacacatgagaaacatagttttcctggaaatctcttgctttagcatatacattctgtgttttaaccctgaatataattcatgacgctttgttggaggcatcatgacctaacactgttgagataggtagaggactgatgttcaggagatgtggtttcgaatctctctttcactagctggctgtgtgactttaagccagtcattgtttccttatctctctcatagatacgttcataactctgatagggcctcctggtgcattagtattttgaggacatgattacataagctatttttttcctttgaaaatttaaaactatctcataagtaaatgaaagcaaaagtattttactcttcttttgtcttgcatttgctcatccattatccagtttataactttctgttatctttttgtttattaactatcacttcattcattgggctacattctatgtaaattatttaactctgcaaagtgggaacacaaaatatttaataagactctgtagacagaaagcacaaggcagtgtgaacaccacagttagtttctgtccagttttttgaagtcatcttaaattcatttattattctctgtccactcaggcaggaattttaaaccctttctgacttttggtttcaaaacaatttttaaagcatctgaaaagccctgaaacaaagaatgataatactttatttgcacataatttttaagtggccaaacagaggtttttggcttttagttctgttaaaaagtcctccctcagagttgaaaaaagaacatgaacatcttctgccaaaaggttaaatcctttgaatagaaggcctttcagggaagtgcccaaagatcatgaagaatgaaaatgctttttcaatcattttaatttaatttaattcaaacagcattcacagagtacctcctaggtgaggtgctgcccattattgtaaaagcccctttgggaactacaaagatgaatgagacatgacatccgcctcctcttagtgcacaaggcaatgggagagaaagatgtatgcatagattagtttaaaacagggcacactggtcaagggaggaaagatgacataagttaattctgatgagggcattttagcagacttccctgtagaggtgggagcatttaacctgttttttgaaaaataataatggggaagaaggccactctaggctgagagaagtaaatgagcaaataagttggaaaaaatgtgctggtgcttgggctcttttgtggaactgtaaaaagacaagtcaggtggattatagagtgtggaaaactgctctaagttagctcagttgagatcattctatggagggttggaatgccagattgcaactgcagaatttggtatccaccacttgctgtaagaagcaattgaagtttgttgttttggtttttttttagcacttaacacccggaaggaagtctttgttcttatactcttgtccctagtccgtgctactgcctcttctctaatctcatacaattttatgcatgtcaacaaaaacagcatgtatcgcactgtgttaaaatcaccagctcacttggctacctccctagtgggctgtaagacctctgagaatgagaactgtatatgtatatttaaaacatatatatatatatatgtgtgtgtgtgtatgcatagaacgaatagattttaaaaattagaagccatgtggtcagggttgtgttttaggaagagaaacctggtgactgtatatagggtggaattgaaggtggaaaggtgaggaatggttggatacagggaaagtttttgtagctctcttgggaggaaggaagaaggaagaagcttggctctttacaataccattagtgccataatgcgagaatgcaggacacttatgttggcgaaataatttagaagactttgggagatgtcaaaagtagactcactatttcattatcaaaatgcagagagtggggctggatgcagtggctcattcctgtaatctcagcactttgggaggctgaggcgggtggatcacctgaggtcagaagttcacgaccagcctgaccaacatggtaaaaccctgtctctactaaaaataaaaaaaattagctgggcatggtggcaggcacctgtaatcccagctacttgggaggctgaggcaggagaaacacttgaacccgggaggcgaggttacagtgagccaagatcatgccattgcattccatcctgggagacaagagtgaaactccatctcaaaaaaaaaaaaaaaaagtacagagtgggacatgaagatgcttgccaagtttaatggccccagtgtctgatgtcttctacactggttcagtatcagcaagtaaccactgctaagtctagttggtagctctcaaatatgtgtaactggaactagaggcaaccatatggcaaaaacgacattttagtatgcctccgtagataatcaaagatttgagttgaagtgttgtaattgagtaacttatttgcagcgcatgttttctgaaaatttagtcttttttctcaataaaaaaatacatacacagaaatcattatgccgaagaagaaaaaaatctgaaaatgcatatagtgtgtatataaaccatacaagaaacaaaatatatgttctgtatgtaaatatcttatcctgttctggacactatttcaaaatatcttgattgaagcattctatggtacagatggaaatcttatgacaatcgttctaaaaataaacaagagctttagcttttctgtgttgcttaaatttggtgagacgtttttgtttggatcctgtaggagcaatttgaatggctttgagaaatgaatgaatttttaagagaataaggatttgctggttattagtcttctaagcccttaactatgttgaacctcacttttatcagagttggaacagaagggacttcaaaaatacattcttggctgggcatggtggctcacacctgtaatcccagcactttgggagtccaaggcgggcagataactgaggtcaggagtttgagaccagcctggccaacgtggtgaaactccatctctaatttaaaaaatacaaaaattagccgggcatggtggtgcactcctgtaatcccagctgattgggaggctgaggcaggagaacctgtgttttcaactactgttcttatattattgaggcttatgtgccagtcacttaaaatagtattttttaataatatttttactgagtaaattcattttgctattaaaatactttgaaaggtttaaaataatgtgtctgagagcatgaaaagtcaggacagctcttagttgtgagacattatcccatgcagacagacagggcatcaagcatcaagcattttatttttttttaactttaagttctggaatacatgcacagaacatgcaggtttgttagataggtatacgtgttccatggtggtttgctgcacctatcaacccatcatctaggttttaagccccatatgcatttggtatttgtcctaatgctctccctcctcttccctccaacccccctacaggctctggtgcgtgatgttcccctccctgtgtccatgtgttctcgttgttcacctcccactaatgagtgagaatatgagtgtttggtttactgttcctgtgttagtttgctgagaatgatggtttccagcttcatccatatccctgcaaaggacatgaacttattctttttaatggctgcatagtattccatggtatatatgtgccacattttctttatccagtctatcattgatgggcatttaggttggtccctagtctttgctattgtaaatagtgctgcagtaaacatatgtgtgcatgtgtctttatagtagaatgatttataatcctttgggtatatacccagtaatgggattgttgggtcaaatggtatttctggttctagatccttgaggaatcgccacagtgtgttccacaatggttgaactaatttacactcccaccaacagtgtaaaagcgttcctatttctccacagcctcaccagcatctattgtttcctgactttttaataattgtcattctaactggtgtgagatggtatctcattgtggttttcatttgcatttctctaatgaccagtgatgatgagctttttttcacgtttcttggccagataaatgtcttcttttgcaaagtgtctgttcatattgtttgcccactttttgatgggattgttttttcttgtaaatttgtttaagtttcttgtagattctggattaatatccagaatggatgccagatggatagattgcaaaaattttctcccattctgtaggctgcttgtaccctctgatgatagtttattttgctgtgcagtagctctttagtttaattagatcccatttgtcaaatatggcttttgttgcaattgcttttggtgttttagttattaagtctttgcccatgcctatgtcctgagtgatattgcctaggttttcttctagggtttgtatggttttaggatttatgtttaagtctttaattcatcttgaattaatttttgtgtaagatgtaaggaaggggtccagtttcagttttctgcatatggctagccagttttcccagcaccatttattaaatagggaatcctttccccattgcttgtttttgtcatgtttgtcacagatcagatggttgtggagacatcaggcattttttacctctgccccttaaataccagaattcagtattttaatttgacaagtagcacatgaatgtgttctcatgataaagatttaaaatacagaagtttagagagtaaaactgtcttcttttattcttctaataatttctctctcttcctgaaaaataagtttacctctgcttctgaaactttatgcttcttttcctaagaatttataaatacacacacatacataattttctgacataaaataaggtgtaaaatacatttttccatttctttctttaatttattctgacaatgtttttatacttcaattataaggacctttctcattttaagtggttacctaataaattataaatagatgcttgtaatttgtaaaataattcccctattgattggtatgtcatttgattctaattatttaagcaaactaaatgtaaatttgtcttttttgaggcaaacatcttcctgctcactgccaagtttttttttcttgtggattcctagaagtggaatttatctgatactatgagcctttctgcgaaatggtttttcaagtaaacttttattagatgatgagcgttctaggttcttattcccggaccatcaaaacatgttattgattcttttaaatactttcccagtctgatctgggaaaagtgatagctcattgttttaaattgtgtttactactgacatttagcatgtttttatattggccatttgtatttcctttcataaatctcctttttgtcctattgagttatttttctgtcagtttgatattagttttactataatgtaaagacatcctctatattttcttatatctaggaaacagttcacttttctatcatagtgaagtgtagctattatctaatttgcatctaatttggctttctttttaagttgcacatgagaaatatgtgctacccatgtgttaaattaaataaataaaaacccatataccaaattaccctcttttatgtgctataacaataatattcctagtgcttatgaaaaagtggccaaatatatcagagcaaaaatattctcctttgttgaatagcaaataatatgggaggagaaggaagaaacaggatacaggtatctttgttgaggttcaggcacagagataatgtaagtcagccagctgcttttatactagcagcatgacatggaaaaatgaaaataaaaattcagggacaataaaagatattttctcctttgctctcttgaagtcaaactgtgttctgtgaagtatcagtacaacttgctattactagctatacctgtctaaatctccatgactattagggcaaaactgtgtcctttttaattttttaaatgctggttgttaaactccttcagctaatgggggcttagataaatttttacatcctactaaagttactgttaactcaaaacatgactacctaatctattcttaaggcaacagagtctatttgtaattttctatcaactgtcttactctttcttgctgatatagcaaacgtaacaatctacagagagaaaatttgcagtgctgaaaataatatgaatatcacaagaaaagtcacagaagcatgactcaatagcatttttaaaaaggaaaataattaaggaaattgtattgtattaaggaaattgtagtgcattaaaatacaatgctgattaaaaatataaataacatgttttaaaaagcaaaaaaaaaagcacatttacaatcccatattctctacaaagaaagttgtaattatcagaaattcacctcaatgcatttaaattctgaaattttaggcatctcaaatgtgataaatgcagcaaaatatgaaggaatggcaatagtacaaaacacagaagataggtctgcagtaaaattaacaataacctggaactataatttcagatgactttagcacgtagttgggatctagtaaagaggaataagatggggaaatggaggaaatgtgtagtaatgcttttataggaaggaggagacagaggtagattagactttgatgaaatgttatacacttgaaaaaatatgttataaatgtatgagtatttattagaagattacaaataagatgcataactttaaaatcattagagggaaaataacaaagttttcaaaatgatagatagggaaaggcaacgtgaagcaacatgaaagtacaatatattttaaaaataagtgtaagaaataaattcattcactatacacttgaacacatcaaatgatctgaatttctcagtctgattaagtagctctatgctgtttaataagagctacgctccgcaaaatggtaaataaaagttgaaaacaaaggaatagacaaagttataccaggcaagtgctaacaaaaagagagcagttttgctaacctaactatcaaattgttgacgcagattctcaggccacaacccagacctactgaaacagacactgtggggttggggcccagcaatccagtttggaaaccactgttttatatatgtcctgagtcccaaattcatttctctaaattgcttgggattagaacaaagaccatgcaatcacagatttcttaaaaatggaaattgatcctttatcctagtaaaatactgtgagaactaagagcaacttttacctagtgagtccttaaatattcacagtggagtggattctgaccagtagaatctctacgcagtgagcttgcttgagttcaaatcatagttttctcatggagcgttatgaccttaaggaagttaataacctgtttgttttagtttcctcatatgaagatagcaagaaaataaaaaaatcttgtataaatgttgggagggttaaatttggtaatccgttaaaaataagtagcccaatgcctgatatatggtaaataccccatacatgttctttggtattgtttaaacaatatttacctcatgcaaaaatgaattctacatggtctaaagacctaaacataaatcaatttaagcatcataaaataatatataattgtatgtgtacagtctttgggtaggaatgatcttcctaagaacaaagagcaaaagcagaatccacacaggaaaattttgtccaatttgcttatttataaattaaaattttctcaacacaagagacactaatgaatagtaaaacaaataccacactcagagaaaaatagttcaacagaacaaaagggaaattttattaaaagaatatacaaatgaccaataatgaaaatatgttaaatgtcacaagtaaatgccatgtaaaataatgagttatcactgttcacagatcagattggcaaaatatttaaaatgatcaagaatatgcattgatggtccaggagtaagacagcacactgatctcttaatgcaggttttcttgggaaaactgttttagaggaaaggttcgtagaatcagtgaaattttacttctaggattccattcaaaaaaaaaaagttggcaatgaatatgaagatgtttgtccaaggaagacaaatttgcattttgaatttaaaatttgaattctaaatttgattgtagattctagtttcttaaagttaaactgaaaacaaaaaagtactctcagatgtccactggaaattttatgagctataagggtaatggtggttggctgacttgctaatttagaaaattaggggcaatctaaatttccaagtttctttcaagtaatctaataaagtgtcaggaatcagaggttccaggcaggctagtttagtgtgattactaaggtcattatgcttgggattccatctctgttaacctacctactgttcttttggcttgtggaggcagttatattgttttctgcattgatcttgacttctaagttaccagcagttaattgtatcattgtctatgtgaacatatcttttccttttagggtagggtgtttaaagatataaaccttggactaaagtgatttaggaattctgttaaagaaagaagtccatgaattggaatctgttgtctttatgtttttttcagttgcaatatataagcactagaaaatgttccttctattttatatattcttcaaaaagattttttctacttaaatttaagtagacattttgactggtaaaattaatttatgctatatgcttttaaggccacttatcaatatagtcactataattaaccaaaaatatataagtaattaaacacaatactaaaccaagtgacaaatctggacaacattaatctgatttttgaataattcatttttatgaactctcagatattaatattaaatctctttaagctttttatttaataaatcaccttcattgaaaataatattacataaaattgaggatgtccaaaaaatgtggaatatctaatgcctatattttcacttacttaatttctccctttattacaaaaataatttggcagagatcatataagaaaagggatttttaaaaattcaagaaccaaaaatattaaagttgtggaaaggaaagaatagaacacaagcatgcaagccataagattttatgtagctcctaatagtggatattagcatttatttctgggcttcctgttgtccacaataacaaagaaacatatcatttatatgattttcattgtatgaagcatagaaaatatactgaacctccatgcaaagaaaagtttatctcggaacatcaccttactggggactttctataacagacactcatacagtggatggacagtgactttattaacatctcttcaacgtacacattatcatagtccttaaaataatatctagtataatcttcaacaatatttaaggtgtgacaccaaagcatacaactaaatagaagaagatctgtgggaagtaaagaacatatggcccaaggttaccctttatgacagtctactttaatccacagggaaaatctagattatttaggcaaaacataaactatccagaataaaaaatagacttgatatcattaaaactgtgccctataaaaactgcttctctaaaccagacatgatgtgctggacaaccaagaatttgagattttattgtagtcattgtgcatgtttaacacactaaacatttccaatatccagattgttccttgaaggtagggttttcatcttgcacatattctgattctcttctgcatttataattgacctaaggacctgttaagccaatttaggaatccttgctggattcaatgaaattaacatttttatgggttgtaaaaattgggctatgcagtaagacataatattcttcagcggtgagaacacaatgggactttaaaggcactgtaaaatgttaatcctttttctatctcaaaacaccataaaattacctctataaaaagtttagttttgaaaacaaaattctacgtatgataaacacaacaccattttacaagttgggtaatgatacaaatgatacaaattgcatagttacaggagtctaggcccacagttgagatacatgttgtcaaaagagaaccatttcagctagagcaagaatgtgatgggaactgatatgatttggctgtgtcctcacccaaatctcacctttaattgtgataatccccacgtgtcatgggcggggccaggtggagataattgaatcatgggggtgagtttttctcatgctgttctcttgattgtgaataagtctcatgaggtgtgatggtttaataaaggggagttccccaacaagctctcttgcctgccaccatgtaagatgctcctcatttgcctgcaaccatgattgtgaggcctccccagccatgtgtaactgtgagtcaattaaaccactttcctttataaattacccagtctccagtatgtctttattagcagtgtgagaacagactaatacaggaacattcaggaaataggttagaaaataaaggatttttctgatgacagacacagaggaacagtctaggacgtattaaatagtgggagataaagtgagattagaagatatccagagaaatgtgaagagagttgtccttgagaaaagggatggcataggagctgtggacttctgattgtgaccagagtaaaaaagctgcaaggtgtgatgggtctagacctggtgattgattagaagtgaaggtcaacaaccctaattaatgcctccttcttgggaataagcaaatcatagaaagtttgtgcatggggaacagggagactccaggggcagtggagaggcagagaagagtggtatcatgggagcacacagaaatctctgggcatcccctcagtctagctgtggacagtgccctcgttgggctgggaaaggttgggggagagagagctcaccaggaacatgtactaagttgttccatttttactgatgctgatttctattcattcttttgccttatattgtagtaagtgtctactaaatttagatttagtgaatagtctaaatctaaaactctataaattcacttttatcattgtaatttgccactgagaacccaccattcagaacaacagtccaacttcaaattgcttcagtgattatattgttaatatttcctagcttccagaattgaatctcatgaaattcatggaatttggatcaatgtgtgtgggtactgtggtgatccattccctcctgtggactatttctcctttctgaactgaatgcttctttggttttatgtctactcattaatgactacatagtaacccacttctgacaaaggccagtctacactgccaaagtgtttcacttagcatgcctcccagtggaagcagaggtggaatccaaagttttcagttcatgttgctgattcattcaagttactgaagaaatgtccagagactagagactgtggaagttgtttctgttctgtgaaaaaaaaaaaagtgaaaaattaagaattaagagtggagatgtcacttggtgttgccaggctttggggttttatatacctgtataatttttaaaaatagaaaaggcacagaatcaacaaccatttaaacaaccaccaccacaactaatatctgcttacaccagcattttattaaagaattgctattttcacactttaaaaagcaactacatttcacattttgaaaaatgtatgtcctcatttttttttcttatttctacatcatactaatgaaaagtccagcatggatctccaagaagctgcagacctgagttagagaacctgaactagctgacctctgagcctttacaaatgtgatattctgtaacaatcttatttagtagtataatgcataattatgtatttggttctgtactattcagtctgctttattaatctcacttgtagctttaataaaatttccagaaataatattagaagttacatctagatgtttctctatgtatttactttgctgcggtgttgtcagtcattgcacaagacctgatactgctgttcagactgttcaataaatatataaaataatgaaatgtatttattaaatataataatttaattattttaaaccatcatgtgggcaatacataatttctccaaaaaaattctaacaaaaggaatctctgaaaaagctgtctttcagcacacaatagatcaaaatgtgtaaaatagcatgaagttctaaacacagctgaaagttcatacagcattgttaacacagtgcgtttgttcttggataggaaagctgtgctgatgaaagtactctatttgccttatagattaatacacctgcacctgttacaattctcatggatgttaaacagcatgtcatccaaaaggaaaactgagaatactgcctgttgccccatgctgtagctacctgctaaccacagtagaataaagtatatgaaaggtccttccacaatttctggaatatagcaagcccaaataagcatttattaattcagtcagtgtactgggtttaaaaattgtggacagtagatgacaacagaaaaatcccaccaaatggaaacatcatacaaatactgcatacacacatacaaagaaacaattggaatttaatattcgattcactgaaagtgcttttcaactttgtagcagggccagtagacatctgggaacccataaaaatgagaaaaataagcctgagctacagcaatcaggatagaaaggtgtgaaggaagggggctgtttttgcacgaaattttagagccagctgttaacttcaagaggcagttgcaaagagtgacagctgtgaaagcaatagattctcttacataaaaagccagttagtaggtgttagtacaggaaaatattgattatgcaaagtggaagtgagagtacttccttagtgagaagattgtgcagattagtattttctagccactgacctcatggaagccatcatctgtggcatcattaataagtacaaggactagcagaggttgggcaagcctggggtttttcatgtaaataacactactctccagtatgtcttaatttaaaaatgcctaatgtatcacactatagtgttatatatttctttcctaagtctatgattaaataaatatgtttttttaaaaaaaataatagaaactcttgctatagctgaagcctactgacatatttacatgtcttgtttcaaagggcactatcccctgaaaaagaaaataatgcaatgctcaacaaactcaagagaaccatacttgggaactccccttcaatcttaaaaggagaactagaaaggaaaatcaaggaattcagtctcaatggaattttccatataattgtggaccttctatggaacgttctaaactttagttgacataacaattttaaattagagtacatatatttataattacatctgcattgaagttttatttaggaaattatctttttgaaaaagctatttttcataacatctttagaatctagtgcctaaagttttaggtatctgtctaggcattcatgaggaagcaactcgcagtgtgtgtttggctatggtaattactcaaggtcaggtaattactgggcagaaaagagtgctggtttctcggtgttgaggaggaagcctggagacttgcaatgggtaaaactgactgggcaatatgtgtccattaccaaaaggggcccttaggatactgtcagaagcagttggtattgactgagttatcaacatttgcagttgtggcctcaagaaaagatgatgttgtttaatactgtgattccaacaagtggcagataaagttcaaaggtagctatccttgtccagcaagattccctacaaagtgaatgtggaaagcacaagtgcagaatcctatcaccggagagagactgatgtaagtccttggcaagctaccaaatttcaatttagagcttgtgggggctaatgggaaggggacatagggaagtatgagtccaggcagcgcttggaacaagggatctgataagtagcagaggtgatggtagtgacgtgagatgccctgcagtctggctagccaatggacactggatctggaagtcccaattaatcttgaatccctttgcagtaaaagggaggaacctctgctgggtgttgcagtcagtgggggacaaggatatgatgtaaatccaagtttatattcctactaggatatgtactccatggaaaattattacagttttaaaatttctcagttatgtttttgttatatattttctaatgtgtgattaacttaaccaggcaccatagtagttagcaacaacaaagaagtataagttgatttttaattatagaatgcataacttaaaaaatagatctagcaatttattttcatggtagcatgtaaaacattgaaatggttagtagtgtatctttatttcaacctccttgtttaaggaatatgagtaacaaaatgtcagatatgcaagtttggatttcagagcttcccactaccttcaattcaatcttctgcccaactctaagattttataaattatatttaatttcttaaatatttttattataaatggcaataggtagaatttaatgcagtttgttcagttgtgtccatttctttttctttttcaggtaagagaaaattattttatttgtttctccgcaggctgtaggaaacattaataattcatggagtcagtttcttctgtgtcaacactttctgagcacaccaccaggtcccaagcttacctggctttctcaaagcacagtgtgcagcacgtttgttcagagatcattcattaaggatctatgggaggctcggctctgtagtactcatataatcatactgtgggaagaatgtttaaaatacaatttcctgtaaattggtacaagagcataagaaatggccaagtgctttgaaaaatgaactaattggtacaagagcctaggaaatagccaagtgctttgaaaaaatgaacttactgacacacgataaaaaacatgggtctccccttcccccagcaatgagaatatatttcttctcatattgtcatactccctccttctggcctctgtctaaccaaaggcatacatgtcagctcatcctaactgaacaccttatgttcattctgcaactctgggtcagtaaagctggctaatttacatggagatctgccctatcaagtgagcccaatcagtatagtactgaaactctgaattaatcatgcctctttaatcaatgagaaggaagagtctcaaagattaattcagatcaacgaaaggatctagaatcatgcatgatttcctgcttgactgactctatgctagtaaatatgcctctgacaaattagtcacataggttcaatatcccaaggaaactaaaaaatgaagacataatcaatgcatccaacattatctcacaaacaccaagtcatcaaccaaacctttaaacaaagttgaagtgacattttgtggctaaaatgtgagtaatttgagtaagggccatgggggaggggaagccacccagtaattacctgcccttatttttttgtaattttctttctttctttctttcttttttttttatctcagctcactgcaacttctgcttcccaggttcaagcaattcccgtgcctcagcctcccaagtagctgagattacatgtgtgtgccaccacgcctggctaatttttgtactttttattagagacggggttttgctgtgttggccagactggtctggaactcccaacctcaatccacccacctcggcctcccaaaatgctggcattacagatgtgagccactacaccccaccctgttgtaattttcatgattataaatctgctgttatgatattatctaaaatgatatagaaagaataagtgtaatataagttaccatatactggtgatttactgcaaatataaataatttttgaaagattggaaatttgtataataattttttgaaagaaattattttctgctttttataagtttgatcaggccctcttgctcaccaacaaaagcaaaatatatacatatttcaacatcatagagagctattgttatattataatgatactttttaaaattattaaatttctaactctttatgccagggagcctcagtcaacctgtcagcttcgtgccttcatttcccccaacgttcatcataaagaaagctataagtagcaagaattgatctttctacggatttgctctgagctgcaaccagccaaggaattactctattgtatgtgtcactgtgagacgtcttgggagaagtcttacagggtgggaattactctgtgctctgacctgtgtgcataaggcctaactcaatgaaaattacacattgcccttatactggacaagtttatgaaagacatccattattattttttaaactatattgggttcctggagatataccttactgttatccttgagtgaattggcttcactttttctttgtcacagaacaaacctgtttacataaactgcatcttcatgtatagatatacaaggacaaattcaacatttgaaaatcacttctaaaaagacatacgactgagcttaaatgacaaaagttggaatagattgtttaggagaagactattggatattaagcctttgctttatgaatttgaatttcaatatatcctgggtgcaatctgtctctgcatatttcagctaaattgtaatcacagcaaccaactaagtgttaacccagccagaatctttcttggatgcttttgagataaatctaaaataaataagacaaaacaaggattaatggaagattaaaagattcacataaacatagctaaatgttaacgattgaagacaatatttttggaagctggggaaaccttttaccttctgtttcttgaggcttaggagatttattcttgggtagttagagactttgattttcctcttttaatgaatgacttcctcctcttccatgctgccttacatgtatttttgtgctataaattttgtaatagcacatttaattgaaaaattttaggcctaccctgtctcaaaagacaggactgtagtcttgcctgaaggtgtccctatactctggtaattcacacaggttagaggtgtgtcccagaccagaaagcaaagctgtaagggtaaaggtcaatagaaaggtaaaggtcaatagagagcctaaagattgacagctctatctcttttaggctgaattcttttcaatatttttctttctcagtagaaacaatctcatttgaggaaaacttgatgataattaacattttataaggcattttacaatcgaagcatttctttcagcatttagagtattgaaaggaaaatattaagtgattaaaaaggcatgtgctttgatttaagggcattgaaagaaatatctatcatttggtcatatctgtgcacaccctccttccctgacactaagattcctagtagactttgattagcctcctaaccatcccaagccaggagtcaaaattcctaaatatctgcctctacctcttggttctttaaggactttcactgacccctgaacaaaaataccttaagaccttaacagaagtatgttaatatcgggtaactgcataatggcattataatcaaaccttttgtctttttaatgcttgaccaattcaatactttacccttggaggagataatgccactggccaggaaacaggaagcaagtctgtgaaagtgttctagcccacttagattcaaatcaagtctctagaatgattgtggctaatactgattctttagcaatcttcacacaatggaatttctttcccttattcccaccttaataagtggtaccaccttttaacaagtccctctcaatccccaaagaaatgtcatctagagctcctgcctcctggtgttttcttcaccctctttccctttctctctctctgctcccactaacatggtcagcagagcattgtcatttctctctaagaagtgctaatatctaactggtttctgacccctctatgatctgtccacactagagccatcagaatctctcgagaacataaatcggcatcttctttaaatcccatcatacaaggattccctgtaggttacaaggaatttacattatataaagcattttataatcgaagcatttctttcagcgtttagagtattgaaaggaaaatatcaagtgattaaaaagaaaatcaaagcctgtgctttgatttaaaggcattgaaagaaatatccatcctttttaatgttaattaaaaagcttccctctcattcacaaagttcctggactgcatcctaactctctcacttttctgactctccttttaatctagtttacaggagtgcccagattaccattgctgtttatgttgctttgttccatagttacatcctacttgtaattcagactcaactcagtcctgacaaaagacttctgttttagctttcctatcttatttcacaattgcaagctttaattgttttatttcctttccttttgctgattttttctactttgtttctctgagcattattttagagccatattagatgagattttttattatttgtaacaactattgccttttattactaatgataatgactgtagtactttaaaagttagtctttaaatgggcctcataaagggtaactttgaaactgatctggtgatttgtacatttggcaaatgaatcaaaatttgaaattgaatgaatttgtcttgatgaattctggccattaaaaaaagatttagagtaactattatctgaatttagatatcagtttttgttccttaagttccttattaaagaaatgtttgaaatcatactctctgccttaaaaatcccaaagtgttctctgggaacataggtaaacaactctagaaagcttctaacagtgatattttatcctttttcttttatcctagtgtacaacctcagttggattaggccaattccctaaaatttcatagaaaggaatttgttttcattgttataaactagagggttttaggaattggcaggatgagagtgggattttctccgcgatccttctgtcaacatttttcatacactattttctaagggactagtgagcagagtactcctgagtccactagaaggtgcatggagtggttgattgatttattgattttcggctaggggatctatatgcagtgctaaactggaccttcttgctcacccaaagcaagtagaaacagttactggattatcagaaaaatatccagattttaacttaacagctgtgtcacatcagggtggtgagcaggtgaatcgacacattttttaatacattttccaaaattgcctagttaaattcttagatgccttttgagtctgagaattgtcattttgggcctgtctacattttaataaataaaccaaattaaatgcattgtcaaaagaacaataaaattaatctagttttgttctagtgttcttacctaaaatgaattaaaacatcaagtgatttcaactcttcatgtatattgcattgttattcagggatcttcaacttttttctattacttctaagagacagtagaactccaaatagtctggatgttatatttctaatcaaaaatgtctttaaaagattatctctttaaaggaaaaaaatttcattttcctattatattttgctttgtcctcactttttctgatcactatatttattcctataactattcagttaattgtacagctttcattgatgacattgcattctgcattgttcaatagagccccttcttaggcactgcttttagtctcatattaactccaatttctttaatccagattgcccttatttactttgatatgaaacataaggccatctgttgagcctgagcttttactatttttgtcatcactatgaatagactggcctccattcatgctctcctgatggatctgtcttgtcaaccataaagagaaaagagttttgttttagctcgcctatcttattccacagagattgataatttcccactcaaactcttacagtttgtgtctcattcatatgaaggcctttctcttcaccctacccatgtgtaggcaaaaaacaagtcaagtggttctgcctccaaactatatcccacaggtgttcgcctcaccacagccatcactcaaaccaagttcccaaaatcgcttacctaggctattgcagcatcttctccacgggttctaccactcagctaatgcactctccattcagcagccagaaaggctttttgttttactttttattggatatttttttttgtcaatgcttgttggcatttccaaagtagttgcttctccagtgcccaatctgggatgtataaggtgaaaagaaaacccagggaactcattgctgcattgttcctcagaggctgaggtccctagcagcctgtcttcatctctccagctttcagaggatacttgtgtttgctttatgtataatatctagagttttaggctgaacatagcaggagggctaggaaaaagtatatcttttggtctagatctgaaagtcctgaatgccatttaaaaatatatatcacattgcatccctgtaccaagcttaaaacctttcagtgactttctcttgctcttaatatacaatgaaaatttacctctgtgacgcataagacccaaataatgtgatcttggcctgtctctgcaatatttatgtgtcagtggctctcattctattcaactggccttatatttccttgaataaactaagactcttttcccactcagaatctttccccatgttgttccctttgtctcagccatttgtcatcaatgctgtcactgcttggctccatttcagcctctggtttaaatgctccctcctttataatgtccttcccaagccaccttatctcatattcttctcttactttcctatgtttaaattttcttcagaaattaatataactcatatttttccatcgttacttttcatagtctatatgaacaggttcccaactttgccttttaatcttttgaaaggtgcatttaatgaacacctcgatggaagatggtagtatgttgtaatcaaccatttcataaagaaatacaaaaaaagcccctgagttatagatcactatgtcatcacgggcccagttgctagttttggtttgcttatttttttttaactattttttttttaaattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatggtgagaatatgcagtgtttggttttttgttcttgcgatagtttactgagaatgatgatttccaatttcatccatgtccctacaaaggacatgaactcatcattttttatggttgcatagtattccatggtgtatatgtgccacatttccttaatccagtctatcattgttggacatttgggttggttccaagtctttgctatggtgaataatgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctccccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcttttgcccactttttgatggggttgtttgttttttttcttgtaaatttgtttgagttcattctagattctggatattagccctttgtcagatgagtaggttgcgaaaattttctcccattttgtaggttgcccgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgattaagtctttaatccatcttgaattgatttttgtataaggtgtaaggaagggatccagtttcagctttctccatatggctagccagttttcccagcaccatttattaaatagggaatcctttccctattgcttgtttttctcaggtttgtcaaagatcagatagttgtagatatgcggcgttatttctgagggctctgttctgttccattgatctatatctctgttttggtaccagtaccatgctgttttggttactgtagccttgtatagtttgaagtcagatagtgtgatgcctccagctttgttcttttggcttaggattgccttggtgatgcgggctctttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaatgccctttatttccttctcctgcctaattgccctggccagaacttccaacactatgttgaaaaggagtggtgagagagggcatccctgtcttgtgccagttttcaaagggaatgcttccagtttttgcccatttagtatgatattggctgtgggtttgtcatagatagctcttattattttgaaatatgtcccatcaatacctaatttattgagagtttttagcatgaagggttgttgaattttgtcaaaggccttctctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttgttttgccagtattttattgaggatttttgcatcaatgttcatcaaggatattggtctaaaattctcttttttgattgtgtctctgcccggctttggtatcagaatgatgctggcctcataaaatgagttagggaggattccccctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcagttttgttgatcatttcaaaaaaccagctcctggattcattaattttttgaaaggttttttgtgtctctatttccttcagttctgctctgattttagttatttcttgccttctactagcttttgaatgtgtttgctcttgcttttctagttcttttaattgtgatgttagggtgtcaattttggatctttcctgctttctcttgtggacatttagtgctataaatttccctctacatgctgctttgaatgcgtcccagagattctagtgtgttgtgtctttgttctcgttggtttcaaagaacatctttatttctgccttcatttcgttatgtatccagtagtcgttcaggagcaggttgttcagtttccatgtagttgagcggttttgagtgagattcttaattctgagttctagtttgattgcactgtggtctgagagatagtttgttattatctctgttcttttacatttgctgaggagagctttacttccaagtatgtggtcaattttggaataggtgtggtgctgaaaaaaatgtatattctgttgatttggagtggagagttcttagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaggtctgttttatcagagactaggattgcaacccctgcctttttttgttttccatttgcttggtagatcttcctccatccttttattttgagcgtatgtgtgtctctgcacgtgagatgggtttcctgaatacagcacactgatgggtcttgactctttctccaatttgccagtctgtgtcttttaattggcacatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagcgcttttagggcaggcctggtggtgacaaaatctgtcagcatttgcttgtctataaagtattttatttctccttcacttatgaagcttagtttggctggatatgaaattctgggttgaaaattcttttctttaagaatgttgaatatcggcccccactctcttctggcttgtagggtttctgccgagagatccactgttagtctgatgggcttccctttgagggtaacccaacctttctctctggctgcccttaacattttttccttcatttcaactttggtgaatctgacaattatgtgtcttggagttgctcttctcgaggagtatctttgtggcattttctgtatttcctgaatctgaacattggcctgccttgctagattggggaagttctcctggatgatatcctgcagagtgttttccaacttggttccattctccccatcactttcaggtacaccaatcagacgtagatttggtcttttcacatagtcccatatttcttggaggctttgctcatttcttattcttttttctctaaacttcccttctcgcttcatttcattcatttcatcttccattgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcctgtagctcagagtaatttgatcgtctgaagccttcttctctcagctcgtcaaagtcattctccatccagctttgttccattgctggtgaggaactgcgttcctttggaggaggagaggcgctctgcgtttcagagtttcccgtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctgggggggtgcctcccagttaggctgctcgggggtcaggggtcagggacccacttgaggaggcagtctgcctgttctcagatttccagctacgtgctgggagaaccactgccctcttcaaagctgtcagacagggacatttaagtctgcagaggttactgctgcctttttgtttgtctgtgccctgcccccagaggtggagcctacagaggcaggcaggcctccttgagctgtggtgggctccacccagttctagcttcccggctgctttgtttacctaatcaagcctgggcaatggcgggcgcccctcccccagcctcgctgccgccttgcagtttgatctcagactgctgtgctagcaatcagcgagactccgtgggcgtaggaccctccgagccaggtgcgggatataatctcatggtgtgccgtttttaaagctggtccgagaagcgcaatattctggtgggagtgacccgattttccaggtgagtctgtcacccctttctttgactcggaaagggaactccctgaccccttgcgcttcccaagtgaggcaatgccttgccttgcttcggctcacgcacggtgtgcgcacccactgacttgcgcccactgtctggcactccctagtgagatgaacctggtacctcagatggaaatgcagaaatcacccgtcttctgcgtcgctcaccctgggagctgtagactggagctgttcctattcggccatcttggctcttcccccctagtttgcttatttttaattcattgattaattcaactattatttaccaagtgcctgttgtgtgtcagacactattctagttgtcagtaatacagccataaacaaaaatacgttactgcccttatggagtgtacattctactggagggaaaataatacacaaatatgaaatgaatgcataatatattatgtgatgcaaataaaaaataaagccgttgaagagaagagaaagtgattggagtaggctgggaataggaaagtgaagaattttttacattcaatggtccagaaaggtctctttgtcatacagtggtatttgagcagggatcttaatgaaattgagagccagcccaagcagatatctaggggaagcaaagggaagactaaggacaaatattctgagactgaaatgtatgtgctgttattgaggaacaacaggagactgatgtggctggagcttagggaaggaggaagcaatgctaagagatgaggccagtactaagatagccagaatgagactattgatggagatggttgacagactttgcctgtgacaaactgcatatgcttgttacacatggccactcttaatgttggttgattaagagtactgtccattggaacatggcaacagtttcaccagtagaagcaagctgtgtggtgagatttaactcaaaacattatttgataactaagttctagtaacaataatacatacatgatacccataatgcctgatttccctacttgactctaggaaggtagataggatgaagagaaagtaaagataattagggcatattataaaaaagtaattagaaatagttctaaaaggaaataaactaattgtttcaaagttatttaaaattcaaaactcacagttgtttaattgctttcttacattgcaatttcgccagggtgagcaactgaatcaagttctgtggataagtggggggaaaaatgaatagagaattaaagtattccaaaaatactgaatgggcgtttaaatgtgtgcaaccttttttatttcttaattgaaatatgaaagctgtgcttagtgcacaaatgagtgttatatcctcattttgtagatgtgggataaggattaaatgttatgtctaatactacgaagagaacacgctgctgttctggacaggaaattcaaaaggaaataagtgcctggtttcactctttggtataattatcaatttccttcattcaccaaggctcatataatgaagagctttaaatctactgttggccatgttcaactgaaacagaagtaaaggttgcatcctctctttcccttactgtagttcctcctgaaatcagaactaaggaaagccagtttccagaggtctttagtaaacacagtctcagaactagacttccttttactcttatgccatccatttctttactagtaagctggaattaatgttgcatctcctctgtcatcctatacattgtaccacaaaatatgtataggaaaacacaaattatgaagtgcttgaaatatattacttcctgttttagaattattatgattgtaaactaggttgtgctgaccttaataaaccactagagattctgtaatttcaccttgttctttttcatacataccctttcccatatagacttttccctttatttgaaatgccttcctttcccatactaccatgcttggcctgacaaactcctatttatctttctgggctgaggttttaagtgatctcaccctgtaaactttccctaatcatcctctctgggttagatacctttttgcacctcagctgtgttgattttcattttagatatgtcttctgtagcagaccacaaactccttgagagcaggaactgtattttcattttccttatattcacaatatgtaccataatgccaggaacatagctgggtgctacaaatatttgttgaataattgaatgacacaatttcaaaacaaatatattatttaaccaaataagtaagtaatgagaaagttacaaattctaaggtcataaagatacttgtaacttagaatgccttttaaagtaatgtactccagtgttatcataagtaattgaaataagcctacacatagtttactcaattattttgatgttcattgagatgagttttgtttccagtaaatattctgaacatatgatgcatcttagtttttcatggtagttatagagaatctatagcaatttaaaatttgaataagaggttgggcgctatggctcactcctgtaatcccagcactttgggaggctgaggaggatggatagcttgagctcaggaattggagaccagcctgggcaacatactgaaaccctatctctacaaaaaatacacacacgcacacacacgcaattagccaggcatagtggcgtgtgcctattagtcccagctacttgagaggctgaggcatgaaaatcgcttcagcccaagatatggaggttgcagtgagccgagatcatgccactgcactccagcctgggtgacagagggagaccctgtctcaaaaaataaaatttgaataacgtttcttgatttctttccattaaatattgacattgaatcaaaagaatctgaaattatttggtttaacatattaagttctatattttcatttttgatctatttaaattgaatgttaattataatctgcacaataaatgtgatcattatgagatggcatttgatagtgaagaggatagctttaccagaaaagaaaaaagtcctatttttttcaagatgtggcaacaactttacaactatatactacaacaaacatgactgtgacaacggattttagcatcactttctttcaaagataaaataggttcccctaaaaatactccatcttcctaacattttaaagaaggatcgagatgaaatttataatactatcattgggagccttaagaattttacagaacttctcagtactgaaatcactactctctcaggatattttttcatgtgttttaaaacacgtgctgtagtgaaagattatactgttagacttttgaagtactggtgaaataacttgtttaactcttctaagttatatatttgatatttgctgccttctcaacatcacagttgagttgaaaaaaagtagtggctttcttacaatgctattgaaatagcattatttcaataataatgaataacaggttgggcatggtggctcattattatttcaataatagtgaaataatgctatttaatggccttatttgcttgtcttctttacaaatcagtgattgaacagtatagggaataatcaatttttatcgtacctcataatttatagaaaaagtattaacattttgctgcatgtgcttactacgttagagaaaaaggttataaatggatgctatagcaacatcctggcataatccttcatttattgacagttttattgaatattgtgatttttattgatttagtaataaatttcatttttgaaactacttttatctacttatacttgtgccgacggaaagtgagaatgttgtaccatggcaattattagagaatacattttaatccagttaagtgattgcatttttttctttccactctccaagttatctttgtttgtatttaagagtattaaactcatttcctttttttccacatactagagactgtggtaaagttatgtggtgttttctgtaaaataagtttggagccattaactgttgctttactgtcaaaggacatttatgtattccaaactgtttcttataataaaaccgtacaacaacaatcaagttaactaaaaatctcctttaaaagaatacatacacataaatacacacacatacatctttaaataaattttaaaaaacgaaccctgcccctagtttcacatttattactctccattgaagttgctttaaatccaccaaaatttagagacacacaaaatatgggggataaagaacttcccgttatttgagtatgaactatagttctgcgcaaccttaaactaagaaaaggttggtgtaatcattccactttgttctattcttagacttcgtcctcagtcagaagttaataatagagatatgatgccaccggaagtggcatctccttccttttttttctttaccatgcagcattctacttttctctgccattcataacattggcagaagggaacttgataatgagagaaaagatttttctccctgcaagtaatagggactcttacctgatgatcacttagggcagtactcaaagtgtgatcccctgggcatccacatcagcatcaccaggggcttgttagatacacaaatatctaactctgagggtgaggcccagcaaatctgtattttaacaagcctcctggtgattgtgaagaacactaaagttagaggactactgatttagggaatagttatcatgacaatcacgttaatcacccattagagagtgcacagataattctatgctatccttaaagatcttctccaaatttattgtttaaatgcagggaaaaacgatgtaatgaggtactgtacctttggacaaattgcaaattaggaaaagttgtccctgaaaacttttgactgtggagaatttacctaatgagttacggcgtgaatttgagaacttcaaagactgagagcttgtactggattgactagcttcctccaaaatgttcccagtggcagtttcacgtggaactacccaatgtgaccttagctagaaagagggtttttgcaggtataacagttaggatgaggtcatactggattagagtgggccctaaattcaatccctggttccctactgggaaggtcatttagagaggcatacatggaagaaggttgtgtgaagatgaaggcagacattggagttaggctgccacaagccaaggaatgtcaaggattgctgccatccaccttggctaggagagagacatgaacagtttctcttccagggctttcagaaggaaccaaccctgctgacatcttgattttggatttctgacctcctaaactattatggaataaatttctgttgtttaaagccaaccagtttttgcttaattgttatggaagcctggggaaactaacagagggctttgtagggtttatgttttaagagtattctttgccttgctcttagtctataaagaccttctcattaaaatgtgctttgtaaagaaatatgctctcatccttcccacctcatcagttcctccttcctcttctgctatatccaccccacacatttgtttgttggttttaagtttcattgagttataactgacaaattaaaattgtattattcaaggtgtacaaagtgatattactctccactgaagttgccttaaatccaccaaaatttagagacactaaactacattcagaaaatgtggggcgggggagaaattcccctgtttttcaaatataaattatggttatgtttctgcaagaacccccaactaagaaaaggttgttgtaataattccagttcattctatccttacacttcctcatcagtttaaggatattcatatccatcacctcacacagttgctttcgtatgtgtgtgtgtgtgtagtgaggatggttgagatctactctcttagcaagtttcaagtatacactacattattattaactacagtcactatgctgtacattaggtctccagaaggcagaaggcggaaggcttttatcgtataattgcaagtttgtgcccttcgaccaacatgtccgtacttcctttttttttttgagatggagtctccctctatcacctaggctggagtgcagtggctcaatcttggctcactgaaactttcaccttctgggttaaagtgattctcctgcctcagcctccccagtagctgggattacaggcacgcgccactacgtccagctacttttttgtatttttagtagagacagggtttcaccatcttggccaggctggtctcgaattcctgacctcaagtgatccgcccgcctctgcctcccaaagtgctgggattacaggcgtgagccacagcacctggcccccacacttttgaaggatctttgaagagtctaagttcaactgggaaagtcatagtcttatttattgttggggaaaaagaaactctactgggagcatattaaatacaaagcccttttcattgtggagaaataaagcatttgtgtatttttagttagaaattatgcatattatctcccattcgtctgtctttcaataaaattttaagttgaggtgtattgtgtttcttaagctgctttatactcatttgttcaaatacataccaagcctttaattagaccatttggctattttatttgcaaataagtaatactattaagtgtatctgtgcctccttctgttgctgtttcaattgtgtcatgaatgcactgaccctccatagacagggttaattggagtgtgggcgtgagtgcatgcatgtgtgtggctgcctgctgtagacttaagataaagaatggagatttaccaagcaaagcttttatgtcttaaaaataaaacatatgtaattatgagtgatatatttaggaatcctgccttaataaaattaatttgcatgcactctaccttatagtaatagttctgagtgactttgctattttttcccaaacagcttagcaaagcatctatattgtaatatgtaagtaggcatttttaaaagtcatacaaatgaaaagaaacatttaataagaatacaactgtgctaaaataatttaaatgacttgagagatctgcctttattatatgtagatttatgctatttctctagccagtaaaacaaacatacaaacaaatccctatttcattctttcagcacttctactatgtgccaagtatcagttattaaaaatagagaagaaattcagagtcttgctttcaaagagtgatagttttaacagggaagaggaataatagacagttaagaatctgcttaaggagaaaactgggcccttgggcagggggaaatttagaaagggtactgtattggcttcctagggctgttgtaacaaattaacagaaacttgatggcttgaaaaaacagacatttattttgccacggtcaggaggctagaagtccaaaatcaaagccccagcaaggccacaccttcctctgcaggctaagtgggtggttcctcccttgcctcttctagcttctgatggcccagagcattctttggcttgtggcaaaataattccaatctctgccttcctctacatgactttctttgtgtctctctgtcttctcttctgtctctcttattaagaacctgtatccttggatttagagcccaccttaatgcaggatgatttcatcccaagatctaacttaattatgtctataaagactcttttcccaaatactgtaatatccacaggtattggatggacttatcttttggagaccagcattcaacctgctacagccacctagagtaggtgacacctccattgcagatcgggtttgaggagagagggaaaacacatagtgaggtatcttaggcatagacaatgtgagatgtgcaagtctttcccattgacaccaaaatgcctggcaaatagcaagcactcagtgactgtgggaatattaatgaaatacactcaatgaaaatggccactagcaggtggacataagtctagtaatcaggagaaagtcctgggttggacagaagaatggacaagattgccaatgcaagctgtgtgagaagcgaaaagagtaaagcaatgaccaagtaatgtccatccttgagaaattctgaagatgaggctgagaaggagtttgtggaaaaacaatagggaaaccagcagagaagggtggcataggagagaagagagaaattaatctttaaaaaaaaaaaaaggaaggtgtcagattaggttaagctgattaagtagtatgaaacctgcatttgggaactttgatatacacagtttcagaagttaaaagtccaatttttcatggattaaaaatggtagaaagtttgacaaacatctagaatttttttacctaatggacaaagaaattaaaccaatacatggccttcccttcataacacccaatgcacatgtttcagagaaagttcttcaaaaattctgtgtgaggacacatgtctgtgacctgtcttctttgaaatatgagacagactgtgcaagttgccacagattgttagagccgctgtgctggagtcgtctacttgtaacctctcttctcgttgcaggacatcttattatattcacagtgggagaatccagtttccaaactgtaattctaactctgatcttccatgtaaaagcatgttctccagggatcctactgaatccactatgaaacatcagtcaggcctacataaagtagatcagagaccttcctgatcagtagtgtgaaagatcttgagaataaaaggagccttaatgtttatacaccatagagatttaaaactgcattatactttgaagccatcatcaccttttttctctgcaatgacatctgttgttaagtgcatttaggttttttaaggttaataactgaaatacccggatcgctgtaatctcaactgttggaaagacactgaataaatcattccatggtatgtcgtcaatataccatcaattttgccttttcaattccatgttaaggagtggttgaaccctgaggtttcttttgaccacttgatattcccccacaaaatttttgaattagtcacaatggtaactatgttcaagcgtgcttgcgtcaactaacatttttttaatttaaggatggtaaatttgggcattttagatgtctttattttaattgttaacaatcaataagcttttaatccttttcttagctttatgaactgagattatggtaagtatgtttattttaaaaacttaaagtggatttactattcgttaccttaaaaagttgagctttaaaattaggtgaaataaatgatgttatttaaaaatcaactttttggctgttatgatatttttagattgggaatttaagaatttaaatgagattatgaaggaagtcatttaaaattttgttttataaatactttgtgttagacttaataaatcagaatttaaaagtatacagattgataagaaatttttaagttgaagcatatacaaaatctgattatataattttatgtcacttataataactgataacctataaacttagaactaacatcaatcaacaggtcaacagcttttgtcttagggttaaaccatgcaatgttatagatcttaaaaaaaaattttacctaactgctattttgacatcaaattcaattaagaaataactccaagacttcagcacatcttagaaaaattcaatagtgtatattttctactcttttatattcacaaaacacatatatgtaactaattagaatttaataagcctttcacccgagagaaaattttggtctctgtaaagcttttatccttgccctacttttaatgtcactatcaagtatgttattctgccgggtttttaaaaatacaattttatgttattttcctgcatgttgcaattatgcggttttcttacatgaatattgctttatggagagaatgctctttgaaattttagaaaaaaaatgaatattgtttctatagaaataggaatactctgagcaatagattgggaaatgagacatattcagtatgaatctgagtctttgttgttcacactagatgaagggtaattttataaaaataaggccaagaaaaaaatgaaatatgggatttcatagtttatctatgataagtcaagccattttattctgccaataactcagcacaatgtagcctcaaaccactctacaccactgtgtatatgtgtgtgtttgtgcagtgatatgatttgtcaaggcattctggcgttaaaaatttgagagagatttttactggcttttggttgtaaatcatgttatttcataaagaaaaagataagatcttaggtaacgtgagttcctggcacttctgttcagggtttatctcattccctacaatttcccatctgccactcatcttcattttatctccatattttctatcctctatcctccttctctgttgtctttttactttcctacagtttcctcatgcataatcataaaagtctcaatttattattactccttttgaaaatttatccctaaagcatttataatttttttattttcatttatttaatttttttgaggcagagtttctctctgtcacccaagccggagtgcagtggcacgatcttggctcattgcaacctctgcctcccaggttcaagtgattctcctgactcagcctcctgaatagctgggagtacaggcacgtaccaccatgcctggctaatttttgtatttatagtagagatggggtttcactatgttggccaggctggtctcaacctcaggtgatccgcctgccttggtctcccaaagtgctgggattacagacatgagccgccacacctggcccatttctcatttattaagtgataattaactaatcaaatatattcatgactgtcaatcaagactcttgaacatctgaggaaacccatgttactatgctgaatccatggtatttccagcacaaaactttgacccttaacaggaggccagaaatgcaaagtcaagtaaattgtgcccctaccttctgtgaaatggcctggctggatctgagctcattggattcagcccatctagagactcagtcatgttcatgaatgtacacacccagacatttttgtgtgtagaaatgtgtgtacaggagaaggcttgagtgaatcgtaagggaaaggaaaggaggagaggttgcagatgtgagagaggagatcattattagaccaaactcgcaacagattgtctgagaaggacctgaagcacaggtggaagattagccttaggaaggaaagggagtacttttcctcttaaacagaaaaggaggagtgaaccaataaagataaggggaacttttgaggtaaatggaaacagagttgaaagtgatcatgttggatgacatctatttcttggtgatagtgagaaaaaaaaagcaaggggtgggactgagtcttgagaagaaccagaaaggattcatctaactcaaatgcatactgcattagtcaggattctacagagaaacagagccaataggatgtgcatatatagaactatttattttagggaattggctcatgtgactatggaggttgacaagtcaaaaatctacagagtgggacagcagtctggagactcagaaaaagttgatattgcagtgcacatctgaaggctgtctcctgctgaattccttcttggttgggggaagtcaatctttgttctattaaggcctttagctgatgggatgaggcccactcacattatggagaccagtctgctttacacaaaggctactgatttaaatgttaatttcatacacatacacacatacacacacacacacacacacacaaaataataataataatatcacagaaacattcagactaatgtttgacccatggcccagccaagttgatacataaaattaaccatatgacacatacgttccattagctgccaggctaactccttgttcttcaaaaatcagttgtcctgtcttctctcaaggagaccttcctgtaaacctttccctaggtgggagtttgcctttttgaactaaattgccaaactaccctgtgtttacttctgtcataaaaacatctttctttaattccccccaccaaaatctaagccactgagtatagtcatttagggagttttttcgttcacatctgtatctccaacacctaaaatgtccccaggtgcattgtaggcactcaataaaagtgatggataaatgaggtaataagttgcatttattttctatcagttttactactctctgaaagcagcgacagagtcttaattacttttttatacctatgaggtaataagttgcatttattttctatcagttttactacattgtgaactctttgaaagcagggacagagtcttaattacttttttatacctaacatctagcacaaattaagagctcagtaaatgcttactacagaaataatggaagtgtgacttaccaaatgtttactctgtatttttccttgtccctgaatacttcacttttattccaaagatttttttaaaaaccacattctgaagaatttgcacagatttgcattgctgtatctggagaaattatactagcaacaagggttataaatcacaaaatactggtggtaggatcagacatcagcagtttttaaagacctgcgggtaattccagaggtcacaaatccttgcactagatgcagttaaagtggggaagttgttgaggaagtttaaaaattttgggtacctctatgtaaggcagagctacatggggataccaggttggaagctttgagtgggctccaggggaggagtgaaggatacctaaagaggagaaagaagtactgaaaagaaagctatgaggtactttgtaagcacctctgagtatttaccatgtatcaggcacagtactaagtgctttgcattcattgccacttgtctccataatagcctttgtaaggtatatagtgttacattcttttcacagataaggacactgaggttcggttaagttcctcacatcaagccaacagaacagcaaaaaattcaagcctatattgactggctacaaagtttatgttctttctgatacatcagcagttctcaactctaactacagagcaaaagcacccaagtctgtaccccacttatgatcagttatatgaaaagttctgagtaagaggcacagtcctccatatttaactttaagtctcatcagtatttctaaaatgtttccagggctgaaaaccactatcagaaacactgtagatactcttccattttgccaactctcatactgtgtgcttacaggtgttctcacccaggaaaagagacttgactcagtttatgaatggcgcaccctaaactcagatgaaatattctgaacagactgagtgtggtggctcacccctgtaatcccatcactttgggaggctgaagcaggaggatggcttgagagtccaggagtttgagaccagcccgagcaacatagagagactccatcttgacaaacaaacaaaaaaaaagaaaatcttgaatagtcatgcactggccctgtgatttgaggtgctcttaattggtggctgctttgatgttagcaagagttttatcctgtttaatttaaattaatgaaatggattacatcatgcctagtctctaactctctgcaaagggtcctgctcagggccgttctgccattgtaagctttctagcacagctgatgctttttcaacataccccattccaaaaagtaggtactacctgggccacacacacattcaccataaaaattaaattgaataggtatcaagaaacaattaagtttcatatcagattttcttccattaattttggcaacacagcgttcatttttctttgtattataaaaacttgttgctaatgtccagggtcaccaacctcatgtgaaataaaatgcatttgtgcaaggccctgacatcatatcaaaattcagtcagttatcttaatgcataatatatatgtaaaaaatcaagagagactggggaagaaaaacacaaaaatgtgagtagaatggtaaaagttgtctaccctggctgcacattagaatctgggataaacagatttagataaacagatgctcagaacccagccctagagattctgattcaggcccagtctgactgggccaatcgttgttatccctaagtgattcaaatctgctgtttttcttacctttctcagactttccactgttgtagaaaatgtgtattaaatgagaatactctgattcatatattttctgtcaaccatgataatgatgatagttactctaattgagcttgctatgtgctaaccaattttcctaagtgttttacatatagcagctcatttagtattcaccacagctactgggtgaggccaatattattatcatctttttgcaaattaaaaaaatacatttatagagattaagtaactcactgtaaggcacagcagaggcggaatgtgagttcagggcttctagcaccccgtactcttagaaacttaagtgagtttatgaaataaaccatattatgtctccccagccttcccatcaggttcccgtttcctcttgacttttgcagagtctaatctaggtataggctcaccagttctactattaggtgcctaggaggttctcccccacttccatctaactcccacacctgctgtatttaccttgcagtggaacagaaccaagtctttgagattcaaggaaatacagctaggtggttcatctgctttgggaaagtggcctctttattcctgaaaacagtagaaagaatgtaaagcttaagaatcacacagatataagatcaaatttatgtactttcacttattaatcctgagcccagggcaagtcacttaatctctctgacatcccatttcttaatccataaaatagaaataatgatttctaaatcacatgatttaaaaggatgaagtagaataacatatagaaggttcctttgcacacagtaggtgctcagtaaacatgggttccttcccttttgctctgctcccatgtcacatatacaattaactttgcacctggcaactcctgtttagcttctatatttctgctttcctttattcctttattcctctgtgtttaaaagtctgtgctaagtagccaaagttttgtatgagaaaggtctgctgggcaaagcagaaagctacacacataacacaactttagggccctaaataaatattaggaacaaaaatgcctctcaaaactttatagcctctcctgcttccctcctctcctgccactgctaccaccaatatatccaaatgcctaaaatcccgttttaagatctctcctaaggaacttatgaagaacatgcattagtctcaataggcacctgttacctcattttgtttacacatggctacatgttgtcatactctatatgctataaccattaattgacatgagactgggtaaaggactggataaagggtaggctcttttttattcttctaattgaaaaattaaaattgtatacatttatcatgtacaacatgatgcgttgcagtatgtatatattgtggaatggctcaatcgaggtaattaacctatgcattacctcatgtaggtatcattttttgtggtgagaacacttaaaatctatttttgtgattttcaaaatatcatacattgttactaactacagccaccatgttgtacactggatcttttgaacttattcctcctgcctagctaaaattgcgtatcctttgaccaatccctacccatccagcccctaataactaaccaccattccagtctgtagtctcgagttccactcttttagattctacatataagggaaggttcttcgctcatttgtgtgtgtgtggcactgaaatgtattagaatgtgctttcacacaagcactggggcttgcccatggtgctcttcatgtttaaagtatggacattctgccagttcttctagagcagcgacaccaggaagctgacagtgaagtggatgttacatacaagctcatcatctgccatctttagggggccaatggccatggccagacatagcccccttttcatctggagcttgattgtgggctcccacctcatcaactttggccaacatattcccgttgtgtgtcagcagggaagggaacttgccagccttatttaggcctgggccaaggatccatgggatctgcttgatctgagactccaaggccaaatggtaccatacctcttggccagcctcttgttcttgtcgagtttctccagtgcctccaggtccatacgggggactccacaaccttggccttgtcacagtgctgctggcccccaggatacacacagaggagtggaagtgggttgtggacttcagcccaatgatgccccagaagtgtttgtccttcttagagtcacagtgagcaatggtctgggccacaccctgcaggaggcatcgctggggccgtccaggaacttcacacactcacatgtttttggaaaggtagagctgcagaacagcttgaagccaacagaaatacctgtttttattgttattattattattattattttaacagtctctgtcttccaggctggaatgcagtaatgatgtgatcatagctcaaggcatcttctaactcttgggctcaagtgatcctcccacctctacctcccaagtagctgggactacaggcacaagccactatgctcagctgatttttatttttattactatttttgtagacatgggttcttgctgttttgcccagatctttctatttcctggcctcaattgatcctcctgcctaagcctagaaatacctcttcaagtttcaattatctctagttactttattgttcatgagaaatgcctgtttttcttaatgtatggtagtctggttgaacaagtcataatataatgcttttactaaaatagtacaacaacgtagaaataattcttttctataggtgtccggctcctcagaggcatagctgatattgtatctgctgtgaaacatttcttctctctttctagagtctctttcctgtaaggtgaacttcttttgaagtttcattttgataaaattccatcactcgtttcttgtcaagcttttgaacttcatcttctatctttgcattttctgatacactcttgctttggaatattttaatataatgcataagcttcttttagtgaatttactgtatatttgattattttttcaagagtttgtaaggaagattttacttgatgttatacgtgattcttcaaaactcttcatctaagttgtctcttatttctgactctcttactatatccaacacctagtgaccactgtccatttcatctctaaggacagcaaacaaatctgtcatcttcaacaaacattcagtcaaatgctagatctgatgttccttctcatgtagaattttttccaaacatggtcttgaaatttcaacctcctttttttctatgtaaattaagaccactcagtcttcctttacctttgtataaaagtaattttccatttccctaaagtttggatttttcatcgaaatttttctttaatactatctatagctgtgttttacttttctgacataaatttcaagattattctggtttagctacttgggattggatggattctgatttatccttcaaatgactgtattatagcctttgtgtaacatcaaccatcatgccatcttcttctggatagttagatttttcttccccattttcccctagaaagtctattttaaccacaataaagagtaggactaatcagttcttaaatatctgtctccagacagcatttcaaacaactttatttcaagtctggccttcaaccaagacatttccagtgcttaatgacctctcttaaaatgccagagcctgtcagaaattttaagtttttcttcatctggagcagaaaacatgccatgatgttctttctccctacatttataaagcaagctttagttctgtgaaacccaatgagagctgtccatagaaccatcttttggggaaaatcctagagtcctgatcctgggctcaaacctgcaggcataatgctcacagagctgcatggagccttcaggataagccagtggtaaagctgtgtgactattgcatgtcctgtgtcacacaagtgactgccacagaactgcctctgattgagaatgtcctattggtcactgtagtcttccaggaacccagaatatcccactcagatcccaagtcagcaattgacaatcaagacaaacttgcagggagggaatcaagggtatgaacacatttttcctcatctttgtttcatcatggaacacaaataaattggtttgtgatatatttttgtttttgctttgttttgtttgtttatttatttatttattttgagatggaatctcactctgtcacccaggctggagtgcagtggtgtgatcactccaacctcctcctccctggttcaagtgattctcctggcttagccttccaattagctgagattacaggcacatgccgccatgcccggctaatttttatatttgtagtaaagatggggtttcactatgttgcccaggctggtctcgaattcccaacctcaggtgatctgcctgcctcagcctcccgaagtgctggaattgcaggcatgagcaaccatgcccagccgtaaattggtgatatttgtatgatagtcggggaaaatgaatgaggttgtttatgactcactccacctagaggctgcaagggacaaacagcccatgtcttgtcatgcgtgtgaacattctaactttgctggcggtcagcaaactgtgctctgagtctcccacattttgtatcagacttctaggctacagccttagagatacaacttgccttgaaaggtcccaaaaacttctctcccaaaacacaccccaccccagtttattgtgggtcagtaataaatagtatttgtgtaagagtgttgaaataaagggcctcaaaagggtttctgcttgcctttaaacaatgattatgcgtttgtctattctcactttaattttgttcattttagctgtatgtatttggaagccctatttttagttgtatatcttcctgatgaagtgaccctttgtcaccatgaaatgtctctctttatctctgataacatattaatactttgtcttgaagtttaacatatctaatgtgtcttacataggcacacaaatatttttatggtatatcttttaccatttttaaactttcaatcaatatgtgtttttatatttaaagcattttttatataaacagcatgtagtttggtcttggttttttattcagtctgataatggaatattgagtccatttacaaaatttatttttaattttttatttccataggtttttggggaacaggtggtattctgttacatgagtaagttctttagtagtgatttgtgagattttggtgcacccatcacctgaaccccatttgtagtcttttatccctcaccctctttccacccttccctggtgagtccccaaagtccatcgtgtcattcttatgcctttgcatcctcatagcttaggtcttacttatgagtgagaacatatgatgtttggttttctattcctgagttacttgacttagaatagtagtctctcatcccatccaggttactgcgaatgccattaattcattcctttttaaggctgagtagtattccattgtgtgtatatgtataatatatgtgtgtgtgacataccacagtttctttatccactcgttgattgatgggcatttggattggttccacatttttgcaattgtaaattgtgctgctataaacatacatgtgcaagttttttttttttttttggtataatggctttttttcctctgggtagatacccagtagtgggattgctggatcaaatggtagctgtacttttagttctttaaggaatgtccacactgttttccatagtggttgtactagtttacattcccaccagcagtgtagaagtgttccctcttcactgcatccacaccataatctactatgtgttttttttttatttttttattatggccattcttgcaggagtaaggtggtatcgcattttggttttgatttgcatttccctaatcatcagtaatgttgagcatttttacatatgtttgttggccatttgtatatcttcttttgataattgtctattcatgtccttagcctactttttgatgagattgtttgtttttttcttgttgatttgtctgagttcattgtagattctggatattagacctttgtcagatgtatacattgtgaattttttttttcccactctgtgggctgcctgcttactgttccttttgccatgcaaaagctctttagtttaattaagtcccacctacttatctttgtttttattgcatttgcttttgggtccttggtcgtgaaattcttgcctaagacaatgtctggaagggtttttttgatgttatcttctagcatttgcatagtttaagatcttacttaaggccttgatccatcttgagttgatttttatacgtggtgagagatgaggatctagtttcactcttctacatgtggcttgccaattatcccagcaccatttgttaaatagggtgtctttttcccactttatgtttttgtttgctttgtcaacgatcagttggctataagtatttgggtttatttctgggttctctattctgttccattggtctatgtgcctatttttataccactaccatgctgttttggtgaccatggcctttacatttaatgtaatgtttaccgtcattagatttaagtctaccatcttagtatttgtattctatttgtcacatctgttttttgttcctgtgttccttatttgtttgctttcctttgagctaattaaaaattttattatttctttttatctcttccattgatgttttctactacacctcaatggagtgtttttatttttcgttgttgtgtcttaagattgcacacatgcatctttattattgtttacctttaaataatattacaaaaataaccatgtaagaacctttaaaaagtataattctatttacttgctgtcctttgctttcttctggtcatgtattttatttacttataggtaacgacacaaaatgtgttactatttttgctttaaacagtcacaagtttttaaaatatgaatagataggtaggtagatgatgatagatatgtaggtaggtagacagatggtaattttttaaaaggtcttttatacttatccagatatttagtcatttatccactctaataattttcagttctccttgtagattcaggctttcagcaagaattcaccttgaaaactttccttgtctcttatagtatgtatttgctaaaaataaacactctcaacctttctcatcttatttcaccctcatgttgaaagatatatttgttgaacatagaattctagattaagagttgctttccttcaatactttgcagatattgcatcgtcttaaggcagtcaatattttagttgaaaactcagacatcatacctaaggttgttgcctgtgtgaaatgtctttttcctctggctgcttttaagatttaccctttatccttgtttttcaatagtttaatcacaaaatgcctcaacgtgttgttggtggtggtggagtttgttttgtttgtttagttgtttgtttttgaattttcttgcttgggttttacttaactttcttcatacatgggttgatatcttttaccagttttggaaattgttcacctatcatcttttcaggtatttcttctccttgattttctccccgctacttttctgaggctccaattacaaatatcttagatcattagatattttgttacagtcacaggatatctgtcccattttcttcactctttttttttctctagtgtttcagtttggatgattttattgacatgtctcaaatattacccaccctttcttctgctgggttcagtctgctgttcaactccctgaatgaatccttcatttattatacataatttttatttttatcatttctgttttgctctttttgataatgcccatatatctattgaaatttcccaatgttaatgcatgcttctcactttttcattatatctttttaacatatctatcataatttttaaacaaatctctgcctgctatatccaacatttgagccatctgtgggtctgcttctaatgtttattttttatttcatagtcacatttttcagcttcttcatgtgttttataattgtttattgtatgtcagtgggtaaaagcacagaaataaataatatttactcccataaaatggctcatccttttctctatttggctgtgtgtggggtcggggggatgcagggagactggattaatctaatatgattagatatgaatgtaagctttgctatagctttagtgtgatttgtccttggctttagatgtatttggggaagaaatagaaatttatctttaggaagactgagaatagcattgcctcagagatgtctgcgtacttaaagccatcctgccaatgtttctggaccacggaggatctctttcttctttacactccagcaccaagctttccaggtatatggatatctctcttcacttctggagaactgctactgtgcactgaatgaagacctctgcaccttgaggggatctccatcaactctcttgccctgccccagcctgtatcaactacccccaaatattcagtgatgatctgtggaaaggagttaacaggcaggcatggattctctctgtggttgtggggcctcagtattctaatctgtggtacctgtccacttgcaactgttgaaagtgtgttaaggctgggcgcggtggctcacgcctgtaatcccagcactttgggaggccaaggcaggcggatcacgaggtcaggaaattgagaccatcctggctaacacggtgaaaccctgtctctactaaaaatacaaaaaaaaaattagccgggtgtggtggcgtgcgcctgtatcccagctgctggggagactgaggcaggagaatggcgtgaacccgggaggtggagcttgcagtgagctgagatcgcaccactgcactccagcctgggtgacagagcgagattgggtctcaaaacaaaacaaaacaaaacaaaacaaaaaaacaaaacaaaaaagaaactgtgttaatacctgggctggttgtccttatccaactctgtggcaaaggtgctccacctgttgctgtgtcctcaggagtgacaacagctgtagaattcttctatccaagaaaaggttaacctcattttgaaaattaatttctttggatttctttgtgtcttcagctctctgatgtgtttttttaaaatatgattttgagactttttgttgttaaggacagataaatttgatagagaagagaaagtgtggaaaggcacacagttacttttagaacactgcactgtaaatatgggggcaatatggcagtcaggcatgcccctagttagttttttttttttttttttgtgacggagtcttgctctgtcaccaggctggcgtgcagtggcatgatctcggctcactgcaccctccacctcctggcttcaagcgatgattctcctgcctcagccacccaagtagctgggactacaggtgcacaccaccatgccccgctaatttttgtaattttaatagagacagggtttcaccatgttggccaggatggtcttgatttcttgacctcgtgatccgcccacctcggcctcccaaagtgctgggattataggcatgagccaccatgcccggccctgcccctattattttgtaggatctgaggcacaaatacaaagagggacatacaaacaatatgtctaaatatttaaaagctataacgcaaacttataaattattaaaccaaatatgttttcctaccttaatatgtgtatcttcataatgatttttaaggccaagttcaaattgaaattctcctaaatgtggctgctcagagagagagagcacccacacactctgccttctcttcccatccctagttctgtcctgtatctgaaagggccttgcactaaggtgtgtgtgaacaccttagctcattcttccaagattgactgctaccccctacatcacatccccacaaacaaccactcttcaactacccttaagtctttaaggtgtgtatactagaggcaggttcaccttgggaagacagacctggatgcagtctcaacgccttttgagcgggaaactccagagtctcacatgctcagagcttggttagaagagggacactggtatttcttctaactcatagctttttggggatgacatagaaaacagaggaagactacagcagcaaggccctctaacgagtgaggcccagggcagcccgtccccacaacctcccaacccccttgactgtgtcttagggcagtactgatggcaacagaatattttggagctaggtgagcagaccacatagagagggtaaatgtggcaagaaagtaaaggatgccaagaataacctgtgtttctctcctcagggccaactcttacagttggataaataattgaatgtatatatctctctaagtgtaaaaggtagcttcaatgttgatgggatactcttgaagaaatagggtacaatatttctagaagactgatttctccagactcacatattataaggagccaaaactagtatgtaaaatgattcaagagaaaccttacctcaaataacaaaatatacaaatgtggtccatatacgaatcatcatgacaacttgaaagggaaattagttcactattagattttacattgtcttctaacaaaaagcaaatataaaatgactgctaagtaattttacttgtcttgactaggttatgacttaattaatagtttaggcagaagttcaattacaaaagaattgtattttcactttttaagagagatagttttgcctaggaaggaattatttataattatatatgttcagatatttaattccacagataaatgatggaagtcttaatatagggaacaacatgtaatgtcagaataaaaggatctccttagtctaattgaatgttgtacttcactatgtctgtctgatagaaataattacataccttgctgggatttagctttcattttagcattgggtgtacttgtggagaaaaatgaaatatcatgttgcccccgttggcccccacccccaaacacacaactgctgaatttggtgggatcattttggagagatgtttgagaatttgttccctttataaggcagtgctaaagagtgaaggcagagaattacaattaaaatggtggatgggatacttgcttaagtctaccctctccctcctaaaggaactgctataatgacaactaaaaaaagaatgaaaaagaaactcactttctaaagaaaacaggagagaacacaacagcagagagctattgactttttttttttttaatggaaatggaatgaatgagtggtatgtgtttttagctaaacagagatgtagaaacccaggtgtctgcagaggagatgccaaaaagaaacaaatgggaactccattgagaaccctcaaaagactcaaagactggaggcaaaaaggattgctgacgctaagggacagacttgaggctgaaaacaggactgtttgaaattcttaacaagaacacctggactcccaaattccctcctcaactttttgcagcctgacagctacccctctctcaccctgtaagagagatggcggggtattattctctggagtaacttaactatagaggctacaagcttagcattattggggacagtggcagatgaggatgagatacgatatagaaatctgggagacttaagtagaaatctgcgtgccgaatagtaacaaactctactttcccttcaagccttcttaggtggctcagctcccaggacactggcaaccaggctgtacttcccaggcagaacattggagggggcaccttcctagagggtctgactacccaagggggaagaaatcttgctaatcttgagggcatttcggtgaaacaactcagctttgtctaatggttttatggtaatgtcctggagcccataatacattgcttgagcagacagctaaagaataccacatatggaggaaagtctccaacaaagagaccaaagcaaactaaccaacaagaaatggaaggaaacaaagactctggagagaacagaaagctgttacatgtagctttaaaaagctgaaatgtgtattatagatagtaaaaaagaaattgtgttcatgaaactaaacatggtgctatgaaaaaggagaaattagagaaaatttaattcttaaaaattaaaaatgttaggcgaaataatataatcaacagaacaaagatgagagactcttctagaggtagatgacaaaaagaagataaatagaaaagataataacgttagagtttgagtctcaaggttagtttcagaataaaagaacagaagaaatagaggtcagaaattgctaaaagtacataacaaaatttcctggaactgaataaatgagtaaaagtccctgaatttcaaatataatcaactgggggaactcatgcatatcgcaccaaatgtgctgttatgagacaatagaacaccagggataaagaagaaatcataagtgttttcagagagaagaaggagggagggaagaggagaaggaagaaatgaacaagcaaggaaaggaacaaagaaagatagaaagtcaaataaaatgaatcgggaaacaaaataacttcttaataacactggaagctaaaagacagtaaagaaatcccttgaaatttctgaggaaaaggtatttctaaacaatgaattctgtgtaaagtaaaagtaacaattaatgtaataagagaataaagaaatattttcaaacatttaagttctccaaaaatgagtttgtcccaaacatctttctcaggaagctactgcatgctcgcccacccacccatgagggagtccatcgagaaagaaaaacaaagaattcagggaacgggacccaaactacagagaggcaaagagcagtcctaggatgacagctcagtagcaagattgccacaaaaagcatgagggtactaaaaaacaacaacaacaacacaactaacatatttgactgtattaagaggaatgttgcatttctattggagagtttgaggaaatataagatgggcagatgaaaaattaagaaaacaaaaatatgatgcaactaatatcaggaaaaagaagaaaaaaatgtgtaaaagaaatgtaatcatacattcccatgtggcttacatgtggataatatatacaagttaaaataatgtaaaccctaattagtagtttatctaagattgttgtgtagttaaattgggaagattaagctaagggaagcatgtgtgtgctcatgtgtgtggtagggaggtaggtgacagggaggcaggaaagaagaaagagagagagatagggagagaggacacacatgctggaggaagtattatatataatatcctacatagaatccttatctcccatagtaggaggccaaaaggtaatatcaacatttgaaaatcaaaaagtaggtatctgagtatcatgtgggaatatggaatcatcatcataatgaacagttagatgaagatggttgcctctgggcttcaaaggtatagagaggtgggtgggacattcttttaagctctacagttttgtgtagtttttaagaatatgtgcatgaatttttattaatatgaaaaagctaattgtttgtaaagaacatgaatgccatgaatactagagctttgtggttttcaagcagtgcttcccaggttcatggagggctcctggagtccccacagggactgcctcatggaggagggggctgaagaaatggggccacaggctttacacctgttactgctaaaggagctatgctttgtcattgttatgtttcagtgaactatttcctttgaagaaaaggttccatagaaaacaacagcaagtttgaaaaacactgatagtagtttgcttatttggagaaaaactgttcccaaattgctttggttcaaatatgatttgtccccaccaaaactcatgttgaggcttggttcccaatgtggtggtgttgggacgtggtgcctccaagggtagattattaggtcattaagagggagtaatgccttttttatgggagtgaagtcctagttactttgaggttgttacaaagtaaaactgcctgtcttgtcgggttttttttgtttttgtttttttttgcatgggccaggctcccctctcaccttcccaccctgttatgaagcagcatgagttcctcaccagatgcagccacccgtcttggacttcccagcctccataacacaaatgaatatgctgactctaactatcagactccatccagtttggctatcacctgtcattttctgttattacacaaaacagaattgtcgtatttctaaccctggatagatctttaaaagaacttgaattagaaccagttttcacatggatttcaaatatggattagatatttgattatgaaaatttgtatattttcattttgctccaaaaccaaattttaccctcacttcttaagcagtatcacatacagtatatgctggcagagttcaaataagtaatccaatagaggtggtcctctgtccctgggatgaagttggacattctggtttcactgagtgatggacatatttatgattgtgctccaattcgagttgactttggttccacaaaggaaaaatacccccaccccagggtatagaaaaaatacaacaaaatctttagttttttttttttggagacaaggtctttctctgtcacccaggcctggagtgcagtggtgtgatcacagctcactgcagtttcaaagtcctgggctcaagcaatccttccatctcagcccccctacttgggagggtccgagctacttgctgggaccacaggtaaatgccaccatgcctggctaattttttttttttgtagagatggggtctcactatattgcactggctaaaaatctttatttcttttatactggagataacccatatgttttgcaagcatgttatattggttgttactggggctttataaccacttaaagacaaaacatccctaacttggtgagtttaatttaggagaaaatcaaatgctaaaacagacactcctgaaaaaatatgtttccttagtcagtctctctctttcattttctttgttctcctctgcactccacatagtgtgaaatgctgtgcctgttctttgtgcttccattatttctcaatataaaataattaaaatctgctttgaaaaataactatgttatctaatacaaatttatataaaatatatttgatataaagtatatatttacacattttatgtgttctgaacttaaatgcatatctcatttgaagttgacaacaactctttgaagtattattattctcattgtagggatgaagaaatagtggcccttggtggtggacctctcccaggttgtgtagctaacaagggataaagaccaaatgaaatctttattttcagagttttggtctacttgggccaaacactttctaattattaaaaaggctaatctttatcacaagcatacatataactttaaaacttccagatcacatatataggatgaccaactctggtttgtctgagactttcctagtttcagcgctgaaaatcctgtatcccaggaaatccctcgggcctagacaaaacagaatggctggccactttacattcagcagtcagtccaagagactgtaatagatacccatcatgggaactgagagagacacagggaaggaaatgcaagtagaagaaaatgatccagaaagtttgtatagacgagtaaaactgatttcttaccctatcaaagtaaaccagttgtaacaaccaccacaacccaacaattggcaccaacttttcaaaaatgtttatgtaaccaaatatatctatagacttaagattcatgactatatcatgaagtgtcccaaagacccacaaacttggtactaccatatcttgaaaagtaaaacctctcttaagtgttttatgagaagaaatcacaaaacactcagacagatatcctagggccaaataccctaaacctctttttgagatcctgatctcctcaacgtctgcctcattgaagtagctgctccccaacccagcttacagtctgcccccaaccccctacctatagtgtgccagattctgtttcccgcctgctcttctctcgttctcaccatcttaagagtgttctttttcttggatatttccctccttgccctttcttaaaaccaacataagtcccattaatcttcttctatgtctctttagacattaaagagcatcttcatccccttatgctcctctcccctataagctcctgcaacaaagatccagagaactagagatgcctcttcaaagatgaggaggagggtgaggaatgaggaaatgctgcaattattcctacttgaatattatagtgtgtgtgtgtgtgtgtgtgtagattatgaaggtaaaataatgtcattacagaaaatttacaaaaagtgaattaagatttttcataaaggatccacaatcattttggtaggaattttttagcctttatcttcctctctggtgttctaatatagttgaaatcatggtgcacatacacatgcaagctgatttttaacctaactaagcattagcctatgccattctgttttttataaaaactatcattgttccccattatttgctatcaaatatacgaattatattttatattaatactatactaattatatttataatactatactaattatatgtataatactaagtatattttgtaattagtatatttgtacatacagccctttgcatgattacagttattttcatgtgacaggcatatataacaggtgtccatttcaaccaatttttaagtttattggcatttaataggattatatgtagcatgctgctgtggttttctttgtttttaaaatgtatgtttgtaaggtatacatgatgttttgatatacttattttgatatatatagtgaggtgattactacagttaaacaaattaatattccgttgtttcctatagttactttcatgtgtgtgtatgagcacgtttgtgtgtgttaagagtacctaataatccacttcaggaggccgaggcgggtggatcatgaggtcaggggatcgagaccatcctggctaacataataaaaccccgtctctactaaaaaatacaaaaaattagctgggcgtggtggtgggcacctgtagtcccagctacttgggaggctgaggcaggagaatggcatgaacccacaaggcagagcttgcagtgagccgagattgtgccactgtactccagcctgagcaacagatccagactctgtctcaaaacaaaacaaaacgaaaaaaaagtacctcataatctacccccttggcaaattaccggtatacaatacaatattattaactgtagtctttgttctatatgctaaatctctacgcttaactatataactctctttttgtaccttttgatctatatcttcccatttctgcctgctcctggtaactattgctttactctatttctatatatttgattttttaaaagattccacatataagtgagatcatgcaggatttgtctttctgtgcctggcttatttcacttggcataatgtcctctaagtttatccatgttatggcaaatggcaggatctcttttttgggggctggataagattctgcatatgtatatcacaatttctgtattcattcctctgtcattgaacactttggttgttcccacatcttggttattgtgaataatgctgcaatgagcatggaagtacagatacctttaggagttgatgtatttcctttgggtatatacccataaaagagattgctgggtatatttttaagttgattggcatttaataagataataaatagcatgctgctgctttgaatcttccatatttgtctgtagagcccctgttttctaatgcagtttatgtaaagtttttctactttttcttgggcagtatctattttaattacttttaaatgacttggatgtattaatgttttctcttttaacaaaaatcacaattataccccaaattatttttgcataaaaagtatatgcttttaaaaataaatgatatgacaaaaatattagctataaaactatcaccatgagaatactgcctgtcctaatcccttaaggatatttattagggaggaaaaaaataacagaggtcgtttgcttttcagtgaccaggttcttcatacacatggatgtctcacagatcagctaaggcctgtgtttgaacaccttggtcacccctgcaaggagccatgctccagcatttgccatccacagaacggtgctaatagagtctatttctggagaatggaggagagattaacttcttgttcatgataaatcaagggtatctgatttgcctgttacatgcccagttttctttggaagcaagccctagaagctgtttttctgatctaatcctaattctcacattagtgcttatgaaagaggaaaacaacatttactcacgataaagactgagttctagccattataaatcttatcaattgccttgtgaaggttagggggaaaaagaaggaaaaaaatgattgtactcactcacacttgcatctggactaatgttcctattcccgttgttgagtgttctgagatttctaagactggcacaaatggaaatagcagcagagataaagttgggaaccttaggagatatctgactgatgaatgttgcactataaagagtggccagtaacagttcgataaggaaaattattatagtttactcattactgggaaatattagcaaacctaaacatttcatttttttttctatttttcttataagccaccaagattggtagaagtgctcttaacaaatatttgccacgttaatatttagaatcacacacatgcatacatacatacataagatgtataatgattttttggcttcagtaaaggtacttggtacataatatacattctatataatattttggttaattgcctgaaaagaagcgtatttttcccaagacaaatacaaaacatatttatctaagatgtaggccaacaaataaccattttccataggttaagatatacacttgcacatgagcagttcttcagtttcaacaaccattttttgagtatcagttatgtgctagtgctcactctgagatacaacagaggtgaacagagcagctgaatgtgaaccattgatggccgcacgtctgtccacccttcttagttcatttgtgttttggcaccatccattagccttgggaaggcgtgtttttgacagagggataaagaaacacagtgacagaaatgtgtactttctggactattgctttatttcttcccatttatttgtgaagtcattagaatgcccgtctatcagcattacatagagcctgcagtttccctaagaaactgtcaactttggggacaaaaataaggaaagtttcttactcctctgtttctatcttttgatctttttaaaagacatctagtaacaaagttaggctaaaaggctaaaagctggtaagccaccaatctatatggggcatcaaaatatcactaaaataggctagtaatatgatgccaattaatcaagttttccctcatggtttcttaagatggtattgccctagatatgataaaatataacccaaaatagaagattcaaaaccatcaacaaacaaaaacagaaagcttgctttctggcatctacgttttgccgttgaatatttttgagatgtccacataagttccaaggagcagctgcagccacaccaccaccctgagcccagccagctgacagttgcctagagttggcagccacagctagctgaaatttggaaacccccaaatgcttagggttgagatgtgtccaattaccaaaattataaagccttcattaggcttttgaagaagttgtgtggtctgtagaattgcatgttttgaacataaagaggttagttattttcagaggcaggagatcttttggccccagtgaccactaaatattaataaatattaaacacaagttaattaatggtgatttaaagggaccccatgttgttaattcatgtcagtctctatttgatgaaatgtatctttttctttgtttccattcactcaatttctcttcttttagatatacacttgtataacacacacacacacacacacacacacacacacacacacattttgttttccagtccgcactcaagttttgcaagacagtcctgaaaaagaagtttcagtggggagatagaagtgttttttgcactctctcctgtttggttgaaatcagtttttccacaattcttacaacaagtttttctctaacagaaaatgcacagattgaacagttgccctccaaaacactggcaagcaggcggcatgatgatttcctcttctaacggatcccaactcatttactaagactcattcaacttttaacaaaaaatttgtcatttctctttcttactacagccattgccatcctctgtaaaattacatgtggacattaaaacttaaatgctgtcctacaatgaaaatatttttaatgccctcctcaaagttaagaaaaaaaatttactatttgtattttgtgtacctgggaagttattcatgctgagtaacagtacaaaacttgagctgccttgctttctgcttccaggaatgccaatcagagaacattctttttcaggcagccaagtttggaagtcagttggtttctggcagtgagtagggggaggggatggcaggggaagcatagtgagtcctcgggctgatgttcagcttccaagtgtttccgtaatatccgtcaatgaaagcatctccttttacccacgtagagacaggtaaaaagacagctgagtaaatcagcattagatgtaacagcggaagctcagtcagagggagcggggagggagggcgcatgaaagcctgccattggcgagcttaccaaaggcatctgccagtgggacttcaatggaatgtgaaaccaaatcattttcaagttaaagatagacacagtacacaccaggatctagaggctggatttcatactcatagctctccctagaatttcagagagttctgttatgatctctgttgtaattaccaatttggttcaagtttgttctttaaatgaatatgcttagaattcacatatgttctggatgtactggaattaaaaggatttaagagatcatggtgtgcatgttctagggtaagtgaaaagattggtttttaaagtgcatcgcttttctgggatgcttaatattgaatttttctttttatctgtgtgaatgaaaaggtcaagatttttcagtgttgtagcttgcttacctttcttaagatacttggtattttacattttgtgcagcagaaagaggatttttgcttagttttgaaatttacattgcaagtctgtaacttcagttttgactttatccttatttgtttttccctctattcttctcttaagcactatgagtttactgagttacaatctcaatagttttatgtcacaacacagactgaatgctactgtgtctattatgccattggatgaaactatattattgtgagatggagttcagtttcccctgcatgttactaagtcacttcccaatttgagaaacaaaaaaaggaaaaaggagaggaaaggtgctctaaaggtggcttaaactgcgtaaggagcctttagaagatattctactttttaaaaagcaactgagaaaaaaaataggcacttttcaggaagagaagaattaatagaagttattttttagtgttatctcattaattccaagcaggttcccctccttcaggaaaaaaaaaaaagctgaaatttgctaagtggatggaggcgttctgattttacagagcttgagagaagacaagggagaggaagagttgtctgattttgctattgtcgcactgttttaggacttcaaacttcttcttgaaaagaatgacaaactttagttctcttcatgttttgcccatgtataggttttgtttcttgttttgtcaaatgacctctccctctgctcttagagacagctcttccaaacttgcacagcattccttctgaataaatactgtccataatagtcacagagtacatggtgtgaattggaaattctactttatatggggaaaataaatctgctgacgctgttattacagagtgcacagatgaacagttgttaaatgtaactggccagttttttgtcttgtcaaatagaccagattctaatgaactaagttggctaaactaggtacaaacaatgaagggcttcttatggatttttcattcaactttgatgagaataagtaatacactgtgtcactcttctaaaatgaaaaatgggcattatattgataaagtcatttgattttacaactactgagtaatctagtgaggccaagcaaatgtgaagttggcagagctcagttctgatgcccctttcctcctttctctgtccaattttccctccctctcagtcctccttatccctccagacccctgatgaatatgactactcagcgcccccgttttcttgtcaagcaagacctatactcaagaaagaatctgacttaagagagttttaaagtcaatgtactaagtcccccagtaatatttgcttttcagtgtaaatatctgaccttgtgacagtttagacaatttgttaaatgatagttaaccttgggtaatacttataattaacccctttaggttgcaagcaattgcaattaattttcatttccccataatcatgtgttaactttgtaaattttctgtggtcatactgggtgccttgtgacattgtattaccagttgtgtactgaatggttgacaataagaatgaacctggcagaaatcacaggtgcttccaagaagtttgtgaatgcatgcacctgggtgctcaccatacactcaggtacacacagtaacacatgtaggcataccttttatgtaactaatatgttttttattgaattataaaataaatgaaaatatgttaggcttaccagtgtgggatttgggttttttttcagtgtgtcaaaaaaaaacacaaaaaagaacacaaaatgtaaaattctaaaatgaagaatgttaaactatgtggccaaatagtgttgacagaaaaagagacaaatatttctctgctactattatatcacttttatagtttctaattcttgtataaaattgtcaatcttagcttttattcttttgaacatcctaagtgtagttttataatctatttctgataattatagtatctcaagtgttactggatttgtttctattattactcttcctgctagttctcattcatggtgtcttaatttcttggttgcttggatatctttgactctatgctggaaatgtatttttaaaattacattataattaaagatcgtaagagtaagttgagatctaagtgataatgttttcctccagagaagactttggtttgcttctgccaggcacctgggggcgatatcagaccagaatcatcttagacaaagtacaactcctgatgttccctgaatcacctctgtgacaagaaggctgcaaatcagtgagaggaatggtaggttcactcctcccctaaaggagagtatgacctttcatgacaccagcataaagctgggttagttaattaaagccccacctgagggccaaggactttgacttttctatgaagcacagaaagctacttgaagtgtaaagctagattctcagatcttttttcctgatagtcatatgcccaagggcttttaaaagtgacctcacctctctgatttctgatcttctcctaagttttcatatgccaaatcttcaccatcttactaaaggctctttgctgttttttgtttggttggttggttttttgttttgttttgttttgttttattctgttgcccaggctagagtgcagtgacatgacgcgattgatctccactcactgcaacctctgcctcttgggttcaagtgattctcgtaccttggcctcccaagtagctgggattacaggcacatgccaccatgcttggttaatttttgtatttttagtagagtcgggttttcaacatgttggccaggctcatctcgaactcctggcctcaagtgatccacctgcctcagcttcccaaagtgctgggattacaggcatgagctaccatgcccagcctctttactgtttttatatctcaaatatctttattacatcaggtaatacatacaaatatcttattacatcgggtatatcagtccagattctctcattactgttaccagaaatggaaattcatcctactgctattatagttgtttctttttacactcttcgttctagagaacatatcaaagtttgctgatatcattaatgatttcagataacttttctgattttattttttagttgtgacctgatatattcaaactttttggagaaaattgcatatgcatgctgattgaaagattcatgttttctgactttatttgagctgtcaacaccacctaacagttcttttttttaattatacgcaagttgtgggatacatgtgcagaacgtgcaggtttgttacatagggatacatgtgccatggtggtttgctgcacccgtcaacccgtcatctacatcacgtatttctcctaatgctatccctcccctagcccccaattccctgacaggccccagtgtgtgatgttcccctccctgtgcccatatattctcattgttcaactcccacttatgaatgagaacgtgtggtgttcggttttctgttcctgtgttagtttgctgggaatgatggtttccagcttcatccatgtccctgcaaaggacatgaacacattcttttttatggctgtgcagtattatttgtccctagctggcccctttccttggcaatttctttaacctctaatccatcccacaagcatccttcactctcagaagttgattttgactctttctggtttctcttggcctatatccagtactaagacatttaaaaaatcttcttaaatcccgtgctttccattctctctgcagttgctctacttcaggtcttcatcatttaacttggctattatatggtcttccagttgttctcctgtctctaagctccatccacaccctcaccctgccactacatacacacttgctgaaaccaacatacccatcttctaaaaactatagacttcaattaattgctcccctacttaaaaatctttagtgattcatgactcccttcaaaataaagcttagtgtccttagtatgtcttaaaaggtccatcacaaagcctcgatctgtttctcaaacattgactccactgcttcactggttatcaccaacacttcaatcacatacaatggctgcctccacaatatgccgtatactattttagctctgtgctagtctacctttccccaccgccccccgcccccccagaatgcctattgcttctctcctttgtgggaaaaccccacttttcctttagggttgacctcataagtcaccttcactgtactttctgtactttctttttaagtgtatagctcacccactgttctgggagtccctaatgctgtggcttgtgtcttactcgcttttttattctcagtcactgacacacaggaaccactcaaaaaaatgtttaagaaatgaacagatgactattcagaagaagtttgtttctgaggaatttgttttgttaatatattcttttccattctaaacatcattttttcttttgaccttagactctttgtctagaataatgatcattagtaatcctgtatgtcaagtggagtcagtaaaaacatgtttatttggctgttgtcactgtcttggggaaagggaattctctattttctttctttcttttttttttttttaccaaatgtgatgtataacttgattgtgacaacaagagagtagaaatttaagtatggtgagtcagctgtttattatcagagagattcataatcaaaagagtcatagagtgggaaaactgacatatttcaacaaatctagtccagaatgttaaatagcacaatgggaaaatgtcaatgaggcacaactaaatgaaaattatctcattgcatacaacctcaatttcaaccattagaaaacactgggttgttttcaaatcacagtgtggtgctacaaagaaagcagttgagtgtttatgtaatacaatattgtgaaagcttgtggaaaacttttcttaaaatttttaaggccttggccaggcgcattggttcacgcctgtaattgagcactttgggaggccgagacgggtggatcacgaggtcaggagattgagaccatcctggctaacacggtgaaaccccatctctactaaaaatacaaaaaaaaattagccaggtgtggtggtgggcacctgtagtcccagctacttgggaggctgaggcaggagaatggcatgaacctgggaggtggagcttgcagtgagccgagatcgcgccactgcactccagtctgggtgacagagcgagactccatctcaaaaaaaaaatttaaggccttgaagtgcaatttgaatatcatctttctaaaagcctatgctaagcaaagaaaaactgtatttgtttattaaacattgaatatagttgatgggaaccagaggaagaggaaatataacttattaattccaaggatgtttaattaattttatactctttggaccacttataaactttttacacatttattgtgaggctttgatacgccaacttctgagatttagataaataagaaacttggcttatattatttctcatacaggacactcctaccttcacaaagagaaaagccccagtatgggtggggcttcagaatgtatcttcagaaaatgtatcttcagaaaacatctttgaatttaatgaaatgttcaaactcagtgtttgagatcccagaattcttcatcgcaaaatatgaaaatatgatattggcctttcttttttgcctcatctataaaagaactctaaactagctcttgaataatggctgatttctaatcataacttccaaacagctgaactcatttttctcattaattcaataatttgaactcctaccttttgttctaactgtgtagacaatgaaattacttattcacccccttcaccggacactggtactgaaggatatcatgttaaaacaatgaatttaattaacaatttttttcttttttgttgttgaaaagggaaaacaaaaccctcaaacctgaaaaattccatatcccttcattttactttttcttattacagaagcaatgtaggaaaatcatgactttacctgtttttggttgtcgttgttttgttttcttgttgtttcttttttgagacaaagtcttgctctgtcgcccaggctagagtacagctgtcagctcactgcagcctctacctcctgggttcaagcaattctcctgccgcagcctcccaagtagctgggattacaggcacccgccaccacgcctagctaattttttgtatttttagtagagacaggctttcatcatgttggccaggctgattcgaactcctgacctcaagcgatctgcttgcctcagccttccaaagtgctgggattacaggtgtgagccaccgtgtccagccaacaaatttctttatgtatctttcattgatattttaaatgtatttgtcttaatctccacacatatttaaaaagtcattttgcctttctcaacaactagtattttcttctcagaaagctaagttagaggatagtcttgagattcttaaaaaatctcttgtttaggagatacttatgtaacagaagagcttaaagagagctgaataaattctgaaaaaaagttaagtcaaatgtgtattttttattacatatttaattaaatcttaatataaaatagaaacacatttatttgcataaataaaactggacttggcatttttgcaaaataaaaatgatgtaaagatgactcagacactctgaatcatgaaagttttgtaaacctctaagtattttaaaaagagcaatagagttactttaattatttttctttttaagtctcagtttattttttgtactcattcctatatagtgtgatagttcacacatttatagatgctgaaacaatgaattcactgaattaatcacagttcaggaatacagatgccttaattagttttttacaagatataattttgaatgaaatttatcttccaatgcatatgaacttccaggtcttagattgttcatttctacatatttgaagaatcatgtttactaaccaaaagatatttaacacctcagataaatgtagcaattcttcccagatgcatccaatgtttgaagttattttgtaggtaagagacatttattttacatatgataaaactaagatgtagacatatgaagtgttccagatatactatgggtggtttcctcaggtaacaaacaactctcaatttcagtgacatatagaaaccaggtttccttctcacttatacaatttagccaccacagattagctgaaggttcttctctacacagctgttttcacctggaaatgacccattttccttatactcacattcccttagccaaagcatgccatgtggccacacctaacttcagttggatgggaagtataatatgatcctaccattggcctagaacaggtgagccccagtactggggcttagcccaggagggtttttggctttgcctagggcaggaaagaattcaagggcaagccagtggtgttagacagcaacttttactgaagtggcagtgtacagcagcagcagaggtactgctccttgcagagcagggctaccccatagagtgtccagagtagcagctgagaggcagttttgtggtcatatttatatctttaattataagcaaattaaggggtgatttatgcagaaatttttaggagaaaggtaacttctaggtcactggtcattgctatggaaaggggttgtaacttttgggtgttgccatagcaatggggaactgacatggcatactgctaagcatgtcttatggaaagctgtttccatactggccctgttttagctagtcctcaactccttccagtgtctgagcccagcgtctggagtcaagtccctcctcctacctcaccatgtgcttagaaagagaaaggactggaatatttatgtagagctctgaggaatttctacactattggataataggcagcctaaaactcccttagtaacacagatttagacttaaagtcatatatatctgtgaacaggtccatacttggtaaatgtacgccacctgcgatctgatactaatgtctattgcctgtttacatcttttggctcttatctccactgagacttttcagctgtctaaatctttaccatttccatgtctgtgaccttttctgtccagcttctccaccactatggaattctaggattttacctatccttacacttaccactcagggagtcctgcccataaacagttttgggaagtgtaaggagactccgttggggcaattcctacagaatgcagaaagtaaatgtgaaatcttaatgctttctcctctctaggaactgctcatatgtagtacagaaatggagaaaaaggaaattgaatacaattctaatcctcagcccccactttaatcagtagacagagtaaaaggcctaggctcagggaatatggcacagaggaatggtgatgtatattatatattagaaatacatagtctcgaatagcatttatattattggtactctaccctttgcttagcatttagttttaagcactaactataatcgataaaactcaggaattcaaagattgagacacttaagagttgaaaatttttaagccaatattttaaggtcctttgaattgtcatttaaatcagcaaatccaatttgtgtccttggaagccaataattttaggaaatattatgtgtgtattgtggggagggctgggataagaatcttggatcaaatgaatttggaacatgctgtataccgtatccctttcttggagatttaggtaaacatttgcattaagaatgcataaaagttctacactaaagggatatgtttgactttctttaacccagtgttttccagtgtaatttgactatggaactttataattatagatagatacatagatagatagagatatatcacatttcaacaccacaaaacacactttggtaattctggttgcaagaacctctaaggctgagtggtgcggtggctcatgtctgtaatcccagcacatgggaggatcatcaggccaggagttcaagaccagcctgggaaatgtagtgagagcctgtctctacaaaaaaaaacaaacaaacaaacaaaaaaagaggcccggcgtggtggctcatacctgtaatcccagcactttgggaggccgccggatcaggagaccaggagttcgagaacagcctggccacatagtgaaaccccgtctctactaaaaataaaaaaatcagccgggcgtggtggcaggcacctgtaatgctagctactgaggagactgaggcaggagaatcgcctgaaccggtgaggcagaggttgcagtgaaccgagatcacgccattgtactccagcccgggcgacagtgtgagactccctctcaaaaaaaaaatacaaaataaaaaataaatttaatttaatttaattttaaaaaagaaagaaagaaagaaatttagctgagcgtggtggtgtgtgcctgtagttccaatcaggagactgaggaagaaggaacacctgagcccaggagtttgaggcagtagtgtttgtgccactgctccccagcctgggcagcagagtgagaccctgtctctaaaagaaaaggaaaggaaaggaaaaaaaaatcccatttaaaaaataaaaataaaataaatacctctagtacattgtattaataattaaaagtgcaataatattgcagctcatgtaatacttttatataaagctaagaattttaaaggacttttataagtatccttagtatttggcactttattttcattctctttttttttagcagtttttattcacttaaaatctacatgtaaaatttaccatctttaccatttttaagtgtagagttcaatggtaataaatacatttgtattcttttttttcacctttttcggttttcattgtcttgttaaatggcattgattttcaacaccaacagaaatcaaactttaaattgacagagcttgcaataatatttgtttaatactgttgaggaatattatctttgatacaccacaggtaaggagattggttgtgttcttcagaatgcagaactctaaagtgatttgctccattttacctatttcattcaaaaatctaaaactgttatttcattttagaatatgatcacacatcgttaaatttattagacttattatttctttatgaagaccttgtgaagagaaaggtcatcttcaacttcaacatcttcaacttctttttcttggtagtttttcttggtagtttcctttaagttcagaagttttaaagcttaaaaagaaaaaaattattgagtttcaaaaaaaagctctacgctctactaaagttatcatgtatgggaatttttctgtgcaagaagaaaagcagtagactaacaaaaacaaaatgtccacgttcctaaatatgtgttatagttgtgaggtgttatgaccatttaaaatgaagcaattgttccgtgaactgttatactaccagcaactccattcaaagaaaatcctagatataaggttcacccataaatattaaggtggcttaggcgtgaccgggtgtgtgtcctttcatcacttgtccactctgagaagataatcctgcttttcattcattagcaatttcagttcctctcccatcatttcaaaataagcgataaatcaatactttaaaaaaaatttgggaaatataacttctttctgtaccatagaaagagaaattattcagtcaaaactgtgggtagcataaattcttagcacacattttttttcctttaattaattttggcttatatttattcatagggccataacaagattcagaggctataatgatgtcagcaactcctctaaaattttatagcaagaggatctgaagatctctgttcagcattgcagggctgctcctctgtaactctttgactagccccacagcagaactccatttcttgtttgtcaaattatgaagttaattgtattcatattctgaaactgcctagcacctagaacatttggaatgctgaaaaatatcttatgtagctgtttgccagacaccagaacataaatctaacttacttagatttacagtactaccgtttctcctttaaaaaggacatgagggaaatgtttaacttaatgaggcagaggatcctggtgtgcaagttacattacatttttcattgcacaagagtaaattattgctccagtttcctatatggtaccccagtggcctcaaagacacaatgtagcttcccgaaatgccaacttttgtcttaggccataacttattctcagagagtatgctttctgagaattacccataacatttcttacaataggctgaatttcttgaaggtcattcatatataccaacttaactggatttgtcttttgttttttttaacttagaaacatccaagtgataagtctgcatacattattttacaaaatggaaaaacaatgggcattttctttgtctcaaacatttagaaaaccagcaaaaaaaaaaaaatctgggtaagaaattaaattatagggcatacaattttttcttggaattttcccactgttactgcaaactttttaaaataaataatcatgggtcttttggaggtggtctttgagggtttagaactataataattaaatatattgttctatatttgtaaaaaaacaaaaacttattttgaataccaaatgtatggacccacatgtccaaatgtgtgtttgagctttttaaacaagctttgctttctaataaggtaatataagaatgtaattaaaacaaaacaaagtccctccaccaatcagtgttgcaacatttgggtaaattttagagcttgacaattttcaaagcagagacattactccaggctttctgccaaaccattactggtaatctgatgacaagggatgaagcaaatgaaagtgctgctgcctggcttagttagatatgcattttctagaagagaagccaacagatttcttatgcaaaccatcaaaattgcaactcaggcacacacacacacacacacacacacacacacacacacacagtgcttttacaagtctaggaatatacacattaaaacacaactccatgcttaagggcaatgcagaagtagcagacacagctagggttgactggatcctttctttaccttgagtggttttaataaatagcaacatttctctcaatggctgcagtacaaataattaaattacttatatctggacaggatttagcattgccttcacatggttaaattccaactactacccaaaatctctcattgataagtgggtgatttgggctgctattgtctgtggtttatttaaatgatttaaataaacatctattctcctatagtgttaaaaaacaatttatgtactattaatgaaaaaaatccacttcagttagtaactatgaatgaccttcaagatagggatataagaaagtaatcaaatcagggatgttttataaaaggaagactttggagtttaataagttctgtggaggggaaaaatactgagtaaataactgggtatttgcatgcattattttgacaacgggagggctctattttttttacctatttctttagaaatctacttgatatagctgcaacttcagtatagcaaatttatatcttgccattataaagtctatgttgtctcttagctcatatgatggtatatattttcaaaatacaaataaaagaaaacatttaatgtactatgttctttgactatttcacaacaaaaatatttcacaacaaaaaatgagaaactagcaatgtgtctattttttataatcatttcacaaccaagactcgtatcaaaatgacactatcaataacatgcatattggagtaagacattcctgaatctcagcattatactccatatttgaagtcttaaacaacctacacagtgccaagtccctgcctttgaggaatgcagtgcccagtgggaagacacatacatatggtgatagtttagttaaattgtagtaagttatagacagtataaaggtgcccagagaagacatccagaagaaggtgatgcttatattggatcttaatagatgagtaagagttatttagataaggaaagatgggaagggctttcaggattgaaggactagcatgagcaaggatatgaaagggcatggtgtgcagaggagatacccaacagtttggtgttataatagggtgaactctgaggctaaaatgaaaggcgatgaatttggaggggtaaatagatatccagacatggaagggttttcatgtcattgtaaggggtttggtctctattccttggaggtttagtgcttcgaaatccaaacccctcccacaaagtaaacaaagcaaaaataaaatgaatacattcccacgaaagggactgaagccatagctcaaaatggcctcccatctgtatccagttctttgaattctcaagtatttgcattttacttcataatgaatctttgtttcattcaccataaaagtatttttctccacatttctagtaagatgcaccatttttatccaatagctctcatcccttgaaatactgtttgtgtccttagaattctctatgattacaaatcttttttgactgagaagtgcagctgtaggtagcaaagattatttaaactaagagtttcaagaaatgtatttcacataaattgatcactctggatggtgattttaaagaaggcaagaatacagactgaggagaaagagaatattgcaatagtctgctcataaaatgttagatgtaacagatttcatgatgcctagttagatggaataatattttgaccactgaggggagctcccctattttttctactttgattctgtagaaatctaattgatatagctgaatactttccaaacttgttccaaagcagacattctaaataaatatataaaaaatggactacattttatgattttctcatagtttcagcccttccccaatactacaaatacatactaggagacatgggagaaaatgtttgttactgttaccagcacttataacacagagagaggtgtttgtcctgaagggttcctgatttcttctcatgacctcttgacatcttgtgacagtcttccacaaacactcaaagttctgggttttgctggaaattggggtactttgtttcccatgcattcacacaatccactttatccagggtcaatagatcagaagatacagaattgcatacaacaactaagaaaaaggccaaagaggtagcatttcgatactcagtgaggaaggctttctactgatggctctgtttaatagatacagtagtgaaatgcaagacagaggattataacagtgcttgatctagaagtggcaaggattccaaatccctatgatttgaatcttaaattgctatgatggatgccaattaagggaagcccagaaggtctctccaatccctgatgaggctaccctactcttttgacagactcaattataattttcaatcttacgaaaagaactgtgccatgtcctcctcattttatatatctaagtaactgggttggtatttatatgaattggaagcatgcttatgtgcccaagcctacataaagataggcagcctgacctatgatgacatggttttgctatcacggtcaggagtagtcttaataagtagctgtctgttactaactgctgccaggaagaaagattttaaattagcagtgctaaaaataaaagacatatcctttattcaaataaacaatactaaataatcctattaggtcaatttgttcatctacttgaaatatttaataccctggagcacccatcagtatgtctttctactcaaatattcagaaatttgacaaaagggacaaaagtattcgttaggttttttttttttttatggattcaggcagtgcaatggtgagaactattcataaaaatttctaggcccaaattgcttcaatcatgcctcatgggacttatgaaatcacaagagcagattcagaattctttcttttttcctttttgagaaaaaaaaagtttatccatctctatgtattagggtgacccatctctttgtgagaataaaagtcaggcagttttcccatcagaatgtcaactctgctgccttctcacctgctgtttaaacatatagatctttcttcaatcaaccatgcagaatatcagcacttctaacagctgtcaacaaatttaaccttggattggctgtgctatagccaagataccttctctaagtgctattgtatattggatctcagacctagagcacgttggcttaacactttctctgccccctcatacacatgtaatgtcattactgagtaactatttaattttgtggtcttgattactgctcaagtttaccataaagcatggcactttgggaaaataaagaatgactttgaacaactgcagtaacatttgtgctaaatgctacttgctatcttcagaataaggagctaagcccacacaattctcatagggattatgccaggaaaaagtttatcactcaagacaagcttgtaagctttctttattgtacaagataaactatataatctatcagtttccctttttgttttgactgctttaattctttttttttttttttttgagacggagtcttgctctgtcacccaggctggagtgcagtggcgcaatctcggctcactgctagctccgcctcccgggttcaagcgattctcctgcctcagcctcccgagcggctgggactacaggtacccgccaccccacccggctaattttttgtatttttagtagagacggagtttcaccgtgttagccaggatggtctcgatctcctcatctcgtgatccgcctgtctcggcctcccaaagtgctgggattacaggcgtgagccaccgcgcctggccactgcttcaattcttaaagctaaatttgaatgctcagttgtattaatgatccagttttgggtgcctgatatagctactgtcttcaaaatttgttttgactcatacctttgcagagtcccctttattttctcttttataacccttatctcatgaaggtggaattccttccttgtctacttgcctgtgattttggactcacgtgataactgtctagtgttctactgtttctcatcatcaagcaaataatgtttagtgaattaacattactttgcactgtcttgtatgttttaacaatgaaatatgccattttgaaaataggaagtaaaattctaaaccatcaagaatgattaacaaaccaattaattagctgagaataataaataaaaacaataacaattcttagggacactttgagaccaattttctccaaagagcttagcgatatcctcttatcctccctccatttttgccgagatctatatatatatatattattttcagtcaggtcacattttactgtattgagttttattttcagcaagttttaattttgttggagtttgcatcagaggaatctagacagaatagttaaacaataaggtcatgcctgattacaatgtgtttatgtcatcagtttgtcctattcttacaaccaaggccactagtcaagtacgtgaggagacttctataggctaaggaagatttcacctgtgaggctgtgtttatgagaactgggataagtcaaaccaaccaagagctggtgtttctctcatggaaatcttttgacatctaaggagactgaggcaggagagattaagtaattatccaggaccagaacaaatcagtcttaatggaagtataaatcacaaattttctggtttaaagtccagaaactttatgactttatgacttccgtatgactgagcatacggaacatgattttgaagtgtggtatattgtcaacttatcttttgtgccaatagcatgtacagtttgttttcaggtacatttaaaaaatgtatagatccaaagggatctgggaaagggtgcagagaactacataagtaacagtgcacacttgaaaatgaaatacttaagaaaactgtgataaatccactcagtaaaataatatgtggccttttatgcatttaggctgttgtccatttctttaatgatctagaacaaaagccttcctgtaaactgtatgacttcagcatagcttatttaactttttattctcatctcttaaattggaacaataatagagctactgcctaggattgttaaaaagattcgatgagataatccatgtaaagaattgatgagctcagattattacatgtagtaaaataatgtctatgaaaagtgttaattacatagggaaaggctgatgtcacaatgtaacaataccataaccaggacacaaattatgcaattaattagaattatgtggatatcttgatagaaaaggctaagacagaaacattaattgcaattactttggattttgagaaagaggagattattttatttcttgtattcacctgtattgtgcaaattttctataaaatgcatacaacatatgctcagaaaaaatataaaattcataaatatagatctaaactcccacaaaaaaaaattctcttggatcttaacaattcttggattttttggaggtagctggtgtggtttatttgcttacaacctttatctgtgagtgtacatctctaatacaccaaggaaacagtaccattcaactctagtgcaaatcccttttagctttttagacaggttcattcacctgtaatgaaaatttaacaggtagagagtgattaaatcctggtctcagaagtttcctccagtctcaggtgctgagccctataaatctttattcatatgaactcatttctttctttagaacttgtgttactcttaagcaaggaacaagttcagaagaatcatgtattcttgaaggacatgggggtgtgtaactgtgaaaagtggcacccgagactccaggcatactctgtagcacctctttgctaaagaaataaaaagcaccaggggtaaaactcagagcagaatcaatcttagaaggggcacagggggaaaacaaaactaaactaaaccatgtgggctcaggagtcaggaatcagagtttcttggtttggggacctggttctccccttagctgtgtgtggccatggaggagctacttcacctcactgaaaaataagtgagatggcagatatagcaggtgtggagatgctggtcactcatctcaagagcagtttccagaagactccgctggcagaggggtctcgggcatctcgctgggcaggcgtgcagcacatcacatgctacctgggcagtcacagagctgggctggtggcactgggcctgtgtttcacggggctcattgatggctgtccacctgcccagcccaggctgaccatctggcctcctatgagtgcattctgtgggcggcacccttcctcacccacttgctgctcaactgcagccagctgacacgggccaccgcgcgtgagctcaccggctggcaaggacatcacaacattccctgtgctggcctgggaggacctgggcaacaacggggacctggcctccctggctcaacccctgttggttggcctgcacacctcactccccaccatctacgcgtgcctggaccttgagcctaggacctctgggatcctgcagctgctggctgggacctgaggcccagacctgccatgccaggtgacccacataccacctaactcactgctactgacttgtgatgctctcatgcacataggacagtgggcgatggtggccaaggaggtctcccaggcccccagggatcctgtacaaatgctcaacctgagattaaggggacagaaggagaatgaactcataggaggccatatggtcagcccgggctagagtctcagcctaccctcagcggaaggggccctggcacccacagtgtggaccctgtaataaagggtaatgtccacttccatctttctggaaaaaaagaaaaagaaaaaaacagggagagtattttctgcctatgctgtgattagctatattgaaaagcaataaacaaagaaagattgttgtcattgattttgcagcacttgcactcatcagtaaacattattacacgttgacattttcatggtgctcagcttgcctgtaaacatttccccaccaatgtgccttgttcttgccttatacttatgaaacactatacatattaatctaaatgaagatactatactcattagaattaatcatgactaggagagttttcagtgcataagccaatcataatgagtccaccttcatgctataccttattacttttaaaaacatatacagtcatatttcattttattgcaggtcactttatttccattcacagatactgtaatttttttacaaattgaaggtttgtggcaaccctgcctcaagcaagtctatctgccatttttccaacaacatgtgctcacttcatgtctctgtgtcacattttgataattcccacaatatttcaaactcattattatcctattgattatggtgatctacaactagtagtctttgatgtggctattataattgttttggggtgccatgaactacactcatataagacagatattttaatcaatgttgtctgcattctgactgctccactgaccagccattcctccatttctctccctatcctccaacctccctattctctgagacacagtaatgttgaaattaggccaagtaataaccctacaatggcttctaagtgtttaagtgaaaggaaggatcctgtgtctctcactttaaataataattagaaatgattaagttaagaaacacatgttgaaagccaagacaggctgaaagctaggcctcttgcaccaaacagtcagccaaattgtaaatgcaaagtaaaagggaaagttcttgaaggaaattaaaagtgctaccccagtaaaccatatgaatgataagaaagtgaaacagccttattgctgatataaagaaaattttacccatctgggaggaagatcaaattagccacaacattcccttaagccagagcctaatccagctcaaggccctaactcttcaattctgtgaaggctgacagaggtgaggaagctacagaagaagagttggaagctaggagaggttggttcatgaggttgaaagaaagaagctgtctccataactaacgtaacagaacaaggtgaagtaccaagtactgatgtagaagctgaagcaagttatccataagatctagctaagaagactgaggaagataactccactaagcaacagattttcaatttagacaaaacagctttctataggaagaagatgccttctaggattatcatagctagagatgcaaagccaatgcctgccttcaaagcttcaaaggataaggtgcctcttgttagggtctaatgaaactgataactttaaattgaagccaatgcttatttgtcattcaaagaccctaggtcccatcagaataatgctaaatttactctgcctgttctctataaatggaataacaaagcttggatgataatgcatctgtttatagcatggtttcctgaatttttaaaaatattttaagcccactattgagacttactgctaaaaagaaaaagataatgttcaaaatattacttctcattgacaatgcacctggagcatccaggagctctgatggagatgtacaatgagattcatgtcgttttcatgcttcccaagacaacgtccattctgtagaccatagatcaagagtaatttcaacttccaagtctcattatttcagaaatacatctcccaaggctgtagctgcaatagacaatgattcctctgatggatctggacaaagtaaatcaaaaagcttctggaaaggattctccatcctagatgctattaaggatatttgtggttcatggcaggaggtcaaaatatcattaacaggagtttagaagaagttgatttcaaccctcatgaatgactttgaggggtccaaaacttcagtggaagaagtaacagcaaatgtagtgcagatagcaaaagaaatagaattagaagtagagcctgaagatgtgactgaactgctgcgatcttttgatagaacttgaaaacaagaggagctggttcttacagatgagcaaaggaagtggtttcatgagatagaacctattcctggtcaagactctgtcaacattgttgaaatgacaaaaagtaatgtacagtatttcaaaaacttagttgataaggcagtgacagggtttgagaggattcgctccaattttgaaagaagttctactttgggtaaaatgctataaaacagcatttcacagtacagagaagtctttcatgaaaggaagagccaattaatgcagcaaacatcattgtttccttatgtattacgtcattcttgcattgctataaagaaatacctaaagctgggtaatttataagaaaagaggtttaattgacttatggttctacaggctgtgcaagcatggtgctgacacctgcttagcttctggggaggcctcagggagctttgacttacagaagaaggcaaagcaggagcaggcacaacacatagtgaaagcagaagcaagagaaagagtggaggggaaggtgccacactcttttaaacaaccaaatctcacaagaacccactattgcaaggacagcaccaagccatgaggaatgcgcccccatgacccaaacacctccaaccaggccccacctctcactttggggattacatttcaatgtgagattatgggggacaaacatgcaaactatatcatcttattttttaaaattgccatagccaccctaaccttcagcaactattaccctgatcagtcagcagatatcagcaacaaggcaagactctccatgggcaaaaagagtatgactcaggaaaggcttagatgattgtcggcattttttggaggtaaagatttttttaacttttattttagtttcagaagtagatgtacaagttggttttatagatacattgcatgtcacgggggtttgttgtacagattatttcatctgtaataagcatagtaataagcatagtactcaagtaataagcagagtactcagtaggcaactttacagacctcacactcctcccaccctccactctgaagtaggccctggtatctattgttcccttttttgtgtctatgtactcaatgtttagctcccacttgtaagtgagaacatgaaatgtttggttctcttcttgcattagttcacttaggataatggcctccagctccatccatgttgctgctgaaggcattgtctcattcttttttatgactgcatagtattccatagagtatatgttccacattttttttgttcaatccaccattaatggagacctaggttgatttcatgtctttgctattgtgaatagtgctacagttaacatacatgtgcatgtatctttgtagtagaacaatttatattcctttgggtgtatacccaataatgggattgctggatcaaatggtacttctcttttaagttatctgagaagttgccaaactgttttccacatggctgaattaatttacatttccactagcaacgtataagtgctccctttcctccacagcctagctaaaactattaaaaacccttgaggaaaacctaggaaataccattttagaggtaggccccggcaaatattttatgatgaaatggaaaaacagttgcaacaaaaacaaaaattgacaaatgggatgtagttaaaccaaagagcttctgcagagcaaaagaaactatcagcagagcaagcagacaacccacagaatggtatacaatatttgcaaactatgcatatgacaaagatctactatccagcgtctactatccacatctgtaccagtaccatgctgttttggttactgcagcctagtagtatggtttaaagttgggtaatgtgatgcctccagctttgttctttttgcttaggattgctttcactattcaggctctttctggttccatatgaattttagatttttttcagttatgtgaacaatgtcattaatagtttgataggaatagcattgaatctgtaaattgctttgagcaatatggtcatattaacaatattgatccttcctatcaatgagcatggaatgtttttccaatcgtttgtgtcatctgtgatttctttgagcagtgttttgtaattcttattgtagagatctttcacctccctggctagctgtattcttaggtattttatcttttgggggctattgtgaatgggattgagttcttgatttgtcactcagcttgaatgctattggaatgaagaaatgctactgatttttttcattgattttgtgcccagaaagtttgatgatgttgtttatcatatctaatatcttttgggaagagtctgtgggtttttctaagtataggatcatatctgcaagcagggatagtttgacttcctctctttctgtttggatgcattcaatgtcattctcttgcctgattgctttggctgggatttccagtactatgctgaatatgtgtggtaagagtgggcatccgtgtcttcttctggttctcaaggggaatgctcccagcttttgcccattcagtatgatgttgcctgtgggtttgttatagatggctcttactattttaaggcatgttccttcaaagcccagcttgttgagggttttaaacatgaaatgatggtttaaatttttatcaaaagccttttctgcatctattgagatgatcttgtgggctttgtttttaattctttctatgtgattaatcacatttattgatctgggtatgttgaaccaatcttgcatctcagagataaaacctacttgattgtggtggactcgctttttgatgtgctgctggattcagttcgctagtatttccttgaggatttttgcatctattttcatcaaggatattggcatgacattttcttttttgttgcgtctttgccaggttttggtatcacgatgatgctggtctcacagaatgaattagggaagagttccccctcctcaatgttctggaatagtttcagtaataatggtactggctcttctttacatgtctggtagaagtcagctgtgacaataaagtatttttaattaaggtatctacattattttttagacataatgctattgcacacttaaaagactacagcataatgtaaacataacttttgtgtgcactgggaagccagaaactttgtgtgatcctttcattgtgatatttgctttattatagtggtctgacacttaacccatgatatctctgaggtatacctgtatgcacatttttagagaactaatttatctgcacatttccttcatctttttgataatataattttccaatattatactgaatacagagaagctaatctctgggctgggtcaccaaatgttagagctgggagcaggtttagacatcatctagtgagtagttcagattgttaattttccggaagaggaaaccacagtctagagagattaactttgtccaagagtacaagggtcaagagtcgaactcaatccagttctgttgtgttagatctttttacctttaaaatattcatgtcaaccatttttgacatatatgataatgatttgccagcctaaagtatctcattttatggggttcattctccttcaatatttgtagacaatagtatgaaatcattttgatgatgaaaatccagagacagaaggattaatcattgtcagcaaatcattttaaatcagtgctgactataaattactgtttcattcaaacatggtatcagatagttctctatacacagatcaagcaaatggaagcatgtccttcacaggctggagtagataggtcataattctgtgactcactttacaattctctcagtctctcaatcatgtgttattgttcctttctgcctatgtcatttttgggggattatgccaaactgttcacttttaggatgtagaatttttggtgtttttaagggctttgtgttgcagatgaagaaagaacttcaaaacaatgtcatgttgtgataaaagaaaacaattacttgcaatattgcctaagcatttttcattttcgtaaaaatattgctcaagtaactgaccctcaataatgaggaaaacctgtatttttaaaatatcttttcattcatttatcatctactttgatcatcagccatgtaccaattaatttattaagtctgtggatgcaatctctgccccagggagctcaaagagtgtaggggaaagacacatacaagtaaattgttaatatttcatatgacagatacaatagaagccccaaaaggcattatagaggaagcagagaattaattcagggaaagataaatgcgatgaaggttggaagatgactacaagtgtgtcaggcagatttgcgtttgtgtgtgcatgcaatatgagtgcaaaataatattctggaaaaagtaaatatcatttaaaaggtattggaggggcaagagtatgatatctttagttaaatgcaaatggtttagcattgctaaagcctaagatgtgttgtaatgagtggtacagaataagactgggcacattgggggaagcatcataaaaggtctttaacactgtgttaaacaggttaacatttatactgggtcagtggaaaaccatttaagaattatgaacaggcaatggcataaccaatctcagtgttagaaaaaccactgttgccacagtctgaaagaaagaatggatggcagagaacctcaaaccaggaagaatagcaaagaagcaatataccacaaattccaagcaaggaaaaattagagcctaatgttctaaggaaatcacagtgataatgtcaatgagataggaaagggaggagaaatttaagagatacttcataaatagaatcaacatgatttaaagattggatgggaggtcaggaggaaaagacatatcaaggatggttcccagggctctgacaacagaatggatggtaatgtcatccactgtgatagaggatgtgggaaaaggttcatgtatggaaaggatgaacacaatggctttggacattttgagttggaggttttagtgggatatccaaactaaaatatccagtagtcattaggataaatgggatgacatatctggtgtagagatactgatttaaaagtcatttgtatataagtatttaaagctatgagcagtatgagttatcccaagaaggatgtgtatcagaaagaaaagaagcatggggaagaaccctagagaacacttatgattttggttgagaaaaagttaattgtatcatcatgagacactgagaataattagccaaagagatggaggggtgaaaataaggacagaatggttttaccaaaaccaagggaagaacttttttcagggagtactgcaagtggtattatacgaaacaaacaagattggtaaagacagaagttcctgttggcttccccaattcagaggtcagagacagtcttactgggaacaggttcagtgtagtggtgggaaaatgagctagtttgcactggggtaaaaggtgaaagggagatggagaagtttagacagtcaacataagattgctatttgggaaatttgatggtgtagaaaggaaaatgagaggtagctaaatggggaacccaaattgaagaacgttttttaaatgtcaattttaaataagtttgaagatatttgaatgctcatatcaaaaaagttcatggaaatggataatttgaatacacagaaaatagaagatgattaagttacagagaatgaagagaagaatctctagaacaggtatttgtgcgaaatacagcttactcatcgtattagtttattctcacattgctataaataaatacctgagattgggtaatgtataaaggaaatatctttaattggctcacagttctgcaggctatacaggaagcttagtggcttctgcttctggggaggcctcaggaaacttactattatgttagaaggcgatgaggaagcaggcacatctcacatgccctgagaaggaagaagagagagagcagggaggtgccctacacttttgaacaaccagatctcatgagaacagcacaacggggatgctgctaaaccattcatgagaaactgcccctatgatccaatcacctcccaccaggcctcacctccagcattggagattacatttcaacatgagatttgggtggggacacatatccaaaacataccacttattacaaaccaaaatgcacattgcatagttgaaattttttctaataaaaaatgtatttggagtaactgaattgctttgggagcaattgcataaaataccattttaaaaaaacccagctatttattgcaaatttcaagtgctattttttgttatcaagggaaaattggtagatagaatgtgaaccgttgatccagaaaaatctccttctctcagttctacaaatgattacctagtatttgaaacatgatttcttaaggatcatcatatattacaaatatatattacaaataaatatatattatatataatatgtgtatatgtaatatatgtacatattgtatattacatatatatgatatatatatatcctgtgaataatgattgtgtgtgtatatatatacacacacatcaatatatcctgcagaagacattttagaaagaactaaattctgtgggaactggtaatgctttcttaataaatagagctggtccactcccacgttcactgtagcattcattattcacaaaagtcaagatatggaatcaacctaagtgtctgtcaatggatggatgaatggataaatgtggtagatatctgcaatctctactgtatagcttaaaagagaagaaaattctgtcatatgtaacaacgtggatgaacttgaaggacatcatgttaagtgaaataagccaggcacagaaaggcaaacactgcctgatctcacttacatatggaatctaaaaaagttgaattcatagaaattgataatagaatggtggttacaaagggctggggaagagactggggagatgttagtcaaaggatacatttcacttagaaaggaggaataagttcaagaactctattgtacaacatagtgactatagttaaaaacaatgtattttattcttgaaaattgctaagagagtagatattaggtgttcattataaaaaataagtatatgaagtgatgcatatgttaatgagccaaatttaactattccacaatgtatacatatttcaaaacaacacattgtacatagtatacgatttatatttgtcaaataataaagacaaagttgaactcatagaagcagagagtaggagagtggttgcaaagggtgggcagaggggaggaattgggagatattgtccaaaggatacaaaatttcagttaggaagagtaagttttggagatctattggtgactatagctagtaataatgtatacttgaaaattgctaagagagtaaatcttaaatgttctcatcacaaaaccataagtatgtgaggcaatggatgttaattagcttgacttaatcatagcacaatgtatacatatatcaaaacatcatattgtacactataaatatatgcaatgtttatttgtcagttaaaccctagtaaagtagggaggtggagagatcagaagccccctatacgtataactccggttttaaactagtgtgatttaccatcaaaagaacaacttgaattgttatccatagaccacactggtttagtaaaaagtgctacggtttggtgtacatgacagtgaggtggttaatttgaggtgtcaacttgaccggattaaggaatacatggaaacttgataaagcattattttggggtgtgcctgtgaaggtgtttccggagaagattaacatgtgagcctgagtggactgggtggggaagatctgccctcaatgcgggcaggttccgtgcaatctgctggcagcccagagagaaccaaaacagagacaaggtgaatatgttatgtatctgctggagctgggttacactcttcctttcctgtccttggacaacaactccaggctccctagcttttagacttacgttattcctcgtgcccctctccacccgtcttctcaggcctttggccacagacaagagttataccatcggctcccatgtttctgaggccctcggattgggctgagccatgttaccagcatcccaaagtctccagcttgcagatggcatgtcttggaacttctcagcctccataataatgccggtttgtttaataaatcctctcccatatatctgtttacatccatatctttatataccctattggttctctctgaagaaccttgactaatacagatgggtaacatcagactctcttaaaaataggaaatatttttcttctaagaaataccctgggataacaaacatgctgtgtgttaaggcacatgagacccccatggggcagatctcccagggcaccattcacatggaatacattggagctgcataacctcataaccttgccagtatagggtcaagggccaaaaaatgcaggcttcacctaaaaaaggaacaaaaatctgattcaggaagcaatatctgagccttgagcaagaaaagacagactttagaagacttttattttggttactgagaggctgtaataaacctcagaagcaaatcaagggaaacttcattcatactgtagatttttggtgttggagttttatagaattttctagcagatagaagtaccttttctaataaaatgtatagtacaaaaattttcttttcttgtttgtacaaagtcactttatctttctggaacctttgcttctctatttagttttcaccaattagtttcaggagctcaagggcatttttatattcagagaacattctaggctagaatcagtaactacagttagaacacatagaagaaataaatgaagacagggcttttatatccttaaactcactcattcactcatccattcaatcaataagtacttttaagcaactgttatgtggcaggcggtgtgctatgtcctggccataagcctagtgaggaaactaagagtaggctaatggttcaaggaattaaacacatgctgagagagaaggcatcatgtatagcaagaaatgcagtcacaccattgaatgaggcatcagtgttgttctctgaaagctgcattttaaaaactataatttggaagatccaaatgtgttgaaaattgtccttagaagctattttaactttacacagatgtggcgctttcataacaggaaaatgctcatattttcagctcaagttcttaagtggggaaaacatggcagatgcttctgataagcataagagattgacttgaaatgaatttttaattaaaattacccaaaggcctagtgaaatgatttcccatgactgtccaagtctatgaaaagttctgcccacctctgaagaaagaaatagtgtcatatttacatcaaaaaagcaaaaaaaatacaaggtagtcggttatggatggattgtgtcatgaagttttcttgaatgatacaatgaaaattcaatttcaattcacttttgccagttgcagatcaattaatctcaaaatcttcagtgtctcataaagacactgaagtaaataacaataatgtaaaatcttatgctgagaactgagtaacacattgatatattaacatttctatagaaagtacctactatgttgaaatatctgttattgcatttttgatatagcaactgccccttaagtaaagatctgacagcacaactcactaacttacatttaaatctagactttaacattatttttgagtaaacaaattaggaaagcatcaaacattttcttctcacatgccaaatgccaatataatttcaagtataatcaatgttaactgtggaaatgtttgttcttccaaaagatggctactgagaaggctgatatgttaaataaagttgaaatttaatagaaacttaattagcaagtgctgttaaattctttttataaacaatgctatcttaggtgctttgagagataaaaagatgaattagacgggaccgtgactcatccagagctcacaatacacagtgggaaacagctgtgataagtgctttaatagttgaataaacaacatcaagtctgaaagtattgcagggaatagggtaattaattccagttggggacactttttttcatttgttttgttttttgagacagagtctcactctttcaccgaggcttgagtggaatgcagtggactgatcttggctcactgcaacctctgcctcctgggttcaagcgattctcctgcctcagcctcctgagtagctgagactacaggcagatgccaccacagccagttaatttttttttttttttttgagacagagtcccactctgtcacccaggctggagtgcagtggcacgatctcggctcactgcaatctccaccaccctggttcaagcagttcccctgcctcagcctcctgagtagctgggattataccaccacgtccggctaatttttttgtatttatagtagagacatggtttcaccatgttggccagactggtctcaaactcctgacctcaggcagtccacctgcctcggcctcccaaagtgctgggattacaggtgtgagccaccacgcctggcccacccagttaatttttgtatttttagtagagacggggtttcaccatgttgcccaggctggtctggaactcctggtgtcagataatctgcctgcctcagcttcccaaagtgctgggattataggcgtgagccactgcgcccggccagggacaccttttaagtgatatacatcaggtgaagcattaggtgccacaaaggacaataatacaaacatatgatatgaccctttcctttgggaaacttatcttcttggaaacataagacatacataaaatatatgtctacatttatacacttatatatacacaaaatattatcaaatacacaattgtatgcaaaagaataaaaagtctttgaccagaatgtagaggctctgagagttcagtagaaggagaagttggtatcaacgtgagaaatgaaataacatcttggagaaggtggaccatgatatgggagaggaagtgctggaagtacttgcagaagcagcagaaggtaagacttgaaatgatgaaaacaatgaatgaaggcagaattgactacatcctgttccatgaacctcagagactgacctggccaaagcatgaggtcttctttggggaaccttggaagaactaattggttgcattaagtgtaggatgggggtgctttgtgaatgccaagacaaggaatccggatttgatctgataggaacaggaaattctcgtagactgtcaagcagcctagtgacacgtgaaagcaactagaaagattaggcttgtgattattgcttttttcaggaaatgttttatataaagttcctctaaacagtttataaagctttagacagatgtacaatgaatgttattattacatcagacacatacagagaactaatgagtgtgtatacaaccctaacactcgtgaaagtgttctgtaaaatcttataagtaagactcagaagaaatcatttagttggcctgctctaccataaaggagtagatgaaaaacagagataatggattaacatttgttaaaacaatgtcagagaaaccaaagtggaaatgctccatgaaaagaaagatttatgtccaaaaagggcctatcacagatattttaagaaccttcagaaagtgtcctgaagttaaaaaaaaaaaatgaaatttccttctgtaaggctgttttctgtttgttggtttgttttaagagggaaatatctttgagagttacaaactggtcattacacctttaatacctgagaagaggcagacgcaacaggttgccagcaaccagcaaaccatttaatgtaggtagcaatctgcatgaccttatgaggggaaaatcagggaagatcagttcaatttccacccaaaacacagtaatagatattagtgataaggaggccataatgtggctgaatttttgtaaggctttagggtctgctccagttggcattcttcttaagaagctacacagatgcagcctggggctgtcacatgtggacatagatgatgagggtttatatccagatattatttattgtttaagggtgtctcaccattaatttggaaacatttgtctgtagctgataagctcactgaccaaaggtgtgtgctaatggcatcaaagtaatggaaatcccctccatgtggactcacatgctcctggagtcacattaccagctgggctcactccttcccactgactcacaatgcatgtttttatagctagaagaacctgacaaaaatgatagaacaaaataaatttgtcatcaccactagaagaaaagaaaatccataaattctgcttaagcaaaagtctatatctacggatgagtctgagagtcaaaaaaaaaaaaaatcgattcattcaaagtatctaccacttcaagaaagctgatgatttaagtgacttgatcttttttgtgttcacttggttggtcaaaacaaacaaacaaatttacccttgaagccaagaatatctgtgtgagaatgtgtgacagctggggaaccaacgttcattccaagcagtacctgtgtaaagtgtgttcactttcccttactcttctactgaagtctccactgctccctttagccaagaaggacaaattcttccccagaccccatggttccttcccagtccactcttctcagggccctatcagttcccatagcatcctcccagccaatgcccacatatccattcaagatattaagtttaggttcaccaatatcaataagccttagagatcatagagggccatgctatctgaaaagtccctttcaatatctgcaaatgaaattattctcagatctctggccccatcatctttataatgctcagtccagtgttctttgtcctttgcctctcttggaacatggtgatcaaccttgagttcctgagtcagggaaggatgatgcacatgattgtgccagtgcagctgtgcttattgagaattccacccacagcccagcctctcttttgaatgtgtgctaagtctgggcaaaatatgaaagattttctttaaaaatcttcattcaatttttgacttcccagtgctgcttatatttcttctaacattagttacttgtaggaattccatggtacacccttctgtctgactgtatgctaattttttttgtttgtttattgttgttgttgttggggggtagagatgggatctcactgtgttgcctaggctggtctccatctgctggcctcaagtgatacttctgcctcagcctcccaaagtgctgggattacaggcatgagccactgcgcctggcacaaatttgttaaaatatgaattctaatccttaagaagactcaagttatctacaatagctatgaaacactcagaggcttctttaacaactcatttctctagctttcatgaagaccacttaaaatccttcttatgcattccctctctgctaaccaacgtctataactcatcttatttttaatacagtaagaagttagaagatataacatagctgtgtgctaaatcagttctactgaaaggttttcaaattatttggtaaaggattcacatattcatgtgacacagtgatttcttttgatcctgttttgccataaggatctttagacatgacatgcaattttataaagaaagctagccatcaggttagagatccatttgtgaagaaagactcatatcccttggcctgtacttacacaatgttcaaattgcattatgtttattgagatttttttcattgatccagataaatcttgcttgatgccttttcaaagaattgcttatcagagaacttctagtaaccttctggcatttcaaaattgcatattccctgcataacaactttatttgttgtaattgtcaagtttcaatgtttctaaagatatagctaaagcagaaagatgtatgtgtgaagtattattggatgcctggatttcttacaaactctgtacattctttttttcttacttgaacttgtttgtcacactttataagcttatattttcaaactggttgacacaccttatacctaccatactcatagtttaaatcatttaaaatgcatgctattcacagtacaatgtttcttaactgaaataatgttaataattttatctagaaaatggggccaacttcacaaagcgcctcctccccataaatgatattatctcaatctaacactgtacccacattaaccgttcttcttagtagcataaataatttcatgagtttaataatcaaatattttattaaattatgaaatggcatatcatataaatattttaacaattagaagaattctctgctatgtttacacaagctcttttattttctttattaataaagaacaatcctcactacagctcaacttcagcttcaattaaaacacaaaaaagcttactacattatttatattaagaattaacccaggtttttcccagtgcttgaaaatttttcttattgtaaattggcttaaaaggtctttcaactacagcaatacttaccaaagtgttctctgttagtctgccctgacggagtttccataagtaactgtacaaagagccagtaagtgtggttgagacttgggaaaactggttttattttttatccttttatcttactttctttttattttattgccattgttgtccagattcctaatgaatatggtactttcagccctagctcggaagatatctagaagtggtcccaggaattcactcaacatgctatctgttctcctgggataggatttcatcagaaaaaccagtgaattcaagtcgtagtgagatattttcaggcaatcctaagatgcccattcttctgggcttccaggacaagtgctgtttaaaacctgcaacctctttagtcctccaggccacctatgcctgttacctgtggtcaactacaacccagcatataagcctccccagtccttcattttctcatgggcttctaccaccagacacaatgtcctgaaccaccttcctcctaacttagtccattttgaactgactgctggtcccgcaatcctccatactgtcactctcttcactgagcatctctcctctcctgggcttgatacatgcctgctgggcctctgattccatgcttcctcagcagcccagtccagagaaagctgcttattctatctcatgctctgtgtcgtagggttaaatgatgtcgttggcatttttctccttccccaaagtggtttccaggccatattctaccatcacttgatgaatatctctttttgggatatatggtgtccaccttcacttctctctacctcagttatcaccactgtaaacctacttgttgaagagttcagaagccagtacatttttttttaatcacaaccctagcaactgccatcatcttaagtgacttcacgtctgggcgggtgatttatgaaaaggagagcttatagggccttggcttccctgacttctctattcatcttctctattccacttcaggcagcccaccgcccagccacatcataatattgaataacccaattctcctgaattcataaaatcataaatgaaataactgatactaactctaagccttagctgctaatcacatgcagtgtatgatcattttactctgtaataatcatacattatgttacagggttactgtgagggttagtcagcgataagaaaatgaagagttgggaatagtgatggaaaggatttgaaaggggagactagtagcaaagagatcagtggaaagttcattttatttggagcgaagaggttcctggaagcctggatagaggcagtagcacaggaggtaaagagtgtcagtttcctgagacatgagtgagataaaatcgggaagatgtaataacctcttggatttagagaggagcaagaagtagaggctgactccaaagtggctagcttgggagaataattggattgtagctctgttcatgcagctggaaggtggagcagataaatgataaatttcaggtattattaagccaaactgtcaaaaaaaaaaggtagatatatgtgtttggaattcagaagaatagccagagtaaaagataaagctgtgaaatcatcagcatataaatgttattgaagttaagagagtagatgaaactacccagggagagtgtgtagaattaggaaaagaaaggataaatgactgaaggacctcaacatcataggcatggctaggagacacagagtcaatcacagggccagagaaggaagtaatggttacaaatgaaaatgatttaaacaataatactagctaacatatattgagtgcttattattaccaagtagttttgctatgcattttatatgcattatagtagaggggtttaaagcacacgtagcgcttgggttcagattataattctaccacttagtagctatagccattaccaaattacttaagcactctgtgctgctatggcttgaggataataaaagtgccaaatttatagagttggcatgaagcctaaaatggttaatggatcatttaaggcaatgtctgactcatagaaagccctatataaggattaacagttatttttattattccaattttaatttcacaataactcaatgaggagacatgatttttatcactatttttaaattgagaaaactgagattctaaaaggttacttatagcaagtgtcactgttgatatttgaaagagatctacctgagagtccaagtatttaatgagcaggaaaggatgttgcagaaaacaaaaaagcaaatagttttaagaagcaaagtgattaaaagatctaaatacaatgacgtagtcatgaaaataatccataaagcacattcttttaattcatctgctaattcatctaatagtagcaatagagatttgatgaagataacatgatttcagagttggtcaataacaaggaactgttaccacatggaaattgagctacaaagagtctgtttacactcctaccctgaactgtgtaccaaggactcccatgtgcaaacttgttcatcacccaagagtcactgtgcacagaagagcttatagatatgatctgcaattatgtcaatacaatgaaaccactgggttctcctcaaatttagtgagctatacttctatcgggagtttcacaattctccatttggcagataagttttttgcatactactttgcaccattctcatggacttcattttaaaaaattattatcttggtgtctcataacattttcaatttaatatgcttttagttaaagaaaatataatttatttctgtttttctttaatccatttaaattaatccatttaaattaaattaatagaatttaatccatttgtaatgtaaacttcacaaaatggatttataaatcccttggcaccagaagcagattacaggacatcatgcttttccttctccttgtatggtgccacagacataaatggctcatacgtatgggacattttgtgtcaacttttcctcaccagtacatgaagcttatgttcccctatgttaatggtgatttaaggggaggatcatttagcaagcaagtcaagtggttcccattgcatttcagctctttcaaatgtggtggctgcaaatgatgctgctgtgctttgttgtaggtttctatataacgctgggcatggtgccttatttaacagttccctagtgctattttggaaaagccctctgcagaaaatgccagaacacagcttgaactcttgtcccctgtcagggagaatctttctatcagcgggatttctcagctgtttcagaaatcattcagccctttaccggtaaattttgttcctgtaaaatatgccaactgtagcttatcctaattgttcatcctaagagctttagaagcaaagatttttatctgggaacttcagcatttgctacaaacttttatacagaaatcttaattttaattcactaaagattttctcttgtttttcaactcacttttaaaaatatattaatccttattttcattttcatcaataaaatgagattttctttttctgttaagctagtccacctgcaattaacaacaataatttgctaaattaagagttagtatatcctttgttatgttatataccagattatcattcatttttattctttgtggtgctattattatccctattttacagctaacaaaactgagacatagagaggattaaaaaaattctgaaagttagtaaatggtaaaaccagtatttgaatccaggtagtctcattccagagccatatttgatgaacaaggaagatctagaacattaagttaatgtatcttccttgtgatgaatcaatggtaactattctgatatctggattaagacaattctttacagcctttggtgagtttcaaaagtccagtgtgagttaattatttggaactcagaatacaatgctagagaggtctggtgctctgcccagcccacaaaatctcatttgaaatctaaagtcggtgaaatacagcatatttatagtaattaatgtcaaagctatgatgttgcaatatcagacatcaaggaaaacataaaacagtaagaaactttaaaaaatttttaatagtattgcttgaataaatgttaggtttaattatacaatgaagggaaatataaagatctattatagtaagaaagccataagaaaagaactgaataagggatgttacaagacatgctaattttcaatgaagtggaaaaattgcaagcagagaaacagaaaagcaggcaggtcgggatggcagagggccaggtggtatgcagaaaactgaatacacacagtactaacaggtcatacactcaaagggttcctctcacttttaagtatggtatgttttgtggaacacacacacactcacacacatgccacatttctactaccctgtctgaccacctaacattaattgctaagaatggggccagcccaaggatatccatgcctgaaggactgtagagtagtgaacagtctcctgagtttccagcctaaggaaaaagagtaaatgggaaaacagaacatacctttcttaaaacttcaatcaactgtttgggcatcatcaaaattggtttctgtgggcttaagtaggaataatatcaatttaatggattgagataacatgggaaatctacagtacgttttgcagcacatagtagataaccaatagctggtagttaatagtattacaggagaaaacagatgtgcttcctcaagcccccagcccaaaaaggaaagaaaacatagtgcatatctatctggtgtattttaagtcactttttggatttgaggttgagatttggaagataaaacctctagagatgtttgtctttcattcactgtggttgcatttttcatcacgttttctcgaaagcatttactcctttgcccaaaatgcatttctgtacgttagctattctcaaactttttagtctccaaggccttcaagcttgtaaaaattattcaaaggacttcgtttgtacaggttacatctgttgatatttatcaacttagaaattaaaattaagaaatttaaaatttttttacttacctattaagtcaaaaataacaaaccatttacatattaccatactttattaaaaataaactataatttataaacaaaaatttagtaagaaagacagcatgttttcacatttttgcaaatctctttaacgtctggcttaataaagaactgttgaattctcgtaattgcttctgcatttgatctgttacaatatgttgttttggttgaagtatgtgaagaaaatccagtctcacacatatatgtagtcagaaaaggcaagagcattttcatagccttttcagaaaattgtggatattcttttatatagcacctaaactcaaaaagtggttgtttcttttaaaaaaaatttaattaacaaatataaattgtatactatatacaaaatgttgttttgaaatatgtagacattgtggaatggctaaattgagctaacatatgcactacctccttttttgtagtgaaaacacttaaaatctattatcttagcaattttcgagaatacaatacattgttattaactatagtcactgcgttgtgctgaaaattttactcaccattattcttgcatcatcagtgcaaatggtaacacagtgaataaatctggtaacatgttagcattatgatttattcctcctaactgaaatgtatccttcaaccaatatccccccactccccaccctaacctctgctaaccaccattctattctacatttctgtgaattaaacttttttagattccacatttgagatcatgtggtatttgtctctctgggcctggcttatttcacttagtataatgtccctcaggttcatccatgttgttgcaaatgacaagatttccttctttttaaaggctgaatagtattctattgtgtatatatgacacacttttaatccccttatctgtggatgtgcacttaggttaattccccatcttaactgttttaaataatgctgcaattaatatgggaatgcagatatttctttgacctacagatttcatttcctttgaataaatacccactagtgggattgctggatcatatggcagttctatatttaataggaacctccacactgtttttcataacagctgtactagcttacattgaacatgtgattgtttcttaaaggtgagttgcagtgtagaatcttaaatcatattaataaactttgcataatttattacattaaaatccattatctgtctcatacttcatatatatccttaacttaggtatgattttataacatcatgcattgatcatttggaggatattggtttacagatcttacgtaggccttccaaatattgacccattttacttaacgataacaaaaacacgaattttgttaatataaccattgatctcaccaatcttttatctcaatcaaaagtcttttaggtactgggaagctgtcatgctcatggagacaaaggcaagttttccaaaattctaatttttgctagaaagctccaattttatcactggcaacaaatactgtcatttgttttacttgaagtgacagcttaattcttttttttcaattaaaaaaaaaaacctgtgaaatatccaagattgaataaccatagtttgtctgtcagtcttctttcacttaaaatgatgttccacaaaaacacatgtagcctagctcacaatcagttgcacagatgtttcacgtgtgtgcacacaatatattcttcagtgtgcagcaagtctttatgtatactttccatttcatcacacaaaatgttaaaaagacatatatttgagggtgatatttaagaaaattaattttttttgagacaaagtctcactctgtcacccaggctggagtgcagcggcatgatctcagctcactgcagcctccacctgcggggttcaagcaattctcctgcctcagccaccatgcccagttaatttttgtatttttagtagagacagggtttcaccacattgatcaggctggtctcgaactcctgacctcaagtgatcctcctgcctcggcctcccaaagtgctaggattacaggcataaactgtaatcccacagtgctgggctgaaaattagtaatttttaatgtttcatcaaggacaccctgaagtaaaacaaacttttaaaaaacctgtagttaaaaattactagtgaagtctgagagaactctctcaattcttgtggaggtgctgaaagttttactcatcattgttcttgcaccatcagtgcaaatggtaacacagtgaataaagctggtaacatgttagcattatgatgaagagtgtattgattttatggataccctgaaagagtctcagggtctcccaggagcccatggatcaccctttgaggaacagaaccatacagaatgcttctttctaagtttgccttgttttgtcttattttaaagcatctcccttctgacctacagcttttaggtcattgagttacagaatccaaaattgtgactatgccgtaagaatattcagaataaaattcagataataggtgttggttaaaatgaatttagtaatctgtttgctgacagttttgaaatgctgtaggagatattgatgctcaatggatgcttaataggagactctgtcattgattggaacttccagggtatttcttctgaaaggaccccagagaagagagaataaaattgttggcacctgccagttgcttaataccctccaaaaaggctgagtttctaaataaataaatgctgtacttatataataccttgcttgcgtaattgctgatatttgctccctaattgttccaagagaaaggaaatggatggaattatgtcctaatgttgtgccaagagcaaagaaactaggtatatcttcagccctacatataatttgtttcagggccagtctgttgctgtcagtggcatactctgctatttacttttagcaaccaggatttaattaagtgcagttcattgcccccttcacagttcttatcagatccttcagaagtgtaaagccactgttgctgcctgaaacatgctgcccaaatgggaaaattatgggaaaaatatatctatttcttccccagaactggatgggaaagtacccaaaaggagaatatatataaatgagtgaatttcttacatgtgtaaatatggcaagttagttaattaaagcctattccgtttggctctcagatactattaggctaaaaatttgcttagctcttagtccccactccacaaagcactgtcaccctcaccaccacagtctggcatctagcagcatttcctctgagcgttagagtgcaggacctggacctattgatttggggcagagacagacacagttctttctcagaggtacatttgtattatcccagcttatgaaaccccaaagcagtttattaaattctgtagtgataaatgtaagtgttacaaggatactctccatagaaagggaaatagaaccagggagtttcttaagattcagtcagaataaggccaattagctgggtcactcaaatatttgagagcactgagctaagcatatatttcaatagcaaaggtaaatttgtcattacagtcttttccatgtgaacttgtcattgtcatttttgcctgggcatctcctcttcacattggaaagagtgaggcttgtccattgtcagataggtcccaggcatctcagcattacttcttatcgttgtctgtcctttgattactacgtagcctcctttagctagaaattaaatgaagtaatggatacggatcacataataaaatgcttggcataagttaggagagcaagtattaatcccctttctgatgcttgccttttctatgcttctgatgaacactttattctcttaggtatccaaataccctaagtggaattattgttaagtcttgtcactaatggttaatatttactgagtgctcactgtgcactaggcattacatttaataaatttttaaaatacattatttcctttactcctcacagcaatctgtgacaagtgctataattatttccgtgttatagaagaggaaactgagatacgatatttaactaatttacctgtctggaaaagggcagagctgagattggaatctaggcagtctaactccaccaaccatgtttctggttggtaccctacactgacactcaagtgtgacctgcctaggcatcattctttatcttcctaaagggactttgcatactctagctcacttcattatgtgttgatttacagtttaattctcagaggacatcttggttcctatatttctatattctatatgggaacatgctaccatcaccttaattcataagcatttctgattgctgaattcataaattagaaaaatatgatactcatgcccacaatgaaagcaatattccactattcaggaaaataggttcgagtaattatcctagcatacattcacattttacatcagtatttattgatcacttactgttttccaggcattgtttttgtttgtttgttttgttttttgaagtggagtttcgctcttgctgcccaggctggagtgtaatggcatcatcttggctcactgcaaccttcacctcccgggttcaagtgattccccagcctcagcctcccgagtagctgggattacagccatgtgccaccatgtccggctaattttgtatttttagtagagatggggtttcttcctgttggtcaggctggtctcgaactcctgacctcaggtgatccacctgcctcggcctcccagagtgttgggattataggcgtgagccactgctcctggccccaggcattattttaggtactactgatacaccttagaccagagattgtcagcctcttcacattgacatttcaggcaaatcatcctttgttgtgggcagctgtcctgtgctttgtggcatgcttagcagcatccttgccttcctcccacaagatgccaaatagcatcaccctgtctccagttgtgacaaccaaaactgtccccagacattgccaagtgtcctctggagagaaacagcaaaattgctcctggttgagaccctcttgcctgggccctgctttcatgaagcttctatatgaatggactgaaaaaagaagacaaggataaataatagaattgcaggtaatattgatagagcaggagggaggggcctatttaagtatgatagtcagatacctcacctccaagccttcttcacaccccaaagcactgctcaaactaaacttctctgaattgattaagtggcatagtactgcaaaatctccttcagcaaaaggcttttatgggcctacttcgattatagctcatgttcaagctataaacacagctcttcctgacctactccaggactcagaaggaaagaaatacaagttaaattaaactcagaattggtggcagtgtttttgtttgtttatttctttattttccttattcttattctgctcccatggagtcttagtgcttctctctatttagaaatgaagagggactgcaagctcagctgccagcctggcagataacaacagcagaagttgcaacatcaccttctgttctgtttttatttggacacatttccctgagatttactgagatgggattaggataatagttcagagattattttcgcctagcccagtgaatacttgaaaaacaaactatcttttcaggtataaaagattgcacttcaaaagttccaataaaagcctttgatgcaaatttctcctgatctaagtttcaaactctgccagaaatgactgttaatctacagttggacaatcagagatgataatgctttttatattttcatatgattatcaccattttgtcagcagcttcctatttgcaccttgcagaccatttcattacctctctcagcaacagctatgggatggtgtgactgactccctgcctgcctgtccctcctctgagttctgtctccttttcctcaacactctcaggctgaaagacaggcatccatagattaacaattctccctcattggtctgtagacaattgtccttctggctttactctgtattgatgctccaggtccaatagctgacccttgttgtccttcctaccctctttctctattcttataggaactgcattgtcagcaaaaatacctaatgcccatggcaaggacctccagtgccaatcacagacattcattcgttcacttatttgttcattcatcctatagacatttatggaatgcaactgtaattcagaccacatgctaggtacagataccccttgatagtcctaccaatctttctaggcctcttgctattgggtgctatgctttaaccaactgcctagaatgtctcccatgatttgaacctaagcccagctaaattgtttgcttcatctttaaaaaccaatttgaagtttatattccttccagccttgatctagcctaccccagaactggctagttccctattttcatgttaaagtttaaaagtttattctaaaagcaaaggtttgtttttttcttatggccttctagctgcttttcattgcatagaaaggactaattggcagtggcggatgttgttgttgggttggtttgttgttgtttgcttttttgggaggggaaggcatttgaattttaccaggtatcatcaatttacatatctataaacttggggtaaagactttattattaatcaaataacggatgtgctattttataataaatgttgctactagtaaaaataaatattaaaataaaaatctatctagaatatttctagaacagagtagataatatatgaatataagggtaagacagataataatcttaactatctattgaatcatagaatctcaaagatctacaagaacttattagtgacttaccaaatcccatgcctaaaaataattataactattaataatgtgataactagcatttaatgaataatgtctatgtactgtgttatcagtgaagcatatgattgatttagtttaatactggaaatttctcctctccagcactgggaactggccactgatcacagcagccccagatgtttcacagcaactctgaatattacagacttattccgtttacccaggctaaaccttccccctctggaacctggccgatcaggcctagtctctcttcctatgacagccccttaaatatttgacaacaatcatacttttcttgaatcttcttttatccaggtggaacaatatcaataattcatttaatcaatctatccacttatagtatgagattcttttctggaggagttcctccaatccctggattcaacctatccctcctattgaatatcattgcgtctcaaattgaggcccagataaccaaacattgtgtttcaggcataaacagagctggggaattctccatttggttctttattttattttaatgtaaataagttgatataaggacttcagcttggagttgagtggtggagagagatagagagcaaggatagaaagcattgtttgccagagagctgagtttcataaattaagttacatgcgtgctgactttcatgtatgccaagagtttaaaagtaatccctgaaaaacagtcacatagaacagttatggcacagcataacccaccaaataggcattaatatccttcccagcaccattattatataaggattgtactatattcagaacttgtttaactactttatagctgcctttcaattaatatacattgattattcactggatatgaggtactgctacagtaggcagaagcttgctaatgaggactcaccacattcttcccaaagcagcagagagtctgtgagaagccactgaggcattctgggaaccctctagggcatcctagagccaaattgaatgtggcatcaggatgacaagaattaaggcacttgggagctgcactggggtccccccttaaaggttgcccaactggaagctgggtgtctctgagaaactcccacccttcatgttgggattatctgggctttagaaggagcccactgatttgaggaagagtacttttctttactacttaaggctcttgaatgccatcttactacccaatcttactaccttggtagaggagaacaactttcacattccactttacttcaggctgggttgctttccttccttccttccttcctttctttctttccttctttccttctttctttccttccttccttctttctttctttcttttctttcttttctttcaacggagtctcgctctgttgccaggctggaatgcagtggcgcgatctcggctcactgcgacctccgactccctggttcaagcaactcttctgccttagcctcccgagtagctgggattatggtcacgcaccaccacgcccagctaatttttgtatttttagtagagatgggttttcaccatgttggctaggggggtctcgatctcttgacctcatgatctgtccacctcgacctcccaaagtgctgggattacaggcgtgagccaccgcacctggcccagactggctttctcagggaatcatgctgccttggctccagtgtgaaatctctctgcttacagaaattcagaccctcccagaaatgtcacagcagcactgccctgtcccaaactaacactacctggaattcatgtgagtaactagcatgccataacttagcagcaggctactgcaaacatctctgagtattaggtataactggaaacaaacaaaaaaaaggaatttgacgactatttctggtaacattctggagacatggccagtctttagtgggtacagtgactttgtacctaagagtggcaagatgtgtcatggctcttggttcctcagggcctctcctgtgttaaccattgctgcttttaattataattagagcccatgggttcttagccatggtggtaaagcacatacccaaatattttgaaatcttaataaaagaagaatgcatgatgttagtttaactttcaaaattaacactcattaaaaagtatgtgatttgcattagcacattcttattttgtgataagagtctacaagaatcactcttaaattatggcagcagcctatccccagttcctgggcttaaacacaatatgacaaaagaatcataagcaatgtgttaattagcctgtttctgattttaccttcaattccacatatttcatgattttcaggaaatctgtttattctttattattctctgcaggtgttttgagaatatattcattgggtaaaccagaaatgttggcaacaaaatcccaagatccagtttccttgtctaggctcttggtcagaagcatctgaccagtatcccaattttaaccttaaacatatttcagattatatgatagaaactgccttttttaaaagctgagattatgttttctgctccacattttgagggtagatgccaacatgaaatcttaataaaattatcattatgtaattcacagcaatcagattgtatattccttaattacatgatttgttaaatatccatacattattaagcatcatcttttatacctataaaattataagctcctgctatataatataatctagatctacccggctagaacaaaactgtataattcatcaaaaattacatttttcttcagctgtatattatgttgttctctctaaattatctatcactcttatcatggccaatgtaattgtgagggataatagaaaatgggaataacattgatattttaaataaaaaaaataagctaaatctcttttgagtaagtagtttcaagcttccctcaccagatcgtggcccacttatatccttttattgtcctattcaccctctagtggaattcttagtaagtagtggaagtacatatagagagagtgaaactgcagaaataaaggagatagccaaaaagccacaaaactgaataattcatggaacatgtaggagtcgactgtattatcatcaagaggatgtttttgtgaatgttaattatttatgactacttgtaatgtttatgtttattagttgaggtacatagagaataaaattgcatagcagctagtaaaataacttttaaaagattccagtttaaacacactcattagtttaaaaggctttctgggattacagacattaaaacatttaaatcttactagggagtcaaaaggctctccaaggatttgtagtcacttaaacatctctatttttgagttacaagtttgggttagtcactgttgatttgtatatttttaatcatcaagaatatctgagaaatatacaatttggcacctcactttataatctgaaaagaacagcactgaggcttaaaaaattttttgagcaaaagaagaacatattttttagttcatttcaaccagtctttttccttcagcctaatatggatataaaatgtaactggcattagcgtttcctagtattgctgcagcctgccagaatgttgagacctttgcacaatgaatccattattacaataaatatgaaaagacgacataatattctaaacagctcatcacattctttctaatgttccctgtactgaagaaaatattttaatgtatactaagtatttgaatttattttcaaaatagtgaattcatgctttcaattgttgccctttaggagtccttagtgcacatttgtaaggtaacgacaaactgaatctttaataatgatcgtaatgatcactttaacactggaagaaaactcaatgttttcctaagtttctcaaggtcattttttcactccatagcttttcaacataatgtagttgttgtcatcttaggaataaggattttcacaaagtcaggctccagcctgtctattctgattctggaaaacctttggcaattttcatgctaggtggaggactttgttaaataaatagtgtgattttaaaggtgctcattatcctcaatattaaacacttatagtgaaacctgcatatacccactagggcagtgttacttattattaataagatttttgtatgggtttttgagcctgttcatgaagttggcaaaagctgagaatgttattcgtcccaccttgtaatgtgggcaggtaatggagaattactattgactaagggaagaggaaaatttaggctttgttgaaggaatattaactttagtagtattcctttccattctagatatctcgattcatagaaaaacctacagatatgtataaatccatatagaagatagagaataaatctcaagaagggctctggtaatacagatggtgtgtatacactacactcacaggtggatgaaatggagaggggttccttgatcagaattttgaacaagcacaccctatgaatattattgaagtaaatagggagtctcttcagtttcctgcaacgtcttttctagaactctgtaagagaagaaaaaaagtaagtcagatgctttctcagctgtattgactttagaagctggcttacatattttccactctttaactcgttttctagttttttaaccattttttgaaaaaattgggtcttgcttattaatattttcctcttggtacatctccatcacctattctcctaatctaatctagaaatcaagaaacagaggtaaagacatacatcctggtcccctcctatttatccttctaactgcatgggatgtgatcatctgaactgcactgactgcatatgtactctcttagctggtattctttttatggttcagtattttaagaaatgtctgattgtgcttcctgccttttcagtaagctataccctttaaatcaatattttaaaaggtcatcttgacagttacttcagaataaacaaatgacaatacaacatctctcattagatgatgaaaatcacagtgaaaaactggacacattacttaaattcctgtcttttgtttataataaactaaaaaaaaattcatgttaagaaatggcaataaacttattttctagatgtaagcattttaacttggtagttttaaaattaggacgatacagctcatacaaacaataagaaaccatatctgttatattttacattttattgtgaaaaagggcatattttacatccagtgctgattatatttaatgtctaaaagtcattttgagctattaagtaaatgatgtgaatttaccagagtaataatcaccacttttaactttacttgatttgccacaagtcaatgcctcatataaactgtacattacagattattttagaagcaatatgacatcggaagtaccaaatacagtgctacaaattttttaaagcacagaccacgtattcaaatgatttattcttctttacaaatctccatctgaagctactagttttattattcttattactttatttatttatttattttttgagatggagtcttgccctgtcaccagactggagtgcagtggcgcgatcttggctcactgcgaccctgcaacctccgcctcccggattcaagcaattctcctgcctcagcctcctgagtcactgggattacaggcatgcgccaccatgcccagctaatttttgtatttttcgtagagacggggtttctccatgttggctaagatggtctcgatctcttgacctcgtgatccacccacctcggcctcccaaagtgctgggattacaggtgtgagccaccgcgcctggccagttttgttattcttaagaggctcacagccttctgagaggaagtgagatagacccatgttttcatttgagtgaatgtgagtaccagggtacctgtccaatggttcctctttaggaagcactctcaggattcaaaatgagaataacacacgggtagccactttggctaagatccttaaatttttacattattagaaaagccacatgtataataaattaggtgatatgacaaatcctgaaatgtctccacctaccagtccaggatgggtggtcctgatcagcaggtggctttcctctatgtgatgattcacagaaccaggcccatttcatctcaaagctcagccaacctcttggaccacagaattcctcagattctagccaccagtagggggaaaaatggcatagaaaaagggcagctttacaggagcaggcgcctagaagtacctcgtatcacctttgttcacagcccattggctacaacttaaccacatgacttcactgcaaaggagtctgggaaatgtagtagagctgcgtgccaggaagaggagaacagtcagtggtctttgccacacctaccgttccatatgttcctaaaaatgaggaaggcactcagctattttggactggcttctagggctacctctgtcactaaggaattatgaaaaatttagcaagttctgacctctgccttttgtatgatttggtctcataaagctgacagtcttaaagaaaagacattaagtcaacacacaaataaatatatcattacaattttcagctaatataggctctaaaagagcttggaacatgcctctctggcacttacaacagtgcttagtgcacagtaggtgctcagcaatagttgttgaattaatgcatgcctacctccatggatgaatgaatgaaaatatatgagggggaaaaatagttgctgtaaaagaaagcagtaggggaatctaaattagtttggcaatcagggaaggtctttctgaggaaataatattgacattaaaacataaaggctgactaggagttagcaaaaagaagagttgtgtggtggacaacatttttcaggaagagggaacagcatattaaagcatctgagttgggaagagattaatacatttgaggagctggaaaacggccagagttataagaccccagagggtctgagtggtaatggcagaagtgaggctaaaaaaataggcaagggctgtatcaggcaaggtttataacgtatgtctagccttttggtctttccacagtcacgatgaaaagtataaggaaggaaagggggtgatgtgattatattttcattttaaaagatcatgctggctttctgtgaagagtaggttgaggtggggtaagagtagaagcagtaagtttgactagttgggagactattggaaatcatccaaataggatacctaaatcagtgcagtggtttaaaacaaggtggaagcacagcagatagacggatttgaaatacattttgtagataaagggaaattggagtagatgggtaaatacagcaataaagtcctctggctctgtttgtcattattctctttagagatgccattaaaatgactgctgccactaaaagtagacctttcaagacagttagtgttgctttattcagattcttttagaagctttgttccgactctcaagatttttcaaaaatcagtcaaatagcaagcatttaaacttaggctagattactgggattcttcaaaacttgttccaagttatattgtatttctgtttccctttgtcttcaagaaatagattaggtaagttgcataatcacagtgaagaattttgtatgtgtgcatgtgtatgtgcaaatgtatttttaagtgcccacacacattaactttaaaatatttttgttaaaaggtaaattttggacaatctttaatatttttctaatgtggtactgttggttctcatttttcaatttaatgttttaggaagtaattcaaatattctaatagtgttaattgaagccagtgttctgctctttcggagaccattctaatgattcaggtgtttattagaatgtttttttggagataagaacactgtgtacagaaggctggaaatttgatgtttttgcattccattctgctctcctctctctccccattcattcttgggttacaaacttatctctgtctgtatttatcatcttgaaatggacattatagtgatttcccagaggtattgagagagctatttcaatgtttataagtcagcttttaagatgacgtgcacaaaagaagattatgatcttgggattgatatatctgcaaaacggctgctattgcacaagtaagaatgctgtgagggactggtgaatttcctgtggggacgttatacccacgatcagtgaaatacttctggtaggttccctccctcaacctaaagatagagcctcatttctgtgactcttctggcaatagcatttacatgtgttaaatgttattgcaattttaaataatttatttgaataattttcatccaaaaggcactattttgagctacaagttgttggattaaattaaatgcttatttgcattctggagaaaaaaattgagggaattatgatttctacagaaaaaacttttggttgtttctgccaaacacattaatgtttataacctcattttttcatttcatgtctattgggatatccttcactttctttttgatatctactccagattaacttttacctacattctgttttaagattttttcaaagatcttttaaaattatttctttattttccattgctttttcctgtcacatagccacctcacttcaagattatgctatacgtgatccaaagcataggaaattgagggaaacttgtaaattcactttgttgctctgacttcagtttgtatgtggttgtaggataataatataaaaatgacatgtgtttgccttcaaattccaagctgtgaattgtaattcctggcaggtatttcacttattccaaaagtggtagttcacaacctagcaaaagaaaaaaaaaaactgaagtcttggataaagtcctttgcacaggagaacttgagagtcaaaagacttaaatttgtttcaagtttctccgttgcacggatcagccaagcagatctctgattacactgctttctggcacctggcacctgaaaatcttcacttcctgaaagccaagtgtttgaagacaaaacgttgaccttccaagcatctggatttactgccaaaacactaaataagaactacaagcagaaagaccatgagtcagatgaactcttcattttatttcaaggatgaagttccagatacatgaatcaactgtaaatagtgaaagaaatatgtgagtgtgagtgtgtgtgtgcatgtgcatgtttgtgtgtttttcctacttgtaaacatctgctttgttcctacttctccttttgagacacagtctttttatagtaatggtggaaattagatcctttcctttttcgacactgttaatcatcgtttgaatttgaagccagtatctctacctcaaaatagaatgaaaattcagtttcttagcctgtggcaccttcaggcactctgttagcattcaataaacatttattgagcttagagacagacactatactaggcccagaaggcaaagctgctgcaattggatgttctgtcctaatattagtaaataacataaaattagtgcactgaatcagaccctttgtcctgctaaaaccacactttttctattatagtagtactaggatatgtgttaatacagaatatagttattctttttactgtcagattaagaatttacctctaattcttcatgtacattagtaatttattatagttctactaccctgaatcatttgaatgtttaaaaattattttctattttcaacccaatcctactaatattagtagtacacccttttattgatcttacacttacctcttgaaacaacaatagatttctagtggataagctcattgtcatcttttccagaccattcaaagctttctagactttacgtcttcttttcgcaaacagaatgccccatatttttgtagtctgtctttatacagctacctccctattctccttagacacttcatatatatcttgtgagctgtggcaactagaattacaagtggtatttaagatgtagacacaatgtttttgtaaaaatggccacattttgttaatgtataattgcatttatgatatcatttacttattagcaataccttcctagtaagattactatgaggataaaacaaggtaatacttgaaaagtattagcacagtgcttgacatggtaaacactcaataaatgctaatagtcattactatttgattttgattttataatattttaatggccataccccatatgctagccacttttattttttaaatcctaggctttcctcattcaataatagaggatatgcttgagtcagatcaacattgctaagactcatttctgatcttgtttgtttcattcacttaacaaattaacttaattaatattccaggcattgagctatgtactggaaatacagctgccagaagggcaaggtctctgcatttatagggcctaccataaaatggaaaactaataataaaatttcattacgatgcaatgagaagtgcagaatcaatgggagaacacagaaggggaagctaacctaatacagggaccactgtggtttcctggaagaagtgatgttaaaactcagacctgggccgagcatggtgactcatacctataatcccagcactttgggaggccgaggtgggaagattgcttgagcccagaaatttgagaccagcctgaggaacacagagagaccctgtctctgcaaaaaatacaaaaattagctgggcatggtagcccacacatatatagtcccaggcactcaggaggctgaggtgacaggatcacttgagccaggggggtcaaggctgcagtgaggcatgatcatgccactgcactacagtgtgggtgacagattgcgaccctgtctcaaaagaaagaaaagaaaaaaggaaggaaggaaggaaggtaggaaggaaggagagaagaaaagaaaaaagaaaccacaaaacagcaacaacgaaaactgagacctgaaggtgagtaggagttagccagacagagggcgggggagggaggacaaaagtggaaagatcaccagaaggaatagcatgtgtaacacttggaggtgaaagaaaatactctttattgaggaactgaaagaaattcagcatgagctcagaactcatcaatgagttctcttcatccatccaatagcattcagccttcttagctggattttgtgaaatttggccctatccacccttcccattactttcctcacataccccacccactgttcctacatgcccaggtgtttgcttatttccttgactggaatgttcttcctcaaattttagaattcagggagcatttactgagtaactggtacatgccagacattgtgagctatcacccttccaatgtcttttcattcattcttttgatgaaaatttattaagcaccaacatatagagggtgccatgctacttttccagcactagtttaaatgacacttctgtgaaggtccccagatgcttcaactgacataatctcttctagttttcttcattctctgaagtcctaatatcctaaacgtgcctctcttctgtctgctgccactttttgtactgcatgacagctaagcagttaacgtgaatccgaaatctccatgagacttctgttctaggtggccaagtccagggatccaatctatcatcgggtaatgcccatcaccctgcattaacctaggagctgcaaagttcatagtaaatatccaaaggggtggatacatattctgaacctggataatggtgacgttattttggtacttcctaatgatccacattgccagaacaatgactttgtttcaaagtgatcatatctgaatctagtataatttctcttaaatgtcactatttcctgcaggattccaagatttacataaaaacctgatgggtgaatagtatgtttttacagattacacatctaaaatacttgaaactgtatcaccactgctatcagctccgtactatgcatttactcatgctttttatttattcttataatcatggtaaatcaaaaaagggaaaaaaacgaataggcttctacctgttgattgctaaaaataaaattcagcctcacctttagcatttcaattttatagtcctctacctggatttatagctaatatttttagtgattgcttatgcatttcctaggcacaccaatctaatttgtagcaggttctgtgattcatagtgactactagaattgaattctgcttgtctctatagtgaatactatagttaaggcttgattctttccaatgtatcatttatgtgattgaaagaacaagaaaaaaaaaacacttaacactaaagagttttttaaaaataccactgagggtcaggtgcagtggcttatgcctgtaatctcagcagtttgggaggctgaggtgggcggatcacttgaggtcaggagtttgagaccagcctggtcaacgtggtgaaaccccatttctactaaaaatgtaaaaattagctgggtgtggtggcacacacttgtagtcccagctacttggaggctgaggcatgagaatcgcttgaacccaggaggcagaggttgcagtgagccaagactgcgccactgcactccagcttgggtgacagaatgagactccatctcaaaataaataaacaataaaaacaaaaaataccactgaggaatccatgctaaaatatcaatatcaaacagctttgaattggagactcacaatacagtatatgtcttcagatacattgtctcacttcagcctccttatatctatccaaagggttttgatgagtttttcttgtcagccatttcagataatttactaaagccaacattcagagtgttcctatgagaggaaggcttgggacagggatgactcctcaaggaactgtggatttatttataggacttgggtggtctcagtaattcacctggtgagcttgctcaattttttctcctgttattggccaaccatcttccagctggattagtgacattctcaaatagctgatgtgatagagctgttgcaaattggcaggaagactttcaccttggaaacagcactttgcaaatgtccctgtgaccccatttcaatgtagttacttcccatgccttaccttagttaataatcctcgagcagttaccagttactgagtgacagtcgtgtactaggtacaatacattcattatctaaatcaaaactcaagatttctctaagtaagctctattattacctttatattaaagatgaggaaacgcttttagagaaaataagtcacagatgtaagtccatgctgttggtcactatgctgtacttgccagtgtatactcagaacacacgcagtacctttaatactaactgcaacaaagttaaatatgaaagttaatctcttgggaacattctaaaaacatacctcatatgggtacattctaaaaaaatacctctgaatccaaatgcagattttataacttatcttccatgtgggataatctatgttccactatgtatgtgtttagaaagtggactgtaaaatctgtaaataattttttttttttgagacagagtttgctctgtcacccaggctggagtgcagtggtgcaatcttggctcactgcaacctccgcctcctgggttcaagcgattctcctgcctcagcctcccaagtagctgggattacaggtgtgtgccaccacacccagcttatttttgtatttttcgtagagacgggatttcaccatgttggccaagctggtcctgaatgcctgacctcaggtgatccacctgcctcggcctcccaaagtgttgggattacaggcatgaaccaccgtgcccggcctaatttttttaatagggataataatattaagaaattcttttactaacacatgtagtttttcagaactccataatatgcaggcaatatatgatattcgattattaaatccagcaaaaatgtaaacccccgtttaagtagacaggtaagtaaactgctaggttcaagaggtgaccttcccacactctgcctacctactcaagcccttctctgaatcggttattggacatattcactgcctccttctctcttacataattggtgttactttagagtaaggggaagattagcatcacccaaacataactcagaccattccagcccaccaaggcctcctcccccacctcccacctccacttgcctgctcaaagatgctaagaatcctacttgcttaactttatctggtaaaggaaatggtggctaaaggcaaaactaagcaggtatttctgagtattatgttcacctgtattagctattattaaatgaaaaagaaaagttctcagataagcagactattgtgcattttacccttgtatctttcaatttactcatgtgtcttcactttttatcacagaaattatatggatattaatttctaaaaatatccaaagggtaacttctcatgttaaattgtgtcctcttttctataagtgtttaggtttactattaataattaataagacagtaatattcctgggagctggattgcccaagtattgttttaaccaaataactcactgtatttgagcacaataaaactcttactttgttagagtgtgaatgggccagtcctgccaggagactcataacgttgctatggaatagacagactttgaggaagaagttaattgttcatatatacaaagaaattaagtcttcattttacctattctctaactcgtcaactttcacattctacccttttaaatgagcacaaaagggaggctttacacacataaacacatgtttacacacacgtgtgcacactgagtgatattttattgtcaactgcttctcttgctgcagatgaatgaatcaaattatgtgaatatattttatgttcttgatagtaattctgtggtttgcattacaggatggtttatatgattatcaaatgttagcagtttatagaacccttttataaagttatagttataagttgcttttatctcttgaattagacatgtatcagttatgaattttatttccaattttagtgttgctaaaccataagcacagatgtcaatcctagaagaggtgaagtaagccactcatgaaagtgattcgtcttggttaagtcagtgaagactggctatacagtttggattttattttctgcacgtcttgctaggaattagaagaatagaagggttcttcttacggtaaatgtctgacaattgtgtcgttttccttctcctctttaggggaacagggtgctaaaaagacttgaaatgagctgccagtcaccattaaccccttcccttctgaacttccaggtcacggagcagtccccaaatgctttttactttcatattgaagttctcctagccctgccaggtttcctaaaccacatttcacagatgtcacaagtttcaatggtgtgttttttcttttgtaggtttctccaaaagagttttattaacaacacataaacttttagaatatacaggattcgttatttaaaatttcttcattataaaaactgaaacaaagagaagagaaaattatagttgttagatgttgaaatgcttttttaaaacatagtaatgccgttatctaaaaatttagtgaaatgatgttaatagtccaatagtctattttacgtaatctttttatatttgcatagcctttttttgtttgtttgtttttttgagacagcatcttgttctgtcacccaggatgcagttcagtggcatgatctcggctcactgcaacctccacctcccaggctcaagcaattctcatgcctcagccttccgagtacctgggactacaggtgtgcaccactatgcatggctaattttttatattttcagtagagacaaggtttcatcatgttgcccaggatggtctcaaaatcctgagctcagacaatccacccacctcagactcccaaagtgctaggactaggcatgagccactgcacctggtcctatttgtaaagtcttaatcaacatctttttaacccctaccatttctcctgtccattggaatcagataatgtaaggttgtcattctaaaaatactgaaagcctgtcatagcttgctttaacttttcttgcttttgtgtatttcccaaatatggtacttttttggtattgctcagcaacacttgtcaagaatttgaatttttaaaaaaacttgtcaaaaaacaaaatgtgttataaatcagtcagtttgctttcattgtccaaactgaaagagttaagaaacaatttcctttgagtggtaaaagtaatctatttttatttatcatgtaaatgtttatattgtaacacaatgtcttttttaatgagaaagcaaaaatatacttaaaaatcattagaataccaaccatttaatttttctttaaaatatttttataactttaaatggatacactaaatttttcatacatcactctccatttagacaaggaagactactaaacagagattttaggggaacaccatgagccattctccaatagaagtctatccaaatttcagtttctgaatttgagggatgaaattaggttatgcatttgggaaggaggggagacatcacatagctctgaatgaaaaagaatctgaagaatttcacactttcttccaactagctcaggagccacacacactgccatctttgtattgctagaatacacctttggacaatcattcaggaagtcctggccactattaatgaaacctctgctcagctacttgctttccagctttgctcataaaaattaaagtcagtagttaaaatggatgaaagagaaatttcaggagaattggctgacttcagagtctcaaactggcatctgtttgactccaaaactccaaagtcttctaagtagatattggctaagaaaaagatgaaagaagctgactgatgaaactgattcaagcactgaaactaaaaaggagagagtatgcagcaggatataggagaaaggctactaggaatccctcaacactagccagaatttagggggataatttactagcagtgacaaatcagactcaaagcacaaaaacagtcaggcaaatctagaaattacaatctttcagtagctgtttaaacagccaaattagtatccaaattttgcttttataaaaattcttttgtttctttgtttgtcttttgagacaaggtctggctctatcacccaggctggagcgcagtggcgtgatcttggctcactgtaatctctgccccccgggttcaagtgactctcatacctcagcctcccgagttgctgagacaacaggagtgtgccaccatatctggctaatttttttgtatttttgtagagatggggttttgtcatgttgcccaagctggtctcaaactcctgatctcaaacagtctacctcccttggtttacaaagtgctgggattacaggcttgagccactgaatgtggcctttatcaaaatccttattaagtcaaagtttaagcccaatatgttataatactgtcttgattaccaccaccaaagcagtgttaagagcattcaagtctaaaacagaacagaaaagtccagagaacaacactaatttatttctacagtgctcattttgttcttttatgagagtgtcatttctcagcatcttggacagtgccctttctttcttaataaaatggccagaattaaataaatatggctaacactctttctccactgtaaccacggctgaggcctaatgacaattcagggtagaatatctttcagtgctatggagtatgttgcactgttctttagcttagagaactgggattttcaaatcagcaccttaagtggaattttgcagcctgcatttttaaaacacctactgccttcctatccatttactgtacgtgtgtgtgtgtgtgcacgcatgtgtgtgttatgactggaaggagatgatagcaaatatcttcctttaaaatagtactatccaatagaaacaggatgcaagccacatatgtaattataaattttctagtagccacattaaaaaaggaaaaagaaacaggtgaaattaatctaaatatattttacttagtccaatatatcaaaactattatcatttcaacatgtaactaatataaaaagttattaatgaggtcttttattccttttttgtactgtatgcttgaaatcctgtgtagattttacacttccaacacatcttgatttgggctagccgcatttcaactgctcaatagccacatgtagccaatgactactggactgtacagcccaggtataaggcaggcacttctttgtacaacagtatctcatttgaaatgcctagcttctgatatttcagctctcagtttgaacatgtttttccttacacaagaaatccatatatatttcattctagattctaacacgtacacatacacacagacacacacagacacacacacacacacacacacactcatttaacatctgggttttaacaacctattctgatcttcttctaaataaacttgaaaaataaaatacttcctctcaccagccctttctgaaggagcatgtgagcctgttatcttgcgcattaaccggtgaccgtatttagtgctgtcagagctgctgactcattgcctatgaatggccccgctgccagtggtgattgtttgacagaatgccagtaatggctgcctacggctgctgaaaagctgaccttgtaacaacatccacattcttttggttgcttttgctgacatactctcaactcaaaaactgttttcaaaacaaaagtataatgaagtattgagcttttaaaagcaattgtatttcagttctttaaattatctgagtgtaccaaggagggcagaaggcaaagaaatgagtatacaagagagggaaccatccttgaaagttgacatttgagctacaggcatataatacttggggacagtgttctaagacaccatgggcatccaaatgaagcaaagctgtgtaaactgaaaataaaattctaagccccccaaccatcggaatggacccctcctctcagccaagagcattccagttaacctggaaaactagttcaggccgtgagaggaagtggggggtcagacatcctccctttggaattcaggcacaactgagcagcattaacattaaaacagagatcttaagactttttgtagcaataggtcaccaaattccagcctgatctagtatagcatcacctgacagacagcaggccctgaaagatatcaaagtattttactctaaattatatttctttgacatattttgaaatagccctgcaaagctattgcttgtggggaaaatctgcattctgtagagaatccccttccctttccaggtctttttcctgatccaggagagaatcgactaagagtctggcacctttttaagtctaataagaaacatttacaatctaatctctctgaagcctgttacttggagacttcatctgcataataagaaccttggtctccaaaaccccttatcttagcccagacattcccttctgttgattccaggtctttagacaataacttaagtcttccaaccaattgccaattagaaattgtttgaatctacctatgaccttgaagctccccacccccgctttgagttgtgccacctttcctgacccaaccagtgtacatcttacatgtattgattgatgtcttttgtctccctaaaatgtataaaactaagctgaagcctgactactttgggcacatgttctcaggagacagggctgtgtcactgaccattgcccactcatatttggctcaaaatttatcttttcaaatatttttcagagtttgactcttttgtcaacaactattatgatatctattttttatctttctcagtatcatttattagctctgtattactaacctatttgaaattctgtttatttgcaaaatgtattccattctccaccctgaaaacattttccccaagtggagcttctaaacaaagaatatgagatgctctccattaattaataagagctaaggtactattaaatacttaaaacagggatcaaattagcagtacttactagacactgctctagctagtggatacgttgatcattcacactatactcaactttgcccataaaacttagtgtatgccttccagctgcagtatgtattgatggccctgccttctgttagagtacaagtttttagattcttctcttttcctggtgatgaggtctgaaactcttgaatcttctaaattcctacttgggctgatatccctgctccctctttctggcttcttttaccccagagtctaatctgcactggtagtaaaatttcctttcagttcacatctcacacataacagccagagtctgttttgctaattttaatcagacaaaggatgagtttcgcatagatgagttttcaataaacaggatgaatgaacattcagctagttgttttggcatattttcaccactagagggagataaaggcgcctctccatccactgttcccaccctctttgccccaagataggagaggtgacagagttaagtgcagaggataatggtcagtgagatcatggagggaaattaagttatatatttggagaaatcaaaaatgtggcagctttcaaaccctgccaacatgttttatgtggcctacccagtttggggcaacatttataaattggaaaatttcacataaatatctggatttccaccctgagcttgaaaatagaaagatgtggccacactgtatgtctgcgcctctgtgtggcagtcagagggagcttctctctataaacaaggcacaaactcttcatttcaactccatcactatcactctctatttttctaacaccgagattaaatgtaagctgttacttattatcaagcttgcatcattttgttgttaagaaccggttgttgttttttttttttttgtactcaggtcaaagatggtaaaaagaataacatagcaagcaagcctcttgtaatttcaaggaaaatgagagagaacatatttcttggaggcagtaaaaaatattcataagagtaaaatatgcaggcacaatgtgactggtctccttgacttacacttacctatttccatcatttacatcagctagatgtccctatgagctttgcataaccctttggaaatacctgcttcccaaacatgatatggcaggaagaagataagggactgggcgatcctgggacccagtcaaataccttctctcagttgtccccactaactaatgactgagaaatgtctctcatgactgattacccaaggatttacaaaattgacatgtgagggacaaaaatctcagtctcacttaaaatagcaggaaaaacatatctgcatgtaacttatactcacagaagaattgcagaactaaaatttggatttaggtaggataaattccaacacacagctgatattctgatttactcatatcattgcttcttgatctgaaaaagaaatgataatataaatattagtaatcatagctaacatctgttgagttgacagttgtgtcaggcactgtgctaagtgatctcctttaaccctgaggaacaactgtgttattcaacctcagagatttgtctcaacaaccttaatatatgcccttccttttaggacaacggttctcaaaatgaagacactttcatgagattcttgaggttaaaactattttaataacaactctatcatattatttgcctttttcactatgggacagtcacacagatgtgcaaaagtaatggtaagtaaaactgctggaatctattactaggggttgaaggcagtggcaccaagctctactggtagtaatatttcttcactcccatgtacttccagtgaaaaacaaagcaagcaacagcaaaagcatgttattaagtcttgggagtgtaaatgacgttattttatttatttatttttactttttatttttttgagatagggtctcactctgtcatccaagctggagttcattggcatgatcgtggctcactgcagccttgaccccgtgggctcaagtgatcctcctacctcagtctcctaagtttctgggactacatacaggtgcatgccaccacgcctggctaattttttctttttttgtagagacaaggtcttgatatgtcttgctatgcccagacttgtcttgaactcccaggctcaagcgattctcctgccttggcctcccaaagtgttgggattagaggcatgagccaccgtgcctagccacatccttttaatagtgcaaggaaatgggaagtacacataaagcacttttgaaatatgttgaggtgcggtagttgtctccaagtattattgttcaaggtacaagtggtactagtcatttctttcatagaacattttttttttgaaagaacaatgggcagacaaactatgattatttcagcaggggtatttggcaaatgttttttgaaattgaatgaaataagcttgtcaccagaaaaaacaactgacaggaatttctgacaatgataaaattcaaactttcaagtagaaattagaattttgaaaagcctacatctgccactataaacttgacagcttctcaatacctttcttgatgagactcgtggtgacattaacaaaagtaattttttgttatcaaaaataatacgtaaacatttggaagatctgctttactaagtgagctagactattttgtcataaaatcatatatagatttttttaaaaactataccaagtatgagacaaataattgagtttactgtaatagattatatgaagttcattgatatgtttcagattccacattccatttttaaggaacaatcacttgttgaatttcactgttgtatcaaagaaaactgtccataataatctgaaaggctatgaaaagactctactatttcaaactacaagtctatgtgagcctggagtttcttcatatttgtcaaccaaaacatattccaatagattaaatgcagaagcagataggtaaatctggctatcttccattaagccagatattaggggatttccaaaaaatgtaaaaccatgcttatcaccaaaattttgttttggaaaatatttctattttattaaaaatatattattttatttatgtcacatgtaatgggtttatcattgtcacataaatgaatttatagaccaattcttttaagatgctccaatcacgtgctttattaagtcaattttaaacgtataatgagaatcaagggaggaaaggtggggtaggttaatgcacttagaatagtatgcaagtggaataaaaggaactccaccacctgaatgctgggttatacaatgtccatatgtcttgtttctgctacaccagccttccaaactggtggtgtggttgtggagtgagaatagggtttgaggaaggggcctaaacagacaggtggaaggtgtctggggtacaaacttgctctatcacagagacacaaggacaagtacacctatcaatagctttagctttccattagcttgccaagtagctttgggttttatctccagtgaatttataaataaatatttttaaagtttataagttttcatttctaatagggtaaatattgataggtataataaacataaacaaaagctcttggaggtcttcagaacaaaaagtttaaaaacctctgatgtaggatatgggatccctttttttaaccccaaagtagcatggcaatttattgaaaccaaattaaatgatttatcttctatcttctatcttcttcttcttctttttttttttttaaaggtactcatctccccagagtcagatgaaaatgctaagtcaagctctcagtaaccctcaggtggctcctaaggcatatgtcatatgcaaggccaccagttaaggtagaaatgcaccactaaagggcaagacctgagcattctttcccagaattagatgcttctgtctttttatgatttccagtaaaagtatctctttgtctaacaaagcaaccacccatattttgcacacaaatatttttttccttagggaaacaagatatacattacaaacaacaacaacaaaatattaagaatctgattttcatgctaagaatttgtcaatgaaattgtgtccaaataactgctacatttgtatacaaattttttatgaaaacaagatttatgattggggtttaatgcatattagagaagaattatttatatatatattttttattacactttaagttctagggtacatgtgcacaatgtgcaggtttgttacatatgtatacatgtgccatattggtgtgctgcacccattaactcttcatttaacattaggtatatctcctaatgctatccctccccactccctccaccccacaacaggccccagtgtgtgatgttccccttcctgtgtccatgtgttctcattgttcaattcccacctatgagtgagaacatgcagtgtttggttttttgtccttgcgatagtttgctgagaatgatggtttctagcttcatccatgtccctacaaagaacatgaactcatcatttttatggctgcatagtattccatggtgtatatgtgccatattttcttaatccagtctatcactgttggacatttgggttggttccaagtctttgctattgtgagtagtgctgcaataaacatacgtgtgcatgtgtctttatagcagcatgatttacagtcctttgggtatatacccagtaataggatggctgggtcaaatggtatttctagctctagatccctgaggaatcgccacactgtcttccacaatggttaaactagtttacagtcccaccaacagtgtaaaaacattcctatttctccacatcctctccagcatctgttgtttcctgacttttaatgattgctattctaactggtgtgagatgatatctcattgtggttttgatttgcatttccctgatggccagtgatgatgagcattttttcatgtgtctgttggctgcataaatgtcttcttttgagaagtgtcctttcatatccttcacccactttttgatggggttgttttttttttcttgtaaatttgtttgagttctttatagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacgtttaagtctttaattcatcttgaattaatttttgtacaaggtataaggaagggatccagtttcagctttctacctatggctagccagttttcctagcaccatttgttaaatagggaatcctttccccatttcttgtttttgtcaggtttgtcaaagatcagatggttgtagatgtgtggtattatttctgaggcctctgttctgttccattggtctacatctctgttttggtaccagtaccatgctgttttggttactgtagccttgtggtatagtgtgaagtcaggtagtgtgatgcctccagctttgttcttttggcttaggattgacttggcgatgcgggctcttttttggttccatatgaactttaaagtagtttttttccaattctgtgaagaaagtcattggtagcttgatggggatggcattgaatctataaattactttgggcagtatggccattttcacgatattgattcttcctatccatgagcatggaatgttcttccatttgtttgtgtcctcttttatttcattgagcagtgatttgtagttctccttgaagaggtccttcacatcccttgtaagatggattcctaggtattttattctctttgaagcaattgtgaatgggagttcactcatgatttggctctctgtttgtctgttattgatgtataagaatgcttgtgatttttgcacaatgattttgtatcctgagactttgctgaagttgcttatcagcttaatgagatttggggctgagacgatggggttttctagatatacaatcatgtcatccgcaaacagcgacaatttgacttcctcttttcctaattgaataccctttatttccttctcctgcctaattgccctggccagaacttccaacactatgttgaaaaggagtggtgagagagggcatccctgtcttgtgccagttttcaaagggaatgcttccagtttttgcccattcagtatgatattggctgtgggtttgtcataaatagctcttattatttttagatatgtcccatcaatacctaatttattgagagtttttagcatgaagggctgttgaattttgtcaaaggccttttctgcatctatttagataatcatgtggtttttgtctttggttctgtttatatgctggattatgtttattgatttgcgtatgttgaaccagccttgcatcccagggatgaagccaatttgatcatggtggataagctttttgatgtgctgctggatttggtttgccagtattttattgaggatttttgcatcgatgttcatcagggatattggtctaaaattctcttttttttgttgtgtctctgccaggctttggcatcaggatgatgctggcctcataaaatgagttagggaggattccctctttttctattgattggaatagtttcagaaggaatggtaccagctcctccttgtacctctggtagtattcagctgtgaatccatccggtcctggactttttttggttggtaagctattaattattgcctcaatttcagagcctgttactggtctattcagagattcagcttcttcctggtttagtcttgggagggtgtatgtgttgaggaatttatccatttcttctagattttctagtttatttgcatagagatgtttatagtattctctgatggtaatttgtatttctgtgggattggtggttataacccctttatcattttttattgcgtctatttgattcttctctcttttcttctttattagtcttgctagcggtctatcaattttgttgatcttttcaaaaaaccagatcctggattcgttgattttttgaagggttttttgtgtctctgtctccttcagttctgctctgatcttagttatttcttgccttctgctagcttttgaatgtgtttgctcttgtttctctagttcttttaattgtgatgttagggtgtcaattttagatctttcctgctttctcttgtgggcatttagtgctataaatttccctctacacactgctttatatgtgttccagagattctggtatgttttgtctttgttctcgttggtttcaaaaaacatctttatttctaccttcttttctttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagtgctttacttccaactatgtggtcaattttggaataggtgtggtgtggtgctgagaagaaggtatattctgttgatttggggtggagagttctgtagatgtctattaggtccacttgttgcagagctgaattcaattcctggatatccttgttaactttctgtctcattgatctgtctaatgttgacagtggggtatgaaagtctcccattattattgtgtgggagtctaagtctctttgtaggtctctaagggcttgctttatgtatctgggggctcctgtattgggtgcatatatatttaggatagttagcacttcttgttaaatcgatacctttaccattatgtaatggccttctttgtctcttttgatctttgttggtttaaagtctgttttatcagagactaggattgcaacccctgcctttttttgttttccatttgcttggtagatcttcctccgtccctttattttgagcctatgtgtgtctctgcacgtgagatgggtttcctgaatacagtacactggtgggtcttgactctttatccaatttgccagtctgtgtcttttaattggagtatttagcccatttacatttaaggttaatactgttatgtgtgaatttgatcctgtcattgtgatgttagctggttattttgttcgttagttgatgctgtttcttcctagcatcaatggtctttacaatttgtcatgtttttgcaatggctggtaacagttgtccctttccatgtttagtgcttccttcaggagctcttgtagggcaggcctggtggtgacaaaatctgtcagcattagcttgtctgtaaaggattttatttccccttcacttatgaagcttagtttggctggatatgaaattctgggtcgaaaattcttttctttaagaatgttgaatattggcccccactctcttctggcttgtagagtttctgcagagagatccgctgttagtctgatgggcttccctttgtgggtaacctgacctttctctctggctgcccttaatattttttccttcatttcaactttggtgaatctgacaattatgtatcttggagttgctcttcttgaggagtatctttgtggcattctctgtatttcctgaatttgaatgttggcctgccttgctaggttggggaagttctcctggataatatcctgaagagtgttttccaacttggttccattctccccatcactttcaggtataccaaccagatgtagatttggtcttttcacatagtcccatatttcttggaggctttgttcatttctttttatgcttttttctctaaacttcttgcttcatttcattcatttggtcttccatcactgataccctttcttccagttgatcgaattggctactgaagcttgtgcattcgtcacgtagttctcgtgccatggttttcagctccatcaggtcctttaaggacttctctgcattggttattctagttagccattcatctaatcttttttcaaggtttttaacttctttacaatgggtttgaacttcctcctttagctcggagaagtttgatcgtctgaagccttcttctctcaacttgtcaaagtcattctccgtccagctttgttccattgctggtgaggagctgcgttcctttggaggaggagaggttctctgatttttagaattttccgtttttctgttctgttttttccccatctttgtggttttatctacctttggtctttgatgatggtgacatacagatggggttttggtgtggatgtcctttctgtttgttagttatcgttttaacagtcaggaccctcagctgcaggtctgttggagtttgctggaggtccactccagacccttttggcctgggtatcagcattggaggctgcagaacagcggatattgctgaatagcagatgttgctgtctgatggttcctctggaggttttgtctcagaggggtactcagccgtgtgaggtgtcagtctgcccctactgggggatgcctcccagataggctactcgggggtcagggacccacttgaggaggcagtctgaccgttctcagatctcaaactctgtactgggagaaccactagtctcttcaaagctgtcagacagggacattcaagtctgcagaggtttctgctgccttttgttcggctatgcccttcccccagaggtggagtctacagaggcaggcaggcctccttgagctgtggtgggctccacccagttcaagcttcccagctgcagctttgtttacctactcaagcctcagcaatggcgggcacccctcccccagtctcgctgccaccttatagttggatctcagactgctgtgctagcaatgagtgaggctccgtgggtggggcgtgagaccctccgagccatgcgcaggatataatctcctggtgtgccatttgctaagaccattggaaaagtgcagtattaggatgggagtgaaccgattttccaggtgctgtctgtcacagatttgcttggctgggaaggggaattcactgaccccttgtgcttcccaggtgaggcaatgcctcgccctgctttggctcacaacaagccccagtgagatgaacccggtacctcatttggaaattcagacatcacctgtcttctgcattgctcacgctgggagctgtagactggagctgttcctatttggccatcttcaagaatgatgtttaaaaatgtggaattgcatgtgctcagtacaaatttaattcagaatatttgtcagaagtacggtactctgcatgcaaacgttttctctcctctccattcaccctgcttttcatgttactaatgtaactgatagagttcctacaaaatctttttttattttgcctttttgttctatatctagttttataaggttttatcctttcttcctttatttcttcattccttccttcttttctaattgaactttacatcatagtatcaacagacacagttataccagatcacactgtatcagtctcttagaagtgtgcagtgggcttctctaacaaatgaatgcatggaaattatgagcaaaatcatgatcacatagtatcagagagatttcaatacactctatggtatacctgcttgtaggtaactacaaatatggctttttaaaagctagttagactaacctttgacacatttttacttaacctgcaaaattcaatttaattctttttttggccaatttggtgggtataatgagatgcaggagacaaaagactgcacttgggtaaacattgttttcttgtcctgatcagcaaaaatacgtgaatctttctgccttacttggaattaatttcaacatggagaacataaagctttaatgagattcatcactgtggggtggcatttatctatacttagttttagtttcatattgccctacttatattcataaaaggagattttcatctaagaaaacctgagatacttaggtttagtgattatttgtgtaggtaaatacacaatgagactcactggtttctcaactgtattttttaaaaagatacaaaatgagataatcactccctttaaaagtgtattctaagaaagtgactcctatttttctgatattttgggatacctgaattttgtacagtagcgatttctataacaaaataaaccttaatataaaaataaaatagtgacttactgctttaccttgaaatgcagctgacatgtgttctgtgtgaatgtgtgtataaagtacgtgaataaaggagcgttcagccactactgatgtctcatatcttcatatgtatcatatcccttagtgagcaagttgaataaaaataatttcatagccataaacagaggaagtattcatgctgaatatgtatagattgctaataataggacaaaaaagtttcaaatattaaaacaaaattatatatagtttacagttcttcaactacttccttaaaaattatatggtatgtatatatatgcacaaacatatgtctgtgtgtgtgtataactggaagtaaatgtataaaatcttcatagggatttcctgtggggtggaatgtgggtgatactaattttcttcacaatttattatattttccacatttcctaaaaggagagttactttgatcaaaacacacacacacacatacccgcagtttaaaaactccatgtttcttcttgtctcttgatctatttttaataaaacttgatttttaataagtattaccatgtaagccaattatttttacattttatttgtttgttttttgagagaggatctcactctgtcactcaggctgaaatgcagtggcacaatcttggctcactgtaacctccgcctgctgggctcaggtgatctcccacctcagcctcccaagcagcagggaccacaggtacacaccaccacgcccagctattttttgtattattagtattattattattattttttctctatacaatttctgagatacttacgtaaacttaatcactggggttttgtcatgttgcccaggctggtcccgaactcctgggttcaagggatctgcttgccttggcctccgaaagtgctgggattacaggcatgagccaccttaccttttaaaaatgcaagtatcatctcgataagcaactgtcttaaccttacaataaaatgcaacagaaagatacgcagagccagtccttcagaaaaaaaaaaaaaatgctgtgcaagaaacagctgataaatcctttttaaaccaccttcatttttctcagcacctttaaaacagttgactggatacccaactgaactgatattgacaggcaggccatcatattatttcttaagtgttcctgaatgtcagcaggtcttcggctttgtggcgtgaaaaattctacattcattgctgaaggtatatatttttttcctgttgacagctattttgtccaaatattgttctctctgctttatcttactttaacctaagtgataaggtacaactttttatccacttctattgacgaaatatcaagaataaaaccgaattctctgctactatcttatacttctcaaatatcttcttgctgtcttgttaaattttatcagagataagtattaaagtaggcaactgaaaagtgaggcacagcagtggcctatatggatacccagaattgtgaagtacacacatgtttctgcaatcactgggctgtgatttgatggaaatgaattatagatgcacaaccccttctgagattagattaatttccctgattattagtccaaagatttaaaaacttcacagaaatgaggttgccgcccagcttaggagctgatgcagccagtctcaaaggcactttccttggggcccagaatccctaatgggagaggcctgcctgactgtgtgatcttgcccttccgcaaaggtgccacactggatgtgaacaactaaactgtcacagccacagcccctttatcctaggggcttgaagaaataagctatgcccttaataggaagtaaagacatccaagaccttcctgcctctcatactgtgctgtgtgtcaacaaaaataagtccttaaaatagagaggatgcctaagcatccaatagcactaattctgtttccagcttttaagtgtccaaaaaggcccatttgccagccatcctctccctgactctgacttaattaatatgcttgtgtctggggtgattctgggtttagtccaagggccatgattccaaatccattttactacaactttctaagccactttgacgttcttaggctgataactaataatctggtgaaattatttgaataagtttatactgccactctgtacaggaaccagatgtgaaaacatgagctttgtgtttgctaactgttccactatcaatcatttattcaaacaagcatttagtgatgattgctattcatcattaaagattatgtactagagatgatgaagaaacaagcaataagtccctgcccagagttgcacgtattcttataaagggataagaaaattcatggtaattttaaatgataacaggtgctgcaatgaaagacctccaagagtggtgtggcagcactaaggactggaatacagagagggtctaagagcacagctgggaggggcaggaaggaattcacgtggtatatagagttggaggaagcttcaaaagggaagttagacttaccttgttcaacttcagaggtctggatgggacctgtggtaaaattacataatagaattaggactcaaaggaactcggaccacctaccagggttcctcaacctgggtactatcaacattttggactattcattatttggctgggggttggggggcagtagtcctatgaattttcagatgttcagcagtatcctgacctgtacctactagatgccagttgcacgtacccaccctgcacaaccaaaaatgtctccaaacattgtcatatgtcccctgggggcaaaatcaccctgattgagaaccactggacaaaagtcataccctcaaaagaagtcctggagagcacctttttattcctccttttaatatttaggctacccgttcttgaataataatgaaagtagctaaaatttctgcttggattccttatatttttagggtgaataaaataatcatgaattcttcagattgtgatgatgaaattatttttaatatggtgcaagttcacaagggtaagagaaaggaaattgaaccaaatatttataagaaaaagaagacaaattttaaaataagaaaatgtaataggatttttcttttactacattcttgctagttaatcttgtatttcaccctaccttgtttattctaaggtatgtataaataaaatcatcatctagaagctttaatctgacttgcaaatatttgtgtgaaagaaaaatccaaacttcttagatttaaatttgatggcaaccaaaaatatacattcattcatacatctgtttgttcgtgcaataaatattactgcaggcatactatgtgccagccaccattctaagcatcaggtgcacaacaatgaaaaaagttcctgcctttgtggagctatattctggtgtgaagagacaatgaataaataatacatcaggtagtggcagtacaggggaatatatcaaaataaacaatagagagtgagtacagagtgctatttatggtagaaacatcagtccgagcataaataggaataataacacgaatgttaactcttctccagtctaatatttgtctaggtcccacagaatctgggctgagaggaccacatatcccaatttgtaataaacgtgtatgctttaccaaatcctaccactacaaatgattattgagcctctgtttaaattgatatcattggtatgaaggtcactacctttttaggtggcccattctgtttttgtgtcctccaatttgagggggtcctcttattaagcaaaaatgtgactcctgcaacttccatctaacctacatgcctaaaatgcagcacccaaaatgaatgaaatacttctttcttttatggtactctgtggtaagacactggttcctagctccaatccagaccctggatgaaagcttttctgggagcttagtaaagaatacagtatttttattttataccatgacactaaattttaatttctagtcacaagttagccaacctagaatttacgttagctgacctgtaatttaagtaagaacttaaagagagaaggggccaggcacggtggttcaatgcctgtaatcccagcatgttgggaggctgaggcaggcggattgtttgagctcagatgttcgagaccagcctgggcaacatagcaaaatctcatctctacaaaacatacaaaaattagctgagcgtggtgctgagcacctgtagtcccagctactcaggaggttgagatgggaagattgcttgagcctggggagcttgaggctgcagtgagccacgatcatgccactgcactcagtatgggtgagagagcaagaccttgtctcaaagagagagggagagaatggagaaaggtataatttgtattcccacccaatgttcatgtgacaattttgctttccaagtgtccagtaggctgcaggaagagtatagtaggattgatgcctttaattcactagcagcttgggaagctgccaccctcaggtgaaagaaagagtagaaagaattgagggtattcagctctgcatactctggagttgccatgcaggatagaagccaagaatggtagggatggatctgcctccagattagacaactaacttcttttaatcactatctgtgatatatggggtgaagtggggccacttcttagtagaaaaggaacagcagaatttaaagctgccttgtgatccgtagaccacccaaggtgtaaattttattagtcatagatcctggtcaagatgtcaacctggaccacccatggggttctttaacacagtgtctccatctgagcattgtttaggctccctccaaatctattgcagtctggagtaacccattggatctggacaaaaaaaaagaaatatgcaagtcatccttcccaaaattgtcaggtacaggaacaacaaccagcagccaaatcctaagaggtccctaggacaataccaagtgatttctcgagtgattctacattgccagatagagctggatataagtttatctcactttattatatacatagatatagcctaaggtgaaaatataatactttagattatatgcgattttcatttatttccaggtgctgtggcttagagagctgtgttcatgaggagaaatattttaatatataatttattctcagatacataggtctaatctactccgactccaatttttttttaaaaaagcatgtactttaagaaacaaaaaatatctgaaagtactactgttgtaataatacatttaattcaaagaatgtcaaacagaagatgtatatgcctagaatcatagcacagggaaagactgttgggtctgaatgtcacagaacagtggttaattgtgtagtgaaagtctctttatatcctattaaattgtattaggtcattctcactctactataaagaactgcccatgactgggtaatttataaaggaaagaagtataattgactcagttccagatggctggtgaggcctcaggaaacttacagtcgtggtgaaagtggaagcaaacacatccttcttcatgtagcagcaggagagagaagtgccgagcaaagggggaaaagcccctatactatcacaagaacagcatggggataacagcccccatgagtcaattatctcctattgggcccctcctgtgatatgtggggattatgagaactacaagtcaaggcggggacacagcaaacccgtatcataaataaacctcacgtaatgaacatgtctgagaacttagataagaggaaggggaagattttgttatagaattttctttagtacctcaaatcataggaagcctgaacccagtcatgaaagctgaaataattattgtgttcattttagataacctgggttgggagaggaaagcatggggtgggagtcagaagcagaaggcacccatcacccagcaaaggtgcagagctgggttccttccatcccttccctttccacccccactgccaccagatgccttgtcccttttactttactgtgtccctcctccccacacttttccttcatcttaacatgagatttcctaagcttcaaatttttgctgcttcaagccatctggcacctgggatagtaacacgcagcctgtgtgttcacagggagaagcaaggaagaaagggtgaggaggaagagaacactggggaggactggctgaggggagatgatgagtggagtgcctgggtcactcccagccatagggtcagggatcttgggcattggggcgggcagtctagagcttgtctctttcagttctcatttagaaattttctcagaaggcaaaagcttataaaaccattcagcttagttaagaaaaattaacagccaatcttatgaaatatttacaatttatgttattactacacaacataattatatggattattaagtaacattaggttgcctttgtagtccaccttgttgtagtccactcttacagggtatctactaatgactgctcaagctcaatccatcagaggaaatgttagtctgaggactctgatcttagcaatactttacttggcttcagtaaaaattatgtcaataaaatatcccagaaaactatctacttggaaaacaaagaagattccatgtttttccatttctggtttttcagtcaactaaatccatagagctatatcaggaacccaatgttccaggcaactatcattaaccagcttttaaatcttggatgatcacttaatccctctggaactcactgtcctcatctgtgaaatgacttctaccataaatgtctgttattataaatatttcttatactaaatgaaaagcaaggttctaaattgcatacgttattaatagaggataaggggatttataaaataacgtatgttctagatctgccaattctggcttcctgtttgtgtaataaatacagaagtgtgaattgcttagctaaataaaagtctactttctcgttgcagataaataggatttaccaatccttggatgaagtgcttgggaagtctttaagtgccataatcaactgccatttcaaagaatatagatggttttgaaaagttcatgctgtcccttcattgaattttaggtgagtgtgtttaagacaaagaacttaagatgaatattgaactgtttctctttagagtgctcctctcatttgcctgaaaagaaaatgggtttaaatattatcaatgctgaggtggagcaagatggctaaataaatattatcaatgcctttcagtttcgtacctttagtgaggttccagacaatgaaagacttaccgtctttttgtttatttattgttattattattattatcagaaaccatctgaactgtgagctatataacataaagattgtcttgaccgtcacttcccagtttctattaagcaaatgccataatacttcattctattctaaaggttatataatttgtaaaatataaaatgtatttaatatcagtgtaataaaccagaatgagacaaaatttttgatggcataaactgaaggaaaatttgatggtgataatagtggcttaatcactaatgaatctgtgtttgagatcgggataacgttttagatgcgcttattgggaggttttgcttagaattaaaagtagggcatggttaagggcaggtgtgctaaatttttaaagtgctatgtacagttaaacacaacacacacacacactcacattaagctttgttttgtctggccatgaaatgaatgaataaatatattttacatcatcatatgtcatcacccttccatgtcagaaaagagaagagcctaaaattggtggtttaatattagtctgatatatgccattgccatttttcagcagaatagaggggaatggagaaagtgagtggtggtcatattgaggatattgtgtggctttccacctcctcctaagtctagttttcaaagtgtggctttattatgtactttgaagaaaggtgatcttcagaacaccagcatatacctatgtttacaattccaataaaataatgcagctgacagagcattggccactgtctaaatctaatctgaaaggcagagatgcttccttaatacttttgattaacttcaaaatgatggcaaataatgctttcataaacttacaggtgtataaatttggtttatagagattggatttagaactaaaatggtaattctatttatttacaagatgtgtgttgaatgcagttcccagaagctaaacttggtgcccatcaaaaataccagtaaatcaatttgcctagtgtaacagttactctagaagaaaaaaatgaaaatgaaaaacttattttctgaatcctttattttccacttgtgcccatctgtgcctgttaccttcagggccattccttgccctgccctgcctctctttattccacagggactgaccctatgggctgtattttccagccagagcctctcctcccctcctacatgttacctccagcttcttccagtgacctgaaccctgaacctcattaacactacctcttcccttttgtcccttgagaatcatgagtgatagtgcctttggcttcctgaggctgctgatcttcaatttgatccaccattcccaatttagcttctcaattctttcatctttgtaaccatttccttgtattaaagttcatcattttaaatacttagaatgttttcttttatcttgattgaatcgtaactaatctatcaatacttcattaatttcttccaaaattattggaagaaaatgaacatggattacttgcttcttaagaaaacaagtgattcctaagaaattaaatttaaatgtaaagttgggcagggtgttttttacttttaaaatactttatactaagacattgagatataatatacatacaaagaggtcacaagtaagtgtatatctcaatgaattttcacaaagtgtatacttcccatcagatcaagaagtagattaccaatgcccccagaagtcctgctcacgtgagcttccagtcattcctcccacagaggaaaccatcatcatggcttatgtgacaattaactaattttgcctattctagaactttatctaatggaatcatgcagtgtgtcatttatttattaatttagtaaaatttatttgagagcaatttaggtcacccaaaaattgagtagaaagtacagtttttatatatccccctatacacaacacacacacacacacacacacacacacacacacaccccacacacacacaccctatggacatcctccaccagaatggtatatttgtgactatcaatgaacctacattaacccatcatcacctgaagtccacagtttacattagggtacattcttggtgttgtgcattctatgggctttgacaaatgcataaatgacatgtatccaccactgtggtgtcatacagaatagtttcactgccctaacaatcctctgtgctcttgcctattcatccctcccctgcacctcacccctcatctttttactggctccatagctttaccttttctgagatgtcatatagttgaaatcatacagtgtgtagccttttcaggttggcctctttcactcagtaatatgcatttaagtctccttcatggcttttcatggcttgatagttcattttgttttagtgttgaataatattccactgcctggatgtaccacatttaatttatctattaacctattggaggacatttttgttgcttccatgttttggaaattatgaataaagctgctataaacatcatatgtaggtttttgtgtggacacaaattttcaactcatttaggtaaatattttaggttggtgcaaaagtaattgcggttttgccattactttttgatttaattacttttgcaccaacctaataccaaggagtgtaattgctgaatcataggataaaaatatgtttagttttgtaagaaactgccaaactgtcttccaagttaattgtatcattttgcatttccaccagcaacaaataagtgtcctgttgctccatatcctctccagcatttgatgtcagtgttttagaatttggtcattctaataggtgtatacttctgattttaatgagcagttccctaatgatgttgaacatcttttcatatggttactttctaactttgtatcttctttggtgaggtgtctgttccgatctttggcccattttttaattgggttgttttcttattgttgagtgttaaaagttctttgtatattatggctaataatcctttatcacatgtgtcttttgaaaataatttctcttatttctgtcttcgcttgtcattctcttcaaggtttgtttttttaaaaactgaaaaaaaattaaacttaatatatttaaagccatatcctcagctatacaatattgtaacattaatttgttgctgttaacacaatcattgtcaagtttcccattttgcatatcaaattaatgggaagatttttaaattttcaggtatatcccaagtattatttttatttttaaaatatccacatttcacaaactttactatgtacagtataagaacttcttagtctcattccaatttaaatcagtctcattccaacattcacatttaaatctaaagcttctgatttactttattttggttcttttcacctgcagttgagagatctgacctctctcttttagtaatggttgtttgctacttgaagatgccttatgatctgaacatttcaaatgtcctgtaataaatactggttgtattggaaagcaatgtgatcaggatcccagtgtctgtctttcttgataactaatcaattcactctgtctcaacaattccattcattctaaagagattccttggtattaaagtcgcttttcacttaatcattttggtacttcacttagttattttaaatggaagggccttgctattttcatttccttctcatttatttatgtagtcatgttccttttcaatcttttctcagaggtcatctcaactgctcatctgtccattttaatgtactgtggttggactctgaaggacatgatgttccttctaccaacaattttcatctattcaaccaatgtcaatgttgaacctgcaatgcctaatttagaatcctttcagacaatgcgcaaatgccatcatgaacagaatttctaaaactccttcatcatcctaaagctgggagacacaggtatgaggagctttatgatacagtttaagacaatgaataacttatgttgccagtacaagtcttccccttatttgatacagctctaaaaattctaatcattaacatttttctccagcttttggaaataggattttataaaattataatttaaaaaaatacccttgggaagaaaaatgcacccattaattatatatactacataatatgtaaatctaatgaattagcaaggaagagacccctgaaacaatggtacaaacattcagcattggaagttggggtacacatatgtgggaaatgatctcaccaactttatgatgttgcctgtagggtcaagggaaacacctgacatcaaagataactcaggctgaacagatcttaatgtcacgttgggagagagggatgggaagagtggaggtattagtcattacaataatgaacaacattgtgatgggagatttttatgtatatatatactttaggttctgggatacatatgcagaacgtgcaagtttgctacacaggcatacaggtaccatggtgctttgctgcacccatcaacccgtcatctacattaggtatttctcctaatgctatccctccccttgccccccatcccgcaacaagccctggtgtgtgatgttcccctccctgtgcccatatgttctcattgttcaactctcacttatgagtgagaacatgtggtctttggttttctgttcctgtgttagtttcctgagaatgatggtttccagcttcatccatattcctgtaaaggacatgaactcgttctttttttggctacatattattccatggtgtatttgtgtcacattttctttatccagtctaacatttatgggcatttgggttggttccaagtctttgcttttgtgaatagtgctgcaataaacatacatgtgcatgtgtctttatagtagaatgacttataatcctttgggtatatacccagtaatacgattgctaggtcaaatggtatttctggttctagctccttgaggaatcaccacactgtcttccacaatggttgaactaatttacactcccaccaatagtgtaaaagcattcctatttctccacatcctctccagcatcggttgtttcctgacttttcaatgatcgccgttctaactggcatgagatggtatctcattgtggttttgatttgcatttctctaatgaccagtgatgatgagcttcttttcatatgttttttggccgcataaatgtcttcttttgaaaaatgtctgttcatatcacttgcccactttttgatggggttgcttttttcttgtaaatttgtttaagttccttgtagattctggatattagccctttgtcagatggatagattgcaaaaattttctcccattctgtaggttgcctgttcactctgctgatagtttcttttactgtgcagaagctctttaattagatcccatttgtgaattttggcttttgttgccattgcttttggtgttttagtcatgaagtctttgcccatgcctatgtcctaaatggttttgcctgattttcttcttgggtttttatgattttaggtcttacatttaagtctttaatccatcttgagttaatttttgtatgaggtgtaaggaaagggtccagtttcagctttctgcatatggctagccagttttcccaacaccatttattaaatagggaatgttttccccattgcttgtttgtgtcaggtttgtcaaagatcagatggttgtagatgtgtggcgttatttctgagggctctgttctgttccattggtctatatatctgtgttggtaccagtaccatgctgtcttggttactgtagccttgtagtatagtttaagttaggtactgtgatacctccagctttgttcttttggcttaggattgtcttggctatacaggctcttttttgtttccatatgaaactgaaagtagttttttctaattctgtgaagaaaatcaatggtagcttgatgggaatggcattgaatctgtaaattactttgggcagtatggccattttcacaatattgattcttcctatccatgagcatggaatgtttttccatttgtttgtgtcacctcttctttccttgagcagtggtttgtagttctccttgaagaggtctttcacatcccttgtaagttgtattcttaggtattttattctctttgtagcaattgtgaatgggagtttgctcatgatttggctctctgtttgtctattactggtgtataggaatgcttgtgaattttgcacattggttttgtatcctgacactttgctgaatttgcttatcagcttaatgaagttttgggctgagatgatggggtttcctaaatatacaatcatgtcatctgcaaacaaagataatttgacttcctgtcttcctatttgaatacccttcatttctttctcttgcctgattgccctggccaggacttccaatactgtgttgaataggagtggtgagagagggcatccttgtcttgtgctggttttcaaagggaatgcttctggcttttgcccattcagtatgattttggctgtggatttgtcataaatagctcttattattttgagatatgttccatcaatacctagtttattgagtgtttttagcatgaaggggtgttgaattttattgaaggccttttctgcatctattgagataatcatgtggtttttgtcattggttctgtttatgtgatggactacgtttattgatttgtgtatgttgaaccagccttgcatcccaggatgaagccgacttgattgtggtggataatctttttgatatgctgctggattcagtttgccagtacgttattgaagatttttgcatcaatgttcatcaggaatattggcctgaaattttctttttttgttgtgtccctgccaggttttggtatcaggatgatgctggcctcatgaaatgagttagggtggagtccctctttttcttttgtttggaattgtttcagaaggaatggtaccagctcctctttttacctctggtagaatttggctatgaatccgtctagtcctgggtttctgttggtggtggtggtggtagactattaattactgcctcaaattcagaatttgttattggtctgttcagggattcaacttcttggtttagtctcgggagggtgtatgtgtccaagaatttatccatttctcctagattttctagtttatttgtgtagaggtgtttatagtattctctgattgtagtttgcatttctgtgggatcagtggtgatctcccctttatcatttttattgtgtctatttgattcttctctcttttcctctttattagtctggtagccatctatctattttgttaatcttttcaaaaaaccacctcctggattcgttgattttttgaagggtttttcatgtctctatctccttcagttctgttctgatcttagttatttcttgtcttctgctaacttttgaatttgtttgctcttgcttctctagttcttttaattgtgatgttaaggtgtcaattttagctctttcctgctttctcctgtgggcatttagtgctataaatttccctctaaacactgtatagctgtgtcccagagattctggtacattctgtctttcttctcattggtttcaaagaacatctttatttctgtcttaattttgttatttacccagtagtcattcaggagcaggttgttcagtttccatgtagttgtgcagttttgagtgagtttcttaatcctgagttctaatttgattgcactgtggtctgagagactgtttgttatgatttccattcttttgcatttgttgaggagtgttttgcttccaattatgtggtcaattttagaataagtgctatgtggtgctgagaagaatgtatattctgttgatttggggtggagagttctgcagatgtctgttagatctgcctggtccagagctgagttcaagttctgaatatccttgttaatcttctgtctcattgatctaatattgatagtagggtgttaaagtctcccactattattgtgtgggaatataggtctctttgtaagtctctaagaactttctttatgaatctggatgctcctgtattgggtgcatatatatttaggatacttagctcttcttgttgcattgatccctttaacattatgtaatgcccttctttgtctttattgatctttgttggtttaaagtctgttttatcagagacgaggattgcaacttctgcttttttttttcttctttctgtttgcttgataagtcttcctccatccctttattttgagcttatgtgtatctttgcacatgagatgggtctcctgaatatagcacactgatggatcttgactctttatccgatttgccagtctgtgccttttcattggagcatttagcccatttacatttaaggttaatattgttatgtgtgaatttgatcctgtcatcatgatgctagctggttattttgcctattagttgatgcagtttcttcatagtgtggatggtctttacaatttggtttatttttgcagtagctggtactggtttttcccttgcatatttagtgcttccttcaggagctcttgtaaggcaggcctgatggtgacaaaatcccttagtatttgcttgtctgtaagggattttatttctccttcacttatgaagcttagtttggctagatatgaaattctgggttgaaaattcttttctttaagaatgtcgaatattggcccccactctcttctggcttgtagcgtttctgctgagagatccactgttagtctgatgggcttccctttgtgggtaacgcgacctttctctctggctgcccttaacattttttccttcatttcaaccttggtggatctgacaattatgtgtcttggggttgctgttcttgaggagtatctttgtggtgttttctgtgtttcctgaatttaaatgttggcctgtcttgctaggttgaggaagttctcctgaataatatcctgaagtgtgttttctaacttagttccattctccccatcactttcaggtacaccaatcaaacgtagattttgtcttttcacctagtaccatatttcttggaggctttgtttgttccttttcattcttttttctctaatcttgtcttcatgctttatttcattaagttgatcttcagtctctgatatcctttattctgcttgatcgattcagctattgatatttgtatatgcttcacaaagttctggtgctgtgtttttcacctccatcaggtcatttatgttcttctctaaactggttattctagttagcaattcctctaaccttttttcaaggttcttagcttccttgcattgggttagaacatgttcctttacctcagaggagtttgttattacccaccttctgaagcctacttctgccaattcgtcaaactcattctccatccagttttgttcccttgctggcgaggaattgtgatcctttggagaagaggcgttctgctttttggaattttcagcctttttgcactggtttttcttcatcttcatggatttatctatttttggtctttgttgttggtgaccttcagatggagttttgggtggtcatttttttgttgttgttgatgttgatgctattgctttctgattgttttccttctaatagtcaggcccctctgctgcaggtctgctggagtttgctggaggtccactccagaccctgttttcctgggtatcaccagtgaaggctgcagaacagcagagattgctgcctgctccttcctctggaagcttcgtcccagaagggcacctgccagatgccagccagagctattctgtatgaggtatctatcgaaccctgctgggaggtgtctccccatcaggaggcatgggtgtcagggacccacttgaggaggcaatctgtcccttagcagagctcgagtgctgtgctgggagatccactgctctctgcagagctggcaggcagaaatgtttaagtttgctgaagctgcgcccacagctgccccctcccccaggtgctctgttccagggagatgggagttttatctataagcccctggctggggctactgcctttctttcagagatgccctgcccagagaggatgaatctagagaggcagtctggctacagtggctttgaggtgttgtggtgggccccacccagtctgaactcccagtggctttgtttacactgtgagaggaaaaccacctactcaagcctcagtaatggtggaagcccctccctccaccaaacttgagagtcacagatcgacttcagactgctgtgctgacagcgagaatttcaagccagtggatcttagtttgctgggtttctttggggtgggatccgctgagcaagaccacttggctctctggcttcagcccccttcccaggggagtgaacggctctgtctcactggctttccaggcaccactggggtacaaaaagaaaactcctgcagctagcttggtgtcttcccaaatggccgcctcattttgtgcttgaaacccagggcccttgtggcacaggcactcaagagcatctccttgcaaagaccatgggaaaagggtagtaacttggcaagatagcaccctccctcatggcaagttcctcatggcttcccttggctaggggagggagttccctaacctcttgcgcttcccgggtgaggcaatgccccaccctgcttcggctggccctctgtgggctatacccactgtctaaccagtcccattgagatgaactgggtacctcagttggaaatgcagaaatcacccacctgttgcgttggtctcactgggagctgcagactggagctgttcctattcagccatcttgccacaatgggagattttaaataacttgttctcaagtaattcagataggtgattttaatcatgatgtaatctcaagtacttctgttgaaccacagagtatgtgagaaaacccaaatgtgtttaaatgcagaaatcatcttttatccatctttgtattcctggaaactaacacagtgcttggcacactattaatactttctaaataaatggctggtgattaagggcaaaggcacaaagcaatgctggctaatgcttactgagttcttattttatgcaagaaattgttctatattctccctttcatgcctaaacaaccctataacataggcactatttttatctccttttttaaggattaggaaactcgggttcacagaagttaaataacctgcccgaggttaagtaggttgaaggtgaaaattcaagtccagatagtctggcttcagggcctgagctcctaattgtgatgctccactgcctcttaggtaaaataatcaccaagtaattttaaaacacaggagcaacattttgtattacttaaaaacattctgtcacgtcatatagcacacctatattaacagacctgcccaaatcatgaacactcactttgaacagaaattacttcttttctgtattcttcctctcctttccttttaaaacatgaccgactaaactaactttctaacttatgttcagatctcatcattttcattcttcagtgatttgttctatctcaaatatgccattgctccttttacaagattgcttacggatgtgtaattttgagcaagttacttaacctctctgagcgtcagttgaccaagctgaaaagataagtctattttacttcaaggactaggaaacaatacctataaaacaaagcacagtggagttcctgatgcattgcatgtgtgaaacaagcagttgaaaatatcatccaagtactctcatccactttggtttcaaagccagcattgactgccccatcagaagaaaatctgtgttctgtattccttagcatgtcataatactggtacaatggacctcttgggtctcactgcctacctttgcttcccatcagctgatctttgctaatatagggatattttgtctttcctaagccatgctctttgttcctttacttttgcacatgctgattcttctgcctagacactcctcccatccacacccctccctaaatccccttcatctgcatgcactcatgtactcttacataacttgcaatatgctagtcatctttcaatatccagcacagctgctgctgttaccatttcactaaagtcactgatgaacttctcatggatcatagttatgtgtcctatctttgaatgcacatagacttttgggttatttgtagggtatcagcacctaatgtagacaacagaaagaaaatcaaccttcattatcaatcacagcaccatatcttagcttctcatgttatttctctttttcttctgaatttttcatcagagacaaatgccaagtctcctcctctttgaagttcctataccaagttcagaagtagtcttcctttctggttttgaatgaactagggagggtcatattttgagataaatttgagttccttcagtgtagttaagatcctaacactttatccagccattagaagtaaaagaagagctccgttctggggaaggaaacctcacagagggggtccgtggcactctgtgccaagcaccaaagcagacgttccatgaacattatcttatttaatcttcataataaccccacaaattagctattattatccctgttattccgagaaaaaaaactagggttccaatagcttagctaacttgccaatgttgtatttctggtaagtggcagaatgagaatgttagatctttccactgcagcaaactgccactctaaaagagctttccaatttaatcctataagaagaatatgtttgttagatagtgttaaaattttccatttaaaacatttcccgaggagtaagctatttataactgcacagatctttactcattggcaaataagtttatgtttaggttgatgctaaaattagcattatttctgttcaacaagagtttaaaagatgtagcaccttgtggttctgcaaactatttatacaaaatcttcttcgttgatgtgcacataagcctggaaatgatggtatctaaagctgtagactgatagaattttagtgctaaatgttatctgggattaccactggaggtggagtctctttaaggcaagagtttctgtctctctttcttttttctccttaagaatatttatgaaataaatatctatgactaattataaacgaatttctttagaatgcaaaaaaatttcctagacatagtgatactattagcacttcttaaagaagtacataaacacattctgaaatttttataacactattcaagggccatgcataagaataataatgtatattaataactcaaaattaaatttaattgcaaaaatcagcatccgtagagaagggttcctttgtgaaaaatcataagatgcataggcagcatttatacttataatgatcattcattcattcattcattttttaaacatatattgcacatcttctatgttccctggctctatgttaggcacctgggagcctgagataaataaagtttaattatttcaagtaatatcctaattatatttgccatagattatatcatagagtcatagaatatcatagaattgaagcatcagaaaggatatttcagatcatgcagcccagacctcctaatttttagtttgaggaaattgaagactagagagcttaagtactacccaaataattagcagcaaagccacaactcagacatgtctgagtctcctactacccagctcttctctactatacaataaactagctaacatttctatattcttgagtttattttcccccaagaggagattcctggtctaagaagagaagactgagaaaataaagttgatttttcttttaaatataataaatagaagtagatttatgattcatcaagtattaattgagaattaaccaaatatcaggaactttcctacgagctggtcatatgtgtgagaaaaacagaaatgtctttctggaccacatcctgcttgtcatcttgtgtgcactgtgtgtgtgtgtgtgtgtgtgtgtgtgtgtgtgtgtgtaaaaccctagcctaaaggcactaaactgccctttaatgggaatattaaaatagcccaggcaatggcagatataatgtaatgctaaaaaaggcaactaaagtgattagaacatatttatatttactttttttaaaaaacgtaaaacagtgcaatccttaaacaccttatgtattacactgaaaagatacaggtatatgtctttggtctactactgttatatgaataacttgttttatgactgtttcctgttaaacatttcagaagtggaaaataattttttaaaatctcagtacatatctacactgctatatctctttgagtaagataaatatacagtattttagaaaaaaaaatgagaaatctgttcacattcccatgttatgttcctgattagttatcttttgtttgctaattgcccctttacttccctagaagagctttgcagaatactatttaccttttcataagtatgatttttaaaactatgttatcacaagaatggatggagcaatgtttttccatcaaaaactagaattctgatgggtttacaaaagttagtaataatgtgctttaatgttagtgcattcttagtaatgacaatttactgtttgagcttgtattttagccatcaactgatttttgtcactttcaaaaagcaaatgttaagtctgtacagagtttattttagtgaaatcttaaactgtaaatttgatagtttcaaattagcaaagcagataaataatgtagctctcaattttgtctatttctaaccattctctaacagtaggctagaaattttactgcacttttgtctgtgtataatatgccttcacactcagataaaaacttgcagtatttttacttccaatcctagttggataagtaaggtggctgtctttttttttatgaacgggtttttattatatcatgtctccctaatgtatgtaaacagctctagtgtcacatgatttcccttctgaagttgaatttcttcccagggtagtagcatccacaaagcatatatttggcagcaaaacagcactagtacattatagataaggttacattcttcccattcagccacagcaaatgagcctctcatcccctcagttaaacaggttctggttttatactgaagcagatttagcctccctcagttcctattcctcgtgtgtggtcaagggtgctaccatgagtaggacggagcatgccaccacctgaatccctggcatattcccacggcactttgaattctcctttggcaaagaacatttgcagacattaagtacaatggtaaaattactgtactataacaaccttcccattctctcctggattctccctccgtacagtgctagaagtgaaaggacctatgtagcaggacttgtaaatgccccctaaattcagttattaataggaattcttccatctgataattacacctttgagatttcccatatcgtctaaccctggggctgttgtgtgtaaagttgtaactgcaagcatgaaggtttttcactaaaatattattaatccacctcctgaatccaccttctcccgattttgtcttacctaataacaaaggtaataatctagctcagctcatgattgccttctcattaaaatattcagatccttttcatactcatacctggggctcgtgtgtaacatacacagccttaataagctgtggttgcctggtaaccagtggaggcgctaaccagtggagacgggtcagagagtctgaagaacataaataactgaagcattgacattagtttcagctgggtcacccaagccttaattctgcactagccatcccagacatttctaatgggctggtgaaacagtagctttctcagaagtagctccttaaatcataaaaacaagaattagcgtttaacataatgtccttctctatggtctgataggagtttggggaatgaccatggaaacaacaggaccagatcctaatgcctttgaaatactttttacagaatacagaataaagtgtttgcaaggactcaacactctcaaacagctttttccacgtgttcctgattctgttttctcagtttcattaggaaaatttttttttagcatttacccattctctaatattatcttttacacattgagtggttaaggattctgaaacattttcccttttcaaaggctcttgctttaaaaagcaatgtagaaacaaagagaaaaatagttagaataagcagactgatagcaggatggtaaaattaacccataacataaataatacctgataacttctgaagaaagcacacacagcttgaagcatacccagtgctgttccttatactgggacatttggccatatgctgggactttcaaagccccaggataagatacccctgtcttaaagtgtgttacattttaaagggaaaagagaacattacatttttatgaaaacaataagaaatacactattgacttgaaagcaaaattagcgtgagtttttaaggggaaaaaaagataggccgggcatggtggctcatgcctgtaatcccagcactttgagaggccgaggcgggcggaacacaaggtcaagagatcaagaccaccctggccaacatagtggaacccccgtctctactaaaaatacaaaaattagctgggcctggtggcacatgcctgtagtcccagctactcggggagctgaggcaagagaatcacttgaacccgggaggtggaggttgcagtgagccaagattgagccactgcactccagcctggcgacagagtgagactccatctcaaaaaataaaaaaataaaaataaggtaaaggaatggcagcattggaaagtaattctgtcaccagacccacctcatgcactgccattgcctcaccttcccagcccactgagtgggaaatttgaagaagtacagctgtacgagatagacatttcactgtttggaaagaaagatgatttttttttaatttaaatgagaaaaaatgtcactactcataaccaaatgatttgtttggactctgccctacatatgggcaggacagaaaattattaaccactatttattgagagctgttcagaggcctgcccactttactctaaagcagtggttctcaaccaggagcagcttagctgtccagggaacatttagcaatatctgtaggcatttttgattgatgcctgggagtggaagtgatactagcatctagtgggtatagtccagggatgctactaacaatctacgatgctcagggcagtccctaaaagtaaagaatgatctagcccaacgtatcaatagtgccaatgctgagaaattcttctaaaaagtacaaaggctaaagtaactctgtaccaggttcaatatgtggtatttttttgttaccattgaatctccaccaccattcctttaggtgggtattactgttacctccattttcagatgatgaagtggaggctcagaaggttaacttgctcaaggccgtgcagtaaacaagtagtggaccctgaattcaaaagcagattagtttcctcaagccaactcctgtgaggtcactgtgcttctttcttcaaaaatacctacataactgccttctgtgttttctgaaactctttgtctccacagggcccctattaaaatgcatgtgtgtcatttgagctggctgacaggatagttaatcatggcctatgattccatttcctgagtaaatttactgggttctagggacctggactggagaagagatgacattgttagaaggggagaaaaaaggttcctgaaaagggaaatttcatttttaaaagaacctctttgatggagaagatgggattccaggacaaggcttagagtgcagaaaaggcctaattgtgcaccggggatttgattgtatgaaatagagcgaggctgtggtagcaagtattgcaggaggaggtgacaacttccttgttctaaaggagaggataggccgattcttcctgctagaggaacccattgtctcgcttgtggcctgcccttgagggaatctgaactactggaagagcaaagaaggcagtcaggcatgggcacagaagaagcccaggaagtgttggtgatcacaaaacaggaaggtgacaatccactttagccaacacttgctgcaaaagaacctcatcatcctcagcatgtgaaaagaaaacagtaacgttattttcagagaatggttctgttccttgattcatcattcccttgacacactccttcacacaatgcgtcatctgcttttcaatgctcctgctgatggccagctgcactctgttaccttttcaggctcttgttgggtcttgcctctccactcgtcctgtgcccagtcatacagaaccatttgtcatccccctgatgtgtcaacattgtcttctcaccctgtagagtcccttttgtgagtgaagagacttttcccagaaactacctgcattagtttcctagagttgctgtcacaaattaccacaaagcttagtggcttcaaacaatagaaattttttctgtcatagctttgtaggcaaaaagtctgaaattgaggtgctggcagggccattctccctatgaaggttctgcggaagaatccccccttgcctcttcctagcttctgtgggttccagtagtcctggcattccttggcttgcagctgcatcactgcaatccctgcttcagtcttcacatggcttcccccgtttgtatgtctctttttacattctctcctcttcttatacagatactagttgtcttatggttctccaaagatacacaactaataggatagatgtacatataaaggagagtttattaaggagtattgactcacacgatcacaaggtaaggtcccacaataggctgtctgcaagctgaggaacaaggaacaaagctgaagaacttggagtccgatgtttgaggtcaggaagcatctagcatgggagaaagatgtaggccagaagactaaaacagtctaatctttccacgttcttttgcctgcttttattctggccatgctggcagctgattagattgtgcacacccagattgagggtaggtctgccattcccagtccactggctcaaatgttaatctcctttggcaacacactcacccaggaacaatactttgcatccttcaatccaatcacattgacactcaatactaatcatcacaacagtcattggatttagggctcaccataatctagtatgatctcattgtgatccttaactgattatatctgaaaagactttatttctaaaggagataataatatgcatttgagatatgaatttttgagggacactccttgtattagtcagggttgtccagagaaacagaaccaatatgtactcacatgtgcacacacacacacacacacatctataaaaccatgtattataaggaatgggttcatgtgattatggaggctgagaagtctccaggtatgcagttcaaaggcctggaaaccaggaatgctgatgtcctaagttccaggctgaatccaaaagcaagagaagaccagtgccccagctcaaagaccataatgcagaaaaagcacacactctcttgctcagccttttgttttattcagacactgtaattttaacagattggattaggcccactcacactggggatggcaatctgttttactcagtctaccaattcaaatattaatctcatccagaaatacccttgcaaatacacccagaataatgtttgaccaaatatctgtgcacctggtgacccagtcaggttgacacataaaattcactgtcacacaactcaaatacacaatgccccgcagactttcccttgctgacaagcctggcaagggaactgcattcgcagtgattgacttaaacccttccctgagactttggtggaggcacagacaacaaataattcagcattttaccagcaaagaaaagggggagaatggttattaggtaagtaactaataaatctgttgcatttctatatatttctttttggtgaaacagacccatccatattagtctatgctttgtattttcaagcaacaaaaagcaaagcaaaacaaaacaaaaaaaaacttggctagcttaacaaaaaagagacagttgcactttagacaaggacagatccaaaagttcaaaggttatactcaggaccctgtctctttccgcctttctcagcaccatttctctctggcgttcaattaatagttaaggagattctatctatgcagtgatgaagaaaatcagcagacctccaagcataaacaatctacccaactatagatcacagagaaaagagcttaactttgaccaccatagaactctaattggctttccttaggtcacataaacattcctactccaactcttattttcaatcttgattgctgcaggatacctatgatatggatgacccaatcaataccctcatcatatccagaaaaatattcctccatttgacctcagccatccacttgcttgaccactagagctggttaccttcaggaaattaaccacttccacaatcaaaataagatacttctgtctccaaataccacatgctccacttccagctcttttgctctgatatctcacatttgtgattctttgtgttcattaaagggtcttttgggcctcattctttctcactatcagactcctcctgtctttattttcttccttacttgcttctattacatagtttatcccttgtacaagctttccttttatataccttcaagtccctacctcctgtcctgccatcacattcaccaggcattagtgaactcactcacctgatttactattacttgtgtctatgtagctgagctttgttgcagaaaaccacacagcagaccatgctgaaatcctactaggctcataataagcacttcaggtgtgcttgcagcactccatgtctatcctactatttctatagtcagctcacactcctcctctgcatggtgactggttcatcactttcccatttgcatcatgcttcttctcccactccgtgtctgagctaccaaccttgcttcttacttcattgaaaacataaaagccattagatagactccctcttccttaggtttccaaacatgcaagtataccatcatctgcagccttcaactcctttttccctagtgtcgcaggaaaggcagtttcttgccacatacactctgtatcctatctcctttcaccctcttaaggactgagtgcattcaaccagccattttctctctcacatgctccgtctctctgcctgtagtggaccactcagcaggtaaatatttttaagagtctcctatatttagaaatctttccctgacttcatatttcctttcaattgctgccctacatttgctctcgtacaaattaaagtttctaaaaacacaaaaagttgtctacacaggctgactccacttccttgacctctatccttctcctgttcctcaacattcccccaaaaaaggttcttgttaagtcactgtaatctccatattccaaagccagtggatgtttttcccattctcatcttactcaacttctcagtagctttcaactcaagaatcacctgtttcttcctgaaaaattcccttgttttcaagtccatagaagcacgctcacatggtgtttctcctgcttcctaggtctccctgagctggggcagcatcctaggcatgatctcgatgtgtgcagtctcttctcttcccaggacttaaaaaaaaattcctctctacctacaacttccacatgtgtatctgcatccaagccctattttcagagcttcaggttaatacagacacagcctatgtgacatctcaaattcaaaactgttcctggcacacacctctcccctcattacattccctcagcgcattcctgcaccaagccagcttctgcattaaagtaaatggcatctccatttatctcagaatgctgggaggttgtttaaatactttattctcactcgttttcccacattcaatctgtgactgatccctgtccattctaccttcaaaatatgtttcaaatgtgtcgcttgtcattgtccccattgtcagcatccagtccagcatcatcagtcagcctccaaactcgtttcactatccaccctttcctctgtcccatccactcttcacaccatagacagagtgttattttaaaaacaaaagttgtgttttatcactattatcattgaaattcttcagaagctttgtgctgccctgagaataaatttcagaatccctaacatgggcttcaaagtcctggtccctgtgtgaccctgtccccatctgcacagtgctccagccacactgctgttcctgcattcctccatcacaccaggcttcctcctactcacggactcgggtctccctttgcctgaaatccctcgcctcctttttcacaggtgtcatctcaaatgtcactttctcagaaaggtcagagataccaccaaatcacctcagatgtgacattctatcctcatagcccattccaagcatggacacagactaaattatcacgtgaagctgcggccagctcccgaagctttcctaaaatcttcacaataacagagacgatacaagtcagaaatcattaaaattagtcttcagcataagtattaaactgtaagtcttgcccttcataagacaactgctagattggcctttcttattcatcctaataatagaatccattggcgtttcttcttgggccaccgtttttagaacttgcttcccccacaggaaggcgtttgctttgacctggaccttatccccacgtccagaacctcagcacctattctctcccttgatctagcccctagtcccttccccattccaattaataacttgtaattttccacctatatcacccataataaacacagcatttttttctcttttacataaagtggcttaatttctttttcctccacctctgtcttccagactaagctatatataagcaatacacctattaaaatttattccaaaaaaaagagcaatcataaagccatgaactctgtagccttccttagaatcttggaaaatagacagttttaaaggtaacaattcattttacccaacctgcatatttacatagagacagataggaaatggtaactataaagatgttgactgtggttgttgggattataaaggattagaaaatatttttgctaacttttattgtttaattggtctgcagtgtgtactgaggatgtcataaagtctgaaacagataaaatagtctttatgttcattctttacatatggttgctacaggtataacagtatggttaggaaagctcaaccgcaggattgaatgtggattgtcgggtttctctatgctctgtatgtatgtatagaagaatttaaatacaaaactggtcatcactgggatgtagagcgttcctacatgtactacaaatataagtggctaatatcctttgaaaattcgtccttgatgaataatatagaatgttaatgtcttcctaacttgtatacttataagccagaattttggtgctgtattaggaggttcttcctaatgtctcgcctggcaaaaacgtactatggtagcttcagtaaaaaacgaagaacatctattcaccattattttcactgggatatacttgcaaatggtcaagtgcctccctcacaggcttctcttccactttccttcctgtttattgttcaccatcttaccttttccagtttctccctttcacatgtcactatgaggctccaaacagaatgcagtggcctgatggagaactgaccagtgtggaacaaggagcatgcctcccagattgactccagggatctctgaaatatcagatgtacagtccttgctggcagagtatttgccaccacagacacccagaagtgttcaaagtgcctgttatctttatattttgggtcaatttatatgaaatttgttcaattactagatggaccttttttattcattccaataatggaattcatttaagtgtatagaatgaaattccaaatattcgtttgttgcttgtctcagtttagtcaaacaatttccacaatagtgtgcatttcttcagtatttccttcttttctattctccccttcttgggaattttgctatgtgttttcttgaaccacatatgcttctctttttctttcccccaaatcaccttatatccttttcaaactgtttcttaatctttgttttaccataataatttattctacagtcttcccttaattttttctaacttgctttattttctcatattctttttttatcataatgtcatcaataattaactttgtgtgtctacagggtacatgacatcgcatttgcttcccagttctctccatcccattatctatgatgcatacacacatattacttgatatgtagttatagttcaccctccccttgcccactgactacataattacttgtcctttccccagggagccttacaaaggaaggaagggagaaagtggagtcactctgtcactcctacatctcatcttggtcactgaatatgcttttagagtacatcaggcatttctccatagagctttagaatgtgtactgtgctgatgtattccaagtccctgaatacaaagtaaaagaatctgggaaaatacacctaatatcccccaaacaaatgctttctaaactcaggggacactgactgggtgatttttcccctccttaacattctgcctaaactgacctaattaaattctctgtctactctcaaatcagttggtcatattccttctcatatattgttatagctacagttagtatttcctttttccatgttcttatctccccatctagattgtaggccatttatatttctttgactacacctagttcattaactgtttttagaaagcacttaattcaaaggtactgaatcagtacatctcatttcagaataagccacacagaagaaactaagaaacaataatctctaaatctttgtatccagactaagaaaatgaattcttttaaaagtgagatctcaggaatttgcctgttttcttgacttcacaggtagacttaattttcagaaatgtccttcccttttccctttagctgagagagaatatatccatcaaatagagatgtcatggctgtgcaaacacacctgggtttacaggatatgggaatgtcacagagagcgaccagacaggtacttattgagttacctgacagtcttccactcaaagcacatggattttcttctaccccaacgtactaaaaggccataaaagaactcagaggccataaaagagccataataattttatatcaatctcagctcactaacttgatgagcaccctgacccttcagctcttttggaatttttccattttgtttcccacagaacagattttgatctgggagaatatttactcctcagtatcaattctgtcttgccaccaatagaaggtgcctttagatatactgccgtgtgggttgtccctgataaaaaaaaaataaaaagcaaacaaacaaaacagcatcacccacctcaaagtaactaccattcctgacttggactccagaacacattcatggggtttcacagatgacatcaaactggaactgagagggaagccctcagagatgagttgccatttagaatcagcatggtaaaattacaaaaagcaaagtggactcacaaagaactctgtttcctttctagcactagagtaatttcatgctggaactttaagcaagttatttcacctctttaagcctcagattcctcataaataaaaatcaataaaatgaggtataatactaaattatgagtattgattctgccaattcttaaattttgttcttagactttctaactcaaactcagtaatctccctccacttccaggaatctattctaaggaaataacccaaggtataaccaaaaatttatatacaaagatatattgcttataattagaaacctggaaaagactaaacatatattagcagtaagggatagttaaataaattctgatatatacgaatgttaaaattttatgccactattaaaaggtattttcaaagaatgtataataccatagtgtgcttattttacatgtctgtctttcagtgaaaaggcaatattcaaaattattctgaatttttttttcgagatggagttttgctcttgtttcccaggctagagtgtagtggcgtgatctcagctcaccgcaacctccgcctcccaggtacaagcgattctcctgcctcagccttccaagtagctgggattacaggcaatacgccaccatgcccagctaattttgtatttttagcagagacggggttcttccatgttggtcaggctggtcttgaactcccgacctcaggtgatccactcgcctcggcctcccaaagtgctgggattacaggcatgagccaccgctcccagccatgaatttttaatgtatgaagaaatacatcaaaatgttgatacttgttatttctgatagttgaattataagtgcttttaatattatttcacaaatgttttctgtatttttcaacttctctacaatggacatgtaacattatcttttcatgagaacatggaaagttacaagtttttattattaagtttaaaaaccaacgtatttttcactaagaatacattcagaatataagtatataattataatttttaaacacatgaaaaaatacaaaaacagaggcttgaggataaatttccaaaaatgatatggcaaaatgattcagagttcacaataggttatctgtaagatatggagccatcaatttcatagtgttatttaaaaacggatattttctgtgatgtactcacagaagaaaaacataaagaaatccttattatttatagccccattgttacaattcaaaggaaaagtgcatgtttgaaatatcttaagggtaaaatagaatatcttgatattaaattgtataaattgagatggcttgcaacagacttgttctttcataagaaatttttatgagcagaatagatactaatccgattaatattttttaggtcagctgctcaaagtggcccaagaaacaatgtgcttgcaaaaattgttcagtagatcacaatctttttttgttgctgtcaacacactttcttttttaatttaaaccagtgccctaacaataaagcactttgtggtatgaaaaaataaataataatttttaactatgatgtgaaaattgcattttcagaggttcaaattgttttgcttgttttaatttcattaacattggccatcaacgttttttgcagccatgttgcttaatttaagcgcgtgacttctgagcccatgttgttaccttgagtttgtaggaaattaggtgctctcacatctgaagagagggcagtgaagcatataactttgaagctccctcctgcttctatgggactaggatttggcaaattgacttcctggggtaccttctgaagcatcattacctatgtctcaaaaactttttctaagtgattgaattcttcatatgaaattaagtgggtcacaagagcacagattatgttgcatattttgttcacatgagggggaagtttaattttaacatttgcaaaaggggatttaaaactttgtgaaaccaaatatactggcgtcgtattccctaggggttaaagaatcaacagtcactttaacatctgacaaaggatgcaccttctgtttggcaatcaatcatattaaatgctctagtaacagtgtaccttaactagataaatgataagctcttacatttacaaaatgaaaaacaattagatacgtgtaatggccacataaccaatctccaggggaaaaaaatgtacaaggtaaacactcctgatgaaatgaatgcagtcagtgagagtctctattcagccagccacacatgagaataggtatgaattattcaaattggggttcaaattattcaaatagtctctccttcatcaactgttttgaagaggattagggagtgctaattttccggtgtagctgctccttgcctttttgcctggtcggcctcacacatttttttggattggatcatcatgagtcaccgcgctgaaggatttttcaaggttggagcagtgccaaagctattttaatcatcccaactgatttgttgtggggcttttctttcttacttactttttaatgatagagaaatcttgcaatgtgcaacattcactttattctttctggtaacttcctgcaatgaaaaataaaattgtttttttctaccacaggcttttttaacccctggctgcttctttgtaccatattcttcaaagggattttaatgctaattttcctataccattggctttggtgtcaggtaatttcctgaatttgattacgatggagagaagcagctaaaagtctacactggtgagcagtttacagtacttgttagagatcaaggtgaccttgtaaaggcttctattgacacaatattggttaattactagaaatgtaatctatgtatataatttatattttaaagccctttatgatgaagattctttacagttcatcttaatttgagaaagtatcattaacaaataacatatagaccattttttaagaatccaaaatgaataccacaatgaactgctgtacttgtgtttttcttccatatttaaagatgaaaaaaattaactaccatgtttaacattcttcccacagtccatttcatactagaaatatgcttaaccttctgactgatcagttgctcctagctggtttgtaggttggagcaagcagcccttgctctttgcctaaaaaggtctctatatttatgctgtgttgttatgtaaacctatgttaggaaacataggattgttaatgcacatcttgttgaaaatgacagtttattcagcaaagggaagtcacgtgccagtcagctttctcatggtccctcttgttcaaaaatcacatattgactaaataatactagccagaatttattgagcatttagtatgcttcaagcttggtgcttcccttggactatctcatttaatccatttccattccttgttaaagtaggaattttacagaagagtaaactgagggttagagaggttaagtaacctatccaagatcacaaaagtagtatgggctagagccagatttcaaatccgcatctgcttgattccacaattgctcttcttaagaactcctctgccttgcctctctttgtgatgtgatgtactaagaaaaattctgtgcagatctctgaagggtttaaccacagcaagccatgctctgaagacagtcctggaggagttgagggaaagctttcagatgccatctttatccattgaagaagtagccctacctagtgccaagtcttttgatggttacttggtagagaaagatgagtaagacaatgttcctgttcctctgggagtccatctctaaagagagaagatagatatgcaaacaaattattgtgaaatgtaagctaagtttgggaaataaggaaggttgtgcaagagcagagtgattatgcgaggcctgagggatgaagtagccatccctggaggacgggggcacccactggctgattaatgtaccatggtgggaggaaggaccatgctgacatgctggcaagcggggaagctccagtcacctgggactccttcagcttttccctaaaggactggtaatgcgctgaaggtgattccttaaatcctaactacatagccattggtttggggagtcccaggattgctcagagtttgtatcgtttcaaatccaagactgctgctcttaatatagagccctccccacctcagcaaatatagcctgatcgattccagcaggctgtgttgcctgctttaaatttaaatgataaattttaaaagaactgaaatctgtttaaataacagttaaacacagggttttgatgaaaagaaaatgaagaattttacctcccacatctaagctgtgattagaagtttgctctagaaaaaaagcactttgaaactagcccttcatacactgatgtagtgttttcagcatctgtgtttactgaatacattactgcattttttaatgtttctaaaggagctgtgggattattgctgcatttcctattgagttagtaactgacatttaaaaatatttagttggctgatgtagtagataatgatcagtatttcaaaagattaatggtgacttaaaatgcatagagatatttcattagttagttgggaaaccttttattcttatacttctgttatttttttcttgttcatgaagttgagtcagcaagagaagcatattcaaattagacttgtcatacagaaaaaaaaatctgactttgtcagggtgggtggaggggaaaaaagcaactttttgtcagtcttttgtatttcagcagctggattcattgctaccatggtaacggaccacatgatgaggtgtattagattgctgtgtgttgagcacaaggggaagaatgaacacagctttttattgaagttaaaggttactttggagtttgtttggaaatgtgtaaggtcaaatactatagttttcagcatatgtagtacttcagaggaagaattaaggggcatgttggtgcatttaactacaaaaccaggtaaggtacaattgaatctatgaaactgaactctctgacttctgtcgcagtggcataacttgctgggtggaatttcactgtcgcccccacccccacccccacatgggcacccgataaatttctcctgcccaccctcctagctcctccacctccggtttcagctgtttttaatttgaaagtctaagatgttgtgaaatgttatagttttatggcagtgtgtgtgtgtgggagtgtgtgtgtgtgtgtgtgtgtgtgtaagtcaaagaaagaaaactgcaaaggaagtaataagaatgcaataactggtgtcttcaaatcagcgtagacctgaacaaagtgttttcttgttttgttttttgaaaatggtccgcttttcttagaggacaccttattagtggcatttgtccaaagctacttgtctcttctactaaattaagcagtaggacaaagttttccagcaaagttatctagtgtgtttattgtatgtgagcttttgtttttctttcatcatattattgcgagcctcatctaacatgtatagtccggttttatctatattttttaaaacatctattatttctattagcattctaatcttttaggcattgtggctgtatgtgtgatacaggatttaaaaatagaagtaaatacaacatgggtgagtgcaaaatgaactcttttgcttagaggctggtaggaactgaatgtaaacaattcagtgtggctgtgtggagcatcaattcccagagcgcagacgccttctcatgcgttgtttacatatcaccctggcagcttgtttcaaaatgggaggctttggtacacacagagcaagttaaaggagaacaatttctttaataataacttattttaattactttttcatggcttttactgatgtttgatgtttgatgtttgactttctcataagatattaggatttactctaattttagccaggggtttacttaatgcaacttctttccttcctcttagaacaaagctgtcttagcagcttttagaaataaaacctaattaaatagtagcaaagccctactgttattctagtgtattcactgtccacctgaaaaagtgcagatataggaaaatctttttgaaaaatactttcttagtgaactaaaatcaattatgtgcccttaattggcactaattaggataaaagccaataaattttcccaagtttgttcatacagcatgctttcttacaaaaggaaaacttagattttattaaatttatttatgctctgtgattttcgtcgctatttccttgatctctctagtttccatatgtccaagccattttctaagtttaagcaaggaattataatcattattcaaaaaaattatttgccatgatttcaaataaagagaactgtttccatgatgacagatatcaaaagtactataatagcatctaatattgtaaatgttcatgcttgtatctgaatttattcctttctttttccctttgttgtttgagtacaaatgagctatgaccatgtctttcaaaacatgagatattttcataaacataagttgttactactagagaatagggagtttctaaaaatcagtgaaagatggtacctggtaaactattctaaagtatgaaattattgaaactgacaatatctgaggtagaaagtgttatgttttattaaaagaaaaataaaagagggaaagaagaagcaagacagagacacagagagagacaaaaaaatgaaaagatatacaaaaggtaaagataaaagtgtaaatgatctcttacccaagcatttttctttcccgccggtactggaaagggttaaatctgtatctgtcagagaagagagtagtatggatgagggaaattactaaaaagtatttttatttcactattccatctttaaaatacatgataaagtatagatagttcctttctattaaataaaatgaaaaaaaatctacagtgaggttgtctcagtctttgtagttatgggctaccagccagcttagatattagagctacaagtgtgtaaaaaccaagatatgcccaaatttctgtgatctttattcatctgacattagaccatatgtacacaaaaacttctgaaataattttaacagagatcacaagatggaagattcttttatagttgttttggtattttcattcttaagaagcaaaattgacttttgatgtacttgctttaaactgtaaattttgccaggatgttttaattgtacagtatttgtttcaactcttgtttaaattatgctttcttgttaattttgaataatttgtagtgtttgttaacattttagctttaatctctagagctgcctagagtcatagaccaatagataattatctgcaaacatttacctctactaaggagacagatatttaacagttttttaacatgttaaaaaacaaccatattgagtaaaatagtatagcctctgctaaaaaattaatgatatttaaattccaagaaaatatttctaaaatagatgaagatcaagccaatgaatgatgactcaatatcatctagatactccatttttaggagttattttttaacctccgattttattaaggtgaattttattattgaccactatgtaatttttgacatgaaaagaattggattttttttttagaaatctaagacttttcaaatgaaaaagaaagtaatggtaccatgatcatgatgataatgataacgacaataatgattaatttggagaataagatagattagaaagctcttgcctctttgtgtagtaaaaggccaatgctcttagaaggaaagtggaaattactaatgggtagtatgattctcagaaattaaccctcaaatttaattaattatgttaatagcatttataagtcactaggaatagaggtgcttggtatgttattatcagactttattataaaatatcttggttttgttcaataagcgatagaggctgtcatcaaaaatgattaaacttagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccatttccacgatattgattcttcctacccatgagcatggaatgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataagaatgctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaacaccataaaaaccctagaagaaaacctaggcattgccattcaggacataggcatgggcaaggacttcatgtctaaaacaccaaaagcaatggcaacaaaagacaaaattgacaaatgggatctaattaaactaaagagcttctccacagcaaaagaaactaccatcagagtgaacaggcaacctacaaaatgggagaaaattttcgcaacctactcatctgacaaagggctaatatccagaatctacaatgaactcaaacaaatttacaagaaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccacccataaatcatgctgctataaagacacatgcacacgtatgtttattgtggcattattcacgatagcaaagacttggaaccaagccaaacgtccaacaatgatagactggattaagaaaatgtggcacatacacaccatggaatactatgcagccataaaaaataatgagttcatgtcctttgtagggacatggatgaaactggaaatcatcactctcagtaaactatcgcaagaacaaaaaaccaaacaccgcatattctcactcataggtgggaattgaacaatgagatcacatggacacaggaaggggaatatcacactctggggactgttgtgggatggggggaggggggagggatagcattgggagatatacctaatgctagatgacgagttagtgggtgcagcacaccagcatggcacatgtatacatatgtaactaacctgcacaatgtgcacatgtaccctaaaacttaaagtataataataaaaaatagaaaaaaaaatgattaaacttatcaagaattgtacaatgtgtgggtcagtatctgacaggaaaaatgcaaactcatttctaggaaagaacaattagttatatttttagtatataaaggggcaattaactggtcttcacttcatggtattattagctggatattttagagtggtattactataataattccccactctcaaacacacatgttatgaaatgttcactagacaccatttcaatattttaattgtttttaattttttaattatttattttaaataaacaatattttatatctgaaacctgttaattttgatttgtttggtggaacatttactcagaaaaattacttacctctacacatccctgacatgaaagaaaatactggatggattggcaattccagtataaaatatggatctatgaaagtagtgaaagaaaatatagaacttatgatagaaaaggatgacctcaaagacaaaaatcataaaggaatggtaatatgaaaacttactccttctagaatatgttatatacaaaattaaaaagataaatggcaaattagaaacaacatttgcaacatatatgaaagagaaaaagtgaatatccatgttatgtaatgaggtctcataaatctgtaagaaaaagcacttcccttttaattttaaaaatatctacaaattaaacacatgtcattttaataattagcaactattttttaaaggggaaagcaaaaggaggaagggggagataatgtctggtttaggaaaagtctggaaaatgggaacacatatacactgctatcatatagcagtgtacactgggtgcaggtggggagttgatcaagctggcaatgtgtagcaaagtctttaaaaattgcatatccttgggccctacagttctactactaggaatatgtcctaacaaaataaatagtctaacgtatttacatagtttttcgttgtttcagacaatagcagtctgaaaaagaaaatccaagaaatatagaaaacacatgagctcgtatttcctctctagaagctataaagctgtaagaagtcggccgggcaccgtggctcacacctgttatcccaacactttgggaggccgaggcgggtggatcgcctgagatcaggagttggagaccagcctggccaacgtagtgaaaccccatctgtcctaaaaatacaaaaaattagctgggcgtggtggcaggcgcctgtaatcccagctacttgtgaggctgaggcaagagaatcgcttgaacccaggaggcggaggttgcagtgagccgagatcacaccattgtactccggcctgggcaacaagagtgaaactccatctcaattaaaagaaagaaagaaaaaaagctgcaagaagtcatagacatggctatatgctggtctaactgttgacttcccaactctttagatggaacatgtataggcaacatggtgtagaaaaagagtcttggcttaagaattggaatgcctgaatcatgctactaactagctgagttaatataaatatgcaaatttatgaaattattaaaataataatgttaaagagtagaaaagtctgtgaatccctttacccatgtatatgtgtttgtcttcaccgctgatttgcaaataagaagtctcatatcaagtgggaagggtagatttttataatttcactgaaattcaataccaaatggtaaaatctggaatgccttgactgtgagagaaaataacaaaatattttaaatagggtatacattccaattattagtttttgaaatttattctaaagaaatttctgctcatataaggatgggcagaggataactgggcttgaataactgggccacacctacatttaggtgtggtggagaggcagagctccagagcaatctgttcaaaattctgtgatgctggaaatgctctatatcttcttagtccaatatagtaactactagccacatgtggctattaaacacttgaaaggtagctagtgcgactgatgaaacagatttcaaatcttatttaatgctaagtaattgaaatagccacgtgtgtctagtgctatcttaatagacagtgacactctagaattaagcacaacaaatagggtcttttatttaatatcggaggttaatttcaagcacctctgctaaattcggatgatatagataggacaagaaggtgagtattctttgtgcaatttcccttttatctacagaaatacagatcaatgaaatcctttgattctagtgactgcaagtccaagattttccagagaagtgttggtctcaagtagtctgtagttttgtttgcttaagaattttaatgctcattcattttctcatttattttttttaaaaaaccttatattgaatatatttgtgttggacactgacattgaaaagatagtagtagtgcagagttccttgattcaggaaatccttggagtatcctaaggagtaaatggtgcagagcagatattacagaggaggggagagaaaatgctgtgtggagaaggaagcactgggataaaccttaaagaaatggccagtgttcaataggaagctggggaaaggaggatcttgagaaacagaacagtatgggaaaaccagggagagatgagaatcagaaatgtctggaaatgtaataatggcagcagcacagaaaatagactagtgtgtagacagaaatgagtccagaagttaatgttacaatccagaacaagtatgagggaggttatgagctaaggggatgaaagtagaatttaaaaagagtagatttgagaggtgttttgtctgttgcttctctttacaataagtcaggtagagaacaactgatttatcttttaagcccccttgaaaattgtcgattactgcatacaatgctggagcaggatttttgtggccaaggaaactgagcgtatcttacaatatgcaagtttttcaaacaggaccaacttacataaatcatcctcttggaagtaggcgcaactacatcatgtatgtagttgaaatgtatgacacatgacaattttgtttggggatgtaatgtaactgaggtggaaacttaatatttatgagacttcctctttcgttaaaatcttaacattctttgattttgacaaatagtgtttttatttcttccaaaaatacaagaattttaaaagtatataattaggcatcgtttagaaaggtcaaaaaagcaatcgtctgttgaatttatgatttgggtacattattcttctccagtctttaccccattttgatggacttttttctcttggcagtatatccaggttcatttataggtgggaagacagtagaagctgttattccagcatcaaagcccccactgttttctaataagacgttaggttttatttcttccaaagccttatgatcactgcagtcaaaaaaagaagggtggaaaatgcagaaaaatggtggaggaggtggagtatggtcttggtcataaagaaatgaaaggagaaaggtattactgaagagtatgggcattagtctgactgtaaggaggactttggcagtaactacaagccagagtgagtgaggaaagaatagcagccatttgggcaatgtgctgaccatgtgtggcttgatactaggaaacctgaacatacagcaggacagagaggagcacatcatgtgagagttccatgagttctcggatttaagaaaatagaagactttctaagtgccagatactgttctaagtactttttgtttaacctatttaaggcaattaaccctttttttttggagaacagtcatagaacatggaaatcactgaagaaatgtaagtagtggtgggatgcagtggctcacgtctgtaatcccagtactttgggaggctaaggtgggtggatcacctgaggtcaggagttcaagaccagtctggcaccaacatggcgaaaccccgtctctactaaaaatacaaaaacaaaacaaaaactagccaggcatggtggtgtgggtctactgtagtcccagctactcaggaggctgaggcaggagaatcacttgaaccagggaggtgaaggttgcagtgaccccagatcgcaccactgcattctagcctgggtgacagagtgagacttcatctcaaaaaataaaaaaataaaaaaataagtagttattatctctccatcaatcctcacaacaaccctatgagcagggtacttttaccatctttattttacagatgaagaaattaaggcccgagaggttaagtaatcccccaaacagcatacagttaatcagagagagctctatttaatcagctcaactactacgccatcctgcctactcttaatctatgttaattttataatatgtacagagatgatacttgtaacgtgctcacaaagtgcctgacatatagtaaacctgcaaaaatgttagcaattatcattatgtaataagatttagaagactttccggtatttatgtcattctacaccgacactgctcagaaatagtaacaagatttttagggcagctctggatttttcttatgtaaagtgtaaagaaagctttgtttaggagcatgcccttataaattggagaaactcttcttctacccaaatactgtcaatcagtttgactggcacagttgaagtttttacctcaaagaatgggcctcattgaaatgttctatatactcatctacatggctctgaccttctgacagagaatgactgctgctaatggtactaataagagcaaatggaattcccttccaagcttggtatttgaataatatgtcaatttgttcattgccgtcttactaggaattaaatgcgctaatatttttataacctaagggagctagtgcgaggttggcagccagaaaagggaatcaggccagaggctggccaaggcatagtcatgagggggtggaagggtcacaaagtcaaagtcaagcaggtggacccaggcagaacccaaccagactctagaacaaagttaggttcaaagtttggttcttatctcctttccctataatgtgggctggtaggggtgggttgattgtcatcctctgtacaaaaagaattgtatggaaaattagctggctctgaaatctaactgaaataagaaagtcaataaaagcataattaaagatacttaaacattgtagatacaggcaatgaaagaacaatgcctctgttgtactggatttccagcagggaatgatgctgtttgggttaagacacaggtaaggcagaggagctttgagaataccatggctcaggaaggaagaaatgtgagaaagctagagaggtacaggagactacagaggagaagggaaaggcaaaatctggattctgagtaatcagaagttgtcgtctgctttggtggctcctatagttccctttgtcttcatcagtgacctgagaattcacagggttttcaccagtaatgtcactgggcaagtgtgccaggccgaccacccaataagaggacaaggaagagagagtggaaggatcagcagaactgtcaccactctgattctgtggtgtgggagctggggatgtggggtggggaatctctctctagaggtttgttctctgctgtgttactcccatctgtgatggctttttctccatgagcttaaatggtgatggttttcttccaactattagggaatacattgataatgttagtgattcatagagtgtctgaaataatctctgcaaatgttatgtgtagttggttatctggagaagtaacaagcttttatcaaccataataactaaatttgtatggtgatttactgtttgcaaaatattcaattatgttatatttgaatctcccacaatcctaggaggttgatgacaccatcaattcctttataaggatgaaggaaatcaagctcaattactttcctagaggcactgggtttgatagcaaagcacaaattttaatttactggtttactaatgcatcctgcttcattcaacacctcttcacctttaaaagtaaaaattgtctcagtgatagctatttacctttagaaaatggctattacaaataaagaactcttacatttactcagattgttcagattaaattctccctttaaacatactttcaaggtagtttatgtacacagtaggtatttaataagtgttaactgcttgattattgtctctttgtactcctccagagcaatcattctgattctcacacactggattaaaaggttgtttattttggagtagaagggaatactctgcaattacaactcccaacatgggaaactaatgaaaaaaaacaaacaaacaaaaacgtgacgcagttctttttaacttaagaaaataatctagcttctaacatataaatgagtagacttaaaataactggacaaagccagaaggcaacaaggcagacaacttatacttaggcaaaactaatcaaaggaaattatcatgagccccaaaactactctgcttctcatatccatgcaacacccaaacaatatacaattttatcttgcctatgaaattcccaagtatattcctacgtatgtgtttgtctttgtaccacacactgtctgtattctttaaaaaccttcccttacctgacattgcccttgagtttagttatcttccttgcctatcggagacataaaaaatactcttcccctggctaatgctctgtgagaaccagtgattaaagtctgggcaggagaaaagaagtcggggcatatgattgtcagtattagggttttccggtttggctaaagtgaagctccttacttcagctagtattgcagctatttgagctcccctttccttatactccttcctaaaatgtttaaaaaaagtccaaattgcaacatttattacctttctcatttaaaattgtattaaaataatcctttgggtttaaatattatcttctgttagtaatgctaagatctgagattcttttgattaggttaaggttaggcaggaaaggaatattaaaataaagaagaatgtcacttgctagctattaaatatattataagctataatcacaattaagttgaactataatttaaaagggtgttaatatagacaaaccctggagtataaacaaatacttgcataggtatcaatatatgctagacaaggctgtgcatagcaacaggaaagattattattattatgcagtaaaatactactgggaaggaaaatattttcattcatactacaaaatgaattccaggtaaattagagttaaatacttactataaatcaaattataaggattaatagaaaatatacaggaattttaaaagagctttattgtgatataattgataatgaactaaactatttaaattgtacaaattaataggttttgacatatatatatacatacacacacacacacacacacacacatatcctaagccatctttagaatcaagatagtgaacatattcatcaccaccaaaaatttcctcaagctccttggtaatgcctcccacctgtccctcccccatcccaagcaaccacaaatgaattttcagtcactatagattagtttgcattttctagagtttatgtaaatggaatcagacagtacatacttttttggtctggtttctttcactcagtataattgttttgtgacttatctacattgtgtgtatcaacaatgtgttcatctttcttactttatttattgtttatccattcatctttgattaacattgaggttctttctggtttttgactattacgaataaagctactatgaacattcatgtgaaaatgtttcaacagatacatattttctttccttttgagtaaatgtctatgggaattttaaatgatccatgaaagaaaaaggactttataaatataagaattaaaagttcaccatggaaaatcattatatttgacaacattaacattttaaattactgcaactcaaaaaaaaatgttcttaaccaaacttcaggttaaatgatagtcaaagaaactgtataagtaatagctaacaatgataagaacttgccataagcaaagcatcggcaactctgtctgatctatcagttgatcttcacaacagtcctaaaaggttaaacactatagtgccacatcctgtgtacttaaccactgttcagtggtgcctccctgtgtggagaaggagtatatattatacatagacggtatatttgtcaaaaaaagtttaatatccaatcgtaggaaattatgtgaaacataatagaaataatttatatattgtatatctctgaaataaatatgtgagaccatatgtcaataacctaaatataatttgtgcaaaatatgtaggagaatacaaaggcaataaaatgggcaagggacataagatgttcacaactaaaaaaagtaaaaatagggccaggcacggtggctcaggcctgtaatcctagcaatttgggaggccgaggcaggtagatcacctgatgtcaggagttcgagaccagcctggccagcatggcaaaaccccatctccaccaaaaatacaaaaattagccgggcgtggtgacgggtgcctgtaatcccagctactcaggaggctgagacaggagaattacttgaacccaggaggcagaggttgcagtgagccaagatcgtgccactgcactccagcctaggcaacaagagcgagattctgtctcaaaaaaaaagaaaagaaagaaagaaaaaaaaactatgaaaaatattaaacttcactcttaatcaaatacattcaaaataaaatcaaactgtgacacctatcaaatgagtgaatattcttagatatgttattgtcagtttttattgctttattttaatagtagtaatatgtaatgttagtgaagttgaaagccattctcacactttattggtggtgaaatataaattaatacaatcattctggaaagcaatttggcatatcagtatgtatcaatgacttgacaataattatgccctttgataaaagattttatttttgaaatcacctgaagcaataaccttaaatggatacaaagagttatgtacagaatgtcttttatagtgtgatataatgtcttataacaggaaaatgaatagctaaagtcatttcatagctaaaaaatcctatgcagctactaaagcggtgtttactaagcattatcataaactgttggtagaagtgagaattactacaaatttattgaacagcagtttgataatttttaatgtttttaatttataaagaaaacaggtttatttggctcgcagttctgcaggttgtacacaaagcataatgccagcatctgctcctggcaagggcctcaggaagcttgtaataatggtacaaggtgaaagggaaatagcatatcacatggcaagagaggggagaggtgccaggctcttttaaaccagctcttggtgtgaattgatacagtgagaactctctcattacagtgaagacaacaccaagccattcatgacagatctatccctaaacacttcccactaggcccacctccaacattggaggtcacatttcagcataagatttggaggggtcagatcctaggcaaaaagaacaaagctggaggcataacactacctgacttcaaactatactataaggctacagtaaacaaaacagcatggtactggtaccaaaacagatatatagatcaatggaacagaacattgatcagaaataacacctcagaaataataccacacatctacaaccatcggatatttgataaacatgacaaaaacaagcaatggggaaaggattccctatttaataaatggtgctggaaaaactggctagtcatatgcagaaaactgaaactggaccctttctttacaccttatacaaaaattaactcaagatggattaaagacttaaacctaagacctaaagccataaaaaccctagaagaaaacctaggcaataccattcaggagataggcatgggcaaagacttcatgactaaaacaccaaaagcaatgacaacaaaaggcaaaatagacaaatgggatctaattaaactaaagtgcttctgcacagtaaaagaaactatcaacagagtgaacaggcaacctacagaataggagaaaatttttgcaatctatccatctgacaaagggctaatatctagaatctacaaagaacttaaacaaatttacaagaaaaaaaaaaaacaaccccatcaaaaagtgggcaaaggatatgaacagacacttctcaaaagaagacatttatgcagccagcaaacttatgaaaaaaagctcatcatcactggtcattagagaaatgcaaatcaaaaccacaatacgatactatctcacaccagttagaatggcgatcattaaaaagtcaggaaaaaacagatgctggagagaatgtggagaaataggaacacttttacactgttggtgggactgtaaattagttcagccattgtggaagacagtgtggcgattcctcaaggatctagaactggaaataccctttgacccaacaatcccattactgggtatatacccaaaggattataaatcattctactataaagacacatgcacacgtgtgtttattgcagcactgttcacaatagcaaagtcttggaaccaacccaaatgtccatcgatgatagactggattaagaaaatgtggcacatatacaccatggaatactatgcagccataaaaaaggatgagttcatatccttttcggggacatgtatgaaactggaaatcatcattctcagcaacgtaacagaagaagagaaaaccaaacactgcatgttctcactcataagtggtagttgaacaatgagaacacatggacacagggagggaacgtcacacaccagagcctgtcggggagtggggggctggaggagggatagcattaggagaaatacctaatgtaaatgacgagttcataggtgcagcaaacccacatggcacatgtatacctatgtaacaaacctgcacattgtgcacatataccccagaacttaaagtataataatttaaaaaaaaataaaaagaaagatttggagggatcagaatatccaaatctatcattcttcccctggtcccccgaatttcatgtctttctcacattgcaaaatacagtcatctcttcctcatagcctccaagtcttacctcattccagcatcactcaaaagtccaaagtctcttctgagactcaaggcaagtccttccacctatgagcctgtaagataaaaatcaagttatttgcttccaacgacagtaatactacaggcattgagtaaacattccaaaagggaaaaatcagcctgaggaaaggagtaagaggccccatgcaagtctgaaacccagcagggctgaccttaaaccttagtgctccaaaataatccttcactccttgtcctgaaaccagagcacactggtgcaagggatggactcccaacacttagggcatctccacctccatggctatgcagactgccaccgagtggctgctctcctggattggagttgagtgcctgtggctttccaggctcaggatgcaagctgccagtggctctaccattttcccaactgaaggacagcaacccccttctcacagctccactaggtagtgccctggtgaggacgctgtgtggggctccaaccccacatttccccttagcactgccctaggaaagtatctttgtggaggctccaccctgcggcaagcaccaaggctttcctctgatacatcctctggaatctaggtggaagctgccaagcctccttcacttgtgcattctgtgtgcctgcaggctcaacacaacgtagaagcccccaaggcttgcagtttgcactctcagaagcggcagcctgagctgtacctgaagccctttaagcaaaggctggagccctagcagctgggatgctgggagcagttttctgaggcttcacagggcagcagggtcctgggcctggccccaaaacccattctttcctactgtgatcctgggctggtgatgggaggactgtcctgaagccttctgaaatgcttttaaggcctttttcccattgtcttggcttgataatatttttaatttccttaaaatacttatgaccattgactagtaattttacttttaggaatgtctaaaatggaaatatttttggcccagaatttataaacaaggatactgatcccagtattataatatccttgtgaatcaaggatattgattcacagtattgtgaaaacaaattttcactgtaaaacaaactaaatgcccaacaatgaagaacaagttaaataaattatggaacatctgcatgatggaaaccatttaaaatgtcctttttttttctttgagagagacagttttgcttttgtcacccaggctggagtccagtgcctcaatcttggctcactgcaacctccacctcccaggttcaagcgattctcctgcctcagcctccgaagtagttgggattacaggaaagtgccaccttccctggctaatttttgtattgttagtagagacagggtttcaccatgttggtcaggctagtgtcaaagtcctggcctcaagtgatccacccaccttggcctcccaatatgctgggattacaggtgtgagccactgcactcagcgcctaaaatgtcttataaaagtgttttgtgaaagaggatatgttttttataaaatgccatctactatctaatcctaatattaagagggagggggggaaaaggcaaaaaatgatagaaataaagcaaggtatccttaatgactgtccatgggtaatagattaattttcctatctttactttcctatgttttctgaattttcttcagcagatacgtattactttcgcaatgttgtgatattaagttaaaagtgagaatttgaaattgcatactcaatgtgaatgcagctacgtatagaagaagcaagaagactatcagctgcaatgttaatagtatggtttttatcttcttttgtataattattggagtttttctatatgttaagaaatcaggacaaaaatgattttgacaaagaaaggacaaaaaacaaggcccacttcttagtttatgaaaagcagtataggagaacagaagggaattataataggctcctcctgctgcaggtttgagaaatatcacttcaactagtttaaaaaatttaaaaaaataaaataaataatttttcatgcagaaatattttacatgaaaagtaaaatttccccacctaaaatttctattctcatcccaggataaaactgttgagggctttatatatttccttccagtacttttttcaaagaatattataaaataaagtatttttctcaaaaaaaaataaaaaggaggaatcagcttatgtaaataacaaggacttgggtacagttggctgcagactcatttagatccagaggcccaaagggcatccccaagttctcttccctgtttcaaggctttgcttgtttctgcttagctttcttcagtgattcctactcaaacacaaaaccaaaccttatgcctctcactagctcctggaaagaggcttcccaaacagcaggtaagatggctgccagtagcccccaaatcacaccccaccagcttcactttctgagcaggagatttttcttaataattcaaagatcccagcaagtaagtgagaaagcctggcttggggtgtgtgtacagccctgaatggtcaccatggccaagtgggtggggtattctgacacccggggtcccttcagttgtgcacctctatgtctgaaggaaaacacaggcagccccaccacaattacctggaagagagtcccagagaagtcacaagaaaaaaaagaggaaagggaatattgaaaagagagtatgatgtcaatgtcaatggcaggaactcataggtataataccaaatgtcttacaaaatcatcttattcagtcagtcctcgtggaattatataaggaaaattattatgtgcactttcaaataaggaaatggagggtaagaaaaacaagttatttgctcaagtacatgcaggtagtacctggcagcaaggagatttgaactcaagtgtgtctaatgtcattgccaaacctcccctctaaaatgttttgtcttccttgagttcttatggctgctttacctgcaatcaagagacagagagagacattctgtgtttctgtgtgtgagaaatggcacaggggcaactagaagttttaataccttcctgtaggtggcaggttgctgctctctccttcagaaccccgctctgaggaaagctaaggaagagaacaggacgtctgagtgtgtgactgaggtaaaatgttgtatatttttcacactttaaaatcagatgtaggattcaaataaactaaaataatttaacactcaaatttttaaaacttctgaaggaggctgggcacattccatattgggcattcaaagagtattttccacagcatacgaggcactctcaaagatacaaaagtaaacacactctaaattaggacacaaagaaaagatggaagatgggaaattcaaggtggaaagacataaatggcaaccagaaataatagtcattgtagatctggcagttccccaaccaaagcagacaatctgaaagaaacctaaggttatttatacctgctgaggatttactctacccagtgattaaacctccaggacacactagataagtctagaagagctttaagacttcaagatttgtgttttcttaaccttgctgtttcttgtccttggttctgcatgaaaaaactcatctctccacagttccaaggaataattccaaaaataaatgtaggcatttgcttgaaccaggacattgtgtccccagttttctttccgaagcctacaggatgtacgagttgctcttgaagcctgtctgcagcacaacaaatccaagttctgcatttgctccccagctgagtgactgcactgggcaaagctgcacttaacagataatacccatgggggaactgctgggtgaggaatttgtagtgaaaagcactgacaacagcttgagatttatttagcacaatttatttagttcttcattcagaagaagtaaaattccatgcatgaggtaatgtatgcaaaagtgctttaaacttgaagtgttaaagcagtacacagttgttgggggctctgatgtgagaatggccagcctgttctctggttagtctggagctaattccttcaagaatcacaggtcagaagtgttgcattgtggccccttgttcagtcttggcaaaaactgagggaacatggcaaagtgggaagaatatagaccttggagtcagatttgggttcaaatatagtaattttcatggctctgggacctctctgtgtccatatgtcctcatttggataacccagttgtcagctgggacttcctagccccttgagggctcacataaagttggctcaaaccaattcgaacccttttcaccacctttgggaatactggagttactgtcccctaacctgttattcctctcaccctaatatctatgcacattgtgttctcttttccccctttatcaaattgcaagtgaaactctgtcccctcactggtgaccaccaaagagctcactcatgttggtgtgtccagtaacttcactgaaggtttggggttggcaaggactggtgtggggaggctcacagcctttgatgtctctccagaaacctctatctgcttttttcacccttcacatatgcctccagatagtttcctaggaacacaaatattttccctcttactatgcagagaaatttagctctcttctgttcttgttccaagttttcatactcaaatgcatcaagatgcccagaacaaagggtcttccaatggcctcctctgaaagcaaagctataaatagaaaaaaagggttatctgttatcttttgaaaatggtgataatttctaccttgctatttttcaagatttgtggccgggcgcggtggctcacgcctgtaatcccagcactttgggaggccgaggcgggtggatcatgaggtcaggagatcgagaccatcctggctaacaaggtgaaaccccgtctctattaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccagcctgggcgacagagcgagactccgtctcaaaaaaaaaaaaaagatttgtgcgaattttagataaaagggatatacaatactttgcacaaagtacagcacatagcaagtgcataatgaagaaatgatgatgatgatgattctgtattgggtagccagtgtttgcagtaactgtacttctttgagtatcacttatcacaattataattaattatttgtgtaatcatctcttaatgtatgtctccctgaagttccctgatggcagaaactgtttctgtcttgtttacctgtgtgtcaccagtgccttgtacagtgcctggcccacatatttaactctttattgtattaatgaatagataaatggtcaaatggagagtgttaaatgtggagagtttttctttctttacagttttaactttataggggaaagaagtgacagggcaggtgagggatggtgaaaactctgaagatgttggaacattgtcagctgtctaagtgtttgggaaagattagcagagactccatttctttattcactcattctttctgtgcattttctactctcaccaccaaatcagtctcctccctatccaagttccatttattagtatccctgaagctgaaaagaaaagagaatatttatttgcctgtttccacactgtctcactaacaccatgatcattacattttcagactagtccagtgaaacctaccttacccataatttatttgaagtagtttatttttccccctaattttcttcatggcaggtattttgtttttcagctaacttgttggattgcctactaatctaactttagtgttatagctttttctgaagaggacaatgtgctctgtgctgtaatgaagcttgtaaattaactctaggaatataactcattcttatacagcagagtcacctgtatatgccaagacagcgtgatccaaagcaaagacactggatttgcagtcaccttcctctgcgatcctcctttacttatctaaaatgagaagcctgggctaaagaaacaaatgtcaaacagtagcaaaggatgcaacctggactgagctgggttctattctccttccctgtgagagcacctccctgcttacgttttagaagcttggctcaggttatggaattcatttgaatttttaaaaatccatggcaaaaataaaaatcagcaagctggaaaagacattcttctataatcccaagcaaagaaaattaaatcacacaacaaatattttctaagtctaaagtgctatgttagtaggaatattagataaagcacatgaggctcagttaaatttcaatttcagataaatggtgagtattttttagtgtaagtgagtcctattcaacatttgcgatatacctgttgttggggttctgacagctgctaagtatgtctatgccaattatgcattctggcactggggaaatgaccacaggatgagtccggggatcctctggactcactgtaagtcagacctgagataaaactccattaattacctgacctccataagtccctattttaactggaggaccacagtgacgttttgggtcccctgcaatcaatgtcagctcagagccaatgtccagtagtccccgaaatatctgatcacttccctttccccagtgcacagttaccctggttaaaggctggaggtctccttggggaagaatgggagaaagattcactgcataaattgtcagtaatgtagtggggtctttcctcaaaaggagccagcctccccttcattcgaaggcttctgggtctgcaaactggctcaagtctggaaattgattgaggggctgtgattctctggttttataattcaaattagtcttctgtccattcgacctagaagttttcttcttgtataaattaagtaggaatgcagtaggcttcctatcagtttcacttctaggaacaccgtgattaattagccaatgccagagtgctacacaagtcagattattctgattgcaggtctgcttctgctgtccattatggtagctatgcccaccgtgcctttgatggttgagtgccaacttggaccctgccaccttgggatccaattattcccactgtatttaaattttataattgagtgactgcggttaccaccattagatctgacatacagagaagagcaattacagagctcttcaaagatgcaggtgctgccctcacaaatctatttcacaaggcattggtcaagggtatatcttctggaccctcccagctgtgatgagtaggtctaaagtgactaatccactccaccatcccaatctccctaagcctttggatcccttcctttatgttaaaccaagggagatcaggcatttccagctcactcacagtgggcctcttttaatccatatttcagctaaccaagcaaataaactattagaatattttttaactccctgagctgcaacattaaaggcagagtttctacttagtgggaccaaattaataaattcagcctgatccaactctatgttccttctatcattatcccacacctttaaaatccattcccatgcctgttctccagatttttgtttatataaattgaagaactcaagcagttcttttcaagtgtagagcacctcctcatgggtcacactctcaacctcacctctaggggctgctgggattttagtctagttataggtctagaagcaaacagaggtattgagggtggctcctcaggagaatcaacattatcttgcttgacaactgcctcaggagagtcactgttgcctcaggcagtgcagggtttatctcttcagacaaaggtcgaaaggctgatggcagtatgggtcagggaggggatgttgactctactggggatgggaaagctctttcttctggcaaaaaaaaggttcatcagagtttacaaactcagtgtcctcagtttcatcagaatcttcccacacatccccattccaagttgcagggtcccattcttttccaatcaatgccctcactttaacagtagtcacctggcgaggctgtgcatgcatctttcattgcaggtcagccacttgcatgataagagcttgtctgtttttccacaatttcagctctttctctacaggagataagactctcattcagggcaatcttagcagatttgaggctcagtgtctgcttctgaagctgggagacagaatcccccagttcatcattttctttcaacactttgtccactgaagttagaagtaaccaaccagcttcattatgttcctttattctccatatatggtcaaaggtattatgtatagagtcaccaaactccttgcctctcaggagcagtgaatcagaagtgtcaaatgcatttattttgcataactctctaaacagttcacaccaaggactatcagtgttctccatactattagaagtagagtccttagcattttgtggtctaatcatattaagcagccaactccagaagcctcaaaaccaacgaaagaactccattcttaatattctgttcctctagaaccactcctgttaccaaaatctgtattagtcagggttgtctagaaggacagaactaatagaacatatatatacacacacatacacatatatatatacacacacacacactcacatatatatacatgtgtaaggagagccagtccaagtcccaaaactgaagaacatggagtccgatgtttgagagcaggaagcatccagcacaggagaaagatgtaggccaggaggctaggacagtctctccttttcacgtttttctgcctgcttgtatttgctggcagctgattagattgtacctaccagattaagagtggatctgccttccccagcccactgactcaaacgttattttggcagcacccttgcagacacaatcaggatcaatagtttgtatccttcaatccaatcaagttgacactcagtattaaccatcacacctatactaaaaaactgtttgccaagtgtggcaaccttatatgccaggctcttagggactaaaggatgtgcattataaaccaagaagagcacgaagacattttttaatggattcttttgctgttgattttcttttattattattattaccattagttcatgtggctctttgcagttcattgcattatttcattgcctggcctcatgttgcaacacattatcattctgtggaccagccagaagaggcagctttccctggacctaacatttttattttcatttttagttctggggtacatgtgcaggatgtacaggtttgttacataggtaaacatgtgccattgtggtttgctacacctatcaactcattacccaggtattaagcccagcatgcattagctacttttcctaatgctgtccctccgccaacctaactgttaaggtgtactcttcacataaggtggctaaaacagtgcatgagaagctagccatttcctcaccttcatctccttttgttatctcacacaggatcctcacccaactcacccccagagacaccacttcttttgactttactacttttggaatttatttctcattcaaaaattgaagccaatagtgttcgaaatgcataaaatatacctagaggacgtctataccatgaagttggaaattctagttcaatgccctccacgtgaagagctctcacaaacactaatgactgagtactgtagtttgtagctgcaccttcagattagctaacactgataagtattataaaggagagcaataccacattaaactctgaaatgttactttccctaatgagtactcacacactacacatatgtatgcgtgcactatttgtcatttgtttccattttttagagatttcatttctaaaagctgtaggagaatcttttcaaatgaattatatatgaaccataattaatatgaataaatccgctcatgcaaaacatttcaggatgtacatttcccatttatattatcaccaaaggaggaatttcattatttttcatacagctattttgtcatggatcttaaaatggagtcacagataagaagaaaaaatggaagattgtacagacagaatcaaattccaggttctaaaactagtagggtggacagcgaagataaagtcaactttataaagataaaaatctcagtattctgaaatttaaggcctcatttaaatgccttgaacttcttaggattaaaagacatttgcccagtgtgttcttgggatattcaaaattgtgcattaaaataaacgtgatattatgaacctccaaaaagtgttcatagtacattttggccaaaaactgtgtgaatcaaccaagtcatttgagcataggtcctgtttaaaagtaatgatgcaaaattcagtaatgaattttgaaaacctaaaaatagtctgtcttgttctagaaatgacaaaacctgggggataactttgttctcattcttcatataatttgatcttcctgctttgccacagggcatcagttttgtgagaaaggcacatagtgcaggcaacatttctcacttggtatggcttgggaagaatgggcttccttcaaaaccagggagtagtgaaagttcatttgtattcatttttaaacagatgtatagtgaaagtattagtattctaaggatatttggattctttgaaaatattcagttatccaaaattaataatttggggcttaactgaaacagaacggtatattttatacataaaaggctatcttaatcatcaaaggaagaactagctaatatgtattaaggaaattgaggcaagctgtacctatgaaggctgttatctaagttcaaatccacaaacaacatatagtttaaattgtgaaatgatatatgtgtacaaaattactttgtaaagtgattgtgaagcctcacctaagcgaaatagtaattatttcttctaaagacggtctggttcttgccacatttttctgtctcttagaaatatatttgaagccataaggctacaaatgaaagagttctctccttttctttctaagtagttcacttagctccagctgaatcatctgtatagtgtcctccctcttatgatgcatacaaccaagggatgcttagagaaagggagcctcccaattcttgggaataggcctcgatgtgtgaattctcacttccagcccttccaggtcaaatcttccaagtctttagtcgctctccctctccgattcatcctgtgtgtttaccgttggattcatattctgtaattactgcttgcattgtttaagtcctgtgcataggagtcttcgcagaactctttgtttcctccactatgaagtataagccacgtgacccggctgtagtcagtgtagtgctccctaacttcactcattttaggcacaagtggcactaatgaacatcacagagacacgccttcatgaaaccgacagtcctatgaataaaacagacaccaacaaaaacaatttcatgaagattttatgacaattgcaaaaactgttagacaattatgggtatattagagtatatactagagtatattagagaaattcggaaaagctgccctgtggtagacatgcctattggaactagccaggtttggggctgagaggggttaggatatctatgaagagaaaaagagaatattccaagcaatgggatcagcagaagcaaaggccctgaggcacatatgagtgaacacagagacatgggcctgggggccaggtggcttggacatacaaagccactttaaagattcgggacttcaaattaaaggcagtaggaagtccatcctgcttttacttgccattctctcaaaaagcatcttagttgaccccagaggccatcagacacaacacgcatgtctactataaattagctcatgtaatatgagctgcaataatagaagcataatatctaaacagaggaaggtacacacagtacaggcccagctagcaagaatattccaggagcctcagaaacaaagcaacatagtatgtttactttgtttaaaacaaagatgcccatattggctttttgccatttaaaacatgatttactaaaaatctagattaccaagcaaaccaggctgagtccagctttgaagctgggctggaggccaccctccttctactcctttctcttcaccctgttccctctgcacctcggtctctttatcctcttcttctatctgccgtcccgatgtgacaaatctctccctgtgctgtgttcagggtttaggatgtctgatagaggacagcgcgtgacggtgaggaatgccagtctgcttagtcatgcctttttgcacacctctggagttttgtgcatacatagctaacagtctggagctgcacattaatgaaggattagtgcagaatgcatgcctagagaaagtttccgagatcatgttgcaaatcacttttgacaagttttgcagagaaaagctgcataattcacttgaactgtttttacaacttttattttagattcagagggtatatgtgcaggtttgctacctgagtatattgtgtgatatgatgctgagatttggggtgtgaatgatcacccatgtactgaacatagtacccaagagttagtttttcaaccctttctccccttcctccctccctgctctagtaatcctgtttctattgttgcacaccatggaatactacgcttgagctttttaaactaaaatatgcctggctgattctctgagattaggatataagtgggatttatattaaaaataaacacatttgtccttctttaaaagtgacatatttaaaaacttaaaataattatcattttctttttgtttggaggtgcaaggtctagttctttttcttttcttaactctcacaaatagtcttcccctcacagacctccataagatattggcataatcctcaagtttggacaaacaaaggcacatcatacttttaaaagctttgtcattcaaaagtctcatttgcttgcctgctttgcagactattaatggaccttggggaataaaaactgaagtttaaaacatttccagacagatgtgccacagagcaatgatttgcttccttgaaaggacttctgtggacccttgtaattatgacaatcacttgcaaactccaagtctctcattcctcacctccgcaatccctgacactccatattcatttcatgataggcattctaaagtgttttttacactagaaggaggaactggctcaaagaaatagatctctaaatcagaaaacagaaaaacatctctaaccaggaccccaaaatgttaaattctggctttggctttgctgtttcactaggcagccttggaccttttgcttgacttctgagtttcattgttctcatcatgtgacaatgcaaagtagggaacagtagtacagatacctattactagaggagaagtaatggtgagaaacttcttggtgtgactccattattcacacaccattcttgtttgccctgacgtgttatgcaggtctggcttttatttgagatgtcctgaccttatataagagataggactgattcaagtttcaagcctaatgatgtaacacctctcagctggaagggagcatctctgagattgattcctacactgtgggagttccaagtatatattcatcacatataataaacttcctaagtcccagaatccctttcgccaccttttgctagcttttataggacagttttttagtagttatttcttaatcagtgtcttatcatttccaggtagtagtttagactcattaagcctttgaagttactggtgctattaagtgcatcattgctctgtgcattgaaggacagtgaagtggtggctgcttgtctgtgtgcccagaaccatcaggaaatggcttgagtaccccctgggaaaaaggctttgttaaaaaggaactgcttgttcactctgggacacttagccttctgcttattagtccttttgctgtgttcttaccaggttgagggacacttctttccataaatgcagacactgaagctggaatctggaacatgtgttttcagtatttagagatctgcagagtggacacatactggcacatcacaagcatgattgttatggtctcaaaagtgtgggaggatctcccaatcccaagagttttgagagcagcctgggtgacatagtgagaccttgtctctatgaaaaaactttaaaaaataaaaattagggcatgatggtgcacgcctgtggtccccattactcgggaggctgaagcgggaggataatttgagcccaggaggtcaaggctgcaatgaactataatcacacctctgcactgcagcctaggtggcagggtgagatgctgtctcaaaaacaggaaaaaaaaaaaagaaaagaaagtgtccacagtagtgttaatgctttttggctgcaaatattttgttcatgtgccacagtcttattttgtaccctggtgactgtttctagcagtgtgtttgtggagtggaggtgatttgaggcacaggcatcatgaatcagaggagcatgatgtatgtgtgggtatttttatttgttccatttacaaactctaacttggtggaattataatacaaaaattaactttgtgttctcgttctctgcgcaggtccattttctacataatcgtattgtatatcactttgtcctttatattatagtaagaataacataacataataaaaggatgtgatattttaattaggttaatgtaattcactgaggtactggctttgggggatcataaagttcccaggagcaggcactttattttcataccctttggctagctagctacttttatgtttcgtaatatttgaactagaataagcagggtatcctcccattcaggcagtccttgatatgtggtattggggttacaatgattcttctatcatgatagccacatatgtgggctgatattttaataacttcaaaataatctttgctatatttacctctattaaatttgttcatattaattaagcaatcagagctaactaaatatattgacacttaaatggtttcagagtgtagcctagctaattctcttcaggaaactcgagattcaaaagcttatgtcaatggtaactttatgtccaaggatttcatcaccaatcctttggagcagaatattcctggagcctagttgctacagtgagtcctgtgtgagccctctagatatcttcaagaagtactgagatccaaagtactcaaatttgagtttctgttttatgctggcatttatcagatatgcaagaaatattcactaatatttatatctgatattagtcaatatattagtcagtacttatctgatattggtcaatttattaaatattgagtaatatctgatacataataaataatagtcaaatattagtatataacaatatgatgaagaggctacaagttggaccaaaggtcagttagactgacgtgagttcaaatttgagttatttaaatttgagttctttaaatttcacttctctaagcctgagtttcctcatctacaaaatgaggataataacaccaactaacttgaagataaaattaaataattaaaattaggaatcacagtaggcctgtctaaaggatatttaggaggtagtagagtctaaggaggattagggaggtagtgcagcctgatggctaggaagccttaggagagacttcttaagtacaaatcctggttctctggctacctgcaatgtgatcttgtgaaagtttcttaactcttctcagttgtattagtttcctcttgttgatctaacaaataactacaaatgtagtggcttaaaacaacacaaatgtattatcttactgttctgagatccagaagtctgaagtgggtcttactgtactaaaattagagtgttggcagggctgcgttccttctggaagctctagaggagagcccatttccttgccactgctagcttctggaggccacatgcatttctcggtttgtgggtcctgcctccatcttcgaatcctctctcaacactttatgagaactccaataattgcattgggcccaccaggataactcaggttaatctctccatttcaagatccttaacctaatcacatccacaaagtcccttttgtcaagataacgtattcacaaatttgggggggttaagatgtggacatctctgattatcttctattatctatctagatagatagataatctattatctatctattcccattatcctgtctatttcatcagccttcgttttctcttcttaaaaacagggtaatatagtatggcctctctcagagttaggataagaaataaataaaataattcatgtgaaatgctgagtacagagcctactcacaaagaggaagcacttaataaatgtttattattattgttatgacattcaatgaatgaatctcagggtctcttccggctaataacccaggcattcatgcctctgcctcaccgggacaatgcaggaggcctggaagactgaaaaagaaggcgccttcccaccagctattcttcctcactcaaattcttggcaatcaccaaattagagccatggctctcttaagaaacacattctcccagtcttcccttaatttcagaaaaaattctcttcaatggaagggacataattaaaagccttataatttataggaacagatccagaggcaagaaataagggctgcctctgtttcttctctttccattctgtattcctgtcatagccagtcaacgctggtcttggggaaaggaaccgtggtgtgcaaaatgccattgtttactgctggagatcttgcagccataacttttggctgctcatacccccgcctgtttcttttccatgtggcctatttagttttggcatctatgttcattaaccccatctacttggctgtgttttcattgtataacaatcaccagagtccctacaatgttgttttctaagttgtttctaaatattgttgttttctaagttgttttatatcagcctaggatatccaccacagaaagaatttaagtggaggaaggaaaaaatagaataatattactaaatttaatatttagctatgaattaatctctattccacatgttactgatagataaaactagattgtaaacttgttaaatgtaggttctcttatgttctcattgtaaatgcatgtttattaaaaatcaaaatagctccttctgcaacatagaatttttgatactttttaaaaatatttttggtacaaataattttgcagaaacatatagtagaatcagtagcgaggaaggggatttaaaagaaatttttaatagacatactctatcatcttttcctatccttcttgtactgactttggaaccctgtgctcttaagttttgctattggtcttaaatctgtagatacacagtgatggtcatattggcatcctcccacccacccatcttagccctcatctgccgttgaccctctcatcttccttatctcaaaagacgctttcctcgtgtggcctctggagaatatcatccagagctagactcctcagaaagcacacaagagccattattatttccttttcccagcgaatcaaaattgccacctcttcactgtgtttatctcaagcaggtatgaagaagaaagcaaccaaattaagtatactaattctgattttcccaaggaaatttgctttattaatgacataaaataaacttcccatggtgaaatttcaaggtacatctcaatgacacatagtaaatgagaggtttcatgttaaagagaactttctagtttcactaaaaatcaccccaaataaatggcaaccctctccatcctcactgattcattcaagaatcttcatgcctatgcaaaagcagctctgtgttctgagtatacagtgatataaagcaccatgccactgttggattcacacatcatggatatcatgattgttaggaactctattggtatttcttttcccaccataatttcctggtctttcttgaccaggaaaaaaatatcatgaggctttctgtctaccttgttggttttagtcacatttcctataacacacatagaaacgaagaaggtgaataaaggaacagagttaaggaaaggaaaacaaagagcagggagggaaagttggagcagagaatgagagaataagatggaaagaagaagagaggtggaagaaaatgggaggaatgcagaggagataggcactttcggctcacaggtctctttccttggcaaaagtgggccattgcacaacccgtgaactccatcctgcccagctcccctctggaattcactcacacatgtcttcagttatgctttagcctatgtccgtgtgtgtctgtgtgggcagtgccccacaaccagtaccctcgggaaaaacagggcagttcctttgagtcttttttcatacaattgcattttggttctcattaagaagctcagtgggatttgtagtcagacatgtctagtcttaaaccttacattgtccacttaaggtacatcttagtctctgaatcttggttttcacattggtaaaatgagactaataataccaaccttatggtgttcttacaagaacacagtgagaaggggcctgcatagtactcggaacatagtaagctttttaagatgataattgtgttaagtagtgtcgtggctattactgttattatttattattatttcttctcccagaagtctgattttttgtcctattgcagaaaacaatatattctcctgcctctccccttcccaactctccaaactcagcactaaaaaaaagaaaatgttaaagcatacaagcctccctagcctacatctagttcaatactgcactttcactctcttttccccaattctcctatggaaatcaatttcagaagcccagatcacaattagcccatggccattagcagccccagtaatttttctcaacacattagaattgggggaggatctatttctttctactactctttctaatatcttcaaaaacaaacaatggtttagaattctttaagcaccaagagtcatgccaataatgtcctaaaacacgtgggattttcaggatgcgagtttctgcctgaccatgattattgggttgtgtatccaggtattctggttcctagtgcatgaggagcgcatcactgtcttctcccaccttcactgttccaccttagcctttgcaggtcgccagcaagcttcttgccctgtcccttgggcagttgctctgtagatgtgtccactgtaattggctgctgccatttcactaatagttggcactccccataaaataaaactacctttgattctcaccaaatcctgactttcttcttctaaaccagcccatgcaagaactgtaatgcctttagttgtgtgtgtatatagacatgaacattttggtggggtccataccttcatcagctcattaaagggtctaaaatctttaaaatatagacagggcagcatcacaccacttagccagctaaatacctccttgtcctgttgcagcctctttgttgggatgccaagtttagctcagtcacttgaaaaaattttggaattacatttttaaaagtattccaaaatattttacttttataaatgtttatgcatatatacaatatactccccactttgataagaggagttcaaaaattcaattacaaaattcaaggttgtcttattgcaaggttaattaaaaaaacagtcttctaatttgggggggggactttttaattatttggggttttttttcatttatacctaatcctgcagattatttgtttttatttatttaatatgtaggaaaaagaaacagatatattttcatgaatagtaatgttctacactgaattgagacagtcccaaatgatcagaaggcagtcatttcctaataccctttccccaagacttaaggacttggctaccacagcaggaggacaagaaagcctctctctccaatgtgaggctcagccatcatttccctatgacaaagtgggcctatgtgtataatattattgctagtgagaaatacagatgcacacatgtacacagtcattctgccaagatacatcgtattgaataaaacatgattctctaaaaaaaaatctgaggtcctggtgcagttctaaaggcagcagtacagctgaccccacctatgatagtctccccacagggactctggaggtccttttgatcaagctcaacctttggcagggctccccagtccctctgagacactctaataactttgaacctcacatgcataacagagtctgaatttggatcatcatccttccaaaaagttcctttccacccatgccaatctgctcccagcctggctctgcagtctttcctcatagtaagggggaggtgtggtgtgataccagctgctattgagcagaagtacctagcctcttaccaagccaaatgtcatcaaatgaaaccaaacgaaaccaaatgtccttaagcaacttgtacagtcttacccagaataagaggtttcttcctgacttgaaagaaccactaagagtagttctttagagaatacaaatggtcctgtcattttttaaatggcatttttctgtttcttaaagtttgcctcattagatacccatatctatatctatatctgtatctatatatatatatatatgtttatgtatatttatattcctctaaaagaaataaatatcttctcccttggctcaaagtaaattttaaggtgggtcttaagttatagaaacatactgcaaagcagcataagaattccaacctaatgttgtacaagtaagttcatgttcaaactcaactagcatcatatttccactcaacccgagccatgaatcggatgcacttagggtgcttttatttttttttaattttttatttcaatagttttgggggctataggtggtttttggttacatggataagttttttagtgatgatttctgaggtttggtgcacccgtcacctgagcagcaaacactgtacccaatatgtagtcatttatccctcacctccctaccatccttctcctctgagtccccaaagtccattatgtcgttcttatgcctttgcatcctcatagcttagctcccacttagaagtgtggatatatgataattggttttccattcctaagttacttcactaaaaataatggcctccagctccagccatgttgctccaaaatacattatttcatttttttatggccaagtagtattccaaggtgtatatgtataccacattttctttatccattcgttggttgatggacacttaggttggttctttatctttgcaattgcaaattgtgctgcaaattgtgtctttttcatataatgacttcttttcctttggggattgctggatcaaatggtagttctacttttacttctttaagggatctccatagtgttttccatagtagttgtactagtttacattcccagcagcagtgtaaaattgttccctttcaccccatccacaccaatgtctattattttttgacattttaattatggccattcttgcagaagtaaggtggtatctcatggttttcatttgcatttccctgatgattagtgattgagcattttttcatatgtttgttggccttttgtatatcttcttttgagaattgtctattcatgttctttgcctactttttgatgggattagttgttattttcttgctgatttgtttgagatccttgtagattcgggatattaatcctttgtcagatgcatagtttgagaagattttctcccactatatgggttttctgtttattctgctgattatttcttttgctgtgcagaagctttctagtttaattaggcctcatttatttatttttgttcttgtcacatttgcttttgggccttaattataaattatttgcctaggttaaagtctagaagagtttttccaatgttatcttctagaagttttatggtttcaggtcttagagataagtctttgagccatattgagttgatttcttaataaggtgagagatgagaatccagtttcattcttctacatgtggcttgccagtttttccaacaccacttattaaatagagtgtcctttccctaatttatgttttgtatgctttgttgaagatcagtttgctgtaagtttttggcttcatttctgagttctctattctgttcctgtgggctatgtgcttatttttataccagtaatatactgttttggtaatgatagtcttgtagtttaatttgaggtcgggtaatgtgatacctccatttgttctttttgcttagtattgctttggcaatgtgggctcttttttggttccatgtgaattttaggatttattttctagttatgcaaagaacaatgatggtattttgatggaaattgcattgaatctgtagatttctttgggcacaatggtcattttcacaatattgattctacccatccatgagcatggggtgtgtttctatttgtttgtgtcatctgtgatttctttcagcagtgttttatagttttccttgtaggtattttttatttctttggtttagtatatccataagtattttattttgttttattttattttatttgcagctgttgtaagagggattgagttctggatttggttctcagcttggtcattgttggtgtatatcaatgctactgatttgtgtacattgattttgtatcctaagaccttactgaatttatttatcagatctaggagctttttggactagtctttagggcctcctaggtgtgcagtcacatcatcagtgaagagcaacagtttggtttcttctttccaatttgtatgctctttatttgtttctcttgtctgattgctctggccaggacttccagtactgtgttgaatagaagtggtgaaagtgggcatcctttgtttagtttcagttctcagggggaatgcttttaactttcccccattcaagaaactcttagtataaatgctcaggtccaactccagattcagtaggtccaggtatttgcatttttgattaggtctccaggctagcgtgagaggcagtcatagccgagaactactatgctggacacttgataagggaaaccaaatcccggataacccatctagctggtcgctacactaaagtagtgagctcatgcacctctctccaaaaaataataataataataataataataataataataacaaataagataccagttccaggagtagaagatgatattcaaagtaaaatacaaagtcagaaactcattataaccttgtattttagtaacagcatttttgtactgtcatgggctcatctagataaaggactaggaagtgaaagcaaatgcaattataatttgcctcaggaaagagctctgaatacttttttattatattgccaaagattaggactagaatgtaaatctaagaaagtaatatcaaaggccttcctcattaacagaaatggaaacaggcatttatatgccaccaataaatcaattaaaggaggaaaggagcttgaaatggccttcattgtggttattaacttcagggagtgcagcagttggggattgctgaacccagcattttcttttcattcacctggagcaaaatgtaggaaaataaagcatggtaatgctgtcatcatattaaacccaaagtctgcttaagtgtttgctaaagtggagcaaaacaaagcagagccagacgtttccaaaaacattgtcctgcttttgtggattttaattgcgagactgtgaatcagtgtgtgacttggtgtgtttctatgtgtctggtttacataaatctggacactgggaattcttttaatctccctgattatttccagtgtaacaatgtcctaaaataggaggattcctttaagaaataatacataaaggaacttcccagtgaagtttgagagagctgtgacccttctccatccttcttttggcctgttaatcgccaagtcctatttacttttttcagtttaccaatttcagaaaatcttaatttgcattgaacagtagcatctggaataaggttactggtgaatggaatctatactagcttagggatttaataattaacagaaaaaagagaattcaatatcttgtcatgccagaaaatgccttatggtttttaggcagccactttaccttcttgagtcttaagttccttagctataacttgggaatgtaatatctttttgacttcctaacaaagttacagggaaaagcattttataatctttaagaagttatacaaatgtaaggcaccattagtttcagcttctgcctttaaaatttcttatatatcatgcgtaatagtaatgtgtatttattatggatggtgttggatgaaaggtgtgccttgaaggaagtaacttgaggatgtgacatttcaatgtgaattcatttcactatgccaaaatatagttcacatttcttctaacactgtattccctacctttggatttattctttatttcttgctggttcccaaactgttttactattattttatccttccccatacatgggggcaaagagttggagccatccctgtccagcggtgcaaccctcttttaatgaccattctgaagaagggtgacttggtgacttcacctcctacaaattcattaatgccatggggccaaaagattatttcctaatatgggagagaaaaagctgaggtcctctcatctgccattctctgtgtggtctggtagtcaccaagtcctatcaaatgtgtcttctaaatctctcttaaatcaatgctttaatgcaacacatgagtctcactcctgaaacacagaagtatccaattcactggactcttccgttagtcgtgtgttcccacgcctaccctcctacctacccagtcttccttccactcaccatgctggagttgtttcctaaacctgaatctctatacatcaatttcctacttaaaccttggatggcatctagcgtcgattggaaagccctttatcgtctaaacatgacaaggatggctttccagatttgatgcctgttaatctctgaagtgtctccactcacacttgcacccagcaatactgagcaactgcctgttcccaaatgcaccttacctattttaaagctccctgcttttcttcacgattctatttgcccttcctccactctttttcatctggaaaattcccgtttatccttttaaattctgtttcagagtccctctttatttgatcctatttcagatcattccagaaataaactactacatcttacagtacatattttcattatggtacatattactccaaattttaattatttgttagaaaaatttgtttcccctttcaaagttgtgagcttcttgaagacaaggatcatgttgtattaatctttgggtctcaagaaactaccagtgtgtttgacaaagtatagctactttataaatattgcttaagtaaatgaatggatgggttcttataagcgaaaacaacatatgtcctgtataatttgtgggactgagctttagtaaaggaaacatctgacagggctcatcacttatttatcactgttagttcttttcacctttttgacatttatataatcttcttgtaaaatctaaggttgtaagcatcttatgtacatgaaggagcaacaaaaactgaccaaattgggctcatcggtgagccatgtgccctgtggtacacattagtgtcatcacagatgggttattttcctcttcacctcctccatatgactttgggcagctgttgttgtactgaaattcatgaaaagcacagctccttgtcaatttccctcatttcagaaataaaactgctctctgtaaaagcacctgctcctttccctacagaatgacatgctcttctctctttcaaaggcagtgagaatgtagtcaggcattgtgtgtctcagatcccattgatgagagttaaattggaaaccaaggagcccacagtggtgttccctgcctgttgaactcatgagcttactttgtcctagagtccctctattgaatcagtgtaaagtgtaatctagcaggcctcccatttttactattatgactacgatcaatgagtaataggtgagtattctcaattttatctgactacactactttccagaaaactctggggataaaatgagaagtgtgttatttttctcttatatttataattatattctgtgccttgtattatttcataccacagagatttttctatctcttccaaggtacacatttgacctggaagtgagaattaatacctattgtgtaactaatgatggttcttttacaagttaattaatcaaaaaaaacatgaggaatagaacaaaagttgacatcagtgtactttgcatatttttcaacttcttcataagacttgattttgctttaaaatgtatggtcctagattataaacaatgtaaattagtttctgtcatttcaaataattaatctctgaaactagtacaatttgaatttcacacttctgtaagtcagatttgggaaatataattgaaagttcatttcatggaaaccaaacttagcttgttttgctgttttctctctttcctcttttttttctctttcattcatttattcaataaatactagctggccatatcatttgttggttggactttgctgggcactgtgaaaaattaagatatgtgaggttagtgctctcgaaaccttacagagaaacagacaaagtgttaaataggagtagagttgtcacaacaccgcaaaacaagtagtacaagcagcaaggcctgcaagttcagatgccaggctttacctctgatattttctgtcagagctccctagactaccatcctttgtgatttatttatttatttatttatttattttattttttttttttttttattttttattttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtgctgggattacaggcgtgagccaccgcgcccggcctgtgatttatttttaatcattcttttcatctcattctaacacacagatccaggaacacatcacttgttctatcctctatctctcttactgcctcaagtctacttctgagcccttgaaataaaaattggaagctatattcatactattttgtgaaagtcagtattatctacccacttcttctgaaataaaggagatgaggttatatgaattaggaagggagtgtttttttctagatctatatatcaactttacctgcgtatatgaaatcttataaaaagaaagtatttgaccatgttcagcaacaaattgttaccaaattgatgaagcttcattagtaactctactcctttccaataattatttaggatagtccctggtatattatctaacccattgttaatatgtgcacactcttcccttgactccataaaccaaagctactctacgtccttccctcccttcctggcaatgggcaaatagtgcttcacccataaaagcatctggtcaggctactggaccaatttgataaacatcacttttaccaccaatttttttttttaattttaccctcaggtgagtcattttgtacacagctcattaccttttgagcagtcttctgctgtagttttgttaaatttatcctcaggaaatcaacccctctcatggtcacacctttctttccacttctatggctataattacctcattgtgtcttaattgcttttatgcttcggtatctctgccactacagtataagcaccttgaggacaagcactgtggcttgatcactgtagtgcactcagaggacagcgtggtcctggcttgatcactgtgatgcgctcataggacagtgtgatcctggcttgatcactgtggggcactcaaagtgtagtagggttcctggagtatgaaaggcactcagtaaaggcttgttttgtttccattcgtttatttttaattgtcagataattatagtgtatatttatggggtacaatgtaatgtgttgatccgtgtatacattgtaggaagagtcagtcaagctaattaacatatccatcacctcaccaacttattttttgtggtgaacatgctgtttgttgagtgagtgctcagaattgaaaggcattgtgtgctgtggaggtgcagaggacaggcaccaaacccaggcagttgtagaaagttggggaagatttcagaggaagatagacaaactgagatttgaagggtgacagcaagttagcttggcatagggagaggacaatcctgtcaaaaaagagcatggacagagtcctagatttgagaaagagcaggggccatagccataggcaaaaaaccatgcagctacaccttttgttaactatgcctgagaatcaaggcagaagtcagtgtggtagacatacgtgtgcatctatatatgtgcacatgagaggaaactttggtttttgaaagtttaattagatgcaataaaaagtcaaatccgtcagcctctaaaactcttgatatttagcccaaagccctctacatgattaaacatatccattaactttctcattattttctttttcctcaagctgaagtttattttttctatcacattttaattctctgttttaactgttggcattttagtagtatattttaaatagttccactgcagacaatagtatggttaaggaaagatatttgaatctaaccaccttgcatgaagttgttatatacaggaactgttgcaagttccaaacactcaacttagaaatgaacatttagaaaattacctgtttataaattgaggttttgagtgtataagggacaactggcaacaggatgagatggaagccatactggtcttagaatccaaacgtctgcatccttcattcaccaagtccatcagactcttggtttcatcatctgttgaatgggatccacaatatctgttctccagtcataggtattcttaaaattgaaagagaaactgaatgggaaacgagtcacctaacagatggtagattgttgtatttagttatagcacaaggtcatttgctacagtagttatttttatgttagacaataaaaattttatcccccctccaacaactacaacaataatatatatggaaaaatatgcgcagcaatttaggttagtaaaactaaagctgtactttttaaaacaaacagttttaaataggttttctatgtgtttgtgtcacaagtacagcaagtacgtttacagagaaatggcttcttgcctcaatagcgtgaggataatacacattgtaactattttgtctcatagaatgattgaagatagtgggaaaagaggaaataccatggcagaaagaagacagctgtttgcagagatgagtaagtatggatcttttaaggaacaccctatagtttccattgaatactcatggaaaggctagaaataaccatttatctttatgatatttgtacttttccttaggatcctaagttcctttcatgaagtgtacattttggccttttttacttcttacttggcaagagttcagttagtcagtaattcatcctaatttgctattagactgtctattttatgtggaagaaaatgtttatagatttatatatttacattcacacatatatgcacatacacagacagttgataaacactatttagtgttgacattaatacagtccactaaactttaaagtctgtgttcatcaccctgaactgtcacagcagctggcatattgtaggcactagataaaatttttgaaatgaattattgactttcttccctgcaaagtgatatcatatgtttatgtggaaaggagaagttaggcacaattactggaccaaactataaacttgtcattcagacctcatgtagaaaaggagaatctattctgcaaactggtttttttaaaaatactaaggaaaataaaagataaaaggagcttagagttgacctgctacacaagggaaaccaaactaagttactgactccagtgaagaatctattcaataaaggctattggtttatgtaagtgcacagttgctgtataagtaattggttggtagcatctcccttgtagaccatttttcttattcataaagaaaaagaacttgacattagggagaaaaccacacatctcaagttgaatattataaaggaaaaagcatggttctcttcatgtctttttatctcttcttcctgcatacggaatgaggatgagcaagagtgagtggtaagcctttttccctaagaaggcagtagacaaaattaggtttctactaaagattggaagtgactggcaagaatgagggtcagaacagaaaaaggaaagtcccagataataagattcatattttcctttatcattccccaataatctggtggtaccaagatagcattagaactaacaaggaggaaagaaaattaaaattgatgtggggaatctcagtcgtgttccttgctttttccacttttagagatgtgcttagagtgtttgggagagtttcagccaggccttccaatttcctagaccccatgtgtggtactgtgtcttcacctggaattgtgacctttgtgcagttacaaatccaacagagcaaggagcctagtgagtacttgtccatctaaacaaaatccaaagcagcacaggtatcctccaacagcacattcttatattaaaaaggcataaaattatgtcttatattataagacatcatgggacaatgtcttctcagacacagtagaaaaaaaatatttaccataaaaaggcaataaaatctggggaaaaatatttgaacttatcattataacactaaagactgtatcagacagcacactgtaagaactataaaagtatgcttattcaatgattttgtaaatccttctttgagtttaagtatcccagtgctttctgaacctgatatagtgcctggctcagacaaatacatatgttacaaatgtctattggattaaaattgcccaactcaaagaaagctcgatatgatttttagagacatagaaataagacaactctaagtttttcttcaagtgacagagacttaggaaaattgtgcattcggttcccaaattataactttgtgttttcatagaaacatcacagtgatgtcttgcagctttattagttctgtgagttcttgtgattaacggtcagaatagataaacaagccaaacaaatatatatctttcctccctgggtgttccaactcaaatgttggcaaaaacagctaaatacgtctgaccttaataattcattagtttgagcaacatgtttatatcagcactaagtagggcacatccacaataagtaggattcggctggataaaacaattggctggtttcaaagggagcaattgattttgacaggtagactgtcatacaaaagagaaaggtaatatcactgcgaatgtgttaaatggttgaaaaatatatgggtatcccagctgtatcagcagcacaccaaagaaaggaaaggaaactcttatcagagaagactgacatcaagattcaaaaagtaacttctaggaatctgtgctttctagacagggagcaaaaaaggactagacttgtaaatcttctcatctaagtattatatagaaatatttaaagaaaaaacaacaaaagaaagtgccaatgagattctttgctttagaaattagaaatgtgaaagaaaagttgtaatggccagagttaaacaggcagggaagacttttatccaagactattgcaacaagggagaaagactgaactcaacttccctggaagaaaaggcaggaagtactttaagcactggggaaaaatactggaggacttcagggaggagattggtcaatgtgattaggccatctgtttgctaattgtcacatttaaaagttaggcttctaccctcctgataagacttggagatagaggtgataagtccttcaattattatatttcaaagggctggcacccaggttcttgagaaagacattcctgggttgtaaacttggcaagatatttacatctcaaaggggcagagaaagaatttacaatgaaaagttttctaaagtaaatgctgtaagaaaacagaggtcagaagcctagagcaaggaagaagtctatctaaagttaggcaagttgaggaggtctaggtcttagaaaaggtaaagaacagagagcaattgataagaaaaatggataagaaagtttggcaaattcaggtgattgcagcacatatgtgttaaacattcactcttagctcattactataagcagcagaagcaggaagaaacagcaaagaaatgaaattaagagaagcatagactaaaaaacaaacagaaaaaaatagctttatataaaaaattgggtgaccacctactttgatttaagaaattctgtacaagttctcccttaaccaaaaattctcttcacaataatgccttaattatcagtttgcttagtaccttggattaaagctgaaaaaaacaaaaaaacaaaaaaaccctctagttaaatataaacatcatcctcaccttggctttttcagccatcatataagtttagcagcttaaataagtttatcagactgtcttttaacagaataaattgtttgttcttggaattaaactctccttttctgttgttttactctcagagcacatttacttagccttatatggtagttacttgtgaacatgtccacaacactcactgctgtgaactcctttttagggacagacctaggacatgtaccttcaaatccattccccttagatgctgaatcaagccttgtttaaaagccgattgggcacaggatgggtaggttttaatggaagggaagtgattggaaaacacactttgagaacattgaaggctgcctaacaaggtaaggaaggtcctggggagaaatgagagtgatgccaccggcctgtcagcagagacaggacttgaaatcaaaaggaggcaaatgaaactactcaacaaataccatttttggcttttgtttttgcttttgttttgagacacagtttcactctgtcgcccaggctggagtgcagtggcgcgatctcagctcactgcaacctccgcctccctgttcaagcgattcttgtgcctcagcctcccaagtagctgggactacaggtgcaccaccacacctggctaatttttgtatttttagtagagacaccctgggtttcaccatgtctggccaggctggtctcaaacttctgatcttaagtgaaacacccaccttggcctcccaaagtgctggaattaccacttgagccactgtgcccggcctaagtactgttgaattatttgaaggcaggccatccttgagagtgttggctgaagtcggcacatgcacgattggaaaggaacctagggcatgattttgaaacgcacactatgagtttaagaaaaccgatctcaaaaattcagaaaaatgacatgaatgaccccaccaccgtaggttcatggatacggtgactgttttcacttgcttcttcatttctcatgctcctcagtctttttaagatattaacaccatggatcgccaccccagaaattctctctatgtcatcaccctaacatagtctcctgctttttctgtcccctctacttctctttttctgtctcttagtaccctgtagacactgaagtcagagaatttaaagatttcttcttgaccagttgtctccatatacaatttgtctttctctcaagcctttacctttattgctataacccttgagtgttcagagtcccccaaaacaactctcatttctcatgagccagcttatccaaaataggcagcacataaactaaacttcccttccagccttgcctacttgttttcaagtgttctgctaatgaagcagtctgaggagggctcattgtcactccactaatagtgcccatcacaaaaatacctatcatccctgccaaggcggctgccttctagtgttcccaaagcctgcggtctttgaacaactgccaagcagctgggcacagctcagaagtggggagagcactcctgttcccaagtttgtgcctcattttgtcgctagaaatatagaatagccctacttgtgcacagagtctcctgttggcaatcttggcccagtcacgcacactactacattttgtgtgcttgttgataatttctggaatatactaaagctctaatccttatatccaactgtcctgtggatatcttacttggacatcttacaagcaactcaaactctttagcccaaaactatcttcacccatcaacaaacctattcctccctgtttgtaccttacttagctcaatgagggatactctattccactcagctacctaaggtagcaatcattttttacccccaaactcctttatcttcctgtcagtatctctctctttctctctctcagtatctctctctctccctccatccttcacacacacacacacacacacacacacacacacacacacacacagagccaatgataaagcgtggcagagttcaggcagcaggttcatcataggcttcatttttattctggaaatatgtattgagcaaaacttttaaatgaatgagatatttaagaatcaaaatggctatatattaatagagctatcaaaaatggctatataatgagctatcaaaatataaaaggcaaaacatacaaaaattgtgtgaaaatgttcagagtgcaaaagctaaaaccaaaagttagataagactggttcgttgatttgttggttgattggttgtttgaatgaacaaatgaatgggtagggaaaaggtggaaggaaagaagggagtgagagagggagagagagggaagtagggacagagggagaagagaagaaagagaatcttttcaaaaagggctaaagaaaggaaaaactgctgttgataacagtgtaaacaatctgtgtctttgctgtcctatttattacttccttccaactatgacatgggtacaagaggcttgaggagacggtgcaagagcactaagttgccttaaataaatttgttttagtttttttattatgaaaagtttcaaatatatgtagaagtagagaaaatagtatttatctcaactcttaattatgtatgccatcccccactgtattagtatgaagcaaaactaataaatcacttagatcagttgaatcaccagatttaacgaattatattccagtgatataattcagaaaacaaccactatccattattttgaaaaataatgaagagtacattgaaaaaaaatgtaacgagaaaattctgtacttttttattaaaaagaaaaagtatagattctttggagtttagggtatgaactggttataagtttcataacaaaatggatgttttttagatcttggccaaaatatagtggtaattctagacatatcaacatactaaaagcaaagattgccctgctgattttatttctttactcatttatttaaattccatctttttaatagataaattaagtcagctaatacgctttttaataagactaccagactgctagatcagaaaaataccatctgataaaaattaaccttaatttcagcaagatattgaccaaagctgttggactgtgcatgtgttggggaattgtggactgggtcacaatacagttaggtagatttatgggggatgtcatgaccatgtctaaagccacaactaatgggtctatcaacttggaggaaggcgtctagtagtatcctggaaggctctgtttgtggacctgttctggtccttggttttaatcaatgactcgaatgaagacacagaactaatcccaaagtaggtttttgggtttataaactttcaagaaaagaccacacatgtaaaactgggttaagttcattgtttgctggggcaaagaaaaatacatttattttgacaaggcagataaacagagtaagaggctatgtatcatatctcagcccagcttcttctggtccctttctggatggatcctgcagctaacacatacattgattgtgcacggttgtgtgctgctatatctgacacactaaattgtattgttcaccacatcccttttaatattcagggcttacatcatcagccaggaagaatttatacagcatttatagacctacagacctcttcctgattcttgaacaaaacacagggtcagttaagtccacacagtgatacgacaggagagagcagtcagtgcacttcaggcccaaagcagcatctctacatccctctttactgcatcctggagaagtgcacctttgccgtatttcccccaggacttcaatcagaggaaagtgcagaggtgccagggttactgtgctcagagggtaaggtcttgcagaaactgagaaacttaactatgtgccacatcacaaacattttttcatctggagcttaaatcattatgcttgaagaacttacacaaataatctgtgcccctaatgttttcttttaagtgattatttacagatattgagactctcctgattgctgagccaaacttagcaccaataaaagtacatcctcatctgggagcaaaggcagatttagcattcaggtatttctaaaagtctctctgtctctggttatcgggcatcttagagagctcattccccacgagtcacatttacagagggcatgaaactaggaaagatttttgaagttccagtgacaacttaagaattttaaaagattcagaaaagttcctagtatgagctaaattttaaaagtaactaaccagataaatatgacgtcctacccttagctccaaaataggcatttaaatagcaaatagaaaagatttgacttatatagaagtgcatatgatttttcaaagcagttttttaattaacttcaaacttaataaaagctggcataatgagccgtctatttttaaaaaaagatcacattagttaggagtccttatcaaaggtagtaataattgctttctgtatattctatacaggtaaagcaatagctatttggattaattttggacacctaattttaaagagatattagccagtcacagaacagggtgactagaatgtttaagggtttcaaaccatgcttgatcataatgaaaataataataacaactgccatgaattgaagccctactgggtaccagacagataaacagtatacctgaaatggctgtggagttgaacatcttttaccctaaaaaaagtcaaggagaagctacctccccagctaaattttaaagtccatgatgacaaggactgttgcacataattttcagatggtaatgaggatgctaataatgataatgtagctgctttgcaatatttcagaaatgaattctcaaatggcagggggaaaagagtatgtgactccaggggaaactagatcaaataggttgaagttacagggaggtaaatcaaagctcaaatataaaaaagaaatttctatcacatatttttgttcagaaatggcacatgaagcctcttaaggggcccatttactgttaagtggtcattatgttctcagtgcagaagtcaagactttatatctgtattaccagccagtaaagttgatattgttatctcgctttatccatgaggaaattgagatgccaaggaaaaacttggtgaaactcacacaactgggaagtgacagagttaaattttacttcctttaaagttcatttattttcacaagtaataatcttctctatcattggaaataatcctacgtggccattggctaaatgttcatctcttgagaacatttctaagggaattcctgcattgggtgagggtagttccccatctctttgatccctcaagtgctcagtgtcactaagcctgtttgtcaaagaataagctttattaagagtgaccgtttaatgatctgctttgtaaaaccacaaagtaataggactattggcaacacttcaagtgaatctgaagatatcggtttgagttgaagaaatgctaaatcccctagtgggggacacttgctaattcatgctgagtttcactgggaaagcacttaattggccgtctaatataatcgcttccaggatagttcatttactttctattctgttttactctaaaggattcacatagcacattttattagtatatgactggtaaagataaaagttcaatacatgcctttatatctgttatggaccataaacatgggcttagaaaaagaaaatatgtagaaatggagaaaagcagacatttattgatagtctaatgtgttctagacaaagtctagagattaactcattcaaaggagggtgggaggaatactaggagctcaggtcttgatgtaacaagcagcccatctgcagggtattgagatgagactgaccaaggctacgagagattctgtggtagaaagtggtgggcaatgtcgttaggcaagtaagctggaaagaaactgcagacgagcttggattctgagcagagcttttagacctgatgttctgggcatcaggagccatgctggactcctaagtgggagagtgaaataaggaaagtagtttaagaatatagggaatgtgttccctctaagttaggaaggaactggaagccacagtaaaagaaaggttgttttagaaaggcatgtcttcctctgagattgacaggaaggatcacaagaaagttgttagtaataaaaatgaatacttatgcagcatttactgtgtgccagacggtgtttaagtgccttaggtatattcactcatttatccttacaacagtcctgtgcaataagtactattattatcatcatccccatcttccaagtgagaaaactgaagctctaaaagcaattggcctaagggcacacagagaagatgctcagcagtcagtacatggtcacctaacagccacattctaatgaccaatagcaatgcactttaaatgcttatttgatgatagtatctatatcatctcgctgtttcactgtaggtcacagcttgagcagactgttttcagaagtggtggacacaacagggatgacattgtgtttcttgatccaagaatatggtttacaacctaatctccaatgttgattacatgtgtgtgctctttttccctagaacctgaggaacttgtccttgaataggacagacctgttcaagtcttaaagttatatttatattctaataaaaataaaattaggggtaaggatcatatctacagttgttttatttgtaaacattgtaaatttctttctgcacacatggcataccttatgtgtcctttttccccgcactaggggctcaagatctggatcgcatccgactctccacctacagaacagcatgcaagcttaggtttgttcagaagaaatgcaattgtaagtatgccagttgtttggactaattaccatcatgaatcctatagtttacatttggtactaagtttattaaactagattctgttacaaatattgctaatattgttatatatgtttacacaacaataaaaggggtattatgaggcacaaatggtagagatgactcctaagtagtcttgaaatctgaaaatgcttaaatactaaagcatatgaaccgtttagttcatactaaaaggatgaacctctggatacatatacaatataattctgaccttggaatggtttaaatctggatggatgtttttcttcttttctctaaccttggtatcataaatgcagtgccatcaaaatggtttccaacatcattctcagcaaactatcgcaaggacaaaaaaccaaacaccacatgttctcactcataggtgggaactgaacaatgagaacacacaggaaggggaacatcacactccggggcctgttgtggtgtgggaggaagggggagggatagcattaggagatatacctaatgtaaatgacgagttaatgggtgcagcacaccaacatggcacatgtatacatatgtaacaaacctgcacattgtgcacatgtaccctaaaacttaaagtgtaataataataaaataaaataaaaatggtttccaagaactttataaaatatcaaacattaaatcccccttatatttgtattttcttttacaagcacaggaaaatattttaaagcttttggaaaacatttaagtttttttctgaaagaacaaaattagctctttgtgtcagagttttaaccacatttgtttacatgagacaaaaataagaaaagagacaatacttaaagaaacaaaggaacttgctccagtttttttttcaaatttaaaagtgtaagcaataagctagatcactagtaacaatgagcagtcttattctctgctgggtcaacacttccattgtattaccatatccattttctcttggaaaaaaatattgattcatagttcatgtgtaagaacgttttcttttctttttaaaaagtttacttattaaaaaagtctcattttttaattaatattggatgaatttttaaaaatgaaaaccgtaatgttctcctgatacatacacatagttctatgataactggcatggtaattagactcatggtaagggtagaaaccggcatctccacatgtctaccctctcagagtctctagaagatgtttcctagggccctgggcaggtcaccttagccccaggcttctaggcttacagctaatcatgactgtgaggatgcaaagtacgcatctattcctcaagtttctcctctacatcttattccccagccccagtggataaaaatggggctgaagtttggggaaggaggggatggaagaaaaatataagtaggttgtcttattttcattttctgtggcttataacagaatacttgaaactttgcaatttataaagaaaaggaatttatttcttacagttatggtggttcagaagtccaagtcaaggggctgcctctggtgagagtctgcttactagtgggactctctgcagagtctcaagatggtgcagggcacacatagtaaggaggctgagcatgctaactcaggtctgtcttccccttcttataaggccacctcactcctgtgattactcatggattaatccattcatgagggcagagcccacatgaccaatcacctcttaaaagccccacctctcaacactgcctcacagggggttaagtttcaacatgagttttagaagggacaaacattcaaaccatagcattggtcacacatcatatatgtgttttgactcctcacaggaagctaaagcaatctaaaatgagtagtgagaaaagcattacagatgttgaaagaatttgttactgtatttgtagtcctaatgagtcaataaaagccatttccactgcttgcgataggggccaaggaaaatgttcccacagaagaagtttcctcttccccttcaaacacatcacccagattacaaataaaaggaagaatctccgtgttttcagcaattaaaagggatatgattgtcccacgttcttatcatgtgttaccactacaatggcctcagaattggaggggaaggcagagggtaagtggtagacactctgtcctccttagagctttgccaagcggagccttccttaggctcctttcaggagagctagagatttccaataaaagactacaaaatggtaagaaggaacgcccccccaaaaaaagcaaaaaaaggaaaacaaagaaaagaaagaaaggaaaaggaaaaggaaaggaaggaagggctcagggaatcagggacttggcaacactgcactcaacattaaggtggacacactgtgttgtccccactcaacattaaagtggacacactgtgttgtctgcagctgtggtccacaggccttatcccatgcctcctgctctctgagaaaggcactttctcattcttgggcatttccttttcctctttctgttcttttctggtccacatccttatcctgcatccagaattgtcttggaatttcttgaaaaacagtagagaagaagtgaggatgctaatccatccctgggtgaaaatagaagcttatacctgtccagtggcccttcagtctgtccattcattgacctcttaattcagttaagtgtataatgagctcctgctatgtgtttgacattgtgctaggtaccaaggatagtgtgatgatgaatgacatgcaataccttccttcaagttgctcaaaatctaactgagaatatgggcttttaagcagatttataaaaccatgtagaaagataatgatagaaatatgtacatggtatgtgagagcttcagggagtcagtgccctgagttgttgggggtgagggtcactggtaggactttcctagagaaggagatatcaggaaagtcttatttattttataatgtaccttataaaattcctgtatttcaggatgagaaaagatattacattctacaaaattagacaaagttaaggcccaaggaaaaaaaacaagcatattttgaatgctttgctaaattaaggttttaaaaattgtttctaccttcatcagaggcattaaatgcaagtactatatgtctttgcaaagttttcctttctaacaataaatgcaacagttgtgatattcagaggtatttgtaaaatgcttacataattgatcttggcttatcttaatcaaagttgaaaccttccttctagaaagttagccaaccagaagcagcaatgtttacatgacataacattagtcaacattgaatatattcgctgattagaggaaagtaattttagtctgcaataaacctaacccacaataaattatgataccttataatggagtttttccctacagtaaaagaaataagaaacaaaatgtaggtagcatatttgtaagtgcatttttttattggaaagtgtcaggctgctctaacaaaaataccataaactgggtggcttataaacaacatttatttctcatagttctggaggctagaaaatccaaaatcaaggcactgccagatttggtatctagggagggcagccttctggttcataggtggccccttttcactgtgtcctctcatggtggaagaagcaaggcagccctctggggctttttttttttttttgacagagtttcactcttttttcccaggctggagtgcaatggtgcaatctcggctcactgcaacctccgcctcccaggttcaagcaattctcctgccttagcctcccaagtagctggaattacaggcatgcaccaccacgcccagctaattttgtatttttagtacagacagggtttcaccatgttggtcaggctggtctcaaactcctgacctcatgtgatctgcccgccttggcctcccaaagtgctaggattacaggtgtgagccacaacgcctggcctggggcctcttttataagggcactaatccccaccatgaaagttctgccctcaagtcctgatcacctgctaaaagtccccacctggtaataccatcgcattaagggattaagtttcagcatgagaatttggtggggcacaaacattcaaacaatagcagaaactcattatagtatttacttcgtagaaatcagtggatctgaagtgaaaatagattgtttacttttaggtccataccttatttaaaatttattgcgtatactaacaaaactaagttttaaaactacataaaggaggaaaaaacaaaaacggctgttgtaaaactatcacctagaaaaaaaatgaatactgtctgcatacagcacagactgtgtatgttttcaggagatttcttttttatctattatctaaatccaaatttcataaatgttggttaattccctatagttctttccccacagcccttgcctactttgtttatgattttgcatgtggacaactggttcctatcactgacattcatgtttattttcttctgttcaattcctaatgtatgctgagaatagtcagttcccgggattctaaaaggactctgaacaagaggccactgtcacccatgaactaaatgaggcccagaacctacttttttatagagaatgaactaatggattttatagatgaatatttgtaatcgatttgataacagggaacactaacttgtaaccccaatttttaaaaatgcatactcccaagaagaattatattcttttttttttttttttgagtggagttttgctctttttgcccaggctggagtgcaatgatgtgatcttggctcactgcaacctctgcctcctggattcaagtgattcttctgcctcagcctcccaagtagctgggattacaggcgtgcaccaccacgcccggctaattttgtgtttttagtagagagagggtttcaccaggttggccaggccaggtggcatgagccactgtgcctggccaagaattacattcttctcattggtagaccagcattttcttaatgtacccaattattggatatttaacttcagtaaaaatgttgtgtaaattctttttctctcttgttatgtatgtactgatataatatccctgattttgtcccttggtccacaaaaagaatgttgaccaatccctgctataaaagacacttgtaagtccaggcgtggtggctcacacctgtattcccagcactttgggaggccgaggcgggcggatcacaaggtcaggagatcgagaccatcctggctaacatggtgataccccatctctactaaaaatacaaataattagcggggcgtggtggcgggcgcctgcagtcccagctacttgggaggctaaggcaggagaatggcatgaacccggggaggtggagattgcagtgagctgagatcgtgccactgcactccagcctgagtgatagagtgagactccttctcaaaaacaaaaacacacttgtaaaaaacccatcttctttttgagtcaaagggttctcctttccaaatcgcttcttccccttaccattcatctttgtaccctgccataccttccccatgatgtaactagcacattctctaacagaataaaagaatgagtgtttctaaaaaattaggggacaccaagttgattatttgatattctaggaggaatggagcagaacaaagaatacaaataatattttaaataatcctttctaatcagtagtcttctcttcagcttccagattttttgttaactttccacaaaaattaataccccataaactcttataaggatatataaaatggcatcatctcagcctttattttagacaaatagctgtttctaccataacattatttccttggtcagcattgacgtggttaatgatccagataccctgtaatgtcagcagatctttttttttttcagaaattactttggagtcaatgaaatgcagccctaaaatcatgaacaacaaaggacaacaagagaaataaatcagaaatatctaatccctcctgtttaatagtaggaacaaaattaagaaggcaagggaatattctatcctacacccacagctaacattgcaccatcttttagtcctactggttacagcctgaattttctttccattagtcatatcaactaaaatttaattaaaattttgtttaaaaggcaaagaggagaaaaggtctataattatatctcggctgtcagagtttctcaacatactctttttctagtaattgaaatattttaaaggtatccttcattcagatatgttaagttagaacacctgctttttctatgttactgtctctaaatttcttttcaaatttcttttgaaccaaaaaaatgcagttacctttttacctaaatgtttctctatcaccataaaagtaagccaagtgagtcccatataactagtcggtcctgaatcaatattctatgaatgaacgaatatgctccactagattcatttctcaccagtcaggtgactagaagaacgctggtcttatgtggcaggagtagccttgagctatgtttttagtagtaaacactaatattccactcatttttcttccaactagtgtatcagtattttcctcttccctgcttcatgtttaaatatgtggatttttagctgccactatgaattttctattcttggtaaaaaattaccataaatttagcagcttaaagaagcacacatttattatcttacagtttttgtaggtcagaaatccaatgcagcatggctgggttttcggcttagctttacactcaactaaaatcaaagtgctggttgggtctgtgattctcatgttgggatcaaggttctcttctaagtgcattcattgtgggaaagtgttattttcttgtggttgtaggattggggccccgtttccttgctggctgtcagctggagactaccttcagttcctagagcctcccttattctttgcctcatggcccctgtgggctgctcagggcatgggtgtttgtggcttcttccagcccagctagagtgtcctctctgacttccccatttatgactagccagagaagtctccttgcttttcagtgactcacgtgtttatatcaggcccactcagatgatatccatattttaaggtcagctaatttgggatcataatatcatctgcaaaatcccttcactgcagcccctggattcatgtttgaataactaggagaaagtatgtgacaccatgcaccaggaatcaaccacactgctcaagaacatagactcttgtatttctcagataacgatgtataaaatcttggatgtaaaaataaagtttaaagtcggaaacacaggcaagagaaatcgaaccagagaaagatatgtatttaaaagagagggatcagaggattctccctagtcaaggagccagcaggaaaagcaggaatattcacagttggggaaataaactgcagatgactaacccttggagcacaattatctatgttagtgttgttgcaaatgtttttactacatattttcattcctgatgttgaatcattctagacacttgtttagaataaaggaaggtgcattgtgctagaatgcaacgttcccaaaaattccctgtgggaaagttggtggtggcagtggaatataaacaaacctattaaagatgcctatgtaataggacaatggaaaaactgctcctctctggcaccctggacctatggcaaaattatttccccttaatcagagtaaacctctggatgagaaaagcaatgattttaaagtcctgatgattatgatatgggtttaattaaagctgcttcttccctttaatggtttttaagatcttaaaaatcagggttttgtttccttgttagtagacttttgttttagagaatgccagaagctttgcttaaactgctgccactgcataacctgtgagctaagccacacctgtagtctcgtttccaggcatctggatgtaacacacagtgacttccttccctttcttctgcttctgcattagacgtgaaagctgtgccaactaagcacttttactttcacagctgaggaaaaaccatcatcttaaaatgctcctgtcagttgggaaagagtgatgcatacagaggaatgcgtttcaagcttcccaaccctatctaacaggtgccaaggcaagattcgatgaccttcccctggtggcctgccaagccctgtttctgggaaactgcctgcttggcttggagccagtcagcagagcgatgaagggatgcccagaaggggttctcccactgcctggctcccaggatctcaggactccagcacacattgtaagaaaacagaagtcagtcgggaggacagggatgggagagcagcttctcccatgaaatcacacctgagattccatctgaaagtcactcctgatgtcacctgggttcactcctcactgaggttttgttaacattcattgttattagcaatcactcatttatgtattcactccataaatagagacagcacttactgcatgccaagcattattctagatcatggggagaacagtgtgagtacaaagtggaccattcagaaattcatccctatttgcatattctcttactgaaactttacataaatgcatatttattttagtgtacttcttcagcaataaaaatttcattttcaatatatcactctcacctgtcgaagagtaaagcaaaagagagatagaagttggtaatagaaaagtggaagatttattcagcgaatccttttaaaagagaggttgcttccacagggtaccaagactcatcaagtttctcaagtcataaatctgggcatcatctttgacctcttatctcaacccagattgaatcaatcataaaaatctcatcagttatgctttcacatatatctcaaatctatccacatctttctgtgctgactacaaatgcctagtccaaaacatctttacctgaattacaatctaaaatggctcctaaaacttcctatcccctgagcaatcccatgcataatccccaggactgggaatttcgtggaattcactcctgtgattagattatgttacattgcacagttgcaacaaaccttaaaataggggaatcacctgggtgggcctgaactaatcacctgagccctttaaaagcagagagttagccaggtgcagtggcttatgcttgtaatcccagcactttgggaggccgaggcgggcggatcacaaggtcaggagatcgagacgatcctggtgaacactgggaaaccccgtctctactaaaaatacaaaaaattaaccaggcttggtggtgggcgccagtagtcccagctactcaggaggctgaggcaggagaatggcgtgaacctgggatgcggagcttgcagtgagccaagattgcaccacggcactcctgggcgacagagcgagactccatctcaaaaaaaaataaaaataaataaataaataaaaataaaagcagagagttttatctggcagccgtagaagagaaaatcagacgtttgaagggacagatgaatttgtcatgccattgctggcttgaagatggaaagtgccacatgctcaatcactagatgttgggagacagctggctgacagccagcaaggaatagggacctcagtcctatggtcacaaggaactgaactgtgctaacaaatgtcttgaaagtattttttttcctcagagcttctaaaataaaactgagttcagccaacaccttgatttaatcttgtgataccctgagcagggaaccagtcatgccatacttaactccttaactacagaactgtgagttaataagagtcttgttttaagattatgagtttgtggttatttgccacacagtcataaagaactatacacagtaaagcatggacctgtgctttctgctatacacagtaaagcatggacctgcactccagtgacatctgtgagaaagaagactgctcagatatgtaagagccactgggacatatactttgtataaaattcaaagcaggactgagactgaataaccctgtaggtttagaaggggagtggacactttgttttacacaactgatgaagttcagcgctatttaccgaaaacttttcccttatcaagttccaagtcccttatcatcatagagggagaaaaaggaaccaaaggcaggatctggacaaggagcaggataacaaaggtgggagagagaagtcaaaagtcaaccattctgagtaatgacacccccaaagcatcctccaaacacggagaagccacacagggaaataacatatgagtattttctttttgagacagagtcttactctgtcgcccaggctggagtgcagtggcacgatctcagctcactgcaacctctgcctcccgggttcaagctgcatcagcttgattcacctgcatcagcctgagtagctgggactacaggcacttgccaccacacctgactaatcttttgtatttttagtagagatggggtttcaccacgttagccaggatggtcttgatctcctgacctcgtgatctgcccgcctcagcctcccaaagtgctgggattacaggcataagccaccgtgcctggcccacatgaatattttctaccacaaaatgaattcaatctcaaagggatatctaaacccagattagatcttgtcacttctctgctcagattcctgcagtggctccccacttccctcatggtaaaagcatagccctgacaatggcccagttggctccactggatcaagtctttttttgttctgccctcatctcctcccactctcctatctggttactctgttccatccaccattggcctccttacttcactgggaacataccaggcatgtgcccgcatagggccttagcactggctgttcccttcacctggaattctcttcctgtagcgaactcaatggcggacctcctcgtctttctcaattctttgctcacttgtcatcttctcagtgagctctctaccttggcaaccccatttaacactccagttcccctatccgccttgtcctattgtttgtatttttcctaaagtatttattacattctaatatacgctatgctatgtaatttacttagttgttatgtttattacaccttcccaacttgagtgtaggcttctttgggcaaagatcagtgtatgtcttgtgtactgacatatcccccatacctggaacattataagtgttcaaaaaatacttactgaattagtaaatcaacattttgagactactggggaggagctcttgaacaagaaaatgatgtcaaagatagtgtatggttcagtacctattaattttaaatgaataaaataccactggaggtctacctagtgtgttgacattaagttgtatttcagaaatgaaaaatatttatagatatcttctgggtttaccccaatgctcagtatccatccattttcacactgtattagttcgttttcacactgctataaagaacttccctgagactgggtagtttataaaggaaagaggtttaactgactcgccattccatgtggctggggaggcctcaggaaacttacaatcatggcagaaggtgaaggagaagcaagtaccttcttcacaaggcagcaggagagagaagagagcaagagaagaactaccaaacacttataaaaccatcagctctcatgcgaactcactcactattatgagaacagcatgggggaaactgcccccatgatccaatcgcctccctcacttggcacatagggattacagatccctctctccacatgtgggcattacaattcacgatgagatttgggtggggacacagaatcaaaccacatcaacccctaagtctgttttcctcttaagtgatctgaactttgacttttcttgccataaggcttctaaaaatcttaaccctcatcattgtgttagtgagggaactgcagtagctttaagaagcctagctattgaacctatgactagaaggccatgtgacaaaacccattacagagaaagccctatggatttgtgaggttttacaggggcagaaggatctcgcagcagattgaggttttcttttcctaagttatttgggagacttcagaatcaactggaacttaagagcatcattctaaagcttgatacatagaagctcctacaggagatggggagggatgattacatcaaaccttaaaaatataaatatcaaaaataaaccaagccaatttactatccaaacagctaatgtatttaggcaaaagacttttaaaaagacaattgcattttttattacattaagtgcaatgtagagtggcaccgattgtctccacttcactctttttatagcatattttatctttttctagttaaatgtattcaatgctttttaaaaaggttgttaaaatgtacataacattttaaccatttaactgtatggttcagtggcattgaatacattcacaatgttgttcaagcatcatcactgtcaatttccaaaattttctcatcatcgcaaacaaaaattctgcactcattaatttttttaatatcctggaaatattgtctcagccattcttttcagtgatggccaccaaatagactaacctctggggtatagactaaaatggctaaaagtcaagcacatggttaagtgaccttcatggtacccctaaaaaatgttcgtgaaaataaagttactttacaaaacaaccctatttgtcaatgacttgtaaaataaaagctatatatatagggaaagtttgttgttgttgttgttgttgttgttttgagacagagtcttgctctgtagcccaggcaggagtgcagtggcgtgatctcggctcactgcaagctccacctcccaggttcacaccattctcctgcctcagcctcccaagtagctgggactacaggcgcccgccaccatgcccagctaatttttttttttgtatttttaatagagacgggatttcaccatgttagcgggaaagtatttttaaaaatcattctgcaaatatgtatggatcaccctccatgtgccaggtgctctgtagacagaacagtaaacaaaacagaaaaaaacattcatgtagcttgcattctagcaaacaacacaacaatttcagataggagcaagtaatctaaggaaaacaagacagaatgataagaattgttttgtgtcttatcactgtttacatcctccacagtgtctagcacacagaatgcatttgacccatattcatgtgcagatgggttcataaaatgtctattgagtaatgactctatgcatgacatcttactgagtaccttgagggacatggagattattcagacttggagcttcacttcaagctccttgtaaatgatcataagaaacctgatatgcacattctagaggtagctatttgataacttatttagctttttccttggcctaaacccagtttttatttcatttttctttccattactctaatttcccaggccctttctaaagtctttgctcagcatggtctgtacaacttactttagcatcttcaaaatgttcagcagtagcaagaaatctaaaagcctgaattgtccaataaaggattctccctttcttcccttttcaaagccccctcccccaataataacaacaacaatccatcctcaggaacagttagatgtgtgtcaatcagataatgttggttcttggcactatctttgcatttaaaagggaaaaaatttaactggggcagcataagaaaacaaatgcaatgagatttttccattagtttaaattattctagatagtaatattccttagtatacaaatttagtaatagaataacctcaagtttacaatccaacgaatgtgttctatttattataatgctcctgattttgtagattggtagtatcagacagtggatagtggatctactatcaaatagtaattcccctctcatgctttgctgcataaactgatatctgccctatcaatctcatgagccaaatgtcattttctgaaggaaaaaggggttacttataattatggtagttacaaaatcaagtatatatatatataacatatttaaataaattgtcggtagctgtttttaaccattgatggtgttgggctaggacgtctgctttatctccttgtctgtcagaaattataaagttctatttgttcaaggtgaggagagcatagtacaaaagatattaagtggcttcccttgggtaaataccagataaaatcatgtaattaaagagccttacttctaacttcccaatattatccaagtgttatagtagacagtcagtgtcctacaatgtctgtcaagccttgtcaccaaaaaacactggaacattgagaaaagcatgtggaccagcaaacctgctgtaaaactgatagtaatggcaccagccctaagcagcttactttctcagaaaaataatcagcctttttgatataatcaagtatgatacattttatctttcaatttaaatagtgctaaataaaaaacaatgatattatattgtggagaaaaataaagtgagaaaaatttatgtaactaaacaagaatcagaatctgcttcaaacatggtcataatcatcattttcttctcatttattgttctgggaggattcagccaggaatagacagagactttattaggatcagtgcttagtctgtttccccaggaagcagacctcaggacaaaacttgcatggaagcagctcactgggatagtgaacccagaacaaactgaaaccaggaagggaggaaagctgatagacagtgcaggaatttccaagaaaccttgtccaatgcactccagaactgtccattcaggagacaaaaggagagagttctaacctagctgctctgtcctgcattggtcaatggttgcctacaggagttaatgtcctcatgcttctaggttgcacatgtgtgagtggtagctaagttccaggtgtttgtactgagatgtcagaggtattcagaaagaggctgaggccagccattgtccggttgcagctgcatcaacctggttaaaatctgtgtggtaccagtcacgtgtgcaggggcaggagaaagaggcagggccaagaggatttccaaaggtacacaagaaggatctgaaatatcactcacttgattttcattattcagggttcttcatcactatttttcatgggctttttaaaaaattttgttttaattgaaaaagagtagtatacattaatatgtatggagtacaatgtgatgttatgataaggtagacattgtgtaataattaaaacaggctaattgacatatacatctatcttacatacttatcatttctttgtgattagagcatttaaaatctaatcttttagcaattttgaaatatacattattaactttagtcaccatgctgtgcaatagatcactaaaacttatcccattggccttaaaagttttttttaacaaaagatacactcctcatgttctttatactatattgatttatggatgacctcactcaagatacctataaatgacctgtactgctgattaaccacctagagatctcttcatcccaaattctagtcctatttcccaagcaattttctatgcactagggagctgggccacagctattttctgaatgaatgaatgaataaataaataaataaagtggattttctgttatttatttgtatttattctcattgcacagagaattgtatagatatatagtacagaatgaatgaagtaaaagtaatgcagttgctacttactcacttttttcaatggccaggtatacttcatctatttgagtttatgttggccagatgggcacataattcagggtcagtgagttcaaatttctaaaggacaagtaggagacagttcctcatggctgccagccctatcggtgctctttcagaatgtggcctctggcttctaggattctggccacagttcaagttactgcataagaaataagaaaggttctgtggaaaactatgcccaataaagccttgtggagctttcttagaacactgaggtaaagggaaagcttctaaagattatgtgtaatgctgggcatccagtaggtgccctactctattccattcacttagcattattgagaacccagtttgaacaaggtattatgcagagttgagaggaatgcaaagatgaacaagacatagcccatgccctcaagatgctagcacgtagttctgtggtttttaagtttacccccacgtatcttctggagaaactgatgaaagccatggacctatgtttcaaaatatacatgaccctgagcataaaatttagctcatgattttatattaagtggaatttataattccaattatggaatgatataaaacattcaggaaaaaacttgtttattaataactatggaaaatatgtagtgtcataaatggtccaatagatatgtgaagtgctctgggagcaacaaaagggagaaagtaatcctacctgagggtataagaatgagcatcctcagggacatggcatgtgagtggtaccttgagggatggtgattgtagggcacacctggtggagggagcaggctaagtaaaggcacatacaagaaagccaagggaatgtcctggaatttatgaagtccagtgtggctagagcataggactcttggaagaagctggagaatagtgggagatgggactacagactagtagactgaggtccaaacactgattttcatgcttagcctgttgggttttactcaataggcaatggagaacggcatggccagagcagaaccttataatatttcttaggatagacagaaagagacagaaagtggaggtgagtaggaggcttgcttctaagtagaaggcttttacaagcctagattagggcactagaatgtagggaatgataagaccacattaaagatgtgagctctaaaagccctttataaaatgactgtccacaggagaaataagatacaagattttcttgcttctaaagtgattaatattctgaataaagttaaacactggcaatgagaaattagttatcattcagatctgtcttttcatttaccttctcttattatttttgtaatccttggtataatactttaaaaataatgggcttaataaatccttgttcaattgaatgtttttagatttaatttatagtgtgacagctactgagtcaacaattttcatacctcactttgaataacgattctggtctgcagacacaatttaaggaatactgaataccttttcctaataggcaatggatgtactaccagggcctgtgaagattggcatgatattcaatttgattttacaccaaaaatatgttgtagaccttttcatgaaggtttattacatcatcttaaccaggaaattaaagtgaaactaaaatgttatctctgtaagacatgatgcttctctctaaggatccttagcaaagagaactaccttggagataaaagcatgctttcagagccagaaagacgttgagattggaagcataaaaacgcctagtgagctactcagctgttgtttgggttcacattttataaaggtatagctcatgctcactaatggaaaacaaatctgaagattgtgcctttagtaacattttctttctgatttcaatgtttggttaatgtgggtgatggcggatagcttcagtgtaatcacataaaaatgtatctattgaccctggaaaagcataccatttaattgagtccttcttccctaaaagatttttaaataccattttctcatgataagaggcctgaacaagggcataaaaataaattatttattttagagctcttaacaactaggtaatttgcacctggctttcttggccacagtgctcccaggaaattcctctgaatcaaaggagcatctctattcttcctgtctcttgtctaactccattctttaagttgtgctccatagcagtggttctcaaactttattgtctaacaaaatcatctaagaagctgattatacctagggatgccctggccacactctagacctatggattcaaactcgatagtttgagacccacttatggctctaaagaacagcccgggtttccaccaccatacctcttagctttagatggggctctgaattaactcacatagtagtctgaaaatgaaattaaacatttaactttaggagattcaaatctttaataaaatataaaaacaaagatattccctcattgaaaaattaagagtgttatatactgggcagtataaatgaatagttatagaccctgctttcctctaagctccaacacaaatttctctggttctaggtcaatataaaatctaaatgcaccatcatcgttctttgctctgtgccattgctcactgaacccacttcttcctggaatatccttccctccttatccccatctatgcactttctgctgtgttttaggaatcaacttgagccttacctcctcttccaaatctttacatagtttccagcccataaagcattcctgtattttgagctcctgtagcacttttctttttaatctgcactgtggatgtgggctttggataacacagtgtcttgtggtgatcttcagttaggtcatctgagtgtgtctttccccatgagacttacaatcttttttgtagtcaggctctcatattttgttaaatcaccaataacatcaaccataatgcattgtagagccttaaaaatgctggttggatttaatttctttgaaactattatggaatctagctgcttgttccatttcccaactctgtgtgtatatgcatatggcaatctttctccatatgttacagcctgcatgtatgattgatgcatggcaactagtgatacactgaaatattcttttttttttttttttgagatggagtcttgctctgtcgcccaggctggagtgcagtggtgcgatcttggcccggtttcacaccattctcctgcctcagcctcccgagtagctgggactataggcgcccaccaccacgcccagctaatttttgtatttttagtagagacagggtttcaccgtgttagccaggatggtctcaatctcctgacctcatgatccgccctcctcagcctcccaaagtgccaggattataggcgtgagccaccacaccggcccctgaaatatttgatttgaaattgaactaaactcgtaatcactgtgatacagtctctcatggatttataacatcatttcatccactaaagggaaaacaaacctcaagttatagaagaaagctcatattaagggacaaatatatttataccagacagagtgaggcaaagaattgaaagaatttttgtgagtggaaaatttttataattctacctgaatatgagagtaaattttaatgcctctctgtttgctctcaaaaataagaataatgcctaaaatttatatagtactttatattttactcttttcccatgtacattttcactgttcctcagaactctatcagaaaggatattattattcccattgtacaaatgaagaaacacttgaatcccagtgtctcagttcatgtttctctataagagaatataaatagtatgtatatataaatgtcaaatcccattgtatacctctgaatatatacaatttttatatgccaattgaatattttgaaatctaaaaggagagaaaatagattattattgcatgctcaatgcacttatttaatatctctatctcctccctctccgacacacatgtaagttctgtgtgattagggacctattttgtacactccaattctagaaaccagaacagcactgcaacacaataaggactgaataaacacttattgtatgagagaagttataagactaagatggaagactacaaaatgcagccagtgagcagcttagggtaatgagtctcaggaacctagtgtcactcctgacattctcaaggggctaagttcctctccctacctcctcacaccccagttctgtgaagcctggcccacatgtgagctccttaaaagcaattttttcttaaagtctacttggtgcttagaatactgaatgaaactttccatttgagagttgtcgtaggaacaagacaatgcttatatgcgtgttcatctgttcattctaaggacattggaactttgtttgataactaaaagaatgagtctccataattaacttttctacaagctagcaaatgtattttaagaatctgctatatgaaagaacataatatggcacttcaaacccggtgtgtaaactaatcagaaatactacctgaactttgttcttgtactctgaagagtgtaattgcaatggaaattcatgccgggaatattgcactgaaggtcaggaaatttacatctagggaggggagaactgaatgcattttcaggagaaactatttatctttgttgctatggggattcctgcatatatctgcatatctcaaagaggggaaaacaagtcataacagaaacctcagacaccagtcaccctcactttaagcacggagggcagggtggagattgagggagcatgcgcatggatatacacacacacacacaaaaccacacacaacactgtctacgcacaagaagatatatgtattcccaatagcagatcaacagattatatccaatttccagcataactacaatttcctgttctcctaattaaagcacatcataatgcaatgagtgaccttcttagggattaagcctcaaacccttctaaaataatatgtatatatatccttatacaaatcactgttaaactgcataaattaatttatggtaatcagcttcttgcaatacacctcacaacctacgaagacatttcaggctgtcttgatgccaaaggactgagaactactgacttcaagaagcgcttcttatacttaaatgtgaatacaaactgcctagatatgttgttaaaatgcagattacgattttctaggtctgtgtgggagcctaagagatgcagcatttctaaatagcctgtgttttgttactacaagtgtgatgttggaccaccagtatcaccaggaatccattttacatccttgcaggtgattccattgtgaagccacagttaaggatcactattccataatgactaaagctaagtcactataattgtctactgacctttctcagctgcaagccctttgaaaaccttctaaaagtttataatcagtggttgtcagaatcacctggagagttttgtcaaaacccttttccactcttttatattttggactcaggaggtggtagagtctgggtttgagaattttgagatcatcaaatgctttagaaaaagaacatcatgcttagattcagaaacttggacccagcctcagggattcaagaaaggctggccctggataaatcataaaatagactaaatcttgaagttgtctttttgatatttttctcccccatattttatctaacttatatgattctactatttctaataaagtttatgacatcagccatctctatctagatataactaggtttgtcattttagcacttttcctacggatgcttggatttaagtcatctctgtgaatgaaggactccatctcccattaaaatagtgcaagatgtcagaaaacacattaaaaatatctcttgagataaacaaactctcctttacccatctgcaactctccccccaacacccgaacctagcccttttctacctgagattgcctggatttatagaaaaccattgaagctttgtctatttccatttatgtatgtaaagacaaatcttaggtcttaataattaatgcctgaaatcaacactattatcgttacttttaagattccatgaagaactaaatattaggttaagaatgcattttgtctattctcgatgtggttattgttaactaaggaatttcgttatgcaaaccgttgcctttcctagtatattaatgtaaaatatatgcaactgtatagatgagggaattcctcctatctcctgtgcctagtagcaggtgctctattaatggacgactggtttgatagctatttagtaaaatgcgcgcagtgccatctagtggttcatagtcattattacacaacctaaatgtcatctaaaatgatttaactagcacagcagtaagcaacatatttatacaactgtcagacttttaaaacaaacttcttaataacttcttaatgaatctcaacttagcatttctcagtgtcactatttaaataaacaaaaggcttatgttacttaaatttctcaataactaatgtatactgaatgcttattatacaatgcttattataagcactatgtggagtgctttatgtgaagtatctcatttgacccccccaaaacaacaatgtagtagagaaaatagtattgtcctcattttacaggcgaggaaactgaaacctaaggaagttaagtgacttgcccaaggtcatagggacagtcagtaggggaccccagccactgccccggttcctgcaccttctgcactatgcttacacctcccaaggtagtcgccaatgaaataaagtttccatgaaacctttgtgaaagatagcctcctcaccaggtttctaatgacccgatatggtaaaatcaacttaaactccactaactcaaaatttatgacaacaaaactaagtgtctgcttttgtggctgcaatgcactttgtgattcttttacttcacccacataatacgtcatcaagattatgggttgattaatttattgaaattgggatacttggctaaaatttagttttggactcacagatcttataaattagtagtagaatagtatggctttagatcagagtgtatttagttattttatcacaaatagctcatttcttgatcatctattatgtaaatacacgttctcttttaatctcactataactgcctctggatggcattcgtttcctcattttaaaaaaggaataatacaatgtataaacaaaatattattacattttatttttattaataaaatttgcccagttttgcagttatttccagagccaggaatgaaaccttaatctctgtggctgcaaaatctgaattctttccactatgccaccactggaaaataaggggtacaatgtgcgtgactgcagttttttctgcatagtaccaccttgtagacaaaaataccaccatcccttactggaactaaaacaatatgctccaactacttcccactgtgtgcctgtccgtctccgctcctttcttcccttaaagtcagaaatgacatttttaagctgcattcctgatcatgttgctgtcctacttaaaacccatgtcttcatactcagcataaagagccaaatccttattgtagttatggtgctcctgcaaccttatcttgttctggcccaatcaagaccatatcgtaatcccattttatacctagcatgctatatgtcacagtatgtcactatttctgatcacccgtttgtgtgattgtgtgagtcatgtctgtattcccaccagactgttagctcccataggcaggaaccacatctatattgtttgtattgagtcctcacaatctaccatagtgtttgcatataattatgaaaactagttttacttaaatcatttttaattatctattctcacagttagccagaattattttatttttcatgaaatatttttcttttacgttccttatattaggaccttcaatatgtaagcacataaatgcagcatatttatgtttaataactttcatataatttctaggtatttgattataataataaacaactattgtctcctacatgacatgccctattccaagtgttttacaggcattattttattcagctgtcatagtaatcatccgaaagtagatgctattttcagttccacttttctaacatgaagattcagagaagttaattagactgacagtatacctaggattcaaaccagtgtctctgtgattcttcatgactatgccttattgcattttagaaagcaaatgcatccttagaaaaccctgtttcactgttgagtcatttctttgtcattctctcatttagtcaaaagacatttaccaagttcctatgtgtaaggatgtgtaaggcagtgtgaggggcactaggggtgtgaacagttatcacaatagacacagccttgtcctgtgccacatgcaacgcagaatgggaaacagacaaactgttggtctacacaagagtgcccactacatgctgtgatggggaaggacagagctctaaggtggtgcatgcaaggggtataaaacccggagacagggtttctgatccagcccagaaagatatccttgaggaagtaatgttgacgccaaggtatagtagatgagatgtagatgagaagtacacaggggctagatgaaaaaagaaaagaaagaaaaaaaacttcaatccttgtttagatttcaaattaatgggaagttattaaaggactttaagcagcatactatatatatatatatatattttttttttttttttttttttgagacggagtctcgctctgttgcccaggttggagtgcagtggcgcaatcttggctcactgcaagctccgcctcccggcttcacgccattctccaagcagcatacaattttaagcagcatacaagtgatatgtcaaattacggtttagaaatcacactctggctgcagtgagtagaaagggagtacagaaagaatgaaaaaagaactgactcagccaaacagtaagcgtgatagcattgggtaacgaaattgggtggtggcaataaaggttcatggaaatggtgggattacagtgatgtttaggagatatacagtccataggactaggtcattgatagaacccagaaagtaaatctccctggagggagaataggcagcgggaggatggtggcattcaccaaggaagggaatcccagagccggcaaggggagagatgagtatgggctgctcaccctgaggctgaagtacccaaagaacccttacatgggcatgcctatgtgggaacccttatgtgggccactcctgtggtcactcccatgggcctggataattccaccactgggaattctaaaagggtttcctattccttacaatggctcgtcaagagaaatttaagcatccagattccctccctttgccaacagccatttagctttcttgacatatacccatctccctcccatgctcaagttcccagtccatgctcctctccccagatgtctgttccacatcatccacaaccaggaactaggtgaggataggtcacagggaccaagcaggacgacaggctggatgtcatcagcactgctttctttgcatcctgcacccagacacatcctgatgactagatccagaagattcacagatcaaatctatagggagtaattagaggaatcccagctcttcccaactagaatttaaataaataaataaatttagtttataaatgccatttccctgggagtgttttgcttgctagatagaagagttggataaataacaccaagaaatacaaataatttccttgttgattaattcttgatatacagaaaagcttgcaaatttgaaatcacttaaatctgaatttttccaaaactaataaatatttattttagttggtatgtgatttgtactcatctgctccaaatcagagatatattgcaatatatttttcttttgacatgactcacattatttacttgttcatctataatgcattgtctgctaggtaccaggaactaccactttttactctatgcatttttccattttaggaatgccagccccatttcatagatgaaggaagtgagactctaagtcttagaggtcatgcacttgtcgtagaagagccagatttgcaacctaggtctttggactccaagtccagtgctccttgagcacaggtatcttcccttcataacataaaacattattttgagtaattgttaaaattaacagcaaaaatccaagtaaaggacacagtaacggttctatgtaacctgttgtttttttttttttagtttaaggatttgcataatctactcatctcttggatctcaatgtgcacacaaagttagttatgagaaccatactttaggtttttgtttttctttatgcctaatttgaaaataagaatgtctgaacagattgctctctctctcttagggttctgtggttacagatcctgcagttaaacctagcctgggaaaagggtctgacttcaaaagactgttggctagttggctcatttgttattataatggaagaaattggtgacaagttctcctataccaaaagtcagaaaccatagatctgttctgaaaagcaaaagtaagagagaagtcaagaaaaaagtcacatagctcaattcatagtagaagctgatgttagttttgcttattaggtatatagccaggagagagcaatgaggtagaagacaaaaaaatagggagctgttagtgaaaaaatatatatacagtgcatatttctcaaaaacggaaactgttatatttcattgagaataaacaaaatatttatttgcaaatgcaaaagcataatgaaaagtcaaccttaaatggtgaagatgtggaggaactggaactctcgtacactgctgatgggaatgtaagatggttcaactacttttggaaaatactttggaactttctttaaaaattaaacatacacttactgtgaaacccagccttttcatttctaagtatttacttaatatttttaatgattttaatattttgaatccctcattgtctaagagaaatggaagccacatatctatacaaagacttgtacgtgattgttcatagcaattttattcataaacaaaaactgaaaaacaacccaaatgttcatcaacaagtgagttgataaccaaattgtgatatatccatataatggaatactactcagcaataaaaaagagaaaactattgatactttcagcaatacatgtatgaatttcaaaacagttaacactaagtaaaagaatccagacccaaaaaagagtgtttaccatatacttacagttattaagaactgaagtttgcaacagaaagcaaatcaatagttgcctggaacagggaatgaggatggattgcagaggagcatgagaaaacttttgagggtgaggacgtgttctttatcttggtcgtgatcatggtttctgggatctcataacaagacctcagggcaaatagggaagaaaacagaaacagctttcttgactaccctagtgaaagtaaccatgacttaaatcagctggtaataatgtagccaagaaacttcttgttcttgaccagcctagttcagtgatgtgtgacttagttctgctgctgctgcagtgtatacataacttttcctttttaccttgtcttcctgcctaccttaactttctttttttttcttgtttccaacagcatactactaaaaaacacataaataaatgaaaacattttaaatactcaaatataatttggacatcctttcaaacactagaatttaaatgttggccttttctttttgagggggcagggtgtgcaatggggaaataacttttaaaccgatagacttggatctgaatgctagtcttgccattgactcctcttctacttttgcatttgtcagttcagtttccagatcctcagttatcttatgtgtaacacagggataatagctgtatttcaagagtgattgtgaagattggaaataactatctattgtggtggtcagtaaatcatttgcttgctattatgtaatgcacatcaagtcttagagataatgcacagcctatgttcatttacttatgttgaccccctgcaacagctgcacacatgtgagatacctagaaaaaaacaggacagagggtcatgtaaactgatgtatttgccttccattactttgggctgatgtgttaactctgctttaattgtagtgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccgtaagcaccctctgaatgtctgttcctctctacatgtttggctttcacttcctgtcttacttggtctttttcccaaacaattttatatctctctctttttttttttactctcttttttcttacagtggatgcttatgtcagtaaagtctccatgtgtttaatataaattttaaatcctgtgaaaaagactagagagtaaaatggtgccagaggaacttgaggacaattgtattttatgtgctgacctttagttatctcatcccatgcttcctggaagctgtggatgcttgagaggattgcctgtggtgcgatttaatgaagcgtgaagtgggaggatctttttaactctcttctttgcaaattgtttaagacagtgtttctgaggtgtcctaacaaggccctacagcaaacaagaaagaaattgaaaagggtttcttgactatcccagtcaaagtaactatgacttgcgttaaatggactggtcaatttaagtgtttcgatcataaaataaggggatgctgtccacagaccacaactgaagctcagcttcatttttgtataattttcccttttagaatcagagaatttcagggctggctgagatcttaaaggctgttcgtccacatatctcattttacagatgaaggaaatgaagcacaaagaaattgtcacttgtttggtgtctcgcagcatgttagtggccgagtggggacttaggtgttcaacaaaggtttctttaccaaggtatatgtggattcccctgaattacattctcagcctacaatttcaagagggctttttgccaatagcctccaacctggacgtagtaccaccccctccacttccactgcttgttttgaatattaaaaaggaaaattgctaacctgacctttcagcaatcacattttgagattctcagaaggttttacttagtctcattgtctggccaatgcctggaagtatttacccccgcagtggagatgttccagccaggctaatgttattttgcaattcacaaaagctaccagctgtcactttgcaacttagagtgttaacagaatcgttcctgctcagtttttccagtgtgcattattgtcttcgtgatatttatattttgagaaattcttcagttaaaataaacaattttacaactagcattccaggttggtagagtctttgcttcggctgtgcacacttcagaacgagatgtacagctctagcttaatcactatagtaactggatgctggggcaggtaaagaggactgtggttccacatgacaggcagcagaggcagcagaatggaacctggccatggcatttctgtagtggcatttctaacctggccctgtgacaagagtgtggcagctttcagatttgcccctaaagatgtcaagagacttatttgttagaaatgtaacaatggaaactgcaaaaagagaaatataatatctcactaaatcctggagtactgctagagaactcataaagaatcaaagccaaataatcatttgcacccactccataaatatagaccagaaaccagactaacaataaggaagggggtattttgtgagatatataggattcacacaaatatagttagatttttcacttttggtcagaaatatttgctagatcacttctaaatatagagctatgaacggtctctaaatagctgctgaaaatatagctgaatcatttcaagattgatgaaaagctaagtttgacatctattccaaggtaaggaacaattcacaaaaaagttcagaagaaatctttatttggtgcctattcttcgtatagataggaagcctcctgatgtgtactttcaataatctcactgtagtagatttataaacacatccacatagacaaatttcactgcaaagatttataaacatatccatgtagagatcctactctgcagacacttctgcgtttgctccttcagcgtagcaaatgagcataggcagtcctactgacactcaaattttccatctgatggcatggaattttggatatgaaatgtaagccatcaggaagtacagctaactggatatgtaatttagaagtgaatataagaagagaaacttaagaataaaataaatgttcaaattctatttcttataatagtaaactccaatttatccaaatgagacccagcgtggaaatctgatgccacttcctaccacctgtcccacgacagagtccaagtgtttaagagaaccgtctgtattttggcagacatgaatgatcctgatactactaaaagaaagatgtgctgttgctattacagaatcactgaaacatttaggagatttttctcccatttgtcgtattttaaatggacatataaataaacagggaaaaaatccaaaataaaaattagagatgccttaagaacctagactctgaagaagagttgctaaaaataaataaataaaaaagaaaggcagtatagtgatttaaactcatgaagaataagaacttggattcaaagaaacttggccattttgtgggggaggggatggtgccttaaaattcactagactcccaggtagttgaacttcgtgaagaaagtggtaacctgagatgaggattgatgcctcctttactgggatgtacttctgagagccagacttaccttcgcacagccatagctccccaagaatagcattccctctcccaccaaaaaaacatccggatctcaattttcataccaggatgcttactgcagactgtaatcagtttcctggttgcaagatttctctctgctcgttggcaagtcagcctctcagaagatatgataactacatctgtagatgatttgtacaatgttgggggtgggcagtggaccccagtggtttatgctcatgcttgccattctgtccctgaagacacagttccttgagtccagaagatttttgttttttgtgacattccttttaaaaatggctgtattcctgggagggggtcacccagggagcagttaccaaccaacttctaagcaaatctctccacggccagaggttatcttttttaaggcgtctagtggaatggatgagtgtgcctgagaaggatgggaaaagagatgtcagaaataagaccaggggctgagagggaagaagatatgtgagggagcagccagaacttgagccagtctcttcctcttgtccctttcctccgatcaccccaggaactggcctcccacctccccttctttgctgccaggagccttccgctcctctgtctcctccagaatccccccagcaaactggcagcagcttcttctgtcacctcttgtccatattctattgaggagggggaaaactctttgaagtcttcaaaggacctttaatgttgttcttattattttgtaggaaatagagagtaactcaaaagaaaaatattgcagaaagttaaaagatgaaaataattcttaaaagcctataatgtgcagcctttttgagaggtgcagtcacaaactctgaggttctgtgaagcctttcgcctgtcatggtcaagttgatcacctttccacaggtccacctctccttgcacctgattctgctattgtcttatagtgcatgtctgactgtttatatgactgcctcccaaagacttctttaggaaagaaccatattttattcttcttatgaacagcacctgagaccatagccaacacaagaatgaatcaatgaatgaaaatccaaggttgatctttctgagctcttgtcgtactaatttcttttaactatttttttttaagaccgagtctcactctgccgcccaggctggagtgcagtggcacaatcttagctcactgcagccttcgcctcctggcctagagcaattcttgtgcctcagcctcccgagtagctgggactacaggcgtgcaccaccacacctggctagtaattgtgtttttagtagagatagggattcaccatattgctcaggctggtcttgaactcctgggctcaagcaatccacctgcctcagcctctcaaagtactgggatttacaggcatgagccaccatgtctggccagttttcttttaattctttttctgagattaagtcttccttgatctccaatatattacaaagactagcgggtcccagtcacctagattcagaccctctatttttacttctgctccacagaaaaaaaaaacaagtgttcatggttaccaatgttggtgatcctatttttacaaaagacttctatgtactcctctcaccttctccctgcttccccaggaaacactaaaaacaagttgtcttgactcaatctcatttcaattcagtagtatcttctttcgtaagacagttcttcataaagtagattatgtgactctagccttgtttttagcaaataacattatcatatatactcagtcactcaaaaatcatagtatgacagttaaaaatattaaaaggaacagtgattttcctattttcagaggtcaagctatagtcttccatgataatcataataattgtattaaaaataagatgtactcagtatttactatatgtcaatagtcttactgacttggccctatattatcatgattttccagtagaggagatagaaagaggttaaataatttgcaggtcatacagcatcatactaaatgaggtaaatgagggaaaactcattttgtttcaggaactgttttaagctcagctctattcatgctttctgtttcactttttaaaatgaaaattaattaaccttttttctcccagacttgttttgcttattacaggatattattctgatgcttacattcctaatctttccagtttctggtatttatacacatttgaaagagtgtatgtggaagaaatatttggacttaacatgttttacattgtagcattaggatcagttttatgacagctacccagaactacaagtccatcacataatagtcttacgtagagaatacaaaatcctggtattttcctccctgtttgccatattgcaccttactgggccatttgaacacccatgcccactgctgagccttccaatgctacaaaaaagaccacagaactatttcaaatgcatggatatgaaatgcctggtactctgccaaaatccttctgtctttcgaatttaaaaaatgattcgatatttaatgcaaaatgtactacaaagtacacaaccatttctctgcaccaaaaaaagtattgttcatgtttgagactatgtagatttgtgaaagcaaagaagaaaaaaagagaagagttataaaaaaccaaatgttcttctcttttattatctatacagccaagactagatatttaaaacagtgtttacttggcgtggtgacttttttctttgcacgtcttaaatttcaagatgtccatagaacattctcctctactaactaaaatcttgttgtagtgaaaaatactttgttcaaaatttctacatcctgctaaaatggaatcactttccaaagaattttcacagctgtagatacattaaatatcctaatgtcactcgttgtttatctgacatactttgaatgagtagcaggtagaatttcaagagagatgaggaatttcaaggggtatgggggcattccaacagtattgaccccttctgttctggagaaacccctagcaaactcacctgccccggcgctataaggagtacttttcccagatgttttgctaacattgtggagggcccagagagaagccagatccaaataaagggtttctgtctgttcacaggttaacttcactacgccccaaaccagagttaattatgcctgtgaacacttctaaattcaaagcatcacataactgcacaatctaaaagaaacagccataaagccaatcattatcatcgtattcaaacacgttatatttctcaatataaatctcaagtggtaaatcagaaagttgcttctcacttgtgcattcattaattgaactgacatatgtaaagagcttgctatgtggtaggtgttatgataggctgggaataaatgataagacaagatgaaatgagatgagatacccttggaaaatgggttgtattaaaattaactgtttctgaccctttatctccaacatgttgtgagcaaatgaagagtagagaccacacctttttcatctgtatatccccaacctctaggacaatgctaatcaatatttattgagtgactaaatgagtgatccatatgagcaaaataattttcagataaaaaatgtgttatagtagaggcatgttgtggaagcagagggaggaagcaattctctccgttaattaagccaccaaaatgtgtgagaaagagcagtttgagtgctgtgcctctgcttatcaaaaatgcttaccaaatgtttttgtgaaatatgttggtaaaagaagagcttctgattttagtactcttaaatagagaaataattccttctgtctgtttaagaaagaatcagtcagaattgaatcttacttaaaagaacttcaagtttctcatgggattttgtaacttcaaacaggaaaccctgttggcaattcggagacaatttacctcctgtacttagcatccagccctaccgatcaatatctatttgttgttttatcttcttgtcaaaaacaaatattctcttccctgcaacttttccatataaataatatattcttagttggaagaaatcagtatgtctctttataagattatgggaaacccagggcagactaaagcagtttctcacttctttattatgacaagtcaaattttgaagtaattcaaatttttaacataaaacaccctacaaatcactatatatattttaaccaaagggtaagtgccttcctctttccattttcaatcagttgtcccctagaataacttgaaaagtctcagagtgagaaaacaaaatgtaaaggaagataaaagatttcaagaaacattgatttatgaagccatttcagtttgtgcttttgataatttgcatatattagcctggttctcttaaataccttgttacatgttaattatataccaatacacaattttattgagaatttttgaatgtcgatctagaacaagaaagtaaagtttgtataggcaaaagttccagggtaattggcttagaaacagaacatattccactatgccaaaagactataatggagaaaatgaataaagtatgtattatgcgctgttttctctctgcattgaaatggaaaacattacaaacaaaatactattattttattttaaaaataaaataacttttttttttttttttgagatggagtctcgctctgtcaacaggctggagtgcagtggcgcgatcttggctcactgcaatctccgcctcctgggttcaagcaattcccctgcctcagcctccgaagtagctgggactacaggtgcacaccaccatgcccggctaattttttgtattttagtagagacgggttttcaccatgttggccaggatggtcttgatcacctggcctcttgttctgcccacctcagtctcccaaagtgctggaattacaggcgtgagccatcacccctggccaattactattttaataataaaatgatatactaatattaattctttaagctttttctgtgccttttatattaccaaagaattaactgtactagcagccttaattcacaaagaaagacttacatggccatgtgattgaccacatcacagactcctaaggctgatcccgcccctaaaagtctgtgattcatccagacttgtgccctgtgatgcatccagtctctcaaacacatctggctcttttatgtcttgagatggcagtcagaattgcacatgaagttgaaggcatactgccatggcttttcataaaagcaagagaagtatacagactttttctgtgcacttcctgatgctgccccactcccaggctgtttggcctgaagttttagggaaaatctatgtttttcaacctcagcacacactggtggttggcttcctgggttgcagctgacagccagcattccatcggtgcagttttactaccttactgcaaaggcattgccagagacatagtcattttggagcaatatgctgctttcctgctcgtttgtacaggactctgaggagcttcccattatccatcctcatgcacttgtctttctgcttcctagacacttaacagattttattggctgtttgtaaatcaaactggtcccaactaatgacaattcctgatgagcatagctcctaaatttttccatttgggatgtatcagcttttctctactccttgcttcctgtgttaatgccagtgccttttttcacaatgaaatagggaccctggtcccatgttttgctcaaaatatgggctgataaccagaggaatatatgctacctaactgtggttggctaactagccaacagaagacgcttttcactttgggtttcataaaataattttgtgcagaataatctcacagtctctataatttatttaaacaaatcttcagaaacataatttttttgttagagaattcctgaatttgaaattagggtaactatagggactttttcatcacaaatttttttcaaccattatttcctactcacaatacaactgtgcttatgtgatatatttactcttcaaaaaaagctgatattttttaaaggccccctctttaaaattggacaccctcctcttcaccctgttatatttacaaataatgttcttttaaaaaagatccatttgtatttaagtctttagtgctcccattctctgttgtagagtcagtcatctctgctcactcctcaaaccgcataaatatttatccagtgcctgggataagcaaagtatgaactcacccagttttggtgtgcttgccacgacctaaatccctgcatacccccagaatccttcttcatgacagagtcacatttgcaatctggcacagtagcttgcataacaatagattccagtggcctaatttcacccttgagttcctgtaaaaccctcattcggctgccctccacttggtgatttatctagatttattgtgtcaatttggcagaacagctctgatataaccactgttggatctagtatcatcaatcttccatttccaggaacaatacaggactggcaatctccccatgatcttcttcattaaaagctgaggtctaagagtacacctatgagctatcattgtttcatcctttggagaactctctgttccaaaatcattggtggtcaatcctctccttttaaataaattattctctcggattcattgaaaggaactgtattgctcttgaagcctcacatataatgctcctcgatttctttgcattttgagggccacattattgctatgtgattgctaatcttccataccttgtagactttactgttgtcattatttgaaccatgttacagtttaggaaaaaagctaattacctcctgaggtcaaatgtttgatacttccagttatccatgtaatgggaggacaggaatgcttttgaataggctggtttttacaaaatcattgcatttctattacagctacctgctctaaaattaataactcactgagtggatggacactcaaaattctaggtgtaatttttataatgattactaatcatttcttaatataagaaatgtattagtcactaactctgtgtgagaccaagtgctaggcactaggaattcaagtaattcagaaaacatcatctctgcactgaaggatctcacaatgtagaatccagtcacattgtggacatgtaaaaatcacatcaaggtcattcattgtgacagatgccacataataagtaaaaagtgaagggcagagtgatttcctagacatctaggagaaaagctgttttcagagcagggtgaataatgatattgagtggcatcttgacaaatggatgggagggttgtgggcagaccatgttaggagggggaggggccaggaggcgttgaacagtttgaccatggtgtgcagtacaacaacagaaatggtagcagaggagactagacgagactgctgggtgtgccatgagcaaacgttagaacttcgtcctgagggcaaaaggcggccagagggttttaagcaatgaaataatatggtcaaatttgtgatatgagtgtgcaagcagagagatcatttcagaggttatgaccgtgttaaagcaagagctgatggaagcagtgacagtgggaatgaaaagaagggaatggattcaacatacaggtaacaagtctagctgagtccttcaaacatttgttcggagtggtagtaattaaggaagagcaagaaatcaaaggcgaccccaactcaggattcattttcaggtaactaggtacatggtgtttctaataaccagcagaaggactgcaggaggaacagcaggttagtactacggtgagtctgagtattatggaagagctctgtaaagataatgagttctcttttgaacatacttagtttggcatgaggtatctaagtgaaggtttcagataaatgattacataaatctggtgctgaggcttagaaataaatatgaaagagtcactagcatagggttcagtcaattttgcattctggctggttgtatttgaggtattacactaaaaatgacagcgacagtgataaataacaaatgatccctctctgaaacctagtaaggaacaaaaccacgattatttatatcttatttttcttatatataaggcatatgaatcttattcatataaattatttattccatgtactaaagctttgccaatacaagctttacttacctttcagacacattattattttaaataactcttttgaccattcttaagattagcaactatcaaataaatgaattactaatatgatacagtttctgattccaaagtataagaataaacagttgattccagctggaaaatcatttagctgaaacattatactttttatcatatcccctttatatcacatttgtgaaggacagatttgttatacttcctgaatcaatgaggatttggcagcacttgtgtcatttgggtagaaagaaagtgttcaaacagagcttttactttttttttaagacagagtctccctctgtcgcccaggctggagtgcagtggcacaatgttggctcactgcaacctccacctcccgggttcaagcgattcttatgtctcagccacctaagtagctgggattacagacgtgcaccaccacacctagctaatttttgtattttcagtagagacaggatatcaccatgttggccaggctggtctcaaactcctgacctccagtgatctgcccacctcagcctcccaaagtgctaggattacagacgtaagccaccgtgctcggccagagcttttacttttgcccctttaaaatagcagctctctttgaaaagtaaatatatcacataagcacagttggcttgtgggtaggaaatgatggttgaaaaaaatgtgtgatgaaaaagtccccatagttaccctaacctcaaattcagaaattctctgacaaaaaaaaaaaaaaatgatgtttctgaagctctgtttaagtaaattatagagattctggaattattgtgtgcaaaaatcattttatgaaactccaagtgaaaagcatgttctgttatttaaatccatagttagctagtagatattcctctggctatcagcccatattttgagcaagtgacatatacaaagaataagctaagagattctgatgtctcttaaggaaacattgaatagacagttcttcagatatgtgcattgaattgttttcacaaccttttataaaatggatgtgcccacataaggcatgcagctatgtatcctgtgatttctacagaatagaaaatgtcaaaccttgttgctggaagtactccaaatgacatcatggttttgttttgtttttgtttttgttttttttctattaccattaaacagggaaggccatggtaaaatttcagtatttgctgtcaaaatggctttagccacattgtgtggagggaagatcatggacaaattaagatgtaagttattattccttgtgtgtctgtttgcttttccttgctaggtaccacccttttctctccctcattcctctatgtcccctccccatttgtatctttcctcattctatgagagttgtttgaaatacatttttcactgatgtttggattttgtcatagcgatattttcatattagataaatgctaatgaaatgaatgttttcctctacttataacctgttgagtatcaccaactggcctctttctgaaattaaagtaaaataagcactctttgcagttaattgtgttatactgccttacacgtggtacaggatgataggcacgtgaaggcttagtgggaaaccttcccctttaaatcttctaaaagcaagactcttggcacatttcctcattcttctcagccagcactgttcaaatcactgggaactccaaaggtttcaaagccaacaatgtcaggaaagaagaataggaattacatagagacagcattggcagagttaactagatgccagtaaaagcatggtagctaaagtacattgagtaattgtgggccttaatgaacattttgtctctaaatatggtagagttccttaaccaacgacacactggggattgtttgtttgtttgtttgtttgctttaggtaaagaaactgagactcagttaaccatatggctaagacgatgccaggatttgaaccctgacttttttttctacacaggtggttcacaaattttagcatacatcagaatcaccttgagggcttcggtaaaacatagatttctgggtcccaccccaagaatttctgactcagtaggcctaggatgagggtgggtgaaaagcatatttatttctaactagtttaaaatgatgttgatgccgctgtttaaatttaaaatttccatttaaccctatccttttccctaaatagtatgagttggggctataatgctgtgttagaaagggcactgtcctgggaattgggagttccaggttgcaagcccagctatgtgactaatttgctgagttatcctttgtcagttacttcacttctttagtcctcagcctccttctgtatcctaaattttgggattttgtaagatacccatagaatcacacctggctgcatgcagccatctgtgtggctcacagcacaaggctcacctgctgcctgtcctcttctgagtgagatcgcttgcttcttgatccacccaaaaggaaagaataaaggaagacacagaacaccttttgttcctttgaaatttccctggagatgctccagggatgagtcattccagtggaccagtaagtaagtgaaagggacaacaaagcctcaggtagccacacagcttccctcacttctgggacttccctccatggagagccaaagacagccaggattcagagaagcctagccagaccttaggaggagccatgtagcttctcttttgttagcctgaaagatatagaaaattaaaaactatctacctcagtgcttatttgagagataatagctaaattagaaggtgctgacaccgagggcttttttttttctttttttttttcaaaaaaaaagaaaaaaaaaaagcttcagagtaatcctcgggcatttccttcagggttaagccagaaagagaaagtttagcaaaatgaaccaaggctaaggaaggaagttctgagaaccttgtctgccaaccccaactggccatttacgaagaggacattagataaatgtaaaaaacaaaacaaaagctaaacaaaaaaatccacttgagagacatctaaaaatacctgtttaatattatattaataggtacctggatagaagggtcccatattaaaataggtttaaggaaatctaagaaaaccagttttctgcatctcagaacgtctgtcaacctttaacataccaggctaattctgagccctcgaagtcctggtgtttgctgtctttccactcagctttgttcagtgtaagatttcatcctcctccaagagtaagggtggagggtgagggaggggggcttggtggaggtgacagtcacaggagtcacatctcactacagaggtccccaagcccttacagctcatcacctaggtggcgtctcagaccaattactaaactaattactggttagagaaaaagtatgacagcaatggccattgtgtaatccactttcacctcctgtgctcagaagggccatccctttccctcaacccatgagcaatccatgaacaaatgtgggtcaaataaagatgaagggaatggctggtaggtaagggactagcaatgtcagcacagttacaaagttcaaaatataactaagttattgattagatctttacaattgtgaaaacccttccagttctctcttgggcccaggagttcaaaggaaacagtataactgctacagtgctttctcctcaccccatcccatcaccctccaaaaagcactctctagtggccaaagtctatcctctttagggcagtgaaagaagcaacaaatgcatgtgtccccttggaggtaaactaagttttctagtctgcagaaacaagcccacaatatcacagattctgtagaaatacagatagtgtgaccccgataaatcgcattccccactttgagagcagtgcacctgaatcacacccttatgtgtccctggttctctgactgaggagtcactctttgtatagttaatcctgggaagatggttttagcagtttccaggtaacttggttaaaatcaatttgaccaaaaacaatttagttaaaggtaatttggtcacaaaaatctctccagaatgttaactagtcaaaaatgaatatcctgagttatgaatatttctagtttctgtgataattattaatggaatgagcgaatgtgggcaaatttacccacaaaatctgcccgcagagaccagtggctgccccttggtgagtgggattgtgggtgttcctattgtattcttttgctggcttgcattttaatgataaaacagataaggtagccaggcatggtggcacatgcctttagtcccagctacccagaaggctgaggcaggagaatcacttgaacccaggaggcagaggttgcgtgagttgagatcacgccactacactgggcaacagagcgagactccatctcaaaaacacaaatcaaaacaaaacaaaacaaaaaaaacaggtaaggtcatgattttctacgttgcttctgtaataagaaaaagtaaaatgaagggatatggaatgtttcaggcttgagggttttgttttcccttctttaaagtttttctaattcacgttaagccaaaatgccagctgtgcttgtttggcaatttttctatttttgtgcatagggttgagagatatttagctcgttccagctactcccttattgttggtgaacacagagcaagaataactggctgaaaataagtcggaaattttaaaaaacaaagagaaagcaacagaaaatttgaagttgattttcttaacgctttaaaatgcattagaagagaaaacaacactatgttgcaacataatttccagtaattagggcaccattcagtggtagggtgttccctgtgtaattccagggagcatcattgacacagcttaggagatgaagggcgccccctgcagtcatgtgccatggcaacctaaacataaacttacctaataacactactattttgtcagattgttcttggcccaattataagctgttttaatgggttggaacatttgtttatacttctgtcttagggctcctggatagttctaaggatcttaagggattctaaatccaatgctgtaagcctggtatgtcatgtgctgttctaaagctttggggaggactttttaagtctttttaaaagactagtattatggaaaatactgcatatttattgagtttctattactgaactggttgttttgcctctacgcctacccatagactttctaacgcactgacctactttaaattcttcagtatctccctcagcatcttctggacacaacctaaactcctcagtacaattcagccataaaaaagaatgaaatcctgtcatttgaggcaacagggatgagcctggaggacattatgttaagtaaaataagtcacgcacggaaagataaatactgcatgttctcactcatatgtgggagctaaaaaaaaaaaactgaactcatggaagtagaattgtgcttattagaggctgggaagggtagggggctgcaggaggttggggggatagggagaggttagctaatggctacaaaattacaactatgtaggaggaatacgttcgagtgttctatagcactgtagggtgactatagttaacaaaattttattgtatattttcaaaaagctggaagagaagatgttgaatattcccaatacaaagaaatgataaatgtttgaaatgaaggtaacgcccattatcctgatgtgatcattacacattgaacacatgtatcaagctatcactctgtagcccataaatatgtacattaatttttttactcagatagaatctctacagtctcatggttaataaactatttgaaacagcggaaaccctttataaatggagtatttaatgaaaatgagagtcaattcatgttctcaaaaccataatccgataaaagcctctgatatgcttaacatctgactttggtgtaaaaacaatgttcccagattatattttgaccttgaaaaattaaacctaaagtgaatagaggtggcacattcacagcagtttatcccagcagctgtgctggcctggtgacaagctagttagcatggtgacaaactatataatagcaaaccctttcattctaatagtgatttgcacagaggaattataaaacaccttgggaaattatgccattaatattcattaaatgcacatagtggcagaaattgaagaacagtggttcagtgaagccataggcccttcagagaaagatccaggaccctgactttacctcattgatcatccacaagaccaggcttcctcttcactacacgagtcagaaaacccttccctgtaaatcaagtgccttccacccagaaaactgtaattcatagaaagttttcttcttctgtaggaagttaatcaagtgtttgtcattacatctttatcctcaccgtgtctttgattttcaaatatcttacaccaaaatccgaaagttttagtgataatataaattggtaaatttctagctagataaatgaatatacgcacaccccaactttatagtaaaactctcattgtgtttcaaatgaagtcagcgtctctctcatatatacaaaaatttctcttgttgagctacatgagagttaatagttgacctcaaaacaaaaatgtagtgtcttattaaagacatttaataagtgtctctctcattaaaatgttaactttacccaaattacttgtgattgctatgtgccagaatcatctacaaaaagaaaccagagaaaacattatgccaggaatatttcagcataaaaattagcttttatattattctttcataaaaaatgtttattttgctacttttttgtcatttgtagcagatatattgaacaaaaacagtggagaatgttcatgtgatgaataatatctttccttttcctttcatcagatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacaggtaggagaaaaatatgtttaaggaagtatctctttcaaacagtggttgctctccttctagatgtcattccaggtcacagatactcagacaaattattctgtgtgatagcaacctgtattgtatttttcagcctctggcaaatgacctctgagccagtaactaaacccagcacatctggatcacaataatagacagtgtttactgaccatgaggcaggcactgtgctaaattttttcctttcattgtctaatttaatccctacaacaacccttctgtgttagtctcttttcacactgctataaagacatacccgagactgggtaatttataaagaaaagaggtttaacagactcacagttccgcctcaggaaacttacaatcctggtggaaggtgaagggaagcaaagacctaccttcttcacatggcgacaggaaagagaaagaatgaaaagcccaggggaatctgccatttataacaccatcggatctcctgagaactccctcactatcatgaaaacagcatgggggaaccaccccatgatccaatcacctcccaccaggtctctccctcaacacctgggaattacagttcaagatgggattgggtggggacacaaagccttaccatatcacctacaccctcagtgtcattatttttactatcactgcactttcaaaagggcttaattgtctcactcagcctcatgtgaaatatatgcttgacccggcaacaagctttaacattggtttagcaaaggataccagaaaggaatcccaacatctgccacatcatgacctgagaggcccaaaatatggtaaacacagctgcctgaatcttctacagcatgacacatttggggttccaagtgatgtgttttaactgggtatggctcaagctaccctgggaagctgcatagtttagggggctatctatgtgtgtacctctctggtcatgtagagagactccaggcccattctccagcgtagcccagtggtagcatagaaatccatacattaaaggttagtttaccattttttgagaatccaaactaacttttttgtcctctaaaaatgcctcttgactgggtgtggtggctcactcctataatcccaggactttgggaggccgaggctcaggagctcaggagttcaaaaccagtgtgagcaacatagggaaaccccatttctacgaaaaatttttaaaacatagccaggcatggtggtacatgcttgtagtcctagcttctcaggaggctgaggcaggaggatagcttaagcccggatggcgccactgcattccagcctgggcgacagagcaaggccctgtctcaaaaaaaaaaaaaaaggtatatccctgccccataaaatgcatacaacaaatgctcactacacagctttatggattaagagtcaggaagtcttttctttttactgaaattaacttttaaaagtgtcaataggccgggtgaggtggctcactcctgtaagcccagcactttgggaggccaaggcgggcggatcacaaggtcaggagtttgagaccagcctgtccaatatgttgaaaccccgtctctactaaaaatacaaaaattagccgggcatggtggcaggcacctgtagtcccagctagaagcaggagaattgcttgaacccgtgaggcagaggttgcagtgagccaagattgtgccactgcactccagcctgggagacaaagcaagactccatctcaaaaaaaaaaaaaaaaaaaaagtcaatcacttcaaaacacaaatctattttttcattcaattttactgctttccaacttttctcatggcatgctaaatgtatggctccttttatttttacagtgctttatgcctcacaaagtgaattatctgatttatggcttgcaacaaccctgtgacctaacaaggaaaatatgattcttttttaacaatataaagttcatagctagtgagggcagggggctgagtttttaactctggtcttctaattccatctgttaatgttattcttgtgttcttgttgttgttgcttttgttttgtgcactttcagttcatatttacaaatatgcagatgatctgactcaaggaaatgtaactacctgttgtattacttcacccagtcatggaaacaagaataatttcatttataactgaattcttgaattttagttagtgtattatagaataattggtaaatgtgctaatgcctcagaatatatgtctcattcaaaatcagctagaataataggactgggttttaaaaaaaaaatcttaaaaggacctatgctggtgtgatggctcacacagtaatcctagcactgagaggctgaggcaggaggagagcttgagtccagcagttcaagaccagcctggacaacatagtaagatctcatctctgaaaaaaaaaaaaaattaaacaattagccaggtgtggtggcacacacttatagtcccagctacttgggaggctgagatgagaggatccctttagcccaggtgttcaaggttgcagtgagctataattgtgccactgcactccagcctgggcagcagagtgagatcctgtctctaaaagaaaaaaaaaagagaaaaaaggacctatgtgttcaagaattatatgtgatgttgacatgttcaaaattccttttgaaatatcctatagactgttctgttatatgatttatatatatccttaatgataagcaacttatacatgttgaaatcataatagcattgttggaaacttccaggagtgctttttagcaagtatgacaaatagtcaaaatgaataagatcatttcaaatatgaaaagaggtaacacaaaaataataagaccagtttatttttgtacttaatgaattggctattaacagctactcaagagtctgaggtaggtaggaggaggtaggaagacagcttgagaccaggagttagagtccagcctgggcaacataatgagaccccatctttcaagcaaataaataaaatattttaaaaaataaataaataaaattatcccatcccctttgatattctagttcaaaatttcaagtagtgatttttgcatataaatatgtatttttttatttataccattacagtacatgtattaatatagctttcttacttttatcattttgaaagaaacttatagatacaatgcattccttttgtacatccaaaaggacctggatagtgagaaagaagcagactgaattgagaggaattatatataaagtaataaaaggagcaaatttttaaaaatgtagatggttctgtcctaacaggattccctcctgctcttgtataacagaaccattcacattaaccactaaatatttagtacttaaggaagttgaggaagctcagaagggaagttgttctataaatttagaagactgactgacaggaaaattgtagagtgagctatgatgcgttcttgagtaaaattccatggagaatttccattctttattttgcttcattatttttatactgtctttcatatatacaaatgatgctcttggaattgtttttctcctggtgatactattgactcagcctcagtggagagaattcagtcctatgtctgcttaggtataaaaagcaaacgatgttttcagttctaaactagtttaataacacatttggcaagttctgtttcttcagatattagacatttattgagtgctcttttgtttcagtctcaaatgatatgatatttacatagcaggtaaattgagatgattctctgtcctaaatttatggggggtttttttatgcagaaaaaagtcacgttaaatggtttcttggacacgcttatgtcagatcctcccccgcagtgtctggtctggttgcctcttctgcatcgactagcaaatgtggaaaatggtgagtagttactaaggagcaaaggtgattttttaaattattgaaattaggccattagttctacagttagtaagcccaggctgttgttttagggaagcctatttagtggctcttagttttgtttagggtagaactaacccatctccctgttcgggaaggccttaaaggaccactgaaaaattaggactgtcagttccaaaaataaatctcatggtcttcttctcaattacaagtcaggtgtggttaaaagacttggcacgatagaaggcgaacttcaacaaggagtgtgacattattttgtatttgttttagatccgaatttctcatatttgcatacacggtactgattatttcttcccaggcactcagccagaaataggtgggagaaatgagaaaaaaaaatagatgatagcaccctgttaatctttagtcatatgttccagattgtgagctttcaatagttgtacttacgttaaagataagagtaaaataactttcgtatcatgtctttttttaaagcaagtatttctaggataaaaggaactactgttggcatatccagatttaaatatgaaataccatttggggcaaaatttacagaaaattaaacatggagcagttcagtgcctccatctaatctttaggtgttcctacttattgttcaatgtaactctgaaatttctccagacttgacgaggaaataatttagtctctatctcttactgagatttaacttaagtctctatatattactcaacttctgtgtatttctttaatatacattgcagctaaagttagcttaattttaaattatcattcagaatttttagcatctgcccttatttatctgttagttagaagttatgaatttatcctgtttttctcatggagaaaatttaaagaatgaatttattttatttttttgcaatcactaacaatcatagtttttttatgtttatccatatgcagaagcgaagagcaatcaaggtccatgttattatgcaaaatgagttcacgttactgtttacagttctagaactagtcattttccaatcataaagctataatttctttcgttctctctcagcatttcctgctgcaggagatcagtttcttaggcaccatcccagaacagttgtccctagattgaagtcccactctagtctttctcaagagccgggaagaaaggttatgacacttgtttagaagacaatgcgtccagagctagttatgtctttgtttttacactttgctttttatcttcatttattattattttcattgtttttcctgactggttaggccggagaatagctttaccaaaggcaagaattgttattgttgttttagtatctagctcatagcatgtagacaattacttggatttgatcacttaaatctaatattttactttgcttcaaatctagtattttgctttgcctgctttataattcaaatttcctaccaaagaaagttaaccgtctcttgaggcatttgaattatttagaactgttttcagataatttgcacatcttttttagggccctatacacctgcctcaggaaagaaaaaaaaatctgtttgtcagatgtaggcaacaccactcgttaagtaagccattagtcactctattttttaaaaaataacttaattatctcatccacaccagttttccattctctgcccatcttcctttcttttttcttcctctcattctccgtgtctctgatattcgctctcttcccactggacaatcagcattcaccccttgtgcttctgagtcttccagtgagctgtgctggtctcctggagacagagagcagtttggggtaaaggcaagtctgtttggctaatttaaattcttgtaatgtgagagatgggaatagaaagagcaaatggcattacagagatttttgttgttaaaaggacacctcttctccatcccatttcatttcatttccccacaggcatgattgaaaagggttgtaagattccaggaatgaactaaatgtttctctgagcccaaatcaactatcatctgaaatcgtggtgcagagaagaaaggtgcaattcctgtaaggctgtatttttccttcttctggttcatacttttgttttcttggtttttcttcacttacttcccccttagtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatgggtaaggcaaggtccaggcaatacttggagttggatgtgtgagtgttgcccagagttaaagggaatatcaaggatggtggcagaattaaagggcaaacttaccttccatcccaggtctagtattcagtcccccttcctcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacagtaagttaaaatcttttccaagttttgttttgtggaaacggcttaaaaattattgttagttttatttttcttagattctggagttcttttaagtgcgtgactagaatattaaagaaacaagtatgagaggagagtgtggacttaataatactgttccattttacttttctgcagagggtggggaggggagattgtggttatattagcaaaccatcttttcatgaagagtgtgagtgaccaacctggcaaaggtggcatgtgagtgtctgtgtgatagatgtattctcaggagcatgtggtaccaggtctgtgggaggaaatgtgactccatgtgctcactgttcaaatggattatgatttactgatgtttatcttcgttaaactcaaagatcagttccagcaatgttgccctcgtgcatctcttcaaggattggtttttgtaaggtgtacagattggttcttgtgggatataccatcagcccttccagcacctcttggaatagttccgtcacaagaaaatccaacctatttatgagtttttctatattttaatatatttcaattcaacctttagtctttacttaaagaagtcttcagaatatacatcttaaatcaaaatgttcttcctaggaattattattgggaaccaatattcagtgtaaatatactagtacttcatcaccggtcagattctgaattcaagcaacagttcttcactaaggaagagtatactgagaacttgccaattccaatgcaactcctcactgttgtttatgtcatgctgaggacagatagatacattaacacggatcatgaactacaacttagtttagaagaaaggagctaaaactttctattttcttattgttagcatattaccagttttcaaacttctaccccatatcctaaaagatttgatgtttgaaaactaatcagatttagttgttttacataaatgctaaatctacataaggagcctctttcttaggggttgtagacctaacattatattccagggcactatctgtacaaagaaggatcagactccttgagaggacagaaggccctgtggtttgtggggcaaagagctgctgttgctgctgtcttaactgttctaagaattacatctcctaacaaaagccagagggatttcttgagcaatgctcttattacttagcttttaaaaaatgaggacaatagtcacttcattatattaccaattatggactctaggtataaaagaaagtgacaaaatttgaaatggtttcttatggaaaggaaaaacatggttaaggttttattattatgttggtgcaaaagcaattgcggtttttgccattactttcaaatggcaaaaaccgcaattgcttttgcaccaacctaatgtatgtggtaggctactttttataaaattttgactgtataacatcaggataaatttcccaacaatctaaacgaagaagaggcagcgtgattctctggaaataacctgaattttaaattctgaagactcagattgaagttccattttcacttctaactggatgtgttcagccacacctgaaacatctttcttgcacctggattcccgcaaaatcttccactcatcttcattccaagcctatttcctcacaaaccattttctgttcttaagtgagagcagtccttctagaatcaggtctgatgctgtcatgcctgtgatgtaaactcttcatggtctgcctctgtcctggggataaagagacagttcttaacaagccatataaagattttgatgatctgcctcctgctttcctccccagaagggctcccttcactgttgctgcttcctccattctcgaatgaccttcccagtctgctgagtttttgtcagaaggattcctgcaggcccattaagtcccagcgcaggtgccccatgcacaatgcctgcttccatttattgtagcatttgctgacactgagcagcaggaggcagcttgttcggaaactcttttccgagcattgagcaaacttccagactcagaatcagcactgaaaaaggatttcttccgtaaatgaatatctattatgaaaagcaaatcatttgataaaatattacataaatattagctgttgtcacttctgccttccttcttctttccagaaatcacctgctaagaagctgactaatgcattaagcaagtccctgagctgtgcttccagccgtgaacctttgcaccccatgttcccagatcagcctgagaagccactcaacttggctcacatcgtgtgagtatccctaccctcccagtatagagacaattttcttcaagggcacatgtctggagccacacaaaagcaatttcctatcagtggtcagcaaccaagatttttaatttagtttaaaaaaaaaagtcagagtaatgccatcataattttttgttgttgttgaggtgtacagtacttccaccaggctggacaagtaaagtatgcaacactaacataattcacctggaggtggaaaatatttcagaaagcttagttataaaatacggatgttagtggtgtctgcacattggaagttaacaatgggatcactgtggtaaaaaatgatttacagtatattattccttaatttcatatgtgctttgagttccaaatataaaagctgtttgttttatttctctgcagacccagtttaagatgccagcaaacctagaaattacttttgtttttcatcccaagctgtataactttagaagaatcatagcctgtgcaggggaaggttgaagagggggagtggcgggaaaatttatcagaatatccatagattcttttcttcaaagtatgtgtgagtttcgtggcagaaggtgttgggccaacaaacagtccttccagccatccctgctacctcccagaagtttcatgcctttgaacctctctcaggcctgggtggccaagataacaagggggcttaggtagaagaaacaattttttccttggtgttacctggggctcataagaagaaagagtctcattacctgcttctatgcacaattagatgtcatgtagtcacagatgcctccttatgaactgcctgtagttttccacacttcagtgggacctatcacaccatagggcctgtgtttgcatgttgacatcaagaggtgggtgacgggacctaccggtataggaattcaacaatgcaaagttcatgcttcaggcagttcagcatatgatccataaggggcactgtggtgggtatgagaccttcgtggaagcagcaactatgttctctgatggaccttagcaaataccaccaaacgatttgtgttgggtcacgtctgtgagctttgtataaatactttggggctttgttttgcttgttcccggggatgctctgaggcatctctgacctcagcagtatacacagcctggaggctcctgtttctcagcttacaagctggcatgggctcagcctccagaaactaatgtaaactaattctgtagaatgtggctagcttatttttggaaattatgtttctataaataagccttaaaataagccaggggtaaataaatctggggaatgtcccaaagggccaaccacttgcagaaatctacctcacagatgcttattaagaaccttattaagatctagactttccttcccataaccaattagacacaatcactaagttgctaatgaatgaccacagcgaagtgagagcagccagtgctccctgagctctgccgagagtaatttcctaccagccctgctgggagtttcaccccaagagagcagccttcaacagagctgctgggtgtcatgaagatagagggtgtgggtgtgaatagcctggctctaagagctttgctgcttcccactcctccaaagaattagaacgtgatgcactgcaacgtaaaagtccatttcacagtgagtcccactggagtattatctagctcagggcctgtacccagtgggtgctaggattgggtggtgtgtgtgtgtgtgtgcacgtgtgtgtctgcatgagagagagaaagagagggagaaagaagtatttaattggctgagtaataatttttacattttgacttacggggcaatataatctgttttgttatttattgaattaactgagggctatagcctcacaatgcgttcttagtttatgttccatggagagattttaaaattctgtacaaaatgtgtcttctgagaaaaacctctatgtattttaccagatcctcaagagtccttgaatcaaaatactgatctctactcactgataacatattttcccaggatgaaagttttaattttaaaatgcaaattgtacaagatatttaattgttgaaataacatacaagacattctggatgtagaatgttaagtctatattagaaaagaattttttttctatttttagccatagaaattttttccatatttgtttctttttcaaatgctattgtcatgagtagatatccatgtcttttttctgagatttctaattttaaaatgcattgctcatttaactattctaaattatcataggcacatcaaggccattgaaatgaaaaaataaatggtattaagccttaatcatttacaaagaagaatgctctcttaatctgctataatgaacatgtacatggaattaatgaatattcacacttcttccaaatgtatgtaaataagattttgataaattagacaaaaatatatgacattccataccatgtcattttataataagcccactacttttatacagtgctgtacaatggaaataagtgaaatttaagaaataaaacacaccaatactcccacctccacttaatgcgcttaatttattactcccaaatatgacttaaattataaaggtcttatgcagaaggaatattgtcatagtgcagaaatgtgtatagtaagacactttatcattgagtctctagcaaaaatcatcctaaaagtatgttccttagaactatacatagcaataaacatgttttctagctatagctctgtcttggtcatcctcattccctctctgatctttccccttgctttactaaataatttattaagcaatctttaattgtagtacaaaccacatctttgtcattctttggatgtagtgtcacaaaaatatcccagtccacatcagttacacccatagataagcttacagacagaggtaagaagggagcagtgagtggggtgcaagcattggcaatattgatgggcatcctctgtcctgtactgatgacctgaggttctggacattgggaattatagcacagactcaaaataaaacatttttttgccactgtgaaaaagtgtgttgattttgtaaattaatacaaattcttcaaagacatattcagaaaaaaattccatgatgtacatgtttaagtgaaggataactgtatgtccttacatagtgctgaaatatgtagaacattatagagctcatggatataaaatttgatgttgaacattatacagtcttcttaaatgcacatcttgctgtttaatgattgtgttaaaaattgctggccaggcacagtggctcacgcctgtaatcccagcacttggggaggctgaggcgggcggatcacgaggtcaggagatcgagaccatcctggttaacacgatgaaaccccgtctgtactaaaaatacaaaaaaaatagccgggcgtggtggtgggcgcctgtagtcccagctactcgggatgctgaggcaggagaatggcgtgaaccagggaggcggaggttgcagtgagccgagatcgcgccaccgcactccagcctaggcgacagagcaagacgccatctcaaaaaaaaaaaaaaattttttttactacatggcacatgtatacctacgtaacaaacctgcaggttctgcacatgtaccccagaacttaaagtaaaataaaaaaaatgctgttagtcctctaatatatattgcatccaaaggtgagcagcaaaagcattataagatacaaataaaattaagaaaataataagtggaaaatgctttatcaatacattagaaaatatttttattactcatttaaaactcaagttccaactttttcttttttcttctttttttattttttgtagaaatagggcctctctatattacccaggctggtctggaactcctaggctgagattacaagtgtgagccaccatacctggccacaacttaaatgtgaaaaaatggcaaaaatatggcacagtctgactatgtaacaagttaacattttacaggtagccttagatacagtaaaaaaaaaaaaaaaaaaaaattaaatcaataggatttttaaacaggttgcggtactaatacacacacatatacacacacatacatacatttgtatatggaaatgaagcatgtgacacacagaaaatgccattttttttttaactatagccaagggactttttttttctacccaccttgtagagaggtgctgccagtcatgaattagtccttaaatagaaatgagcaggtggtgacattttggtattttgacatttgttcttagctattgtattgcttgtaaatattaccatgattaacggtctctattctgttcaattcttcgctgccaaaagtgatacttggtaagtagtgcagtcatttccagtctacttacaaagatgtataatcatgatcataagtggggatgagacacaaaacaagtgagcaatatgaggctagtttagaactaagtcttcttatgctgtacactcagttcacaaggatgccacttatataaaaatgtcctctgtgaagatcttgtccagaaggccattgtgacttactctcttttgtggagctgtttcttttacataaaaccaaatatgttcaaaattcccagtgtgagccatttgttagataaggtaacttgccatttgattgtggaagaaataggaatttcagtccctctgaaaaccatcatttggtgccagagctagccattctttgtccaaagttcaacatttcagtggtagaccttaaacaaagccatttgctgagaaaccttgatttcagctttgtagtgaccagattcaatagaatacatttatcaagctagttaaaaagcattctaaatccacttgttttctcatttttagacagagcaagaaggaaaaatttttaaaaaaagacaaaatcagaagtgtggggtcaagtatttttttcaactctttgcaaagctacaatgaagatattatactctgttcactgttttaaaatctaacagaccaaacttttcataattcacagaggacatttgtataaaattagcatccttcttccaaagtgctagtgttcaactcaaggcagaattagttttaaactagccttgcgttgctcccttatatatcaaagatatgtcttagataagtaatgcaaaacactaagattgttttcagaacttcagttttgtctagagtagataagtagctgttgttttggcttcatccaacagatgacatgtcttacaaaatctcagagtatagtttagcaccagctaccttgaaaaaagttttgatgaatttgttattttttatttttttatttttatttttccataagttattggggtacaggtggcatttggttcatgagtaagttctttagtggtgatttgtgagattttggtgcacccatcactcgagcagtatacactgtaccatatttgtgatcttttatccctaaccccagagacttattctaagtctcaatgaatttttgcatgtagtattgacattttaaagcctgcagagcttcaggtccattccattcaatacattgggatatgcaagtctacctttttcccagaatgtcttcattgtagaatccaaagctgttctctaaggtaaaaattaaaccatttacaaatttggatcttaattatgccaatataaattgattctttaggctgctataattaatgtctcatcttcaaaacgttctatactgtcaaactcaaatatagaattatagtgaaactgaaatttcctctgattcagaaaatgctccacctcattttccatcttttgaactctaagtcccatctcatattaccattcattatcctatattgaacctaaaaaagggtaaaaatggcttggagatgagatagggatcttagccctatcattttacctgaactaaaacattcatgatggggaaagaatgacagaatgaaatgaaaatcagatgaaggaagacagactccatgcagttggtgtgtagaaccatgaacaattctgaggaaaattgaattctgttttccttctcttatcataagaaaacaagtgaagcttatgggatgctgtacaccacatactctatcatatggatcacccaaacaacagaaactaacttcatatatccttgtggagcttacttgcatcttcacttagaacaaaggcaaataaggtatgatatgattttacagcctgtgtcctttcagaccaggcatgttggagaggcccatcatcatggagaacacagaaggaacctttcaaagcctcaggaatcttcctctttccaagagaatatagattcaatgatcaggtcttcaaggcttcttgagaaggcagtagaagtaaagccactaccttcttcaaaatccttgcttcattccagaatattatacaatgaaacatcaaggctcaaagctcatgcatcagtattcacatggtgtctggagatcttcctcccagtgtttacctgagattatatattctcaaggaaatgtaactttaaaacacttaaggaatttaattggaaaatataagatttcttgttgatcctgggaaaggtagaacccagatcttcccatcccgtttcctggagggatgagggagagttttaaatttgtgacttttatttgttttaactttccattcaccctgtgttttgttttaggcctcccagacctgtaaccagcatgaacgacaccctgttctcccactctgttccctcctcaggaagtccttttattaccaggaggtaagttccaaccctattataaaataagccctttctttggtaatgagccttgattctgtggtaagaaaaatattctcatgcaagccaagggcagaatattgttactagaaactaacttgcaaatatccattataagttttcaatttcattcatttgtatgcatttaaagaggggtagggtggctttggggattaatgtcatgtctggaaacctgcatttataatttacccacagtaagaatgtgagggtatgtttcagttttactactgacacacatgcatcccatctcattaaggaagtcacgttcatagtcctcagagttgaagtcaaagaactggaatttcaggatgcaatggtgtgttactatataaatggtgaaatgtgtcattatttaaagctaagatacaaaagaatcctttgttggtgaaccctggagttcctgaggctagaggataaagaccaaacttggaaatgtagtttccatataagtaatttcacgataataataagaacttttttaaaaggtggatctgcatctcatttctttgcacaagatccattgccatgtgagcaagaaacaggagaagcaaatatttctctaagagttagcatcagacatatgcagggtcaagaggtgctctgagtcatttgatcaaatattgcaaatcaagcaccagataattattttataaatacatggagaaggctcacgggaaagcaaaaacaaaggtaaggaaaattggagtgagtaattgaacataagatttcaaatgcctttcagcagaaaaaaagtacagcctcatatttcacaaaatgcacataattcatcttttccctgaagaggtttataaggtgccagtttcactgtaatatcctggtacattcaactgaggatttgaagacaatgagactaagaacacagctgattttttttcctctgagttcctgtatgtgcccatcaacaggaacctgagatgaagatgttccccataattgtaattagcagaataaacagaatatggcagaaaatggggtttctgatgtataaacgaggtctgtaacaagtggaaataaggaaacagttatacagcagaacatccacagtaaaataatatggtttaggccctcagtaacttccttttagcactcttttttagaatcaccagcaaatgcaaccattttttttttctggaatgaaatcataaactgtaaaatctgtaaaagacacaggtctgtgcatctatctagggaagacctgatgtgatgtttagaaatatgtacttttattaggaagctctgcattctgcaaatatcaagcagaggtagaccccatccttactgaaggtcattttatatcatttcagctcggacggtgcttttggtggatgcgtctagatggataacatgacttcttctaccctaaaatattcctataatactttgagctgttctggttcctccagggtgcatggtacccattaacccaaaatatgattatttcccttttttcccattttcagtcattttggaatgttctctgtgaaccacagttgtgttgtttaaagctcacatttctttctgtcaccacagagattggcctacggtttctgttttgagggtgctgttcaataaagctgtgtacactaaatgtctttcctctctgagtgggccttgctctgtccatgggaagttttaatgaggtctcattgtttgactccctcaggttacctgagggaataagtgcatccagccctgtggctgaagagcattccctcataaagctgtacgtaaatcagcttgatcacggtgcacggtcagtatcccagccctgaattgctaatcgtagtagtagttccatagctagactgataagtcattctactctggcactaaaatcctctcatagtacgtcttattggagatagaggtcttctggggtttaatgaaattgtgttgagacttttcaacttgagctggactttgcagctctttcctctcctttccacatattttatggatttcatagcctcataccggtatataagagatgtatatatgtgaaatgtatcaagctggatcttgtttggacaagtctctgcttttgtacaatttgcaaaaaacccagatggtaatttctaagactcttgaattaaggagtctgttggaaagatctttagcattaactaggtgaggctaggacaatgtcatgtagctggacctctttgcagttaaagacttgaggacttgtacctttctgtcctattggacctggtccattttccccccagggagggaagtctgattcctaatgaagtaacaatttcaaaaacagtttcttgctctctgtgcttattctctatcacttgataatgctggtggtgaatcacttttgttttcttaatcgtgtcgataaactaagatggatagaaatctatcatgccagatgtaggcaaaagttaaaggttctatacttctatcattgaaacagaaccaaagaaatatgacctatggctctgccctcacccctagcccatcccaacaatgaaataaaacctaagcaagccaagtatagtgccagtcagtatagggcagcaccgagaaagtagagaagttctccatattttatttagcctaagtttagtcttttgtatcatgacagatcctagaaagataaagctgaatgaggctgaattgaaatccccactccagaatcctcaccacaaactcctggcattattcacctagggcccttcacaagcataccactttgatcttcaaaagacacagggatataactttgaagtcttttgacatcctagtaatctacttcacacagatttatgagtgtgtacctctggttaccagcatcatctgtcgcattccctgttcttacatcttttctagctctgtacttgattcacttttcccttacttaaaagaaaaaaaaagcgattctcaaaggcactctcccttggtccttcgaagtcttcttacatgtgtgtatgtctatgtgtgtgtgcacgtgtgcacatgtgtacattcagtgttggtcagaagttaggtagaatgtgggtcatataacataattgatggaccgattcacttcattcattttcttgattgtaaactgtatccctaatctattttgttttcttataaatttatgggaaagaatggctgatttgatggaaatctattatcaccactggggaaagagctctaagagctatgtatggtgagccagcaacattatctaagcttatgaaagttagtgtattattattattattgcagatattattgcaaggactgaccacaaagccaggtcccaaaggctctttctccccttcactgcccacagctctgtgcctcttaggatctgctatcttctttggcatcatgcctcctttttaaaatcttaattatcttgccataatcattacttagtttacatgagaaagttaaccaatactttttaatgtcaagtaagcttctttcactatggtcaagcttcttcattagtcagagtaaagactaatgaaaaaattagtcacacttcttttacctccaattttagaaacatcatttaaaggtttcacaggtattttcatagttgcaacctctaaagtggtaagcactcacaaaaggaatcaccttgactattctatataacatctagccaggtcttatcactccaccaaatattaggaaattgcttacaattcatatagcatgttgaacacaatctaatgtgctagtttctggtttgctgcaataacaagtagttaattaatcatattgtattagatggccgggcaaggtggctcacgcctgtaatcccagcaatttgggaggctgaggtgagcagatcacctgaggtcaggagtttgagaccagcctggccaatgtggtgaaactccatctctactaaaaatacaaaagttggccaggcacagtggcgggtgcctgtaatcccagctactcaggaggctgaggcaggagaataacttgaacctaggaggcagaggttgtggtgagccgagatcgtgccattgcactccagccgggacaacaagggtgaaaatccatctcaaaaaaataaaaaatgatactgtattaggctctgtagttcctatagggagagtgcacccaccccagatacttcccaaatcctgatccctccaagaggagcagaaattgtgagttattttttgggttgacttgttggtcaggtgattgataggtttgggttttcaaccaaagaaatgctaattcactgtgcctttttcatttttaaaaaatatttttgcttacccaaagattctttacttaacaaccgtggcttttaatctgactcaaaaagttcaagctaaattttaaatagttgtgatttgatcatcaaaagtagctaaaaataaattttggatactgattgtagcctctccttttgaaaatcaaagttttcttcatagctaattttttctaagattaatgcccatccattttcagtcataaaatagataaatttgtaaatcaacatctggcaccaccctgaagatttctcattcttttcaaactttctgggcatgttgtatgaaattttatgaagttgaaataatcactctctgcagataattctttacttcatgtagtcccagagctctactaatatgttagatctttccaaactggaattacaccagtctacacatcaaccctaataattttctatactatgcatcattaaaaccacagtcacctctcttgttcagttcagtaacctttactctcctactagagttgctttggctgttgtctctgcatgccctataccaagcaaactttcctagaggctctcctgacaaaagtgcaattgctgtgacttgatgatacctgggtacaatgtagtaaattaaatatgacctaagaattcttattttttccatggtacctgtttgagatggttgaacttctatgccagcctgaattgatgacagctaattttcccactgagacactaacctattttttaatactggtctatgaattttcaggtaatacatattttatatttcagatgtaagctattgaaatctagaaaaaaagaaacaatgtttcaagacattacttcttgacaaaacagatttctggatttttttattatatttaagttagtgtgatggcctcattactagactataattctagtgagaaggaaaattttatacactatagatagttacttaaggaggcagccaactttataagtcattcttcacaaatccaaatgtcatacaagcttattaataatttaagaatcaatagaaatgaaaatatctgttcttaatttgctatatttcaaatattgtttttcttttaaccattgcgataattattctatattaatataatttgtttctataatatttgttctctgtgagactgcagccaggcctttaatatcatgttcaataaaagaaaaaataatctttgtcaagggctaatatagtaactcaacattagcagaagtggtttttaaaaatatatttcaggtatccaggaagcatctgtgtgtgattttgttacctttggacccaccccctaaatattttcactgaagtaaaattattggcatcagtcgtcacccttcaaagctaaggggataatttttttaataagtatgaaacattttgagattgttctacttttccagaacccattgtgtcactgtgtgtgtgtgtgtgtgtgtgtgtgtgtgtgagaaaaattttggaaggttatttatctctagatatgctgctttccaaaggtctaaaaaggaagtggtgagaagccagaggatttttgttagaaaaacaaagtctgaaggaatatttcctgccttttttctttcagcagatatatgaacttcaaaatttaccatgccatgccctcaaaggtatggctgttcccacaaccatcagtgataatatgtatgtgaaaggatgtgctcatacagtggcaagggattagtgaaaagaaaaagatggcgataagaaaaagagatttgtgtgcacatgattttagaaatgatagtcttgcttctctttgaaactcagattagaaaaggtgtatcccatggtcaagttgaatgccaaatagttctcagtttcggagcttaaaaggaagaatgcattctgatttgaagacaaggcatgtagaacagaagcagctttaatgaagctcagtctgggttgtatgaaagccattgtcacattctgacacaatgatatgctggaagcactctttccttagtcaggaagtaggttccattgtacctgatcccaaatcccacaaagaattagaaacttaatttctccatgcaaacttccaagctacaaaatcaaagtttagaatctaaattagtccataaaatattgtgataatatagcaccttgaagggatcataataagccacacatcattactgttttagtccctttatgttgctgtaaaggaatgccagaggctgggtaactgataaagaaaagaggttgaggctgggcacggtggctcacgcttgtaattccagcactttgggaggcgacggcaggtagatcgcctgaggtcaggagtttgagaccagcctggccaacatggtgaaaccctgtctctattaaaaatacaaaaaaaaaaaattagctgggtgtggtggtgggtgcctgtaatcccagctactcaggaggctgagacagaagaatcgcttgaacccaggaggcggaggttgcagtgagccaagatcgcaccattgcactccagcctgggcaacaagagtgaaactccgtctcaaaaaaaaaaaagaggtttatttggctcatggttctgcaggctgtacgtgaagcatggcatcagcatctgcttctggtgagacttcaggctgcttccacttatgacagaaggcaaagggaagctggtttgtgccaagatcacatgaggagagaggaagcaagccacagacaagaggtgccaggctacttttaacaaccagccctcaagggaactaatagagtgagacctcactcattgctgtgagaatggcaccaagccattcatgagggatctacccccataacccaaacacctcccattaggacctatttccaacattgaggatcaaatttcaacatgaagtttggaggggtcaaatattcaaaccatagcaatcactattttcacagcaactcaagagaaaaaatttcactttgctgcctctcttcaagcttggaagctggagaagaggttctggtggaaagtacttcaagtgaaaagactttaaagacacaagttttaagtgaaacctgtctcccagtcaactctcgaggttcttgattcatttcattttgaaagagtggctatttttgtcttgttttcatcatgcatttggcctcctctgtacatagtcatatttttggcttcctggaaacagatgatgagaagaagaatttgaggctagctctagaaattacagaaactatgtgaacagtgagtatcaaaaagttagaagtgcttctggcactagaaattaagagctatagcaaaacaaaatagtttatttccagaaactcatgtatgttcacggtgtaactcccatattttccaagaattattttttctaagaattcacatgggaaaggaacggaagataaaaggttttaaactatttctttaaaccaacactggcaagggccaacacaaagaaaatgacaacaaaagttaagagatgtatatatatagaatatgtctcattcctttgagggaagaagggacctggttagaagaaggaagaaaaggaagaggagaggagaggagagacaggcaagtggagtagaggaaggaggagaggagcccaaagatttgaagaaaaaaaaaaggagaaggccaccaaaggaaagtccggcctatcgcccccttctctcagccctacctgtacacagtactgaggctagggctcctccatgcttgggctttgtcagtgatgggtggtggagccacatttctgggccttcactgacacatcttcctcccatagaagttcaccagaataatttgtggcaaacacatctttgtggttgacgttcctgtgtttcttttctctactgattcttgcttgttatcttgcatgttcagcatgagaggttgtccctgtgcaattattcggctgtttgcttaagaaattattgccacaatttctgagattcaaagaacaaagaagcataagaaggcagggagatactttagtttggagggaagaatcatggatgtttcacacagtgttttgaatggttttgcaagcatctgaaataaattatgtaatagattcatctatctttagttacaaaaaagaattggggggatattgggcagcaggggtactgtaggtactgcataatgaatgtatggagatctgcttcagtagacaaagtctggaatgcagttttggtggggtaactgtacatcacagaaaacagaaacagttttggtggtataatggtacatcagaaaatgatggctgaaggtggttatttggccctgatgggcaggtttcacagttttaaaaggaaaacatcaatatgctggaaaaagaaagttattgaggtcatcaggaaagtaaattatcctaaaacacaatctaatttatttttaaagtcaattttgggccgagcacggtggctcacacctgtaattccagcactttgggaggccgaggggggcagatcacttgaggtcgggagttcgagaccagccaacatggtgaaaccccatctctactaaaaattcaaaaattagccaggtgtggtggcgcatgcctgtaatcccaactactcgggaggctgaggcaggagaatcacttgaaccttgaaggcagaggttgcagtgagccaagatctcaccactgcactccagcctgtgcaacagagcgagactctgtctcaaaaaaaaaaaaaaaaaaaaaggtcaattttgttgggtacagttgaactttttaagtacagcaatactttatataacagatgcctttctgaagagctgagtgaaaatgtcattcatctgacaaacatgcatgtctactctttgctagtcattttctttacaaatcaaatttaatattaaatttatcagatacctcactattcaaggaatcttttaatatacactattataaagcaagaattccaactataatgtgcatagttctaatgtgttatgtataaatttatattttttagtacttcatggcctgaaagaatggtgctttatagtagagccctaaaacttgtagtacaaagtttttaagattttaactaatttataaaccattatatatatatttagtagatttagagtttcttgaaaatttttggtggaacctcataatttagatcccaatagttaaatatttggtattcaaacaaagacagacaatttatttttctattttccatgaagaaggagagggacaattttagattcaccagtgtgcaggacaaattcttacttaacctatagaggagcaaactttcttcaaacacattaccaatacaattgtaatactaagaatcaataccatagttctcgatgtagcatgactacaaattgtcacagtagattttggatgactttaccatagccacacttaatgaattattatttatatttctatttgtactttaataaaactatattttaaactttaaaattgtcatttaaattactaaagaaaatgagtagttcccataatgaatccataatgttaagaatttgctttagcaatgagactatattcactagctttgtattaatataaacataagaaataacaatatatatgtataagactcaaaggtgtatttctctgttcctctgaaaattttctttgtagctccacagccaagatcatgtggcttttgcttggagtagtaaaacacttctaatatgaagcaatctctagctaggtaattttcaagtctttctatccagaacagaaagttggaggatgtagggaaggctaagttcttgagtgggatctaaaggctggcaggacttagtgaactattggactgtttacatgatatgccatgataaatgttgaatgaattttcattatgtctagacatactcaatataaatgcttgcttgttaagcaaatagcagaggtcaaatctgggatcatggtgattgcgattgtggttctcaggctgggtttctattcctacttgaagtctgtggaaatctgaaaacatcttgaacatttcaaaataataagagatctgtctaaatgaaacttggatctagacttgggagtgtctgttgccagtttctattcttgaatgcattgccgtgtttacgctcttcttggctttcccatcttattaactagctctcctcccaaggacagtgaagtagagcagaacaaactgctggctagggctgctccagcttttctgaagggcaaagggtaagttacagccagagtgtactggaaccctgcattaactaaactaaaaatggagatttcttttgtcaaaaatgctttgtgtgtgaaagactgtctttgattcagtaaaagcagctctgctttaacccagttaacagcactaagtagttatttccagtagacacatctgtgttgttattcactttcccgaatttgtgtccttttcttttttgaaatgactaagctgaagactcgattttctgaaggatatttaatctttgcttgcaaccaatttcaatgtatttactctacagatgaataccttggccttagtggttgaaaaatgtaaatctgttttctaaaactttatttaacctaaatggaagtctttatttttaaagttagtgaaatcgaattgtggatttcattgcctggatttcacttgtgtttttcatagcacatcacttactacccttcctttacctgcttggttttctaaatgccttttctaccaaaaactcactcctacctcctctacttatttctgtccacctctcttaacaacacgctttctttccccctgccctgtttcaggatacagtacagcctgaatgtggcagacaggctagctgatgaacatgttctcatcgggttgtatgtcaacatgctccggaacaacccctcatggttagtgcaggtttggctgcttgactgtccttagagagggatacagtctgagctggtgacaagcagtctcagcaaggagcaaggtcactggatgccagtggtgacactgaagcactgttaactggttcagttaagaagtctctcgtgatgttagtttggatacttcccatgaaggaaccataggattcatatccttgtttatatattagctaaaacgaaaacttgcataaagggatgccttgctaaatattagccttcaggtagattcaggactccgggtcccaccaatcagttctgtgctacgtgtcatgtcaaattaccacaggatggtgataaaagaatttgtcttattccaaggacatggatgtctctgctgatttggaaaacaatgcttcattttacttaagagtgaaaaagagaaaatgcgatgtgattgaatcacaaaatggaaatcatttctttaacaatgataacagtgggaacaatcgtctttcagcaattctattacacatttttctgatgaccatcctgctaaagcctgctttcacatcttggaatacacaaaacttagtttcagatatgttaaattcaggaattaagatagccctgtgtacttggataaagccattcaaaaggcttttctccattttcattgtgacataggagactccttccattggttaaagttacttgatattaataataaatgtggatttgcagcttgaattaaaggaaaaggacaaactatgtatcatatgtatttttcaatctagttcagactattgttttataaacatatttagcaaaccaattccttgaaaatatgtcaatttttctcaaccacttcaattttctctcaattaagggcccatggattttccatagttacaattattaagaaagccaatgggttcaatttccattaaaatgtttcaaacctttagcatggcaagtcctctttcctctactattagaggaaaagtaattggcaaaattaatggcaattacattaaaagtgatgacaaaaactgcaattacttttgcaccaacctagtatttcaccaaggcattcctcagatgctaggccattgctccatgctccttgccctcaccacttgatgttattagccgctttgtttctgaacctctttcctcctcacttgagtattttcaaaattttcttcctattactgcttcttagatctatttttgcaagattaatacatgagataatttttagttctcatgaactgatgaacatttatgtgctttagtacatacatgtatcttaatttgtatttttaaaaatgtataaccagtacactagtttaattttaccttagatcctactgtttaaggggataaaaatgcactctttggctgacgtaaatccatctctttcttcaaattttgtgagcttctagattaaatagtatccactttttcacaactcaggctctcaaaactacaaaattgctttattcccaaggagtttggtactccagtgttacatggtagctgaagcagtagaactaagcattgaatttttttttaattgtattggtcatctttgaagaagaatacagtcagtgtagattcaattgtaagactatgatgcgatctcacatcatgtcctcttcccataattctaagcacactccagttatttctactgctcttctttgaccttttcttaattaaggttgttaacaaagaaatctccaaagagaaaagctcagagtttgtcactaccagccattttccctactcaagtgattaatcatattgacttgatggttacttaagaccataaatctgtctcagcagagacaccttgcgtctgcctgatgaaagctaaatgtgatttgtattttgaaaacaaagcagaatttaaggccaaccaatcaatgaaggaggctttgttttaatagctgcaccctccatatttctcatagttttttctatccttaaaaaattccaacttctttttcaaatttctcattttttcttcccttttctttatgtttaattagatcccaacaattcctcatacctgtcatggttctataagtaatgtaatgacctcttacctcctttaacatcattgtagctacaatgctttaccatcattaagttacagtgagacatataataatagtaataataatagtaagtgtttttaaaacacttacctcatgccaagctctatgttcagagccttgtatacataatttctcctagtccttaaagtaagcccatggagtaaataagatcatcccccttttatagacaagtaaaggtatcattttagagagcttacctgactctcccttagtcccacagctataaaaagtggggcagagattttaaccattatccatccaagttcataaccactgtgtttcatcacctcttttaaaatctgcatcaacacacgcctttcaggatcttttgtggatgcctccttcacactgcatcctccacgtatttactgaaactgtatatcttattctagtgtttttatttgattttagcaaatattttgagcacatactagtaacaggaatggtgattcttaacaagttaccttttatgtatgtagttccttgagttgtgacttctcatgttaattgtaagcttcaaaaagggcaagagttttgtcttcagtctcttttatcttattacaacagctggagtaagaataataaattttgtatttatgaaatgctccaaaaattacaaagcctttttccacacattatttaatttacttctcatagtcctagaaggttggatatgattatttccatttcactgtttaaaaaatatgagctttgagacattaagtgacttatccaaagtcacatgctagtaagggcttgcaaacaggtcttatgacactggttcccatctattttccaccccattccttggcctctagctgttctccatcaaaagctttgtttttgccattattcagacctaatcctgattaactctgtgtgggggtcttctaccctatattaactacttaacacactgggaaactgacttatttgtaatagtttgctgctaaagaaacacttatgtcattgctggttctgtcagataagtcaaataaataaactgcagctcaagggagaatttctgcttccttcctaattcaatgaagttttaaaagccttaataatttgtatgcaccttcctcattgcaggagaaggagtctgaaatgtgatacagtgtgggcttttactaccctcccccaaagcttgtcaaattcctgggcttgctagtttataccaaggtctgtagtagaccaaccaaatgatttgaaaccagcccagaacttctacctctaacattgtcacttgattagactcctgatgtcatatgactaggttaaaattgttctgcttatatttttctcaagtacaagaaagtgtacatttgtgttgtcaatagatttcttgttaagtggattaataatccatctagtttaaaattgctccacaatattttatgctttgggaaaaaagacatctaagaatgcctatttcagaatttcatttatgaggtctaaatttttattagcttgcatgcttagaactctttaatagattcctattggacctagtttacaacccagacccctcaccatggtgtacaaacctgcatgtgacttagcccttgcctactcctttctcagcctcagatctcatggggttctcccattcaatcactacatttagtcatgtcaatttttgatcaattcctccaacgaaccaagctctttcctgcctcaagactccaatactagttctcccctctgtctagaacattctttcccatttcacccctactatatgcacatgaacttgcttgtctagcttccaatcttagattaaagacacctcccccagtaggtcctctatattagtctctattatagcatactatttttattttcttcttatcagctgcagtcattgtttggttggttagttggttagctgtttggctggttagctcattggttggttggttggctgactggttagttggttggttggtggctggttggttggcttactatttactgtatcttcagtggggcagggaccctctccaacttgttcaccaccttatctctgacatctagcacagtgccaggcacatagtaggtgctcaataaacatctgttgatattgtagaatatcagtagtgcagtagctaaaaaaattccatcttcccctaaacaaagttgttaggagtagtcagaaactttactagcaaaattagaatttttactatttaaaaaaatcactattatagagtagcacttaaattgaacatttagtataggagtataaaatagatgaaaaattaaagtattaagctttgtgtagtggtagacatgggcaaagataagcaccagcaattcactgatgtgaacagagcaactaatagggcattctaaaatttttttaaaaacttaaagtgataattgggcaagaatttttttttaattttaatgcccccctagattcttcatctttgtattagtttgctaagaatgccaaagcaaaatgccatagacttgatggcttgaacaacagaaatttattttctcactgttctggaggctggaagtccaagactaaggtgccagcagggttggtttctcctgtccttgacttgcagatggacaccttcctgctgtgtccgcaaataaccttttttctctaccctagtgtctcttcctttccttaaaagaacagcagtcctatgagattagggccccacactatgacctcatttaactgtaattaaaggccctatctccaaatatagtcacattctaaggtactgagggtattcatatgctttagcatatgaatactgggggagacacaattgaatccataacccacttccccactgaatccactgaattgtatgcctttaatatttttaatgtgtaggtcaagatttgactgactctttttagtacattttgttgattttgaaaaatgtgagtttattgcaatctgttgaaagaaaaaagaaattataatctgttgaaagaaaaaagaagagttacctacacttactgacagtgtctcttttatatgagttttcatttcctgttaacacgactccttttgtttagtaaaatttttaggaacttcaattatagaactggacttctgagaaagatatttccttagaatcctggaaatataaatctaaagactgtcacatcaggaacagttggagtagaaggaaatggaggagtctgagagtttttagaagatagaatgcatgacctcaactgtaacatagggggttgttgaagtcagggtctcaataaaggagtttaaaggtctcctttaaggaagccattattgtggtaaattcttattgttatccatgaagattgccatttcatgatttcctgtctttttttgttgttattccaaaccactcacaaagggccactacactaagctttgagagttagtttctttccccattcttcagtactgtaaaaccatttctcggtccccagtgtcactttgttcctttctaccctgactctcttgagctcactgacttctaaatgccaaaaaaaagtgctctattcccttagcattttgctctaaaccaactgccaaagatagagaataatctaataaagcaatcttccatttgagttaactaatcctcttaatagaagagtagtacatgaaactcgatggccttctaaattaatttctagtgataaaattcccatcactagccagagtagtagaaaaaatatgaaaagaaaatatagaagcatttatatatgcttttgcttttgcatttatatatgctatatgctttggatcacagtattttctggttgactaccctaacttagaaagcagaacaggcccagaaaaaaatcaaaagaatgtgaacaaaccgtgagttcccaaaaatctttgctaaatcacactttcataagccctagctcagctggggccacttgagtttcctggaatgccattttgaaatcactggcaacagacactggccatgcatttcgggtagaatgtggagggctttcaaaataatggattttcctgctctgaaatgccgtcaacactgcaatcacttgttaattcatcatagtcttgtagcaagattactgattataaagtcctgaaatgaatagctagggctggagaaagtgttggaattggtatttattttaatgatttagggattgttgatcattcattttcaactatttgtaattgaagtcttgaaatagaggaatttatcagaagaatgcctccttcacccttgtataatttgaacatactgaaatggcattatgtggacccataaattgttcatgtgcacaaaggggtaatattatcacacaggccctcattcactcagtgctgggggaggaaaggcatggacgtatgagttatcacttgctatacagaatcctatatcttcacgtcttacatttccaggaggctttttaaaaatataaccttcatattacttacactagctagtcattcattttaaaagatacttttatcagaagtttttatcaagatttttaaaattatttatttatttatcaaaatacaaatgtttctgacaaagtcactttcaaggtgtcaaagatatcatgttcctgggcctggagcaatggggttatccgcaaaacactgtgttgaattagatgtatagcccctaatacatgagccagaaatgataaacatgttaaaatcaaattcagttgtctctttgtggggtagtttgacgtcgaaagaaaagacagtgtaactttctctttttcattgaagctgtaataaagaatttagttattatttttaaccattgcagaatgcagacattattttataaagacagacatctgctttaaagcatcagttttccagagataattctgcctttgctattaaaattattttcttactccaaatctaaacttgtgtaatgaataaaatctcaatccactgggattgatactaaacattatgtaagccgtatatcctacaattttctgtcttaagggaatgtttataacatatcacacatgctgtatgggtatctgttaaatactcttgaacaactctctcttttatatcgtttatatttaggtttcatttcacgtatttgtgtcttccattttgttttcgagatcttctagatccttgatactcagtgttgaaccagtacactggaccaatattatcgacatttcttggaagcttgttagaaatgcatcttctcaggtcccaccctcccaacctcccctaccctaccaccacagaaccagaaactgcattttcacaagatccctaggtgatatgcttacactttaaaatttgaaaagcactgctctagataattgtcagatggtagatgatattttgaaggggatgaggattactaatggatatgaacatgttatttaaaaggcaaaataataataacattatattaactaatatttttgagcacctcatgtgttccaggcatcacactcttttgatgctttttgcatacattatctcatttgagcaaaaggaaagagaagcctctttttctgaggagggagaaatcagttgttagataaggaaattcaggaatgttctagttatttattatagctcagagaaaagggctaagtctagagtggaagtattcatattaaaacagctatagcttatatatgcaaggggtgtaggctagagcagagataatgtagacaggaatgtcttatgaatgaccagaaaaaaaaaacaaacctgttatatagtggattcagctaaccagacaagagctatttggaagtgacatagccaaaatgctggaagaacataattactttcactcatcttctcacttcagaacaaaggttaaaacactatgtttcatgtttactctatttgtaaatgtacatataatagtatgttactttatatggatccaagtgattgcaatgaataattcttacaaccttaatattggcataagagggtgtctttacaatatgtatttatgagttaatttctttaaggaagagccgtaagtataagaactgatgcagaagaatataagtatgtttatgaatgagaggaactagtttctgatcttgattctgaactgatacataccacaataaccaataagccaaactacaaccaactagtttgttaacaagattagtgctattggtatgtttcatagaattatttttaatggcacccaaaacttagtcttgaatggagcacttcacagaatgaagttttctgaaatatggaagaattagtaacgcttctatttgcattagtttttagggactcagatcatccttattctagtatgaacagtttctgtaaatttataggaggcactaaaaaattccattaaggtcattgggagtcactactaaaattctgtttctctgaaagtaaatataaaaggcaggttataaataagtagtaatattatagatgagacttgtattagttaccttatgctgcataacaaattatcccaaaagttagtagcttaaaataacaaacatttatcatctcagaatttctgtaggttgagaatccaggtttggcttagctaagtccctctggttcaaggcttctgtgaggttgcaatcaagatgtcacttaaggctgtgatctcatctgaaggctctaccagtggggatccattcacatggtaattggcttgcttgggtttctcatcacctaggtctttccataaaggctgctttatgacctgacagctattttcccaccaaacagaccaagagagctaaagagaaaacaagcaagtccaagatggaagccatggtctttttataatctcatcttggaagtgacattccattccttctgccatatgctattcattagaagcagattagtaagtctagcccatcctaaaggggaggaaattacatgagaatgtaataccagcaggtagggatcactggacattgaccacaatgatgtttttctttcttcttgctttcctattttctaacatgtcaattttggacatgtgttacttgtgtaaaaaggaaagaaaaaatgttaaaggcaataaaagtaagagaaattcttctgatcagatgtattgatcagaatagtcacctctctgtgaggctttcttagtaagacaattgaattgactgaagacaggatttattaatgaccttcccgactatatattagatcatgttacaaattcaagtctgagattgttattctaacagggttttgtgtagtttgcaaatcttttgcaccaaaacattgaaatagtaaaaactccttgtggtaaaatgactgcagcaatctttctcagttgcctaacggtctccttcttgctttgttcttaatagcatgcttgagagttcaaaccggcttgatgaagaacacaggctaattgccaggtatgcggcaaggctggcagcagagtcctcttcgtctgtaagtagttggagtaaaaggattcgtctgttggcatctgggatccttgaattttatatgtcatgtttattgttattatagctggtgctgattaccaggacaatttgtgctaatttattgtgcatgtgtttgttgctaagtttgtggtgtcttggtggtgaatttacagtttaaaaatggaagacttgaggaacaaaaccatccacagtagtgtgaccctggagtcaagctggaatcctcgcatcccccttcattcagtgtcaaccccatatgaagtcccaaggaagggggcaaggactggttgtgattcctttatttaaagcaggtgtggttagtgaaggcactaagtttaaggcagagtagttgcaagtgacacttaaaatataccagtagaaataatagagctatagctttctccatttgtgtcagtctctaagacaaaagcaactgtcagctcaacacattgattcagaattcatctgtgctgactaagggtgagttgctattagtgcgtcacaaaggacaaagagtggcaggggagcaagtgaggaagctgttgcctgcacctctcacatcagatgttgcagttatcagagcccttcatgctgagcatttaacctaatgatcccagatgggagctgcataatgaccgactgcattagccctggcagttgctctctgtgacatccgtgactgtaacactgttagaaactaccatgagcaagatggaggggatccaggacaggctaaaagtgtactgtgtgcccccaaaatcagacatgataaaacagagacgtaattggagtatatgaaattttaagggccataagtaaggagcaaacatgttaaagaaaattaaaatatagaatcagctgagaatacaggagaattagattttaggacaagcaaccactccaggagtcacttgaaagtaaaggcaaaacaaggtttttggaaaaacctcttttccaagttttcttgcctttatccatgcatatacttctataaacagaggctatggtataccaagatatgggattagcaatgtgtgtcccagctctccatgacctcatgcaaagcagtgcttctttgagttcagtctcctcatctgtacacaggtgtaaatatgcttattatatatgtcagtgctgcctgttattagcatccactgagatagtaaaatgtgtgaaagtactgcataaaccagcaattacaaaatggcagcctgcagaccaaatttgtcccccagaaatgttttgttgagccccacagtgttttcaattctttattagatgtcaggacttacaaatcagatggttttccttgaaagtctggattttcatcttatcttaaaagactgaccagatcagatgcatgttccttctgacagcaggcagctggagtggaggcattactctgctgcttcggacagggcaagtgtgtggcactttgccacaacccctaccctggcccacctccgtcacttgagttacttccctgcccctttcagcatttgcattagtgatccctggcagactgctaaatctccatgcacatgttattatttatatgtgtactaaattctccagtcttgttccatttctttctggagaacattagtaacttgtgttccttgcctacttacactatatataatctttgtggatccatcataggaaagataccgtccacacattaattctagttcctttgtaaatctcttcataaccacatattaagaatagtatgattagctgagtaaatcatgattagtaagatgacacttggttagaaaggagatagaacggtcatttagtaaatgggtcaatgtttttctttataattcctgatcaattaatatacatagcaaagcaatgactgaaattcacaactggctcagataagtttctaccatttatcaatacataaagtatatgccagaaaaggaaacttatgtaatgaaatcagaagaaaatcttgaatcacaagtcaaagttgccatatgccagaattagctaccgaaagtcatttagaatctaaaatgtaggacctcaaaatttcttgttagctatataagtcattctttgctgaaaagaggtgtaaattaaaatgcatagacagctttataaaagcaaaacctttacaaaacttaatctttcctacagttaggtttatggacattaaaaagcaggacaagattctctgcatctggcttaggcaacagttgccatttttaaaagctttccattcttcggtagaaagatgagttgtgatttttaaaaatttgtttttaaaacaataaaaattggtgtggaggaatttctaaaatgtactgtaaggcaaagaaagcaagacatacataagtgtacataatatgaccccatttttgtaaaacaacaccaaataaatccttgactaaatatacataaacatacacaaacagatatatatatatggcatatgattaatgatatctatgtttatatgagaatggagaaagctgtgactgcatgtataccagtcgttaaagctgattgcatttctgaaaatgaggagctggagtggtgagaaagtagaaggaaatcaaagaatatacatgaatatgtgaattcatcaatctaaaattacatgtgtgaataaagaaagacataaaagtttgttgattagaagaatcagaaaagtaagtcttaccaactatgactttaaaactatatttttatttatttatttatttttgtgagatggaatctcgctctgtcacccaggctggaatgcagtggcatgacctcagctcactgcaacctccacctcgggctcaagcaattctcctgcctcagcccccctagtagctggtattacaggtgtgtgccaccaggcccaactaatttttgaatttttagtagagatgggatttccccatgttggccagactggtctcaaactcctgaccacaagtgatccgcccgcctcagcctcccaaagtgctgggattacaggcgtgagccaccatgcctggcctaaaactatatttttaattgtacattacagtaattgaacggtaactctagagaaagcaccctctcaacagtgcaacatcttttaaagccacctataatgaaagaataggtacaatggggacagtgtggcaaaaataaaatcacttcccaaagattttcagtcagaaagctgaaaaatcatttttcctaccttttgtgtatttgcctgccagagaattctgttctgccttccacctcacagatgtgctccagatccacagaaaagttggtccataggagaaaaatggcaattgaattttatgtatttgctttctttgttttgatagaaataattccctcctccttgtctgcatatctcatgactcctgccttcccaaatacataggttcacattctcaatatgaaatcttataaactacatattttacagcagccacctcagcagagaagtgctcctgacatctctttcaccatcgatgcgaataagcagcaaaggcagctgattgctgagctagaaaacaagaacaggtgagactttgtagacgtgctggcttgtttgatcaatgtgcgcattccttaataaactatggtcgtgctttaaagtttcagggctttacaccctgtatggctactcaagggaagacatctacactcagtgatgctcacttccaaaaagctggtctttagatctttagaacttcagaagctccatgagaaaacggcgtgtgcatgtatgtgtatagttctgagatatcaatgcaattaatgttgcccctctagacggtctcacttccctttttctgagatacttaattttgttcaagagcttctagtacaggaggaccctcctgggtactaggtagaaggtgtctctaccacccagaaacaggtaggaggctcaccagagaggccccctggaaggaccctgagctaaagaggcatctggagagacaccaccatcacccagttactctccaaacatccaaagatctccacctgcagcccatcagcaggttcttcctctattcaacacagattgactcacagtctacctccacagcatacaccccaaaaattgtccagctcatctccaccaccacccagttcagcctgtccttttcaaaaacatcaatcttatgttattccaggtttaaaccctctaatgtgttcccatcacacttcagttaaatcctactcctcttaccatcacctgcaaggtcttacctgacctgattccctcctgccattccagcctcagctcaccttgctcagcacactcccacctcccatgtgttcctcctgtctacagcctttgaattagtcattccctcagcctagaaagctcttcctccaggtctctgtgtggatggctccttctcatcactggggtctcagctcaaatatcatctcctaaaagaccacctgtctgatcctacctaattgcccctagcccagaaactagtctcaattacatacccctgtgtgtgtgttgggggcaggaggttgtcacttatcactatctgaaataatcatgtgtgtttgtttcttcgtttattgtctgtcttcctggactgaaacggaagttctttgagaacagaggccatggctaaatggtccctggagcccagaaccaggcctggcaattgtagaagctcagtagatatacattgagtgagaaaacgatgaatagctgagttaaatctcaaacttggttctgaggaaacccaacatggaacaacttgtactaggtcggtgcaaatgtaattgtggtttttgccattatttttaattacttttaatggcaaaaaaacgcaattacgtttgcaccaacctaacacattctagtaatatatttcttgaaacagcaccaaaacatttccatgcttaaccccattcttaaacactgatgtgacatttgaggtcaaactggaggagtaaaggaggaggttgtgataattatttcatgcctgtaaaatttgacctgagaatttggggataaatgatcaaagtattctttaaagttctcaagaaagaataaaaaggagggtgcaaactctggttggcactttttcatatttttttctagtaaggaaagcttttggcttagttgtcttgagacctggctgccatcattaggaaaccacaaattaggatagaaatagcttcataaatgtgacaccatgactccatcgcctttgaaactactgctctactctgacccccagggagatgtgctcacatcagagctggaataaaaaaatttaaaaataaaattaaaaaaaagtttgtcacatgtgatccctgtcaatgtagcaaataataggaggaaagaattaagaagggaaagagcagatgcatagtgacgaattataaaaaaaaatagccatacaaattggaatttgttcaggatactcacaagtctgtaaaattacctattctattttatgtatcatttattatatctactacgtgcaagtaattgtgccaagtcagaaaaaagcattgagagtgggagccaagtcttcaaatgagcaaaggcactttaaaaaggtaggagaaacaacccaaaaaaaggaaaagggtagttgggggatgcaagtaaaagtggggacaggcaggcattggagaaagtgtatgagctgagctagcaggcagagggctcgaagcaaacaatgtaaaagaaccattggactttgtggttcgtggaatgcttgtgtgagtattgatgacactgatgacaatggggagtaggagaatggaggggccgtcctcaaatgtactgatactttacatcaattcaggcactggaaagatcatggcaagaaaaagaagcaaaataagccagttttaaattattgacaattagacttaatccaaagtttcagcttttttggaacaaaatattacggttgataacctcagcaaatgtcagaattggaatgtaaagcagttttgttttattttgggttttatttttttcagtccacaaagtcaaccaataatatatggtggaaaggtttatttaaaatgactcagaattaacagatgtcagtaagtcagtgagtgtcccataataaaggcaacagaaagagctaaagaagaaaggaggaaaggagtgataaaaacaatcattttatctgctgttggaaggctgtgccagcttgaggccttaatgaactatgccagagttgaggccattttctgaagaaggacctaactttctatgtagtccgttcattcggactttctaccagacatcattccataatcccttctccatcccttagtcccttttctctaagacatattatgattgctaacaagcatggagccatccattggggaagggaccacagctgggattaataacatatgctcacaggttccaggtggcagcagtaagaaacctgggtttttgttttgaggggttgaagtgagaataaggacaactttaaaatacatttaaagtacatgtgtacaaatatagtttcatttcatcctcagaacaactatttaaggtaggcagggtgactattatcatccccattctacagatgaaaatttaaatgtgaggtgttatttctactctttttccccaacatgacccacttcaccatcattgtggtctaggttgtgtagggcaaacttcatggggaaggtgagtttttaggacatttcaggacagtgaaattttgcagtgaaagttgggagatagaattaaaggtaaaaatacacatagactttgagaaaagcaacaagacacttgccaggctagcactgaggaatcaaagaataaaatgaaaacatcagtatatgaggcttgtataccagaccaaagaattttaattctatcctgttatgatggacagcagtggtcaggcaagtgacagaatgtccgcatgtttatggcaaaataatcagctcactaaatatgcaggttgcatttacaagggattgactagaagctggtgggaagtgatgaggaactatgttagatagatggttccagaaataaaaataaaggaacccaaaaaggagatgattagacaaaaggcaaaatagtgctgaaatgttaatttacaagattctattactcatttctgaactttccattagggattccagattttccaacaacaaccttcacacaactcagattttactagcaatcctcttttctttcactctcttgttctttccttcctcctatccatctgtcccgatataaagagaagggataaaacatcaaggtcaaagggggctttgtggaatatcaaaaggaggtcaaccctgaccagagtttccacaagctgcagcatcacgcctccatcccttcttagaaagaaaagactaacagaaattcacaagcccacgaatattttatcttggttgcactgttaattaacctactcttccacttcttcagagcactttgttttcccttccaatactctgcttccactcgggcatgggggtaacacatttgaggggaaagcaggacttcttttgaggaaataccccagagatatctgcctccatgtggttctgtctatttctgattccagaatcagcatgaagcaccatgaaggccccaacaaccctggccatgccttaatatcactcttgctgcttgtttcctggatgtttttggatcgcactctctaaatgcatgtctttaaggactagagaggaaaaaagaaataggagtgagaagagatggcggaaagagagattcattctgtccctgagttcttttgtgggttctagagctccccaacccatctctgatgagcagcaagtacatcctaagctcatctctctgagccagcagcctggttctctagacatcccagggccaaaagctcctttaggtaatactactgcaccatggaaacccacccagggaactcatgtctctaagatgacaactcaataatcagatctgtgagtttaaggggaagatagagttcctcatttcatttaatgactctgtctaccccaggtaacacacagacatttcagcaatgatctttagaaggtaatggttccttatagcacctttggtggagccagtcagggttagtattaggagtaccaggaatcttcaaattatattgtatgggtcacagcctgtcttggctagacctagcaaagcaagtaccagaagactgaggcaggctgatatatgtggggtttggggctagccagcctggattcacatcacgtctaccacctacttgttatcgaacttggggaaatctttcaactggtctgtgcctggattctctcatttaataaacagagataataatggtacctatatataatagaactgttatagaatgaaataaaataacattaaagaagtcagcagagttcccaggtacagactgactactcgatgcacgttacatatctcttctttattttttcttaccagagctgttgctctcttttccttccttggaccaaatggctctgttgtgtttctgtctttagaatgaacaaagagaatagcaggagtcatagaatatcagggtgttagccctggaggaaatcttggaaatcccactgcactgattttcaggctgagctttatggcatcctgagggctctgcaggggcacctgggagggcacagcagggcccagcaacacagggacttgtcctcatttctttaaccccagcagcacccgaccccttaaactatctgacatgttgggtatccatggcatatttcttttaaagaaaggattccccgatggaatcacaaagaggagaaaacaaaaaaaagactgaaaaccactgaattacagttccatcttctcaccacacccacgaaatgtataatggcttactaatcattagcctcctgattctgggggctttgcgaagcaggcagttttaaatcagccctccaaaatggaaagctacttccttgtacaccaagttcaccttccattcgcagtgctttgctccgtcttactggcttctatgcattttgttgagtaggaaactgacacccccagctcccaagaatacatgacttataaccctgcttaatggcttctgactcacttagggataatttgccttgccaggtcacatatcctttatggctagcctaatgctcaccaaatgcagggaagcccaggctctgacatcaatagttgactgacacatctcacccccgacagaggtcacaccaatagcactgtatgtcacagactcaattactgtgaatctttttaaaagcactttccttctaaggtggacttccctgagatccattgttaaggctgagagatttaagaaaaaaaaaagagaaagaattttgtctaactggggttttctcagataaattcaatgagaagtcccttcttggtgagagaatgaggttacttagttttgtgaaatgagccccatttatccttattttcccttcaggctcctcttacttggtagctgcaggtactttacggtgtcagagtgtgatcgtaaataacaggaagatgcatttttgtctcttaagcagcatgctcttcaaagttggacacattaccttacttgctagtagtaatgcattacattacttgctagagagatgactggaccctggtgatttaactcaacgacatgctgcagaagcttctaggtttggatgtactggaaatgaagtcaatcttcccgtcacccacagcacccatctagctatagtcaaagcctcttaaatacactggaatctgttggttagggaaggtcggttctgctcctaaacataggatgatcccttctctctttgttctggtggccttgatctgctccgatgttagtttcctgaaagctaactaaccttggtttctcaccttcctcctctctcccaagagaaatcttacaggagatccagagacttcggctagagcatgaacaagcttctcagcccacgccagagaaggcacagcaaaaccccaccctgctggcagaactccggctcctcaggtaggagagagcacccatgtcatctcagggaatatatatgtgtcagatctttgagaaagtctagcagtgtctagccagaaaacagtcctcagctaccttagctgctgacatttgtttttttcatagcacacacgtaattgctgatatttgggggatttagagagaagctgtttatattttgttctttcatttggtacagggaaaagcagtgtgtttctgtttttgtttttgagacagagtttcactcttgttgcccaggctggagtgcaatggcacgatctcggttcactgcaacctctgccttccaggtacaagcaattctcctgtctcagcctcccaagagctaagattacaggcatgcgccaccacacctggctaatttttttgtatttagtagagacagggtttcaccatattagtcagactggtcgcaaactcctgacctcaggtgatccacccgccttggcctcccaaagtgctgagattacaggcgtgcgccaccacacccggccagcagtgttctttacatcaaaaacaacatatctcactaggaacaatttaaacatagctctttttagaaataatcagttaaataaacatcacaggtttttaaatttaaaaatttacccctaactcataaaaggagtctgattttctctaagtcttggtctctaatatctttctttatattcagatctttaaaaataggcatcacaccttcctgtactataaaggaacataaaagcctagtcttctttagtctgtcatcataaaatacttgagttagaagggactatagaagtcatcttgttaccagtgaagggtcttgaccacgaagttgtccagggtcttggcattttgaataaagaattggacaaaacgcacaaacaaagcaacaaaagaatgaagcaacgaaagcagatttattgaaacgaaagtacactctacagagtaggagccagctcccgtaagcggttcaagagccctagttacagagttttctggggtttaaataccctatggaggtttcccattagttatttgggtacaccctgtgtaaatgaggacttggcccaggaccactctgattgcttgcaggaggcgaccaatcagaggctgaagtgaagttacaaagtgacatcctatgcaaacatttgattggttgcaggaggggaccaatcagaagtactttccattattcatctgcctcaccatacaaagggagtagcctcggatccttttgttacttgggtgtggaaaggcgaggttttcctttccattcagttctaggaagtcagtacaaatcgtccttagtttcgctgcctccagtccctattctcctgactcaatcagattctgccgctgcatttcagtgcacttctcagagtcagaagctagggagtagcaggccttggaaaagaaatgtggtttctcctactactcccacgctgcaaaatgagtcttgctgtgggctccatttcagactagcttcttaccatgccttgaataaggctggtattccagtgtatttatgtggcaaacaacacaaaaataaattcaaagacattccctcgtataaatatcatactgttctttcacaaggcacctgtagttgggaagtattacattcttttctttttgtttttgtttgtttgtttgtttgtttgagatggagtctcactctgtcacccaggctggagtgcagtggcacgatctcggctcactgcaacctctgcccctccaggttaaagcaattctctgcctcagcctccggagtagctgggattacaggcgcgtgccaccacgcccggctaattttttgtttttttttttttttttttttttttttttggagagacggggtttcaccatcttggccaggctagtcttgaactcctgacctcgtgatccacctgcctcggcctcccaaagtgctggaattacaggcgtgagccaccgcgcccagcccattcttttcatctttcagtttgggtgccaactatgttccaggtatatctataactctgagtcatactttttatagtaagtacagatgcctctttgcagaaacccttgtcagaattagtcctgttttcttcttccatacaaaaagacgaaatgaagcaagttctttatgactatgtttggattttaccaagttcctgttgattgcatggatgtttccggaggctctatctttgctctgctcttcagacactttaacacctgagcacggcagagctttgtttttcgttaatgcatactttcatttttgtcttaaaaccacaatgaactttctcaacgatcatgtttccctttcccttttcactttcgccacaagaaaactgaaagctgagtcacagccagaagtgacaatgaatatgaatgataggcatttctatgtgctaatctgacgctttgctgcatactaactctacatacactgtcccgtaaaattactgtaacaaacctaggagataggcagtattattctactcgtttaatggataaggaaactgagattcacagaagtcacacagaagttgcagatatcatacctttcacttagtgtatatatttatgtacttatatatgatttataaggagaaattttttcttagaaaaaaatttgtataattgtgtgtaatttatgtatatatttcctaagaaaaaaattatcttgtataaccatgataccatcttcaattcgggaaagttaatgttgatatatggtatttaatataaacccatattaaaattttgacaattgttctaacactgttctaaaagaaagtagcttttaacggccgggcgcggtggctcacacctgtcatctcagcactttaggagtgcgaggcgggcggatcacgaggtcaggagatcgagaccatcctggctaacacagtgaaaccccgtctctactaaaaatacaaaaatattagccgagcgtggtggcaggcacctgtactcccagctgctgcagaggctgagacaggagaatggcgtgaacccgggaggcggagcttgcagtgagccgagatcacgccactgcactccagcctgggcgactgagcgagactccgtctcaaaaaaaaaaaaaaaaaaaaaaaaaaaaagaaagtaggttttaacacacatatacattagaaataatctgacagactatcagaataaaggcacttctttagagatgaatacatgtagtgctaggaaaggaaaatcactatttagtcttgttttctcattctccttggaaggtggaggttacaccacagatttgttattatacctacatttggaaaacgctggtggaaacttagagaagattgaatgaagacactcttaaattaatttttaattgaattcgatgtcatatttttaagagattactactgtaagataaatgtacaattagatttttttagtgttgactaattctaaattaatttgccattactcttaatggcaaaaaccgcagttacttttgcaccaacctaataataccagttaacgttctctgatagtttttaaatgcttctcttagtgtttctcacctacagttttagaaggttgctttaaccctcttcccaaagtgtttctgtggccaaagggccaaaattacagaacagtatcaagaagagaactggaaagaaatcagaaacattatctattcttgtaccaaagactactgtggatgtacctggaacaccatacacagacaaggtcaaaaaaaaaaaaaaaaaaagagaaagagaaagaacacctcctgaatttgtcactgaggaatattcttgaatggggcaaggcttttgaaattagaatgcttcaacccaggaagacaaagactaaaataagataccattaaagcatataaaattatgatgtttctcatcctctggattcagaaaagaagcaattttaaaggaaattgaaagaaagattgcttcaagagtaagcagtccttactcttgtaaggattgcttgtaagtggcaataatagttaaaaatataaatttaaaaatttatattttatagttaaaaagttaaaaatataaatttattcaaaaagaattgtgaaatatttataaattttaaattcataattcattatagaagaagcctataagaaagtgaattagaaatgtcctccactgctttaggaggctgaggcaggaggagctcttgtagccaggagttcaagacaagcctgggcaacatagtgagaaaccatctcttaaaaaagaaaaaaagattagtcaggcatggtggcacatgcctgtagtatcagctactcatgaggctgatggcggaggactgcttgaacccaggagactgaggttacaatcagctatgattatgccactgcactccagcgtaggcaacagagtgagaccttgtctctaaaaaaaaatagaaaaaaatagaaatgtatcatttatatcactaacctgtcctcccacaaaatatctttcaattgagtgagtcattgacctagctcactgtgacatttttatatcatcagtttttcgttgcagagttcttgtcatagtttcatttaatatgctatcattgagactagccatatccatttatacattaatacatacatgtttaaagtttccatgcagttttagtatgtaagtatgaatatttcaaactcaaacagaaatctttggggcaatgggaaaattatatgtattacttattcagtaataatcattcagtaatggatttggaatttatttggaaagtatacatatacttcagaattgtgaaccattaacattcctcatcatactgtttcatttctttccccctttaaagatctttttggtacctcttagtgtcaacataaatgatcgagtatagattgtccttagttgttttcattcttgctgacagtttaataaaaggtctgtaaaacaaaacaaaattaagcatgaaccttatatatcatcttcacttgttgaacaagtatgtagaaatgcctttattttgacttcactttatgaaaccaaactcaaacccaaaaatttaaatggattgtatctacgtgctgttaatatctcacctctgagagacacctcaatgggtgctgaagatttcaaatgtacttttctaaatatatttccaaatactaaggtaatcaatattttctgtgaatttgcaaaagggttcttagatttggagaatctggaagatttgcctttttcagtgacaatttggtttttgtttgtttcaagggaccccatagcacatcacagggcccactacatagtaagcattcagaaaatatttcattcaatggttgattaattcagggtagaaaggtctgaaggaaacaaaagatctaaaaggactttaattctgatgtagtatgactgctaacaaaagaaacacttccagctgtaattgttcattcatttgacaacagttccctgcctggtaaccttgtcagagacccagagatgccctttttctgacagtccacaagtccctcaagaatggaaatgtgattagctcagagagttgcatgccgcttctgatgtcagctgcttctttcttagacagcgcaaagatgagctggaacagagaatgtctgctctccaggagagccggagagagctaatggtccagttggagggtctcatgaagctactaaaggtaagacctgccagataaattttcctgagcttattttccatgtcatctgtgaaaatttttgcacataatgtgcaatggtttttccaattgctgtatgtgatttccctcaacatgttgtttcaagctcagatgtaaaacaatttgttagaccagtgtagcagtagctgtcagtaatagaacacattcttttttttttttttttttttgagacggagtcttgctctgtcgcccaggctggagtgcagtggcgcagtctcggctcactgcaagctccgcctcccgggttcacgccattctcctgcctcagccccccgccgagtagctgggactacaggcccccgccaccgcgcccggctaatgttttgtatttttagtagagacgggctttcaccgtgttagccaggatggtctcgatctcctgacctcgtgatccgcccgcctcggcctcccaaagtgctgggattacaggcgtgagccaccgcgcccggcctagaacacattcttatccattcctgaaaccagactgctgagggccttcatggggcaacttcttcttggcttatttccagtttctttatgtctgcaagtaataaaactggatttatttagaaatattttatatttagtagctttcagcaattctgattaaattaagaggagtgactgttaatatcagtaaaatattttattccattagtatgctttatcagtaggtcacatgatttctagtgaactcagacacaaactctaagagagaatatctcattactcttctgtaagtaaaatgtttaataagatgatttatagaagtcttctgtagagtgctgtaatctatttttctcattgggaagtggcattcttcttttagtaaagccttattcccttctttagtatacattaaattgcatttaaagtcaaaagcaggcaaattatggccacatgtctacagtcagcccatgtgatcagtgccacatgatcatcctgcctgatataaacaagcaagaagcagtatggattggaactgtgacatgtcaaaggcaggaagtgaaacttctgataggagaatggtaaagggaagaccctggggcagctcatttgcgagagagggtctcccaactttcagtccgtggatgtcccacggccccaacacaccaacatttgttgtttttattttgtctgtcctttctttctctcttttttttgtctgtcctttctttctcttttttttgtctacctttctcttttcttcttccctttttcttcattttttttgtttctttcttgattgccccctctttccttctttgttttattttttgaaagctactttgtcccagccactgttcttgtaaactttcttttgttttccttactctattttattccttttccctccatcagtgtcctctttaacaattggtattgggaatactttatctttactcaacaaaattgacttttcagtaattagatatgtacagtgtagaattcaattcttgttgatctatcttgggtaagacaagactagatagttcataacctgctgctgtttctggcctgttaatctcatttgataaccaaaaataaactctttctgcttccctttccaaatataccaaatgaaaaggactgaacctatctttcccctcagtgaatgacaggaagctttgaaaactgccccctatgtttctattgcttctgtcaccattagctatgactctttccctatgggatagaagtctattcaccaccagccatgttggtatcaacctagcctaacagagtactgccttttattgagatgtacacataccaggacagagaggtggattgtgttgaaaaatggttgtacatgcagagaaaagagatgggcctgtagtctcaaataaccaagtagacttggagtgatagtcactgaggtggcagaggcctggacctgccgtcaaaggtgtgttgatgtttccccatcttgcgttccttcacactgtgtacatgctcttattggaaccctgggtaatctaactgttattgattcaatctttctgtaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaagaactatgacatcttttagaaaagggaacgaattgtcatttattggaaacattttagatccccagaggtataagtttcaaaccagtcttagcttttcaagttgttgatcagacccttctcttaacagagagataccacagtcactagagataccctgaggttcatgtcatcccaaaacccacagcactcagaagctaacctctacacccactcacactgtgagtattcagttcggtttcattttactgaaaacctgtgaaacctctttttataaaaatcaggcaattaaatcccttttcatcacacaattattgagccttgttccccatggctcaccaaaatgtgctcaattttgtgagagaaagactgtactccataactgactattcacgtcccatctttttggctcttccccaaagcagaatccttactgttggttgacagtaatctctttttaaaaagtaactctcagctttttccttagcaccagagcctttcggctccgggagacgagagggtcattacatacttttttttttttctggaaataggggcattgtgactttatagcctaaactggagctgtctgaacctgtggtcaggctcaagagccagcagggggagcagcaaactcaaaaaaaaaaacaaattaaattaaattaaattaaattaaatagaagcaaaataaaagcagctttaatttcaagtgcatgtaccacgctatgtatgacaatatatcccactcactagcattatttaaaagtttcacattatttccatggatcaattagaaccacaacctgtccaatttcaacgtatctttcatttcttctgtatgctcttttctattattcattatgtgtgtttgtgtgtaacaaagaatgtttggaaaatgctggacacatttttacccttcattcccatggtctgtaaaaaaggaaagtgtaaaatcaatctgtaatgtcagacaataaagataatgtattacattattttgtattttgtgaaaaaaattactttactaaattaaagtcaaattttaacagaagacagtccccctgggtgaaggacacataacacatacagcctgtataattgcccatgaatgcatacatggggtattgctattgtatttccaatacacttagatcatggtaaagaaaaatgccttcttcatgatacttctctgcaaatggcttctttcctctcctgtctcttatttagcatgtgcatagaaaaaggaaataaggttcaattataacctccctcctcctagcagagagagagggcaatcatcctgtcgtcatcagccttgctttagccatttcccttggggatactttccaggccatttcccaggcagcaggatcttgaaaggctcctatggaccaggaagttcgtaaacagatggatgcacagagccaaactgtggcagtgcccccaaggtggcgccactgccccctcaccttccagctcctctccaccaagcccctcagcagcttctgcatctcagggggccaacagcgggtactgcggtgtcggtacccaaggaccagggcccacgtcacccagatgtcagcaatacatcgtctgggtagtggcagagtttgcctatttcacttatttatcttttttgcttttatacacaagcctcttttcaaaaaggacctgaggcagcttacaacaaaagatataaacagtgacttcataaaattgaaatagaaaaatcaaaaactaaagaaaataaaatgtgaatatgctaatcttaagggacaaggatgttactctgcatgttctggcaatgaagcaaaaaaaaaaaaaaaaggaaaattatcggtggttttatcagtacagaaataccacttctcaggggaacaaaatttctgttggcataaaatatgaaagaaagtcttcactgggagctttataggagtactggacgatagaaaaggaaaaaaagcagtcatagatttcatgtggctgtttcttatactgacctcagtcaaaattaaaagcagaaccttatcaatcccagccctatagaggcggttctgcaaggaaataaacaaatgctgtccaaatatagacttctcatggtaaaacatgatctaaggagagaatttagaggttttagactggcatctgcttctaaattctgtttttatttatgagtgtttctcccctttggggacattgtctttgtaaaaccaaacttagaacacccccacacaacaaattgtgctggatttaataacctctacttgctttatcataagtctgtgtggttcaatgtagtgttttattatactggcatatataatttctacttacattgtttcttgttagaggtaatgcatgaatttatccctctcgaggagagaacatgaattaaaaaaaatagtgcctgtaatataatgtgatgattatgatatcacaagcaataaatttttttttacaaaacttgaattgaagttatcctaccctctttcttctttgtgtatctttaagatttattgaaggaaccataaaaagaacactcataaaacgtttaataatgaaggcagctggggtataattgcagtaccaatatgttccagagtttctggtacacttccagttccaaatattatgtaccagtctaaaactgagtagactgactttgactccagaaagtaaggtctcaatattagttttcttagcaaagttactggaattagacctgaattacagtggtaccagatctttgctcacggctgtaagcttaactttcatgttcattaatttcaaactattgataatccatggctaataggattattgtatagattttgatagatactggatgtgaaagcactttgtaaaatcttatacgtcagctataagtatgaatgtatgtatataggtatacatacacacaggtatatataaacttttcaaatttggtccatattttacacacactcacatacacacacacacacacattcacttctcttccttacagttcattaacagtgtctccatcagggaaagaaatttgaaaaggacttttaatttgttcagatctcttgtaattgcttttaacagtagaaaaaaagagtcatttttatgttagagaaagtgacagacaagtccagtaagtttatattttcctatttctggtaacattagatatgatcctagatatactaatatctacagagtgtggctttcgccataatttgagtaggtatattaaacagctaatacagtgaagggctgccagtaacagatgttctatatgagtgcaatgaaacatctgatattttttcttaagttttatctataataaacatttttgtgtgagagaggtgattagtacagggtgcatattttagtcaaggataaaactaaggccgtgcacggtggctcacgcctgtaatcccagcactttgggaggccgaggcaggcagatcacaaggtcaggagatcgagaccatcccggctaacacggtgaaaccctgtctctactaaaaatacaaaaaattagccgggcgtggtggcaggcgcctgtagtcccagctactcgggaggctgaggcaggagaatggcatgaacccgggaggcggagcttgcagtgagctgagatcgtgccactgcactccagcctgggcaacacgacacagcgagactccgtctcaaaaaaaagggggtaaaattaagcttatgctaatttgcaggactttttttcagacttacaataaggatccatttttttaaactacattttaaactttgggattgaattgtttcttatttgggaagataatgtctatacattggtattatgttaagtaatacaattgttctaacttggtggggaaaaaaagtcaagcatcattccaaattccatctcctacccttattctcttctctgtttataactggatggtccaattaagtcaggaaattgtagtcatcaggtttctacttcttccaaacacttcatggaatactagcaggccagcaataacctgcttgggcctcaccttcctggcttttcctagctcatcctctctggtgggtattctatgcaggcatgaaccagtcaaaagcgagggagagggataattcacctcagaaatgatcaactgcaatataaagatgatcgtctagtgttcaaaaacataccctcccagactctctctttttaaaattaagtattgattattataattaattctaagtaagtaaatattatttctctgcttaaaaacctaggaagatgactctctggttcacaataaagtctaccctggaggtcccgagacctgcccatctccctcttctagcctcatttctctctacacccagcagccagcctgacaccagagccacaatggccttcccaccctctccacaatacgtgtcacatttcccatgccttgctcctgctgttcccaggttgctctgctcttctcttctccccacactttctcatttctgcctgcaaatcttcactgttaaaacccaagtcaaatgatgcctcctgcctgaacagtcggaattaatcacctctcatgtacccccacaacactctatacacaatgagcactttaaaaggcctgattataaaaattatcatcagtgtgatgatagccagtgaatttatattggaagaaaggataaaaacagggctgaatgctgctaagcactgctttgctgcaccttcccaagctgctaggtgcggccaggcatgaccagactgcattctcagccaaactgagaggcagactcttcaggtctagcggggagggggatatataattctctgctgtttcaccagggtgtcctgattcaacaattagacatttgctcctttccttgaagcatccctcatttctggtggtgaatagaaatcaaaacacttcctggaaaatatcagaaaatgtatgaatcttgtcagactttttaaaaaaatggatacaacagcaagttgagtagacttggaggatggtgcatagagattaatttttcatttattctccaggaagtgagctattttaaatttgccaagtgtgatatatgttttccttcttccataaatcaactctctccttgggaattttagatctatatattgatctgcatggaccattgtcccttaagtctttgctccattaatcattgagtaatttccaggaaaggatattcacagagattattcactctaactcttctacagttgttagcagacaaccatgcctcatgaccaggctggaggccaccatcccaccgaggccacttcctgtgaaaatgaaactcagtgacatcatcactgatctgccccaatgccaagaggccactgccttttcctagtgttcctacaagaacagaacagaaaggaaggccagagatggcattcctcacagtgggtaggcactaggaagatgctctgcatcaaactggacagtgtcctgacatggagaggtggggccgtgatcacccagggtgtcagtgtcctacccccaaaagtctgggtaaaggctggatgtgacatgggagttgccagttgtgggaaagatgcaactgattattctcttcagcacaggatcttccacctaaattcttcacataatcaaactgcatgaaattgcaccaattagagattcctttgggaaatggtggctattcatcattcacacattggtgtaatttagattcagtcaactgtttttcccttaacacacaacgagagtcaatgattttcttcttattgcagaaccactaatgggagttttgaaaaagaatgcccacagaaaggagtagcaaaagttgcctttgagaccaggaactgagcagggagaggttgggtgaggcatgcctcagacccacaggaattagcagaacagcccagtgcactaggagatggggagaggcttacagaaaaggaggtggaagggccagacatatgagtcttcttacaaatgctgcctagagggaggagcccccagcaccctggagaacctggtataagaggtataagcaaggctggtgtgcactacagccccagaacagacattaaagtagtgaaatatggtccatagccccatatctcaaatcactagatccagatatgttccagaatttggcatttatctgattttgaaaagcaatatgatgcagatatcgtatcagttacctcacatccattaagaccaaattcattatggaatgaccagtgtttgtcagagcttttttggctttcagaattgcaaataagagattgtaggcctgtacttctgtaccaattgataaacagtccaaggccctcccatcaccctgagcacccatacatcttttccatgatccagcaactaaaaggtattgcctggcccagtagcaggaagccctaggacgctgctccagcaccacaaggtggtcctactgggtctgtgccctgtgtcttttccctcttcaggctgctgaacctttctatagtagtgaagcatagatggaagcgtatgatggctggtcacagtgcccacagtccttagactcagcatggcaaaccctgagcttggagtctaaagactggggatcaattttatctctgccattctcttgctcagaaaccttgggtaatccagttatctcctcttagcctcagtttgctaatatataaaatgggaataataatacttcatatggttattaagaggattacatgaagtattaggggttaaagtgctttatggactgcaaattgctattcaaatataagatattaccacttgtaccactgtactaggaaaatgaaacaaaacagtgtatgtaaaagtgctttgtacattgaattacttacaaaagtggagttatattattattgtgaacttctcaccatggaagacaatctgagttcccagggatgagacggtaacccacactgatagccaagagaatcctacttcttaataaccactctgtccaacttcccttctctagtccccactcccggctgtgtttggtcccttgataaagaggacagagacaagaggctcaggagccttgctaaggcctctgccttaaaaagggtgtacaagaggaattgccaaagtaggaagagctcagggcatctgaccagcgtctgtctccattgagggactttttgccagccatggccagcaaggctcccgcagcccagggcactcagagcccctgggctcagccccagccctgcccctctgactccgtctccagataaagcaattattttcacctctctgagtactgggctccacaacttcacatttagagtaagaatgcatacttcccagggtcatggagagaaatcagtgagagtgtatgtgaaaaccctttgaacatcataaggcacaacgcaaatgtgaaattatttattattggcatgggaaggtcaaggatgcagtggtagctcagaagcagaaggtttcaaggtaatggggctgagctgccagagtttgctggggaaaactagacccctccttgagcaggccgagggaagcaggctgcaaaaacatcacaaccgggcaaagttctcttccttgggcctggacagaccattacaaggtactgttgagagtgaaagaatgggaccctcagcccattgggcaccccatgggttattttctgtgctctgttctgttttgcttcatttttaattctgggtttttctcagtttatggctttaacaattatgcgtgatgctgagcctggagagctaacagcatggcatttttcaggattgatgtggtgtgttttaaccacaagccactgagcccaaagcaaatatctaaatggaatattccagagcattgctctggtggtatacatctaggagtttgaatgggttaatgatgactctctgggccttgctggagaagaattctcactctagcaaccacagcaaacagactgggatggaattgatgtgaacacctaatctgttgtgtatgcactcaagggtctccttgcattttcttacgcatgtggctgacttcttttgtcaactaattattaaaacagggagaatatttccaaggcacctcatttagagacaaatccttaagattcaaagtgtgacagtctcagaatagtttcatgccaaaaactgtagtgcaaagataagttccttcagttgttttctacttttttctttacttgtctttaaatcctactattcttattgtcctgctagaatactgctttttcataggagaagagaaggacatttcctgcaggaaataataccaaaaaattagaaaacaaggtttcttcttcttcttcttccccattggaatccctgagttactaatttgacaaaatcagcttttactataaaatagggataaaacaatttacacttcatttgattcttaatttgagacttaatatgcacaatattgtatgacatgatttaaactcttatcctctaaagataatgctagtacagtcaggttgaaaattcagaaagcatccattgcaaatagtcttctagtttgtattttaaactttctccttaatgtcttcttagtcctcggagaccttccttcaaggagaaagtatccacaccttgtaattatctgcatttaacagtaccttcattttatgggcacatgtcccatatactgtagagcaatgctgtactaatagttttagctttcaatatttaacccaaacttcagattacatacaataaggtcctaaattatctgcacctgcaaattagctttaggattaccaacacaattacctaggatttcctcctgctttgaaatttcattgtcactgttttcaacaatcaactgaggcattggggatgacatatgacattttcttgggaaagcaaattaatgacctgcattgtctctccagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagtaagtggctttattttttgttgtggtctgcttttatgtggcaaataggtcaccaaggtctattgagtggtcaagagttgtcagaaccacatgtgactattgtagggtctttcatggctggtgtcagagcctggcctgccagccattttgggaactccctacaccaatttgttctcacttcacgattttaccttcctttggcttttgttgccctgccttattttttagtaagtctttgttcatcaaaagacaggaaatcttttcaccaatacccccagaaaacttcataaatgtaatctattttttttaattcttagagattttcttatctcatattgtcttttctttatattaaagtcaagactgagataagtaatcacagctctttagcaatgaggtaaccaagaaggacatttagtcatttgacagattccctgttctgatgccccgaagagttgaatcattgcctctgtaaggcagggctacagggttaagcctctgcagttagaggagtacaaagagggatggggatgccagccagcactttcccatgacagggagagtaactttattaatttagaaatatttttaacactttttaaaacctcttcttactatcactttttaaatttatagagaataataataaaaaaatcattctgtagaccttcaccggcagctttcattcccagaagtaaccactattaacagtttgatccttcccaaagttttgcttttgtgtaaatagatatgtttaaggatgtgattatagacacatactctttttttcacacaaataggatcatgcattgcattttggggtctgcaatttgcattttctttaaattagcaatatatcattaacattcttcgaagtcttcacatagagatctaaggaaaagagagacatgtttgaatatgggttttaaggcaaaagagatcataaacaaagttaaaagacagaaaacagtcttgaggaaaccatttccagtatatgtgtcaatcaagtttcataatttcagttatacaaaaatcatgtagagatcagaaagaatagacaccaccaaaacaaaaacaggtgaaatatacgaatagacagaagaacaaagagaaattgccaataaatatatgaaaagatgttcaacctctaattacagaaatataaattttaataagtatcactttttgcctagaagattaaaaaaatgttttgaaacatcataatatccagggatagcaaaagtgcgaggaaaaaggtactctcgtccatgtagaggggtgataaaatcttaacacacttcaatgagagagaatgatgaactctctactctgagggaaaaggaaggatctatattagaactttttcttctaggcactgaatataactcaagagtttttaaaaatgtaattcacaaaataacttttaatttttagaaagaaaatatcccttctcttaatcatattttaaagaaatgtactatattttaaatcaatttgtgatttccattataattaatgtttttacttaactactctgatttttttaatttaaacatttattattttatttagttagtattactttctgaaaaatgacggaatgaaattccattaacccttagtgtgcctgaaacaaaataataatctttctctgccataaagaaacatagtctaagttccaatttatagtaccagacatgcatctgcccatgtcttggcagaagaaacaagaatcctcacccctttctcacgctctgggggcattcagtgcatgtgggtttcccattcccaagtggtacttacactggcaggaagagctccaagagccctgataggagacagcgcatgtcctagtagagaccagaatctaaagggctcagccaccaggtaagggcaagaaaaataatagcagctaggaaggcgcagctctcctggaaaacctgatttttcatctgtgtggattattcttaagaagggtgaccacacgcactggtttacctggaaccatcccagttttgccaggtcagccagccttattcatactgctctctttcaccttcaaaattgtccccatatggacaaataatatatgaaactccatcattagccatgtcttcttactgcaggacccactgccctaagcagtgttttgttgttgttgttgttcttgtttcaggaaatgaactaaagcacttctgaaaaggagaagtcttagaagttttcttgctttaggttattaatgggaaggataaataaacaacataaaaatttaggatagaaggaagctttggttttttaaattatttcttcttccctgaaggttcaagaagaaacttaaggaatgacttgctagtggctgcagattccatcactaacactatgtcctctcttgtgaaagagctgaattctggtgagttcctgattccctctcatttgtctgctcatcatggagggatccataagtgctaggggtctctcttagagatctgcttattgtctaatatcaaaagattctttaaagctctatgtgatattttgttggtctattcagatttgaggggttttttttttgtttgtttgtttttggttttttgagacagggtgtctctgtgttgcccggctgaagtacagtggcaccatcatagctcactggtatgtcaaacacttgggctcaagtgatccccctacctcagcctccctagtagctgagactacaggcacatgccagcacgcctggctaattttttgttgttgttttcatagagacagagtctttgctatgttgcctaggctggtctcaaactcctggcctcaagtgatcctcctgcctcggcctcccaaagtgtgtgagccactatgcctggcctattcagattttttaagtaatgtttatattttgcttattaaaagactattaacacatactcaatgtagaaagtttgaaaaaggcagagaagaacaacgaaaaatattcaaactgacctataattctggaatccaaagacagccactgttaacatctatggtgacctaaaacaacatgatgctaaggttattttatagggtcaagtgtattatttatctttttttgagatggggtcttgccttttttccccaggctggtcttgaactcctgggctcaaacagtcctcctgcttcagcctcccgaagtgctgggattcccagcccttatctatttaggtttcattaatttggaatgcctgatcatttaaatttgaatttcaaactgaaatttacctttgcaatgtctctgaagatagatctgcccagaaataaatagcataaaatttaaggagactttttatccttttaatactacaaagagtgttcaaaactttagcagtatgaatatgcaaataaatatcttaccagtcactaatacatctccatctattccttaaggccgacctaccaagagatttgtctggcaagactatggtcttacagctgagattgcaactataagaaataaaacttcagttttaaaaaaatcctggacttcgctttcttaaagcctctcaattgaaaattgttgctgctaatttagattaagattaccaaacggaataaaaagatagtagttaatacatcatgattaatggcaggtaaccactgccctagcaaatgatgagtacaaagttattcttggtgtagaagtcttaagtactgttagtttatactcataattctttaaagtattaagtgatagggttcacttaatattttaagttcatattttaagcattttaggtgaatattttatggttaggattaggttttaactcatagttcttaaattagtgtaatattaagcaaaagtaacaattttagttaagtctcttacagaaaggaaaaagtagaagtcttaaagagttaagtcagttactaagatggcaaaaattcctcataacatttctgagattttaaaaatgctgtataccaaatgattttatagtaattcatgtcaatatcaattcttattttgaaacaataaaaatgtatttgattaaaatatgataactggttaacattttacacagcacaggttgatttgtgaagcctactcctttatttgcaggtcataaaaaaatctaacgagtcattctttatttcttcaattgtatctgctagaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatgtgagtatcttccgcttggaagcattttctcagtaacaaaacaatctgtaggagacaataagaaagtaaaagcataattgtttagggtttttttaaccttcagaaggggtgacatagttttctgttctgccagagatatagaagggtgctacatttaaattcggcattgtaatatttcccctcttacaatttccagagagttatcaataacctaaaccaaccagtgcctatcaagagcctgccttgcccaaggcacattgctagtgctatacaaaatagtattaaaaaactgctgccacccttttaggactcacagactagttcaggagataaatcatcctatcttctgaacttattgtatttgcacttagaggataccatgacattggagaggtctctgtccagaattggtgtaaacaacatcacataagtatttggaattgaaataagtacatgtataaaatctcattataaagaaatccagtttggttgacttgttgaatttgtatgaatctgaccctccaaagacttatttgcaaaagttttcacccagttctggagcttgtcagaaaccagcagcatcagtaacgtccccactagactttctgtgaccctggatcagctcaaattagtcaacagagaaaaccaaagctgagaaacaaaggcaaagctgggacagagctgcagagcccaacttgggagaaaaaggagaaaaacaaaagaaatgaagaaagtggcccattaaatgaccatggttcatggagttatgggaaatgtgggcaaaggctgacccaaaagctgggggagggagtttctgaatgctaaaaatacttcagaagggtgatgttgcttaatatgaaaagtacttcagactagtctataaaaataaactggccattttaaagactcagagaagaaactaaacagaggcctttctggtgtttggctctccatccaagcagtgaataaacaatcagtaatcatggagaattatcaagaggtgtggtctgagagtcagctatgaagcagcagagagtaggatcaaaacaaaaccattatcatgggacttaacatggcagtacgctgctgcttaatatagtttgctttcttgtcctttcttctgtattctagaattgttggatttgttattcaaaatggtgaattagttgtcatctgttttgtctggtaaattcatatctatttgactttttattattaagcatttatatggcagttagctagaatttccttgtcctaattctaaaatccaagactattgaggccaccctaatctgctagccctggtatgctgagtagcagtaccagctaccaacatgtgactcaggagttagggaaggaaagttaacagagtcctgggcagacccatttagcctggccccaaacctccaaaaataaccagaacatgttgtacagctataaataaacgcaaacaacgacatttaagttccaacctagaaacttcttcttgaccacttatttcattttagggaataatttaatatttctattgtctaaacatgtacttgtgttttaccctgagactcttttagtcctatgatttaggtagtgagtttatgtccagccccatgaaaagctttgcatagtctaggatgaatagatggagacagagtcccacattagggaatgaggtcatttttatctatttatttgatagtggaattggataattaaaatgctttttttttttttttttttttttttcagatttagagctaaggtcaagagttatgggttagtagccctcctggcattgactagctgatattctaagacttaattctataaaaataaggcatgaatgtggtatgcatgcatatgtgtatgtgcatgtatgtgcgtatgtgtaacacaaaagaggttaaattataaccaaatgtccttaagcattatttcactagagggctcactctccacacagaaagtgatcttgggttctattttaaacaagaataaaaagagccctcagattgggaaaactttgtatcccctcaaaagatgtttgccattttttaaattatagaacatttaaagggccaacccattccagtaaaccctaggaaaagataaatgaccaatgatcgcaactgccataaaaaaattgtgtatgaaaataccttgatcatatatcgcttcaaacctccaaaatgtttccaagttttttttaggtattactaaagaagacatgaaagtgacttggagaactaaggggaaataaaggtgccaacgaaactacagctcacacatgaatcccgcttgtaattctcttttaagatttgctctaacatgtcatctgtggtttattttcagggttacggaggatgcagatccctatgtgcagcctgaagatgaaaactatgaaaatgactctgtccggcagctggagaatgagctccagatggaggaatacctgaaacagaagctgcaagatgaagcttatcaggtacagggatccaggcccaccccaccccacctcttctgcctcaaccccttggtagctgggtctttgacatgacttgcagaatcagagccttcttccttccaccctcccttttcaaaatacactgatttcactccttaatccgtgtcttttagacagtaaacattttaaatacttcttttttttttaagacagaatttcactctgttgcctaggctggagtgcagtggtgtgatcttggctcactgcaacctccgtctccctgatttaagtgattctcctgcctcagcctcccgagtagctgggactacgggcatgcaccaccacgcccagttaatttttgtattttttagtagagaaggggcttcaccatattggccaggccagtcttgaactcctgacctcgcgatccacccacctcagcctcccaaagtgctaggattacaggcgtgagccactgcacccactcttatagctgtcactcaccatgtattcttttaaattctgccctagaaagtgataaacagccttcttatattggaaaaaaacaaggtaactaacagtccagactctttcaggcccattaagaaagatgctttttctcataattatttttaaatggatacaaagaacagggcacgaggaaattgaataagcataaacccaccacttcccttgaattatttgccctcagtcttcctcattgcccacctcatgccaagtgtaagtaggagaatggcaaaattcctggagaaatgttgggggaactgcaggcctgtgttcatcaaggtatggacggacagattttcagatgtactggagtatgttagccacctgaaaattcactgaacatgacatatacaattggcaataaatgtaaccagcgactcatcctaaaggccatgcatttccccatggaggtcgttctactaccttgtttgtcttcctggtatgttccttttccctttaattcacaggcgtttacttggggttctggtatttcagggatgtttgcctggttgaacctgggcctcaatggttattttatcctgtcagactttctgtccagtggccagacaagttttctgcacattcttttgtttttcttttttcctttttttttttctttttgagacagggtctcattctgttgcccaggctggagtgcagttgcccaatcatagctcactgcagcctctaactcctgggcacaagctatcctcccacctcagcctcctgtagctgggactacaggtgcacaccaccatgcctggctaatgtttttattttttgtggagtcagggtctcaccatgttgtccaagctggtattgaactcctggtctcaagtgatcctcccaccccggcctcccaaagtgttgggattataggcataagccaccatacccaggctttctgcatattattagggcagcagtgccctgtcttactttgttattgaaaaaaaagggaagcagagagaagaaattatctcctatttctcatatgtctatagataaagccttgaaatatttttccaagaagattgtagcaggagggaaacggaagcccaccaattccatcccagcaatataaaaacaaagttttgcctctttggaatgttccatttgccttttcagtttaacgaccacatttcagaagcaactaaaatgttggtctagccataccaaagaaagagggtaaaagaaaaacataagtgactctatatgtagagccgtgctcccatgcttcagaaacaaattcgcctgattgcaaacccatggagagtgcagttttccttgcgccttctatggctcctccacagaaggaaatcagcctggaatgaaactgccagggtgtctctgggaatcctcagggatggcattcctacacatatctccttaggctctgctgtgtagaaggaaagaaaaatgtgactaaataaccaatgttctggttcatgctattagaagcgtctattaggcctccctctttgagctcgtgtcaccttctgtatttcagtggcagcagtaactgaaattctaggggttcttttttttctttaagggaggcaggcttacaccattccatataaaatattagatttttattcattttaatgaattaaaaatgtaaccttctatgagtaaaatgaagggaatttctactaatgacttaagattcaactggagtttttaccatcgctggtaaatcttaagctccctctccctctcctttcttttccgtgcctcatgacttccaagaaaaggacagggaagaagctgggagactataacaggcctgtgtatctccactcaaaacatactccctggaggagatgtcaaagtggttttccttgaatgctctgtgagcatacggttgttggatggattggaacgctactctcactcaatagactctctctctctctgtgtctttgtgcatggcttcccgccaaataattcaccagcttgactgcatcacagacttgacgtgtcacctttctcgtttgtgtcctttgtcacccacaggtcagcttgcaaggttgaatgcaatatccttttatcacactcctctcaagtaagtaccatcttatttaggaggaatcatggccactgtacactgaattctgataacctgtaatgcgaattcacaatcacttctcttagtcatttctttctatgtgataaaataccctccttaactgctgatatcgaagagtcgtctcagtctgtggagggtttcattataaaccagtggagatttgccagacatccttgggaggtgacttcttactctattagctaggaaaattggcacaaagcttctaaacctagagacgttccagtaatcctctgtggctatgaaacttaccaataagtttgtcacatcaccaatccatgacaatatcggagtttgtagccgctctagcacttgaaaaggaaaagtcagtacctctagagatgggccagcttgttagtcatactatacctcgggctcaagagatcaaatgtgtgtgccttaacgagtgaaagcaaaatcatgcattaataaagagaacaaaagagcccaaacagaggaaaaattctgcagccttatgtttttggaatacctgattcaaatccattgtggaattcagcagtatataaattaatttaaaatattattttcatggcatgtgaaaccactccaaagccctacctaaatatgtggaaaattctcagtaattttttaatgcagagagattagcactggactggcagcatcacttgactgtagtggtctgaagcttaggcgccagactctaatagacccatttcaaatacgggtttcaccaaatcctaacagcagaactttgggcaaattattaaacccgtattacctcagtttcctctatacaacatattgcataatagcctcatagaagaggctggtattatgtatcaccacagaagaggccggtattaaaaaccatatcctactcactgggatgtagtttttaaagagcttggcatagtggaaggcacattatcatttattatgaacattcacatatatgcctgcccctatgttcagtgctttatagcacttcaacacctggcagctgccatattgcttacctaagtgtacgggaaacactgggacccagaactagcttgctttctcttctacttttataaacaaggctaggatgcagctacatgtgatgacttggcacactgtgggccacactgttccgtaagtctagattttttctctggctccagctaatagccatttagatgcctccatggtagttcaaagctaatatacctctcaaaggattctggctgcactggcccaaacatttgagctttcccaatcatggaatcccataagtctgtactgcagtggacagtaaatgctatcaatgttggttgctattaataatttgaaaaaggaataaatatctgttaagtgacatactaattagtaaagaatacatgctagtgcaaatgctactgacatcctgtctcagtcctcaggttaaaattaagcaagtgaaaatcatggagtaattgctatgatcatatatattttatgagcgaagaggaaggagctcattgaccactctctattctgcctctcctggatttgagagtgccaccacacatgctctcctgactcattacaagtagagtgaaaaaattcccaggagctgtttctgaaaatattcactccagttataacaaatttagtcccaaggggcaggccttttcctttaatagcactttctttctcttagcttcagcaatttgatcattgttgttctgcacattatttaaacatcagtagctagttcttagaaaaatatttttgaaagtctaataaaatgtgcttgcgttaaacccagataaaaagtggaatttggtacctaaaagccaaaaatttcagtactctagaagttcctaggccattttttaaatctttggttgcaaatttggcagtgaaaaattagactgttgtagtctttgccatttactgcatcctgtagcctacctagctggaattccacagaactctgaacaagaaccagcctgtcattcaatcagccacataggcaaattcatttaaaacctgatagaatgttgtaaaaactagtggcttttcatttttgcagctggttctatcctattgtactttttcttaatgtaaccaagaaatgcaggtgcattttaggccagtttatttcattaaaatatttttgtttagactttctggctgtactgcaagaccagaaattatcccaaagtatatgtgtctcttatccaagggttctgaagccagattcatcagcttgacattagttagccatccgccaaggcagagagccttgcattgggaagaggcagaaggtggacgccagagacatagaagatgcaacctctgctcaaaaagagctttaggcttatttgaaaataagtacacactttcaacatacaatattaaaaaaagtgaatagtttaaaacctggtttattggttttcaactagccacttttgaagaaacggtatacataatggcactcagcttagggtcctccaagactcaattttagcccatttaggtattcaatttgtccctgttacatcctgtggccacatggtacaccactgtccttggccactcacatccaagtggaaattagaggattggaccatccaaagtagattttttaaaaaccaacgtggcagcctaatcatgggtcactggttttatctctttgtccaaaagacagcacaaatatttctgtttgtgttgcttttcccctccagatgcctctggtacccactaagaaagagatccacatggaggacttcctgtcctctcttccagaaggtgcaatagcacagtgtcctaggactttcattcctgattgtcgtaggaaaggagtgtgtgtgtgcatgtgtgtgtgtgtgtgcgcgcgcactttcttctatattggggaaaggggggatcctaagtttcataaccctaatttagaaacaatttgcatctttaaaaaaaattacacattccttattcccaggcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacact

SEQ ID NO: 36797 - DNA, 167400 bp, Homo sapiens
gttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaaggtaccgagcacgcttgcccccaagagaacacaaactcactctcctctcctgtcggtccagctttgtctctcctcctatctagcacgggcgtgggggtctgagacttgctagttagcccagggctgtaggacttgaacgtccggtaggacccgctgctcacgatgctggaccacgtccctgtggacccagccttcccgcccacacattcacacacgcaattcatggtggctccgggttcagagatcgatttcttgcggggtggtagcttggttttttttgtgctttgaacctgcttgtgtccaaagcacgtgtaggtaggtattaggtggcttctgaaggctgagggatggagacagccgagggatactcttccagaaaagcttgagtactgggccagaaaagcatgtatgtatcccaagggtctcagagaccttttgcttaacagggatcacccctaccttcagatactactcactaaaaaagaaaaagaaaaagaaagggtttgcctgcgtttgtctgaaagttgatgttcctcttgtgaaagttaatactctaagaacctatacttgcttttatgaaagttacactaacacgtatacaaaaaaccaagcccgcagcagttctcctgtcactgttacacttcctctgaaactcccgtgggtgccaggcacatgtttgaaaatcttggaagaggatagagtaaaatgtggctgctagcagtgcaatgccaaatggcaactcagctggtggtggaaatcctaagatggagtttgtagttatgtggattcttttaagtgtagagctcctggctctttattctgatttcattgtgcgatccccaggcatttggggaatgtgaggcagtccgtgtataccagcaaaggaaaggggttgccagtttataggatagggacaggccagatggggcaaggaagactgcgatcctgtctctcttcacatgcatccctggaagccattgatatgatcaggaggatgaaaatcacagcctgagtggctctggggatttggtgtgatactgggcactgtacatttcccagccccctgaagttaaccatcaatgatggtaatctaagcccgaaagctttacatcttatttatttttatttttttcctgttacttactggctgccagacctggggtatgtgtgtcaacttttctaaaactcggttggaaatgagggaaaaagccccaacttccagagacattgtgaggagtacatgagaggccctaatgtccacctggtatactgtaaggactcaatcatgtttatccttttccttcctgagataaagagatggaatctatctcatctcaaatgatccactccaaagcaatctgataacccatacacatgcactacctctcctcagtcaaaaagtttctgggtatcattgcctcccattgaacatcagtccccagagtgatataggttagtggccattttagaggaaagctagaattctataaatgaatgtagctgaactcaagagtaaaactagtattgaactttttgaattggcctgttgctctgcagtaggcgtgttctggaaagggcttagcatttgggcaaacagtggcatggttcaaatgcattatatggatttgctatttatagatgtcctaatggaaattatttggcagagcaaaagccacatatgtaatgcccataattatccaccaatttatctggcttatggttttgtacaaattagtttttctcaaagtggtctatacaccggatgtgtgtttctacattcctaaatttgatgtcatggcctcagtaagcttaattagtggagatgaactatggcagcccatgaaccctaggaaattgaatgcaatattgtatgcctacatgtgaatttttcttggcatagcattcatgatattctcaaagtgatccatgccccttaaaaaaggctaaactgctagtagggaggaacgtgtggtaaggtaagggagtaggatggcatgacactggaggagaggaaggctcaattcattctattctaggaaggccacatgttaaagcttactggcgtttacaaggatctttgaccctgagcatgagagcttggtgaggaaaatgtgaacaagacagtaatatgcattccatcttactcttccatgaagtggtcttgtttgtaaaatatcttgtgggacaaacatggttcaggcccccttggcattaaactctctcaaggaagacttaaagttactttttttaaagagttaggtttttttgtcttattataagagtaacaaatactctttgtagatatttgaacagtccagacataaatgatgaaaagaaaaataaattagctcttggtttaccatccagaagcatctactaataaaactttgatctatatctcatgtctttttaaatctgtttatatatttacatagttgagcgagaacaatagtgagcatctactgaatgtttactgtaagtcagatacaaccttaatcttcacaatagaagattctgttaatatttctattttatggatggggaagtggaagccaagaaaggttagatcattttcactgtgaaaatttattatggaaaattttaatatacacaaaagtagagaaaacagtataaagaactgtcatggacctaatcatgtggcttcacaattaattcatggacagtattgttttatgtattaccaccaccaccaccaccctacacatactggatcattttaaagcaaattccagacatgaaataacttcacccgtaaatatgctatcaggttacatctctcaaggataagggttattttcattttattttcataaacatgactataatcccaattagcacatatttcaggtgttttaagctaagggccactatattctttagaagcccacaaatagtctttggaaaatctgtgaacaacccgaaccagcattcaaagttgtccatgtacatgcatatatgcatcatctagggaaagaatttatagcttatctcaggttcacaaagggtctatagcttcaaaggttatcttaatgtcctttttctctttcttgaggaaattgaggcccaaaaaggggcagtgacttgcctgagatcacacagatagttactggcaatacccttacctacaaaccccgtcttggactttggtatcccagtacagtttcctcagagcaaatttctgtaagcacaagtcataatatagtttaatgtaattgtgggttttcttctttatgaaattagttgagttgaataagtttgaaagccactgatgtatcatacccttctatcttcccactaactatttcagaaagatgacagcctaatttattttttaagggcttgacagagaccattgaatataaacaaaaatttcatgtcccattatcccttatttcaatgaatatcttttctcctactgacttattgacaacatagaaagcttgctagtgtctaatgtgaaggtttgctataaatctctttgtcatcacttatatgacacaaggtcacattttgatgatattgaggaatcacacctcaatatcatcaatatcaaaggtgagattgacacacctctgtgaacatgcctaatacctcaaagcctcagcttcctcatggggatgctgatggggctgctactacccaattggtgtgctttttgtaaggcctaagaatatgtaatacacctaatatgtttgttataagcatacacaaacataaaccattatttattttctctatttgtttcaaatcagatgactgctaccaccagccaaccccaaatgtcatcattggaataatttcaataaccacaactgacattaccataatgtaactgagtttacctctttgggcttttagttatgctaattgattacaatgagacttcacttcagctattttgcatccccaagaagataagacatagactcaccagcatgtgatttagattttgaaatggtgctataagccacccagtgccctagtggagccacggaccaaagtgaccctcattcctggaggattatttctgaacctggaccacaatccaacctatgaaaaagaaatctctaaccatgaagacgtgccctgaatctcccagaaagatttctgtgtccatctatcagcaattatttattgagtgcctactttgtgcccagcatatctcatacatatatgtgaagctgttattaataaggaatttaacttctattcagggaagaagatgaaagaaaacgaaaccttggctttgcattgaaatcaccaagggaacccaggccataggctagaaccactaagttgaaatctctgagagagatctcaagcatcagtattttctatacagatgcccactgaaaacagaattagaatagtgtatacataaacccaagttttgctttttcttccacctaatgttatacgtagtcttcctatacttttaagtaaccaaccacacaaatattgaagatagcctaatattccatttcattgttctaccacatcaatttcagcagtcccttctgatttcatatttaggttctttcccagatttcatacatttaaaaaatattaaaatatacattccaatgcataaatatttgtatatgtttctgatcagtttcatgacaaatagaattaactaggtctgagtataaacacttctaaggtattttattctcataaccacagtgacctcagaaaaagttgtattatagtcttttttttagtaaacttttcatcaaagtacaacatcatccccaaaactgcacatattaaaagtttatagcttgatgaattttcaaaaagataaactcttgacctttgtgtgaccacctcataaatcacaaaaagaatattactgacaccccagaatctctctcatacccctttctaatcactaacctcctaaaggtaaatagtatcctcactctaacaacataaattatttgctcatttctgaacttttgataaattgaatcatacaatattttatgcctgacttctttcactcaacattatgttgaaattatctgtgccattgtaggtagcaatagttttcatttttattaccatataacattccattgtatgaatggaacacagtttatttacctactctactgatgatggacatttggattgtttcttgttttgggctgctataagccatactgctatgaacattccttatatatattctttgtggcacatatgaagctcttctattgggtatatacctagaagtggcatttctggcttatagggtatacacatgttcagctttaacatacttttcaaaatggctgtaccacttcatattcctgccagcaatgtataagacttcaatccactctttgtgctaccatcgtttcatattatctttctcattttggccatctaataagcaattaatggtattgcaatgtggttttaacttgtatttccccaatgactaataagcttagcagtttttacatgtttatggcatttgatgtcttcttatgtagttgttcaagtcttttgccatttttctattgggttatttgcttcttattaatttgtaggggttcttctcatattctggatatgagaacgttgagagaaaaaatgtattgcagatattctcttctacactgaaaaaaaaaaggcttaccttttttcttcttcactgaaattcctaatttaatgtagtctaattcttacatttttctcttctatggttgtgctttttgtgtactgcttatgaaatctttgcctattccaaagtcatttagatattctattattattttctagaattgttattatttgcctttcacaggtggatttacaattcatttggaattgcttttttggtatggtgtgaggtaagggtcaagattcattttgactatgccacttttgctatccataaataatttgactgtatatgtgcaagtttctattctgcccattggcctctttgtctaaccttctaccagtacagcactgtcttaaatgtaatgattttatttaaaaggtcttgatatctggtagcgtaagccctggagctttgctcttctttttcaaaacagatttgagttatttttgattccttgcatttccacgtgcactttggaatcacctgatcaatttgcacaaaaacacctgctgggattctgaatggaactgcattgaatctataaatccatgtggagagaatgggcatgttctcactccagagtatttgcttttgtcaagtcccctaagacatcattgagaggaaccaaattttgttactttttcagtttggggtttaccaaaccaacttttgctgtctaaattcaagcctcaaatctatgtgagggcagatccatgaataagaattccaagataaatattttatatttacttatttatttttgtccaccttaagactaaactaagatttctttatcatcaacctgagttggtaagaattttgtttctagttcatttttttccttcttttttagattctactccacgtagacatcaaaaccaacctaggtttttcttgactgtggtaaaatatgcgtaatgtaaagtttaccattttaaccatttttaagtgtacagttctacggcattaagtacattcacactgttgtgcagccataaccaccactcatctccagaacatctttatcatctccaactgtaactctgtacccattcaacattaattactaattccccatccccttctttccccagtctctggcaactaccattttcctttttatctatatgaatttgactattccgggtttaccatataagagaaatcatataatatttgtccttttgtgattgaattatttcagttagcataatgtcttcacagctcatctatgttgtggcatgtatcagaattcccttcttttttaagctgaataatatcccattgtatatatatactacattttgtttatccattaatgcatcagtgaatacttgggctgtttctaccttttagctactctgaataatgctgctatgaagtgggtgtgcaaatacttgttgaagtcccctctttcatttcttatgggtatataaccagaagtgcaattgctggatcatctggtgattctatgtttaattttttgagaaattgccatcctattttccacagtggtcgcacagttttggattctgacgagtaatgcacaaggattccagtttctctgcatcctcaccaatacttgttattttctgggttttgttgatcctgatgggtacaagatggtatctcatgtttagtgatgtagatcatgtttttatgtgcttataggttatttgtatatcttctttggagaaatatctagtcaaggccttcgtccattttaaaattagattgtttggtttttgttgttggattgtagtattatagctttctaaccagcaaatttgaatgatgcagaagtattgaattttattatcattttacttacatttattcatcgaaagggttatttttcatgcctttttattacttgtcttttttggtatgtgaattatctgttcatgtccttgtccattttaatactgttttttcatttcctattggttttaaaaaattatttataaatattaaattcaacctttcagatacattgctaacattttcccagattgaaatttgtcttttttcaattctattacattttcaatgtagaagtttccttttttatggttttaaatgtctcaaatttatttagctatgttttcttcttttcaattatatttagaaaggacttcccaaccctgagaacagaaaaataaaataacctgtatcatttctctagatcctcaatatgtactttttgcttttatcattttcatccatctggaatttatatcattatgtagtatgaagaaatctattttttcccaaatgatgaatcagtatttctaaaaccatttgttgaataatttattcttttttcactgatttgaaattttacgttttttatgtaataaatggtaatatgtattagattctcttttagagttatctgtcatattctaatgttttgtaactttatttttgcacttattattgtactgtactcttgcatgactattatgcttcaatttttgtagcttaataatagagtttgataattaataatacaagtaccctcttggaagttttatatttatctgcactcaacttttcgttttctaccaaattataaaaacaatattttgaaagcaatttcatgaaactcctaatattatttcagtgaaatctttacaattatgagatttcttatccaaaaacatagtatatctgtagttattgaaacgcctgtcttttatgcctctcataaatgcttgaaattgtcctcaaatatttcctgccaaaattctttgttagctattttccaactgtcttggtccattcaggctgctaaaacaaaatgtcataaactgggtttataaacaacagaaatgtatctgtcacagttgtagaagctggaaaatccaagatcaaggcatcagcagagggcctgtttcctggtttatagatggaatcctgtagctgtgttgtctcatggtggaaggggcaaggtagtgctctgaggcctctttataagggcactaatccgaatcatgaaggctctgccctcatgtcctaatcacctcccaaagccctcgccttttaataccgtcatactggtggattaattttcaacaaatgaatttcaggggaacacaaacattaagaacatagcacacagtattttatactctgacttactattatgaattaccatttttatattttttaactggtgatagctggcacataagaaattcatttttatattaattttataatctaaaatcatttatattccatttcttatccattagtaaagaaatacaatgttgcttactagttcagagcatgggcacagacacagccatgttcaaatcccattgtgccagtttaggatgccacttaacaagctttcctgtccctcacttcccagagattcactgtgctttccataaagtgagcataataatgtcctctgcagcattgccattcaagttaattagtgtatgtaaagtgcttaacacagagcctggcatatagcaagcaaattcagattatcataatatgtgaaataataattttgcctctgtaactataattctctttcatttgggggggaagggagtgcagtgggtagggacaggggtttattgctggagaacttccaaaagtatggtaaatattagagagataccaggctggcacatgacttaactttaaatgccactagtgttttactatacatgtagtattgtacagtattggtgctgacaggtggccttagctctcctgtaaaccactagccactctagaagccaccaaaagtacttatacagcctgagaaaaatcatgtggtgcactgcaaattcaacttaaagacaaatccatttccaactaagtcattccttaagatccccttctacacaaattccagacatcccactcatgttcacaattaaactaagacagtctttctcattttaaagataggtcgtgttcctagcttatgaagaatttccatcaggaatagatgtgaaattgtttcagatgactttttggcaagtatggaagtaatcatgtgatttttcttttctttttttttttttttttttttgtcctttggtctctttatctgatggattatattaatagatatcctaatattaaactcttattacagtcctggaacaagtcctgcttggccatggggattttcttttaataaactcccgggttttgattgccaatgctttattatttttacatccacatacataagggagattgttcgataactgtcacttttgtgttcttggtcagattttatttttaaggctatgccaagtttcagaaaatgaattgggaacatgtccatgaatgtttttattttgtttttgtatttttatgtatggaacattttatggaacccacaaataatactctctttgaatgtttaaaaaaatgccaataatatctaaacctgtcacctatcttaaaacaaaatttgaaaatttttttccattattaaattctattccttttttcctaaattggcttgagtcagatttgttaacttgtattttaccagaaaattatccattttacttaaatcttcataagatctccagatgggttataggaggacagccctgggaacttccttcagtctcgtcccatcttccctctctctggcaggattcccatgaattccatcatgttcataccctcttttatacttctctatttctgtgtaacactgattccttagatctggatttgaaatcagaagcattaagcacaagtgctcacatctccaccttaccaaaagaaaggatcccttgctccctctttcaatctctcactcttacttggttccccttttactgctatagaagttgctctttgatcccactggcaatctgtcctctgcccatctttcaaatattgttcttccccagcattctgtttttcacccgcagcccttctcatgcttcataatctctctgggctaaatcttacttcttatcatttcatccaccagctgaaaactcctaaatctgcatccaacccagacatcactctagtgatcgccagaccaatatatcctgctgccctttggacagtctctgttgatgcccacatcttaaattcaagctaccctcaatggaatttatcattcttgattcagctgtcaccccgtttcttcttctgtgctctctttgttgttaatttgttttttctcatgtgctcttctgctgatgagctcctccatagagaagcatcatccatggtgtcaaccaatccggaaaaccagaagcccttgatgatcctgagcggggcgggctaagcagggaagaagctgtttggcagcaggtagagagaagacaagatgtcttgcagctcccagagcatgcttcatttgtctgaaaatgaaacatatacctgttgcctgtttctaatggccctcatagctgaagttacagccagcatgtttttctcaggtctggaagcaattgaaggactgaggtcagacacaaagaaaggaataaagaaggaagacccagaacaccccaaggctcccaggaatgccactgctcccttgccctccaaactgatatcaggggagtgaaaagcagcaccagagttctgtatgccttgataagatcccacattccctcccctcccctctaacactctgttttatcagaacaaggtgacttggagaccttggaaaagattcccatcacaccactttcccagtgatgtcaatcactagaagcacaaggctgcaaggccccttcctctcatagtttcctctctgaacatatctgtacatctgctaatccagcccatcgtccaacctccctacaggtcgataccctccactctactctctagaattcactttttagcaaaatcttctttatcctcaagttcctctctgatgagtccttcacttcttatgctaatatctagtcctttcctttctttctttttttgagacagggtcttactgtgtcacctaggctggagtgcagtggtacagtcatggctcactgcagcctcagcctcccaggctcaagcaatcctcccacttcagcctcccaagtagttgggactacaggcacatacaatcatgcccagctaatttttatttatttatttatttacttacttatttatttatttagtagagatgaggtctccctatgttgcccagcctagtcttgaactcctaggctcaagcaattctctcacctcagcttcccaaagtgctggaattatagtcatgagccccatgcccggcccctgcagagctttcaggtgatggttgttttttccttcatcatgcctggtggccagagaggcagccttactgctgcctccagtttattgtctctcttcccttaaaactcacagctttaaaatccatgctctcagattcttccatttcctgctgttatcagcagtcacctcccaatcccagggaggtctcatctgctagagccaggcctactctaattcactccagcactattcctgttgtacataatcctttatgatttttcacacactgaagatgactcttccaaataccctgacctcctgagtccttaaacttttctcctcctatgatcttgtcttccaccctcttccatatcagccacccacttccatgagcattcccaagacttcattcaaacaagcattacaccctctctagaatctccctttcaagcttcccactctgtggctaccatctaattctctttagcctttctattccaatagtatttcagccacaccagagcataaaatccattaaatcagtgaatttaccctcctttcattattcctcacccattttaggttcttagattctacttttccttcattgtaattacttctttgcaaacaccctcaactcccttgctcctgtgtccctttgttcagcatcacctagaaaattcaatctacctaaagctcattttccacctactctgaaccggtgcttctggagaaagcagagaacacagatgataaacaaggtaaaaaaaatgcataacattattttaggcagtgataaagctaaatagaagagtacttgtggaatagggtagcataggaagctattttacgtagactgactgctatgggctgaatatgtgtgccctccaaaattatgttgaaactctaatctccaatgtgatagtgtttggacatcagcctttgggagataattaggttatgagggtgaaagcttcatgatgcaattggtggccttataaaaacagacaagagagagcttccttcttctctctgctctccctcatgtgagcgtgtagcagaaagcagccatccatgaaccaggaggaaggccctcagcaggaaattgatcatactggcaccctgatctcagacttccagcttccagagctgtgagaaataaatgttgattgcttaagccacccagtctgtggtattcttattacaacagctcaaactctctaagacagtgaccagaaaaggattctgtgaaaaagtaagttttgtttcagaaaccagaatggagtaagggcatgagttgtgtgaagatctaggggaagagaagaagctggcggtgggggagagatctgagcaaagcctcagaggtggaacaggcttgcatttgtgaagagcagctacaaatcttgggtgcttcttgttgagtaaacaacaggaaaaataacaggaggtgagtacagacacctaaactcacctacggagaggtgagtccagtggctggatcttcattgtccaatatggtagccattaaccacatgtggctagttaagtttatattgaaattaattgaaatttaaaaatcagttccttagtaacactagccatatttcaagtacttggtaagcacatgtggctaggggctactgtattaaacaccacagattagagaacattttcatgattgcacaaggttctagtgtacagtgctggctttgtcctatggacttcattgtctgtgctaaggaatttagatttttatccaagtttgaaagaaaaccactggggaaagccagggaggaggaggatctggacagtacattactcacattttacaaagattactgtggctgctgtatgcagtgggactacagcatagcaagagtaaaagtaagggggccagttagaaagctatggtagtccagattagggagaatctggtagcacatagtggacaatttaagaagtgatataggcccggcacagtggctcacacctgtaatcccagcactttgggaggctgaggcatgtggatcacctgaagtcaggagttagggaccagcctggccaacatggcaaaactctgtatctactaaaaatacaaaaattagccgggtgcggtggtgcacacctgtagtcccagctactcaggaggctgaggcaggagaatcgcttgaacctgggaggcggaggttgcatgccactacactccggcatgggcaacagagtaaaattctgtcaaaaaaaaaaaaggaatatatttgcattatattttagaaataaaatcaacaagagttcctatgaatgtatactgtgaggtgtgagggagagagataactcaggaatgacttttaaaaggttaataggagaatcaaaagatatatagatatatatatatatatatcaaaatattttatgatccaagaagccctgtgcaaatgtaagttggtagcagtcacagtaaccttcaaaaagattggatgtgaacttaatcttatggataactttgcaaagatagaaacaatgtaactgacttgactgaaattgcatactgggaagaaacagacaagaaagttgaagaggtcagatgaaggtcttggaaactgggcacagggatttagatttgaaaggtgaggataagagaagtcactaaggttgtaatagtgaagtgaaagatggattggcatggggagcacctaaagccagggaggtgagtagtccagtctttaaaagatgacagagagcaaatgagaagaaagagaaaagagcagacatgagaggaatttcgatgacaagtagaagtgtctgtttcctcctcagggagccatcttcacagagcctgcacaagaggtggaagttgggatcaggaggtcccttatctggctagagactacttggtcagagtgaatgaccagaatacatgaatagagattctaagatccgagccagaaatgaggagacaaggaaaattccaatggtggggtgagaaccaacagagcaaaaggggctaatgttagcagttagaagataagaagcaggatggaatgaggtacaaacaaagtcatcaagaattaaaagtgttagtctcactgcttatggaagctcttctcttctatgttgcttggtccatgtaggttatcagtcaaccttcagtcatagggactgactgtcagtcccagtaatctacatttaaatctcctcatgtagcaagaagatagcagcaagggccagaatcatccaacaagaaaacacattgatttttggcttctataagcatctctccacaaagtttaaaaaaaaaaaacaaaggtgagagtcaagtagaaagacattggattagaataatttacttcagtcctagagtctttctggtacataatatttacctctgcgatagagaaaactctctggtcatagttttcatcatagaaatttatttcctcctcctccagttaatcttattctaaaaacacaatgggagccccaccctggaattcaacaagcttagagattttcatattgatttctttttttatattttgttttagcagatattgaaccaaagttttatcaggcagagtatacatgacttagatatacatatgaaaaattaattataaattggatctctgtttattgaacaatatttttctactagtttcattaaaaaatttgagatgaagtttcttggaaaaataatattataaaaaataataaaaatcacaggatacaaatgcaataaatcttttacatcagatttatggttgaaaaatgctagggataattttctgataacacattattactactatacaaagttagtcactacttttttccagagttccatattttaggggaaattagtgctttccatctcacagaagtacagggatgcttcattggaatgctcaggaaaggagtcatccgggagaatcaagccatactaataatggggggcaagaaaatgttccaagcatttttcctgttgataattttgcttgtaaatctttctggcttacatttccctgcttttaaaagcagaatataccaaatgtaatttcattcccatataataacagcgttgcaaatgctttgtaaatttcaaagcaattttatcgtttttataatttccttctcctagttactcagaatcactcttctgaatgccagttattgaacttattatatgtagggtagttttttcctcgcactaatgactctatactgctgttctctcctagttcttgtgtctgattcttacattttactatctcctcccacacagagtctatccctctctctagtctactctaaggcttctaatttgcttctgctaatttgcgtttgtagtggaaaataaatcaccaaactagttggagttttttgttcctcaaaacaaaatggacactgagcctaatggactatcagaaaagtaaacacggttttgtcttttagtgttttgtgttttgtttttgttttttatttagtgattaatctggtagttcagactttttgtttatattttctgattcttggttatgtttcctataagtctttttgtcagatactgagttcctgatagatttgaaatttcttaactcttgtttagaagacaaatcaattaagctaaagttgctggtactgacttatttaattaatacatttttgctggttgcttaatgtgttgatcagtttactggtcattattttcgatggatctgaccttctaattaacattgaagaaataaattctcaaatataagatttcattattgtaaatatctgagtggatctttttaagctgccatattgggcactatctcttctattcagttatatatactgtaagtgaaaatgatcaaaataaatgtgtcatgaatatgttgcatgagaccaaaaaaatagcaaaagaagaaaaatccagtttacaaaaataaagcatacagtttatgcttcttcccatgaatacaagaaagaacatgatgtaaaatcaagaggcctcatgtcagaccaccactcagactactgaagcctccaaattgtgcagatatttaatcattgtgaaaaatcttccttccaggaggaataacttcaatccactttggatcacccaagtgctcttagaatttcaaggattttatgagcttgtctgaaaaagcaatataagttgtttcatatgttatttctttgttcgttcttgtggttaggattattttggcaaagtttatttcatagattgccgataggatgacttttgcatgcagcaggcagcaaaaaaaaaaaaacctaagctcaatttgtaatacattatagtgttgatgatgggagatatttaaaacttgtgtctgaggagccaagagcaaaatgccaagccatctagctccatggcaggatctttcctggctctcaattggaccttcactggtaagtttgtccatagcctggttggacagctaaatgaagagcctgaatctagctctctgagcccgtgcatctggttcccagactctgggcagcagctgtgaaacagaaggaagctcatgaagagagcagcaatttgacctcatcccctgatggtcagactaaaatgttacctgccagtttatgagctttgtagtaagactattttactgccatctatgaaggtatgttaaaaaagaaagaaagaaagaaagaaagcaagaaagaaagaaagaaagaaagaaagaaagaaagaaagaaagaaagaaaagaaagagagaaagaaagaaagagaggtaaagagaaagagagagggaaggaaggaaggaaggaaggaaggaaggaaggaaggaaggaaggaaggaaggaaggaaggagggaaggaagaaaggaaggagggaaggaagagaaaaagaaagagagagaaagaaagaaagagaggtaaagagaaagagagagggaaggaaggaaggaaggaaggaaggaaggaaggaaggaagaaaggaaggagggaaggaagagaaaaagagagagaaagaaagaaagaaagagaaagaaaggaaggaaggaaggaaagaaagaaagaaagaaaagaaagaaagaaagaaagagagaaagaaagaaaagagagaaggaagggagggagggaagaaaacagtcacccatcagatcatatcatctgacttgaaggagcctccttctgacatacaggttgctgttgctgtggaaggtattgagttcagattttctatcatcccttattcctcacctctagttgaggtctctaaaaagcagagcctgaggttcagaagcatataattcatggaaggtgtgctgtcaggagaaaaccctaggtaggatacagcaggagagagggctgaacaagaatgtggtctcacgtgaagtcttaccttggcctgacccacatggggtacagagtgcaccagagttgcccctcccttaaggaaatatggcaggactttttttttaactttgtgtcagctagtctttggctctagaaatggaagagggaggggagtacaatctcccaaaggggacagttcccattagttgagggtgattctctaaaggaagagagatctgcctgccaaagccactgggagacagggcaagggccccaacagggagggtctggattgggcacccacagcaccctctacagtgggttcctgtctgtgcctctttagccagagcagtcgtttcccttttccatgctccaatattcggaattttattacaatttttgcttcaaaagaagagtgctgcatttgacaatgggttgatagacacctgacataagtctataagggcttttggccctaggaactgggtggttacccctagcacgacactgagtaacatagcagaaagtgtgaactatagattttcagggagggtgtttcctctcagaaaacaccatttggaggggagggatagcacttggcaagatttcatttggccaatttaaagtgctgagtgatggaggacaggtggcccagctgccctgctctcctaagacagccttagtgatcttgtcccctcatatggccatccttcaatctaaaataactcaatttattaaaaaaccatggctctagggtaacttactcgagaatcttggaaaaatttcaattaaattgactcatatacattcagttttttaaaatggtctcccaactgacactgaagtcatagataaatcaaagcccagatctggagtcaacctggattgtgcctcaaggttaagccagctttgaccagccactgctaattctacgacttaggcagccccaggcaaaatggaggcactcatgtgcaagtgctttggaaaacactgaaggaaattaataaatggaaagaaaggattaaagtacttaaaagggggtgggttgatgccccggtcgaaagaggtacaagcagtaaagtaatagtgagtgacctgtggaagctttcctgctcaagacccagcactaaacactttgctttcaatgtctcatcccctgcgagtttctcagtttcacacaggataagtagttcgttgtcaaattcaggtcacctgactcccaaacctgggctactatgtttcagattcagatagataatagagagataaatggatagatacagagatagaaatatataaatagacacacagcacttgctgctcagctactgtcaaatggtcatttgtccacgtgttatataactattcgagagccttaatggagcattctgaatctcatttcactgaaaatataatgtaaaggaacatttgaaatcatcacagataaccccatgattttagggttgagggaactgaggctcacagagcttgaattattctcgcaataacacacacatactacaagcaaaatccacaagacagaatatttagacctatacgctgggttgggacattctataatgaccttcaagaatgttatagagcagttggctgcaaactgaagtgcatcagaatcacctagagggccaattgaaacacagattattggacttcatccccagagtttctgatctggtaggtactgggagagagctgagattttgcagttctgacaagtttctgctgatgctcgtgctagtaatacagagaccagactttgagcaccactgccatagaagtaaatacctactctgagtgcctgtgatatccatcctatttgtttattgctttgaccataattacgtgcaagtgttctcttgacccaggcttgtctgtagatattcccttcatatgaaagggctccgattatagcctctgtcactccatggatggccagaattaattcatgtagcaaggaggaaagtgccaggaccataatgggttagtccaacctttcatacaccatcccttcttccccagctgtggacttggttaaagaaggcaaaggatgtcggcttcatatggctgagattagctcactgaaacctccctataatgttttgtgtttattttgaaactactcaggagtcaagcctctaaaaatgtacctatgtttacattttggagtcactttttgtggaaaagagtctccattccttctggaaataaaggaacagatggtcagccaggtcatgaaagaggcaaagggaacctcccagctatgcatttccttggcagggatttcacattgaaggacacactcttgttcatccacagcatgagcctgccttttccagtatattcttagagggtttcttatgctcagtaaaatgctcattcttttaaaagtcattaacaaaaaggcaatgagttgctttatttccaaaaccttgcagaaagctaccttaaggacctcgatagaaaataaccagtgtgtcaaattggaactatagttagaaatgctgcagggaacccaaggaagcccgcactggctgctttaggaacttgggtagaaatcacactggaagagctgcagccatagacaggattccccagctgctgtccttgggcacctgggaacctgcttcctccctgtctactagcaagacagaaatatgaattgtttaatgaattgaatcacagaaggcagagccagatatataatttgcggggcccagtgcaaagggaaatcggagctccttgctcaaacattttgaagaaattcaagacagcaatagcaaaaagcactaaaccaaacttggggtccatctaagtgctgggccccatgtacccacacacagatctcatccacgaagcaggtctgcagcatgatcatcatggcacagtttggcagaacaagagaaagggaaggggaaaggggatggacatttcacttggacttgctgtgcaaggtgatttaggtacatcattttatttagtctcatttcacagatgacaaaactatagaggtggaggctgagaaaagtaaagccgcttgcccatggtcacatgcctgatatgtctacactgagattcatttctgactctaagtccctgtttgtttgtttgtttgtttttgttttaaacttttccacattcatattcctgaagcagtattggcttgtaggaaaagctcttacatatgtttttaacttctattccctacaaagccaaagaaagagtgaataatgtaatgaataagataattagaaaatggtccaaatcctggtataatgataataataaaagtagaaacaagacatggaggggaagaagaaggaaggaagggaaaagggaagggaagagcgaggaagaagatggggagaaagagggcggtgaggaagaaggaaggtgagcatgtgctggacagttactacatacgatcttgtatgcattattctgtttaatcatcacaacaaccctctcaaagaagccttggttttgtgcccactctacagatgcagagctagaagcttacagcacttagttaacttgctcaatgctaaaggctcaagatttctgtctaaacaacatctaacattagcctaggaagtcacccaaaatggatttaagggctaggcaagggaacagagtccaagataattctagacttcaaaagttgtaaactgcaagaaaataataataataaacagaaggcagctctatacaggaataataagaaggagtataaatgaaaacattcaaattccagagtaaaagcctccatacattggcatttgtgggagtctccatcctgcctgcttgatcccacccacgtatcctaaagcaaagttggcctgtccgtcttcccacctcagatggattcaggggaattatctactcagagtcttatctgcagaggaaactcattctagctacccatatgatcaagctagttattcacccttaaatatgaacagacaactaaagcataaaccaaaaggaccactgtgcacaaaccaaacagctaacccagagaaataagacgtaacacaaggattatggctagccttgaaaactttctaattgatatcttcagagagattcaagaagtattgtgaccatttcaaaggaactgttttttatttcttttaaaaaggtacaatcaatgcctaggaatgaattttttggaaaaatcagatttctgtctaatttttttgtcagttacaataagtaatttaaaaacaatcaatgcaaggcctgaaaaatagaatgaacaattctgaagactgaatcagataaatgaaagataaagttggaaaatctcccaatacatagaacaaacgacagataattaataaaagaaaggtcttgaaatattgaaagttgacacaggtcaaccagtcagtcatctccactgggaaaaaaacagtttgtttttttttaattctcaattttcttctatttttatttttaattatctcttcacctccattttagtggaaaattttttaatagaaaaaaattttaaaaattcagtagaaaaaaagttatatgttcaaattgaaaggactcaataaggaatgagcaatgaaagtaaaatagaagtgccacacagtaaaagcaaaaaatgtaaaaatgatatgtgaaaaaatgaaaaataaaatggaaagaattctgcatacacaattagtaaaatcatgtgacatttataaactacaaaaatagataaaatccttaatatttccagaaattaagaaacaggtgaccttatcatgatgaaactcagaggggcatcaaactgagagtaaaagtcaagggtgccatggtttcagattctgagcagaaagtctattcattctggaatctggaatccaatactgagtcatttgaatgactctgaaaaaaacaagtcatcaacatgtctcccaaaagagcatagatagaaattaaatcctggataaagcactaacaaagcaattttgcacagtgactctgacttgaaaggtattttatattttatcttgtaacacaactctgtatgctacaagctcaaaatacaaaacacaaattccattaaattcctttacaccaacaatacctatgacacacctatgaatatctctaacaagaaatatgtaggtcctatgtgaaaaaacatgcaagcattatggaaaaacaaataaggagatctaaacaaatggaaaaacatgacatttagatgagaagactcaatattgtaaagatgtcaatcaccctaaataaatatgtaagctcaagttgattccaatcatataccaacaagtcttttttaaaatgcaaattgacaaattcagtctaccattcttctgaggaaattaatggcagattacttaaactttctaaggcacattctcttcccgtgtagtattgggatcataatgaaacctatttcaaagggtaattgtgagaattaaatgagataatacatgcaaagcacttagcacaattaccagctgataatagcacccacaaatcttagtttacatcatattatgctcatgtatataaatactcatatgtatgataatgttcatgcagcagtatttataacagcaaaaattagtaaggcctcaaatttctatcagtatcataattataatgattaagtacaatatactatatcccacagcatggaaaaatattattaaaatttgttatgaatatgcctataatctgacatgaacaaagaaagtcacaaaacaacatgtgtacacattcatgtaaaaaatatataaaaattggtaaatagatgatagatgtttttaaataaaagtaaatatatgttagtaagttcacagaaatgtttctggaattatacgcaccaaactgttaccaattgtttgtgtatagaatacaaagattgatgatattataaattatataatatacagctattatatattctttattataaatgcatctattaggttggtgcaaaagtaattgtagtttttgtcatcactttaaatggcaaaaccacattacttttgtgccatcctaatatattatctgaaaaatttaaaatatcatacgattcttgtttactttaaaactatgaaataggaaaggacagtgttttcaggttgtagttgagcttcaggagatccctgtgccagcagggtcgccctcaatgaagaaggaggcttgcaccaagctgctggcctcaccttggggccacccatgcttaaacccgaatgcaaacccctcagccaccaattctctcttcagctttatctccattcctacctgagcttgctacccctgacttactgtgccacactccccaagtgttccaaccctccaccatgtgctctgaaaccttgagctgtgataatcatgctcccttgtattatgagggtgttcacagcttctctgtctgatgagtcactgaggccaggagttcccgaagacacacagcttcctgcagccctccccagtgaaagcttctcccagcactgtacctccaattttatggtaggaaggtggagaaggatctccttcatcatctagggctgtcgcttggcagttactccatccccagatacacaactgatcgctatttaaagaccctgcatgatctaacccttgcctccccgtcagctccatatatgatatagctaaatccccagccacacatgacagttcagcaactgtgaactactgaatccatcatgtgtttcttgcttccatttctttgcccttctaaccagatctcttctttcttcttttagagacaagagttttgctctgtcatccaggttggagtgcagtaacatgattatagcgcactgcagcctccaaatgcctgggctcaagcaattactgcttcagcctcccaagtagctgggactacaggcgcatgccaccatgcccgactgctttttagtttttattttgtagagatggggtctcactttgttgcccaggatggtcttgaactcctggattcaagcaattctcatgcctcagcctcccaaagttctgggattatacgcatgagccacaacaactagcagatctcttccttctgaccagaagactgtttcgtatttcccctacttcttgccccctctattagcatggtcccagtagtgctttaagacacaactttgatcaggaaacctttctcttcaaccctcagccccctccccacccagcagcctgggttaaatggcctgcttaggtctgcttcgctgcacagactctgagatggagaatcacatgcaggtagtttctgagaggcacttttgggaacaggccctggaagacaccagggaaagtgagaatgggctaagggagatgttaaactgcagtgcagttacagcaaaggccttggtctattgcatgaggagctctgaagctggagtggtccatcagagttgttccaaattggcaaaagagcatggggcctatactctcacatctaccagctgtgcctccaaggaaaggacatggtcttgattgaggctgccccattcactgcgaacctgcagccaacaatgcttcaacagcaagggaataaggctggtgatctgggctgtgcaccacagctcccgctgcgtgaccgttctctgcacttaccagcatgtgttataatgtgtcagtcttccctctagaccagagctgagcaagctacagtctgcaggagaaatccagcccactgcctgttttgtaaataaactttcattgaaacacagccatgttcattcattcacacattgtttatggttattttcatattataatgcagagttgagtagtagtgacagactatgttgacctgaaagcctgaaacagttactggctagcactttacagaaaaagtttaccaactcctgctctattatcttacacaatattcactattgcctggaaattaagttttagaggaataatcaatgaattaatgtatggatgaatgaatcacatggacttgggtttcattcttggctctgccactcaaaaggtatgatcttgggcaaatggattaaccgctctaaattcacgttcctcatcaacaaaatgagacctattacttcctttctagggttgtagtaaacattaaatggaaaagcgtatgtagactaatagcacattacctggcacatactatatgttcacttaagtgggagccagtaggtctattcaaaaagttatgttttactttaaggctgaaaaaggctgaattatgtccgtcttccctttatgagtaggccagatgttagtagtgcttgtcttatcaaaacaaaacaagaaacaaacaaaccaaaaaaaaatagataaacctttagcacctgccagaaacacaaggcctttcctgctgcgtaaatatgacagacaatcctggtggatctcagaggtatcatgctttatatttctggcccagatcctaattaattggtagaagccagatcccataaatgagaagtgccaaaatttaaggatgatgactaatttgtcatagccattcagaattccatttcattagcaggtagagccatgctttgggccagccccagaagattgtctccaaagcaagatttccagaggcaccagtcactgcacatttgatggggcttttaatgcttttatatgagccactttgttaatgacattgtatttagctaaggtaacactagacgctattaacctccaaagttcagtggtttagcacaaagaagaagtttatttctcattcatccaacagtccaaagtgggtgtattaattttctattgccatataacaaaaacaccaccaatttagcagcttaaagcaacacaaagttgttatctcacagtttttgtttgttacaagtctgggtataggttagctggattctcccttagtatcttatgaggtgggaattgaggtgtcaggatttcaatctcatctgaggcttggagtcctcttccaagttcactgcttgttggaagaattcacttccttgcagctgtatgtctgaggtcccagttttcatgttaaccacagtccaggaatgtgctcagtaactagaggccactgtaggcccttgccacatggcccccctcctctcacaacctagaagcttacttcttcaaggacaacaggatagtctcactccagtcagccagggtggactcttgtatacaataacaacgtagcaatcatcacagtgactatcccatcacttttcccatacgatgtaagctaatcaagggagttactatcccatcctctccataggccctgcccacactttaggggaggggactatgtactcctgctcccttaagtctttgttgtcttcttcctcctcttcttatacccttctttctgctcatctcctcctactcctaccactagcccagttattgtcattctccaccaggggtctctgtatgtttaggagaccctattgtttgcctaccccaaagccacttattcctctttttcctttctaataaaatgctagtattgctctgatatccactctactccatattaccatattctcagtccaaacatcaaagatgcaaatcctgattggtttaagcaatcatggttgttacaattctggccgatgagacctgaaggaaatctaatggtgaggctcctggaaaaggttttctagactgattagaacacatacaagagaaaatgccatcattcttctgcttctgaatagttgcaaacaggcagccattgtttgaccatgagagaagccagatttaaggctggaatgaggaaggcaaagtaaaagaatggagagaacctgagtccttagtgatgtcattctgctgctgaactaactgtccctagagtctctctgcattaagacctcttgttgtatcaaacaatattgtttagaccaggttgaaacttggtttcatatacctccagttgtaaacacctaaatgattgggtggatggtgtatcaatttttaattgtgataccctccacagagcacagcaaaattatgcaaaatattgtggtacccttacttcacataatatagtgggaaacattaatgatgatgatgataatgataacaccagcaacaaagtagacagaagctgcctctggtaaaggattgaagtcaaggtcacaaacatgaaatttgcaaaatcaattgcccctgattttcctgaacagcatctagaagtatataaacgtgggtttgacatattttctatagtcttccagatttagcattatccagtttgaaaacacagagtaagtgtgccagtgacagacttgagagaagctgttaatgagttgatattaaaagcttgattgaatgcccctttccaatccaaatcagtggagcagagtagtccaaatcagaattttgttgatttatgcttaacaaggttgtaaggaggtaaatagaattcatgctcaggctccattagcattgggtcaacagtcgatattcccaatataaaaatgcattctcagtgaggtttgcttgttttcgttgttgttttatttttgccataaccatgcatcccagccctatggatgacgtgaactgagtggttcttgacccagaaaaccaaatgaactcttgaggaatcatgtccatcaaaagtttagttggcctgtagtgctgagagcaacacaaatgattctgcacagtgacactgacttgaagatatcttgtatccactccatccatccacgtgcatcttggggaaaaatagaggaggcaagtcatgcattaaattatcaaggtaatatatttcaggtaagtggctccataaagccaaacagaatgaacattctactggcagtgtctagagaaatccgtcagccttatatttctatttatgtaaatccaataaacagatgagggaaagctagggcattttgcagaccttgagaggagatttgttcatgttcatcaagtcatattgcttggaataggttagcagtaggtctctacaagaatggagtttttattttcttttaaaggtgtatggaaatgagaatctaagccaaagatcatctggagtggcctatttttagagaaagtgatttgctgaatttgtcattcatcccactgtgagccatggcaggcatcagtagtaacagccagctcttacaagaaaaatctttccattcttgaaaagcattaaaaagaaatgttatcattacaaaggcaggtgagacaggaagtgagggaataagaaaatgtaacgcattttctgtgtatttgtgtacatattactatatatatagatttactagtgtgtgttcgcctgctcatatgcttatcagtgcacgagtgttaagttatgtgtttcgtgggtatgtgtgtctatatcccatgctctgtgaatgtaagtaataatagctaactaatgtttattgggttgatactgtgcctagactctgtgctaagagctttatgaggattctttctttaaattatctcaacagcctacgttttccattcaacaaagaggctaatagaactattagaatcagaaccaaaatttggatcccagcagcttgaccattttgggcaaacagctccccagggcccactgccattgatcaggttgccgtgctacatgctgactgtatttatatgcgtgtttggatattttctgtttgttttggagaaaagcttaaaggatatccgttctttttgctgtctatattaaataagtacatttactcaggctgagacaattaaccaaacacacacacccatattcttggtaacatattgatgtattcagcagcaaattgaaattgaaaaactaacatctgagggtgtttgtaattcctgattgatctttgtctttatcttcaaatattatatgtctcataatccacttagttcaatctggtgccttgccatctggcctctggctcatacaatcagtttgtgtgatgtttgggactatacatttacgggatttgaactctctttataccagatcttcacatggatgtctaatagtcaacacaaagttaacccataaaaagcaactgcccaatatctatccccttcatgtatcagacatgcttcttcacactgtctatcatctaagtaaatggccactccctccaatggcaactatagaaaccaaaaaacctggactcatccttggctactctcttttcctcaaaccccacatccaacccactaagaaatcctgtagactacaacttcaaaatatttccagaacataccacttcttaccatgtccactgccatacccctggcctaagccatcttctgtctatagaaatgctggttctttctataagtcataagtcagtacaaatctttttaatagtcaggtctcttagagtcaagtaatgatgttctataacactgagaataaatctagagtccttatcaagaatctgcatatgtaactttatctgtatcttctgcctcctcctctccctctcctagtctgctccagtcattgaagctcaactccttgatgttcctcaaacacacagaatatatttgcatctcagcttgagaaaatgaccaggatcaaagagtgctggtgggagaagttccaaactgactcttaaaagaagtgctcaggaaaggcagggagtattttgccaacaaattgcaccataggaattaagaccatagcatctaagcccaggagagactgttcttccatgatgaggtcttcaagagacaatgatgagaggtccccaggttgtaggtcccctaatggagattagaccaagggttgtaggctgtgaaggcagcacatatgtcctgtcatgagacaatatgagtgggtcacgagcatggcttttgaggtcttaggaaacctaaattcctgactccaccacttcctatcagcatgtaactgggggcagtcacttggcctttctgagtctcagtctcctgatatttcaaaattttgcagatttaacttctcacaataatattttggatttatcaaaaatctacatatgcccatgggagtatagcatatatgtgctataccagttaaatatattaactgtacaagttaaagataattttgactaaaagtaacagacagaaaaacctaacttacaataatttaagcaaatatgggtctgtttttcttacatagcaagaagtctggaggtgggaagtggctgtcttagttcaactactcagcaaagtcatgaagatcttcctttgctcagccaccttgtctggttggtttatgtactcttgcttattgcattgaaatggcaggagggctgctgtagcttttgacattacgcctatgttctggacaagaaggaaagaaagaaagggagggacaatcatgttctctcttttattaggaaagcaaaactctcgagaaatctacattggatgtacatttcattggccaaaactgtcacatggccatttctagctgtaaggaaagctggatacattgctgttccaagaaaaatagaggttttttttttaaagggaaagagaagtaggaattggaaattgggtatacaactaaaagagtctgcagtgggaggaaagaaagcctttcgggggaaaaaaagactgagaactgctttaagaaacatacaaagtgccaaagatattcttctacattgtcatttgtcagttttattctttcacatttagatttttaattcaactgtaaatttctgtgtggcatgaagagacaaaggaatccaattatcctaaaccattcttatactcacaaaattctacacacactcactcacctgtttcagggctctatgtttgattcaattccattgatatatatggttttacctaaaatattacgtatttttttaattcctatggttttgcagtatgtcttaaaatctggttgggatatcactatctttgctcctctttctaaatagacttaatccaatctacaaggaatttacaaatttggggtggtgaggcatacatttcgttatgtacccagtagtcattcaggagcaggttgttcagtttccatgtagttgagcagttttgagtgagtttcttaatcctgagttctagtttgattgcactgtggtctgagagacagtttgttataatttctgttcttttacatttgctgaggagtgctttacttccaactatgtggtcaattttggaataggtgcagtgtggtgctgagacgaatgtatattctgttgatttggggtggacggttctatagatgtctattaggtccacttggtgcagagctgagttcaattcctggatatccttgttaactttctgtctcattgatctgtctaatgttgacagtgaggtgttaagtctcccattattattgtgtgggagtctaggtctctttgtaggtctctaaggacttactttatgaatctgggtgttcctgtattgggtgcatatatatttaggatagttagctcttgctgttgaattgatccctttaccattatgtaatggccttctttgtctcttttgatctttgttggtttaaagtctgttttatcagagactaggattacaacccctgcttttttttgttttccatttgcttggtagatcttcctgcatccttttattttgagcctatgtatgtctctgcatgtgagatgggtttcccgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcattagttgatgcagtttcttcctagcatcaatagtctttacaatttggcatgcttttgcagtggctggtaccagttgctcctttccatgtttaatgcttccttcaggagctcttttagggcagggctggtggtgacaaaatctctcagcatttgcttgtctgtaaaggattttatttctttttcacttatgaagcttagtttgactggatatgaaattctgggttgaaaattcttttctttaagaatgttgaatattggcccccactctcttctggcttgtagagtttctgccaggagatcagctgttagtctgatgggctaccctttgtgggtaacccgacctttctctctggctgcccttaacattttttccttcatttcaactttggtaaatctgacaattatgtgtcttggagtttctcttctcaaggagtatctttgtggcattctctgtatttcctgaatttgaatgttgacctgccttgctaggttggggaagttctcctggataatatcctgcagagtgttttccaactgggttcaattctccccatcactttcaggtacaccaatcagacgtagatttggtcttttcacatagtcccatatttctcggaggatttgtttgtttctttttattcttttttctctaaacttatcttctcgcttcatttcattcatttgatcttccatcactgataccctttcttccagttgatcgaatgggctactgaagcttgtgcatgcatcacgtagttctcgtgccatggttttcagctccatcaggtcctttaaggactcctctgcattggttattctagttagccattcatctaatcttttttcaaggtttttaacttctttgcgatgggttcgaactttctcctttagctcggagaagtttgatcgtctgaagccctcttctctcaactcgtcattctctgtccagctttgttctgttgctggtaaggagctgcgttcctttggaggaggagaggtgctctgatttttagaattttcagtttttctgttctgttttttccccatctttgtggttttatctacctttggtctttgatgatggtgacatacagatggggctttggagtggatgtcctttctgtttgttagttttccttttaacactcaggaccctcagctgcaggtctgttggagtttgctagaggtccactccagaccctgtttgcctaggtatcagcagtggaggctgcagaacagcgaatattgctgaacagcaaatgttgctgtctgatcattcctctggaggtttcatctcacaggggtgcccagccgtgtgaggtgtcagtctgcccctactggggagtgcctcccagataggctactcggtgatcagggacccacttgaggaggcagtctgtcggttctcggatctcaagctgcgtactgggagaaccactactctcttcaaagctgtcagacagggacatttaagtctgcagaggtttctgctgcctttttttcagctatgccctgcccccagaggtggagtctacagaggcaggcaggcctccttgagctgcggtgggctccacccattccagcttcccagccactatgtttacctactcaagcctcagcaatggcaggcgcccctcccccagcctcgttgccaccttgcagttcaatctcagactgctgtgctagcaatgagcaaggctccgtgggcgtgggatataatctcctggtgtgctgtttgctaagaccattggaaaagcacagtattggggtgggagtgacccagttttccaggtgccatctgtcacagctttgcttggctatgaaagggaattccctgaccccctgcttcggctcaccgttggtgcactgcacccactgtccggcacccactgtctgacaagccccagtgagaggaacccggtacctcagttggaaatgcagaaatcacccatcttctgcgtcgctcacgttgggagctgtagattggagctgttcctatttggccatcttggaaccgccctagatatttaactcaactgtaaatttgtgtgtgacacaaggagaagaaggaatccaatttgtcctaaaccattctgatattcacaaaattctacatgcactcacccatctgtttcggagttctatgtttacattcaattccattgatatatatggttgtatatggtattttataaatatctatttattaaaaataagtatcatgtatttttaacattcttgtggctttctagtatgtcttaaaatctagttgggctattactctctttgctcctctttctaaataggacgttggctctttattctggttcctttattctgtaatataatttttattgcagatgttaatttgttcagtatcctttgggaattacttttaatttttatagtaacttggaaagaattgacttactaaaaatgttagtcaggccaagcatggtggctcatgcctataatcttagctactctggaagctggtgtgggaggatcacttgagcccaggacttcaagaccagcctgggaaacatagtgagacatggtatctccaaaatttttcttaaaattagccaaccatggtggcacatgcctgtagtcccagctacttaggaggctgaggtgggaggattgcttgagcccatgagtttgaggcttcagtgagccatgagcttgccactgcactctggtatatcattcataaacatggtataccttcctattattcaggtctctttatatacactttaataaaacattttaatcatctgcacaaagttatccttgctgctattcagtccttctcttgggctctttatatcaagtcttgtattttttatgcccatcatctccagtcggttccctgtgaaagattgcttattcttgcatcatgcctctgacattgccccttaattctttaggatatgtattatgcatatattaagtttatattctattctggcccaatcattgtcttctctatgccatgttattttttcctgagggctatattcccctgggagtatttgctgccttggctggtaatttgtatgtggtcagggaagcaaaagcacaagccattgagcatgtcccttgctcttatttgaggagtgagtaatgcaccaaagagcaggcttcctctggtactgttacctggattcaaccactccctgtttataacccccatcacccaaccaagtaatgctgcttttcaggaaacttccctgcattttcacattaggcacttttttttggccagggagaactttggggcaggtctttggcctactcctgatatatctgccccccatggcaccaggcatccaaagattctctgcggccccacagcctccagtgtgccccaaactggcattgctgcataaatgctctgcatggacaagagtgtaggaggcaatgaacttcctaaagccatgtaggagagggaagggccctccttaaaacatgataccctgtgtatgccatggtgctcagctctcttctaagtttaagatgtttttcccatataaatggaacccaaaggcctagtagtgtctctcttttcctgtgtccttggagccttcaaccttcttcctgtctatgtagcacatccaggaatggattcaggggaatcagcatagtttatgttcactcttcttacagtccagtgtacttatacacacacaaacactcacacaaacacacacacacgtatataaatttttctattgtttgctttacggtttacagccagagttctcagaacaatgtaaataatagtctttgttcctagaataaaccctatttgaccacagaatataattgaaaaacatatttatttggtttcctagtattttacttaaagtttctctttgtatttagaaaggaaattggtttgtagaatgtggatgtttctatatttctgttcacattctcttcaccgggttccagcaagggaatagtataggtttgaaaaaagatgaattggatctatgctatgggacagattatgtattatagaatttatgtgttccttaacattttggagaaacttgcccataaaaaaccagtccagccattcctttgcagataattatttaaaaatcattttccatattttctttgatgtttaagctaatcagctattctttcatttttaaattaattttagcaatttacattttcctagagaggttattttttaaggccaaatattcaagtatatgagtgaaggttctcaaatcatttgcatttgtggttataccacctttcttattctaaattttgttttagtgggatattttcttttcctattgattagactaagtaaatttttctattttaacatttttttcaataaactagttctttgatttatctattttatgatttttcggtatctctcctgatttcttaggccttcctttgtttttctttttataattttttagttgcttcttgcttcatcaatatgcactatttcctttgtaacaatgaactctttaatggctttgaagttactcttaaatacaactatgattgtatctcttaaagtttttacacttattattttcataactattttttaataccctgaaacagaagaggatgtgtgtgtgcatgcatacatgctaatgagaggtgaggattaatttccagttgtttaggtgttttaatgtttgcctttgggttattaaatgattccacagttctgtgctaatagaatgtggcttgtttaatcatctattctgaggaactcattgagaattcctttgtggtttctcataaggtaatttttggtgagtgtttcctaggcacttgaaaataaaatttatttactgaagtgtaaaaatcttaatactctcgattaaatcaatattataagttcaattgttcatatattttatactttcttttacagtgtgagattaaccatggattgaaggatatcaaagtattttactactgattcatttctttctatttcttcttatagtttaaaatatttatctttgacctgatgtggtggctcacgcctgtaatcccagcactttgggaggccgaggcgggcagatcacctgaggtcgggagatggaggccaccctgaccaacatggagaaaccctgtctctactaaaaatacaaaattagccagacatggtggtgcatgcctgtactcccagctacccgggaggctgaggcaggagaatggcttgaacctgagaggcggaggttgcagtgagccgagatcgcgccattgcactccagcctgggcaacgagagtgaaactccgactcaaaaaaaaaaaaaaaaagaaattatcttcaatagtctaatgtcatgttatttggtgcacaataacataattgtttaaacttcattttggattgtaccattcaccactaagtttgactctgtctcactaacttcttttaacttaaattcaattctatctaatattaatactgcaaagccctcctctttctcagcatttgtcattctccttcctaattctcttatttgttctttaggagttattttggctttagtgtggctctttgaaactgcattgtaaatttatttaattggaacataacccattaacgtttactatgcagaggcaaagggaaaaacctctccttcaccccctaaaggttcactgaaaaatcaacacacaaaaggcaaatgagtagaagaaatggcatacaaatttgttagtgtgtgtgtgggagaatcacagagtgattgtaccaccacacaatggggtaaagatggttatacacccttcttcttaggagaaagggagatgaggaagtgtggatgacataagggggcagcacatgatttttaggggaattcaacgggcttgaagaacatacaatggcctgacagaaagttttttggaccaccctcagagcagacaatggtttataacaaaagtctgttcaggtcagggaagaagaactgttttcttctttggcaggtccagactttaggcagataagaggacttcagaaaacaacctcatcctgtgctttggaaaacacagaggattgagagacaggagcaggggaaggcccgagacaccataaggctgcttcttcagctcagcctgtcaaagcaccatatttggggcataggtttctgtgccccaacaactgccatatgtttgattttgcctctgtcattttattttctatttctggagattatcatactccttgctatttttttgctttctttttaaattattctttgccatatgaacttttttcctgataaactgaagacaatctaatttgtaaaatatactaatggctacttttaaaattctatttaacactattgtaactatgtacctctacagtattagttagcactgagaatagaataacacatccttttcctcttctatcctaagtaagaataatgataggacctaccagatagtgtggatcagaagattaaaagaactgtaaagttctatgaactgtatctggcacatagaaagactcaaatgctagtgtaactgataccattgctgtagtcattgttactttttctccatataaaatgagcaaattcacataacctgacttcctttttcagtcccttgcttttctaatagtaagcattttcaccaggggtccccaacccctgggccacggactagtaccggtctgtagcctgttaggaaccgggctacacagcaggaggtgagtggcgggctagtgagcattaccgcctgagctctgcctcctgctagatcagcagtggcattagattctcaaaggagcacaaaccgtattgtgaactgtgcatgcgaggacgctaggttgtgcactccttatgagaatctaatacctgataatctgaggtggaacactttcatcctcaaaccatcccccctctacctcaatccacggaaaaactgtcttccatgaaactggtccctggtgccaaaaagactggggactgtttccctataccacttgtgttttgttactacaatttttggtacttttgtgattgttaaaacctttctaaacaatatgtcatctgtttcattaagtatttgtgatgagttaattttctttgtaaactatatctatactagtcattttaactcagccatgtttaaattattccaagcacaagtatttttgtgcctcatatttcccatatttcccaatgcttttgttttctctgatcataaatggtaatttgtctgctttaaaaatatgtaggttataactttgtcttacattgtttcatattgtggaagggaaatttgaagagatctaagatttctttctttgtagtttacccattttcctgtctatatgctttgatatccctccttccttttttcctctctgattctggaagtaatattataattcagttccacttattttttaaaagtagttttcttattacctccacaatgagtacattaactacattttcacatacagaaaacttggatacattcaactgtttacaagacatgcctccatatgtctacattcatgtgaagaatatgaacttatttaattgtatatatttgtaactcttacatattgtaccttttaaaataactaacatgtaacatgcttatttcctaaataatcatctatgattatttaaggtgaggagagtctcttttgaagaattacaatagttgtagtcatactatgagaattcaataatttttggtactgtaaacttctgacaggatactttaacatgctggtaggaaaagagatgtctcttttcaccacacgacctgacacatgatgattcccccaccgacagatttgggtcttctttcttcatttaacccagaagctctctcttatcttgtttttgaacagtgcttatgccatagtcattctgaagtcttcttcgggatccaattattcatttatatcttcctgaatttctttaatgattttcaacttattgtacctttactgtgcattccatgaaagcttcccaaacatacccacacataaccagattacctttctgcagacagtctcactttcacctttcctactgtttcaaattttactatgccattatattactggttgctacaaattctttcctgaactcttcaagacccctacttttctaatctagtttggtcatctcagctttcataccttattttgaagattatgtttattcatatttattgagagaaaaaaagtagagagtatataaaatttactttttattccaatagtaagcattttcatagttatgttcctctttactacctgagtgttatgatcctgacttcattttatgtttcagaagttttcactggcactagagcattgattgctttttatgttaatttatttctaaatgaaaaaagagtttcccaagatctacactttgtgcctaaatatagtgagaaaagtctcctatgatgactttagtattcatatggatgttttaagagtcatgttattcttgatcttactttccaggtctaggaaaaaaattttttaatcaaaattaaaaaataaatttcaaaggagtcatattattttttaagctataagagatgtcagtgtaagtacatatcaccagttgggtgatgaaacaacctcagagatcaaaagaataagcaaattataagccttcaataaatgctggccattgtcagccttagcatcaccattaataaatataacttcataaaaattttattataaactcatccactaaacatattcaatgactaatgtcaaagatgaatgacaaacagaaaaatattccacaaaatgacaattttttaataaatatgtaaaacatttacgtatataaaaatatctataacctactacaaaaaatgattatgttttgagcattagtctctgccaacagaggccacataaacttatttataaacatataaaaacatatttagccccactgataagaaattaaaagtttttttaagttgctgtgtcatttttacctatgtaatcagcaaatattttaaaaattaattgtaacaagcactagttaaggtatatcaaaaaagacactccttataccagccaatggtatttgtgtatgcaaatatgtaggtacaaaatgttcattccagtattgtttgtaatagaaaatatactagtgagggaaaggataagctgctataacaaagaaaccaaatgaatgttcactggctcaaaaaatatagatatttattcctctctcacataggtttcaaggcaaactgtttaggttagcaaaaggagtagttgtactccttttggttatctgaagacccaagataccgttcatctgtttccctgggacatctcataatctccatggttgaatggggtctccaccatagccatagtgcagccagtgtgaaaaaggaagagagaatgaagtaggcatatacacaggcttaaggccgaatttcagaagtgatacacagcatttcactgtattccattagcaaaaacacagtcttgtttctgcctttatcagccagaagcttagaaacatataatctaaccacataccgaggaagaaaattaaaatggattttggtgaagaactacaggtctctgccttaagaaaatggaataattaattattctgctgcctccattcaatgaaatattaggcttcaataagaaataaattaaatctcccgtgctactagatacatataataaaaagatccccagtatatattatgaaatgtaaaatcatgatacagaaaaatatacattgtatattagatgcgtgttttttaaaagaggcaatctatacacttatacacaggcatacagacagaacagtgctggaagaagaaactattcatagaggttttatcctcagttgaactagagacctgatgtgagaagacttacttttcgataagtttctttttttgtactgtattttgtttaccatgtgtgtatcattattaatattataggatgtaaatatataagtatgagcaaattcttcccttgcttaacacattcagcaattatctgttgctacaagatgttttcaggcttattaacacattatcgagctcttttcctgtcttaggctttgaacttgaagctcccttcctcctcatctttcttcttttgctcataaataatctattgtcctaaaatgtgcctccaaaaatgatgctgccctatattttaatttttttctcacaagactgagtttaatgccatataatgaatataatggatctgttcatgtatcctctccccaaatgagtgaaaacttgaggacaaggggcatgttgttgcttctccttgtccccagcaaaatggatgacaggcagcatgtagctgataagtatttgtggaaatgaaaagatccccccactcacttaatttaacaaacatttatcaagtgactatatggctgctcttttaagtagattctctgttcttcatgtttttttccaatttctctcttttgccctgtgtattttctccgaaaaaaaaaaacaaaactgttctctcttcctctagtatagtttaaaggacacttgttttagagtccagccatgtaaatatcaatcagagagcaatgaagtttattttaataaagaagagaatgcattgatatgaacccttggtttttaatatttctacagatagattgatataaaaatatagatacatacatataggtgtatgtgtagtcatttatatattccctagctctgtccactaagagatctggaatttcagagcccaaaattaatgccaccccagtagcaataagtgcatctagtgcgcagacatctcagtttctaaatgccattccccaataaaactaaccagcttccttgaagaaatagatggttgcaagaacaggacaggaaaaatacaagataagcctggaaaaatcttgtagtgttaaaaagtagggaagtgttcaaaactgactggggaaaggggcatgccaaaaacgatgtaggtaccaactaaaaggagctctgaatgagcaaacctgggacaatttgagcaacaaaataaataatgataatgaggaattgtaacccatagaataaagcaagtatctatcattccatactgatagaaatgaataacttaatgaataaataaataaataaatgaagggtaattatgcaataggattctaataaatacagaatgactaatagaaatagaacaccactattaggcagacagcaggtaataagtttgaaggcaaaaattcattaatggatgatgaaattagagggcaagtatatgataagtacaggatatttgccatctcaaagtctcatagtcacattttgaaatgacgtatgggatgattttttaaaaagtcttatagtcacatgatatttattatgaaggggaaagaggtaactttacagtggagcaacccagaaaatactactttgacccagtgacaaaagttaatcaccagtaatggaagacgttgacatcaggtgtttcctaatatgatgaaccaagaagagcatatcgcttttgtcctagtcttatgaaaaatacataaccttgatataataatcagaaaacatcagacaaacccaacatgaaagataatctagaaaataactggccggtagtcttcaaaaggctcaaggttatgaaaggcaaagtaagactgaccgaggacctgatacagattggaggaaactaaagaaagaacaattcattgcaatatggaatcctggattggatcctggaccagaaaaggataatatgagacaaccaattctgataaggcaaaattctactaagatctgtaaataagctgatagttttatatcagtgttaatttcctggttgtaatcaatttactgtggttatacaaggtgttaagcaggggaagctggatgaaaggtgtgtatgaactctatcctgcaacttttctttatgactaatattattttaaaagaaaatgttagaaaaagaaatattcttggctgggagtggtggctcatccctgtaatcccagcactttgggaggccaacgcaggggggatggcttgagctcaggagtttgaaactaggctgggcaacatggtgagaccctgtctctaccaaaaatacaaaaacgaaatagcaaggaatggtgatgtgtgcttgtggtcccagccactcaggaagctgaggtggcaggatcactggagcccggtggggcagaggttgcagtaagctgagattgtaccactgcactccagcctgagtgacagcaagaccctctctctcaaaaaacaaaaaacaaaacaaaacaaaacaaaacaaaaaaagagtatttcagataatgtattactgggttgctctttcatagataaaaggaatccagagccctcctgaattgaaaaattcagaataattctccaacacctgacagctaatgtttaacatcaatagttttctttttctcacttgatataatctaactctagggtttttcttaattattaggaggaagcaaagtctccctgttcatttggcaaaggaaactgcccttatcttatctcttgctagatagattataaaaatcaaggaaagcatcagatgaggctctaaacagagttgggattgtacttgctgctctaattctccaagcagcctttaaagctgcaagctatttaatcaaaaaccatttactaagttcctataaatctaacatgtagctttagcagtatactgcagtggtttgaaaattaaaagtcaaggattatacacattgtttgaaatacacaaagtattctgcatataaattgttgtcttaatctgttagctacttttttcaagccagagatttttcttaagccaatacaatacagaaaagcagaaccagactagaggaaaggtctccagacgtgacttagaagcttgggttcaagttctaaccccctactaattttaacatcaaattctataacgtatatgaaaacaagtttttaaataaggatagggtcactagtttattaagtgggctgaactcagaaggttaccctcagctattagctttatttttctctcatcacactcttctaacatggttggttggttggaattctgttcatcacctctcgacattttgtgaaggtctcatggctttcattgttggtcataagggtctcatttttaggtattaaaaatccaacccatctaaagcaaaatgtaagtgtgacagctaattcattgcccttcaactcatctccaccaacagcctccttcttgcctcatccacaaacaccccagctaaggcctaacccttgggttgagaacctgtgttgggaaaatgaactgtggtctgttctttcagttagcctccacctttctcacttccaagtccacagggaattttgcaaacaagagctctaggaggtctcaatcatgtcccactctggataaatgatgagcagagcagaactttctccatgcttttggggctattgtgactccatgaagaacactgtgagcctgtgaaacacctcgaccttctttcacatcccaatatgcatcatatatgaattcttgtatgtgaaatctttgcaagttctcctccaaccaggattgccacaggcccctaatgcagtgtcccctctgggccagccttggaaataagtgccagagagctctgagccatttatgtgctttgttctgtctccccaaagtgtctacaggctgcctggcatgctataactgctcaagaatatgtaagatagggacattttcctggaattctctgggagatgctgtggtaagcagttcatctagtagttaagtctacctgggctttagagtcaatcacttctagattcaccagattcacttccagattcactagattctagattcagtctttcagctaatatttattgagcatctaacatgtgccaggctcagtttgagattctgagagacagaagttaatagagcagtgaaaattccctacccttgtggaaactacattctagcttgcaaagcagatattcaacaaagaaacaaataaatgaggatataatataaagaaatcatatacctcctaataatgatgtacccagagggacacagcatcacttctatgatatttctaccaaaaatatgtgtaacctgacagaactgtgaagaaacatcagcaagcccacactgaggaacattctacgagacaattattctgtactctttaaaaatgtcacaaaaaacaatgaaaagctgacactatttcaaattaaatgagaataaaaatacctgaaaactaaaagcaatgcataatcctagattagaccctgaagcagattttttaatgctatgaaaggtgttattagttctgctcaagttctgctctgctcatctcttgtccagagtgggatgtaattgaggccccctagagctcttctttgtaaaatttgagtatgagttgcattaacatgttacattaatgttaatttactatgttgtatttacataaaaatatggttattcttgagagagacagactgaatgaagtttttgggaataagagatcctgatgcttgcagtttattcccaaacagatcagtgatgataacaatagcaatgacaataacaaatcacaataatatctggatgtcagaaagaacaataaaaaacaaatagtccaaaatattaatagttgttgaatctgggtgaaggctataccagcattcatggaactattattgccaattttcaatatgcttacaagtcttcaaaataaaaagttaagaaacaaaatcaaatagtaataagtgctctgaagaggaaatggggatagagcacagggatcggggaagtctcgtgtgaatgacctttgagtagagacctgaaggaagtgagaagtgagaagaccatgggaagggaagagcattacaggaagtcagaacaacaggggtgaaggccctgacgtagcagttttctggtgtgtttgtgatcagcaaggaggccagagggactggtgcagagtgagtgatgaaggagaatggtaagaatgatcagaggtcagatcacggaaaggatattagattttattgtaactacagagaaactatgctaaggttttgagcagagtagtaaaatggtctgacttccatcttaagtaatcactcttggccactttgaaggaagtatggagcatacagcaagaaatagaatatagttaatatattcagttagggagaccttgaggatggcggttgtacaggtgagaccagatgtcagattgggataatgataacagaggtagtatgaagtaggtggattctgcatatattttgaaagtctcattgactaatgtattggctaatggactgaatgtgaagaggaagggagaaattggagtcaaggatgattccaaggtttgaggtctattaactagataaaatgctatgccctttactaacttagagtctgtgaaatgaggaagtaagctggaggactgcttcctagaggccctcaaggacacaccagtcaggaattcaggagcctttctctgtaagaatccaactgtttcatttgaccttttcagatcccactatgaacctctggtccttgtgctgccccagagaacacatgaggggcgccagagcagagagagatattccttatgactgccgatgtgtttctgcacccatctaggccttgtccactgtaggaggagacctgggagtggtggggaacaggttggaacttgctcagagccttcacatttctctctctctgtccataagggctgacatatgtagcatggaagatgcttcctccccttgcatgtccctgggccacctcaagcctatacacttgttttctggattgaacacactcttcggtattgcctggccaccatggtagctcttcagccttgagtatgtgcccccacttctccttgcctcctcggaattgagttgtataactctacctttggtttcaggcctcagggtccacaggaacattgttatctgtttcactctgctccaactccttacactatactggcttgataccttcacgtacccacatggtttcttgaatctagcttaccctgcctgacccaggctgctggaagataagactgcaagaataaattataaaggaaaactggaggtcataacacaggtgaaaagggtcggagtcttggagaggagagatgaatacaggagatatttttaaggaaagggagattagccttggttactggtagaaaatggggttcaagatgagagaagggaggactcaaagagtcttctaggccagaacattgttctaggccagaagattgaagggatgattcatctgtcattttcttcccactaaatttggggaattcaaacatgtaaggcaggcaatccattcattcaattactcaacatagaatgcctatcctatgccaaagcctgtacctgcatgttggagatccaaagatgaaaagaatagtccttgacctcagcgtatagaataagagtatgtagaatgtcagttgtggtgacgtactgctgcaggttatggtagaatgatagggcacctgcatgcatagaatattgagctctatgtggagaagtcagggagagcctgaggcagggcattagaagcaatattggagctgagacttagataatgagcagtaggtctccaggaacatatctgagagaagatgtcccagacaatacagcacggacaagacaatctgcccaggtttccatctttattaaccagtggagcatatgctaaatacatttgcctgtgcaacagtagaaatactacagaaatatcctcagtgcagctctttcttattgcaattgatgttttaggagcacaatatttgcctcagagggcttttatggagcactatattaatttgctagagctgccataacagagtaccacagactgggtggcataaacaacagaaatttattttcttgcagctctagaggctagaagtccaagatcaaggtattggtttcttctggggcctttctccttgccttgtagataatcaccttctcactgtgtcctcacatgatttttcctctgtgtgtccaaatttcctcttcttacaaggacaccagtcagatcggactagggtacaccctaatgacatcattttaaactacctctgcaaaagccctgtctccaaataaaatcatattctgaggtactggggattaaggcatcaacataagaatttgaggagggatacaattcacccggtagcaaatacccactatttgcacggtattatgagaagcagtacttgataaatgaaacctagcatagtactgaatgtaaatccttttgttctgctgtccatcacttaatttctagaactacttgatgtatcaatcagaatctagagagctctatactgtaaaatcctcactgctctcaacagtttttctaccttttagacagccagccagccatcatatttccatcttctctttcattgaccttcctagggcccagcactctctttgttctcgggggaaaacaccagtgtggtccctgggactgtacactttctccccactgtcacacagcaacaggagcagcaactcagaatgcagagtggggagtggccactgccgcccgtgttgggctttatggccatggcatcagacagcttggcatgactcctacctgaggagctggatggctcagaacccatactctcagttgcaacctcagtgccacctgggcaggcaggggctctctctgacaggattccagatctgaggagcgtgctctgaaacttgccatacaatccattataatgcaggtgctaactctctgaactcacttcttcattctccctgaaaaggaggcctcttgcccaaaacatcaatgagcaatgtactaaatttactgaagaatttgaggaggaaaaaaagggagagaggtttataaagcacacttccgtcagtagttctcttactcaaaaatctctgcctccataccaccccagaatttgtttcctccctgctctttctggcacaactccctcatggcagcctcccctcacccccaactccttttctattactgcttgtcatcttgtagttcagatcttacatctgcaaacttcacttcctctcagtattcagtagaaaaaagggctattatttttaaattgagattggtccttggaaccatcttccctagccaggtagctactcaaagtatttcttctgaatatatacagttctgtttcctaagaggaatctttgaatcagctctgaaggtgataacaatcatcctgtattgttacagcggcatccacatgcctcaccagatatggcagaggtgtggtggggattttgagaagtcagagttatgaagtagcccttgagtgccagacaccttgccagatactttagatgctttattttatttaatcctcacaacaaatctgcagggaacctattattactcctattttatggacggggaatttgggactcagagaagttaaataactttcctacactcacactgctggagaccagcagagctgggaagggcagcaaagccattctgaccccaaagtcttcactgtgtctcttcctcaggtatgaaaggctcctctatctctgcacacaaagggagccttaaaacttttgctttaggcctggcgtggtggctcacacctgtaatctcagcacttccggaggccgaggcaggtggatcacctgaggtcaggagttcaagaccagcctggccaacatggtgaaactccgtctctactaaaaatacaaaaattagctgggtatggtagtgggtgcctataatctcagctactcgggaggccgaggcagggcaaatttcttgagcccaggaggcggaggttgcagtgagccaagatcgtgccactgcactccagtctgggtgacagagtgagactccgtctcaaaaaaaaaaaaaaactgtcgctttattaagcatcttaaagcatctcatcttctatggacttcaggcatctttcggacccattttctcaatctataagatttgggcacattatttaacttctttctaccaccctctccttatccataaaatagggacaataatagtactgcctcatagggttagcttgacaatcaaaagataacccgtgtaaagtccttaggatagagcctggtgtataataagagtacaataactacttggtagtaaattaatataattactatgtaccagtcactgtgcttcctgttggaagtggcttcatggtctgcagcagagccccagggcaggaggtaggaagggtgataacatattacacatgctgcatactgggggtcacgtaggagggaccatccagaagcacctgcaaggaggaccaggctagactccacagagaagttaaagttaggtgaaccaggcatgttccagatacaccgaatgagacacagacctcccaggaagaacaaaccaaggcacttaaggtttatgtatcattggaaaactggggcctgctcttagtttatctaggtgcatggggtgcaggaggggatgactagaaataatactggacaggtggatggccgtaatccagcaggaaggatcccatttcccacagtaaggaacctggtataacctagaactgagggatgccatcagagcacttaaacagttgaattatatgttttaacattgattcatacttcaagatttgaaagaatgcctctgactatttcagcctccattgatagctcctgtttctgacatattagagtaggcagtgattaaaacactcaacttcacttgttaatataaatatagggcttgtgtcaccctcagaaagttttatgcattgctatttgtctccagaattagatcttagacttcctaaaagtggagactatttaaagtcttttgtattttctcaccatgctgacttctcagagctggaagggaactttgcagccactgagctcatcctctatatttactggtagaacctaagccaaggagcttgagagacttgcccaagaccacacatttcagcagtggcagagcatgcaatcaatcttatctaataactgttgctttaccaatatagtcattaataactggtttttggagctggctatgacagagccaggtagatgtaagaagaatatttcaacttcgaagttaccatccaaactaaagcaaatcagtacctggaatgtattgtacttaatgtaaaagaaatcaagctgtgagtggggtaaaactgttggtgagaaatttaatcctcatactaaacactacatttctaaagacccccaatgctcactctctgcccattgagttcacatgtaaaatgttagaggtgaatgtggaaagtgctttgacaaactacaccatcagccaaacttggaatagatgaggtgaatctgcatggcggctggagtgtgaagggagctggcttcgagagtcaatgcacgagggctattaggccacaatatgacaggtatttcctcaattcttagatgtcatcatttaatggtttaatatcttctcagaaaaacgaaaatagtgagcatttcaatgctctttattcaatgaacaaggcataactattttagaaaagttaaaaggtaaaaaagaaaaaatgtccatttaaaaatcaaagatgtagaccacatgtgagtagcaaggaggaaacatttgcttgtcaaaggttccctgatgacttcatttcaactcagaagtaaaagccagtgcattattggtacagtgttaaatagccaaggaaatgtctgtatagtggcaactgactttatggttaaatgtcaacgggcaggaaactgagttgatatggtgactgtgcctcctaatttaccgcctgtgtgggcagactctttgcatcagaaccacccctttcccatatagcatggactttagatcctggcagaaatgatcaggggcacactggttaattaacttgatgtgccgctgtggaacagactggtaaatcaatacacctgctattacattcaccttcaggctgcaattctgtgttccagtgctctcatgactcccaatttctgcattccctgactaattgccatataagtagtgttgctcaacctggcaaccacatggattattgctgaaattccagcaggcaccagaaaacaaaacacactaagcagagaaattttactaagagcacatcaagggtgggataccttatgaaagtccatttggctttaagagctttggagacagagagatctgtatgcagatcttcattctgtaacttgctagccatttaactttgggcaagttgccatttttctgttttctcatctgtaaaatgaggaaataacctaaaatgaacactctgagctaccttcccatcctaccacggtacattactctagtccattcaccctcccctgtctctgaaatggttattccacatctccctctttcaactctggacatctcctccctccacctcccactgtctctgactcaggagacagactttttctctttattcactgagaataaagaagcaatcaaaagagaaaagccacatccagccaataccaattccaccaactcttctccatctttctccttatggtggcctgcctcactccaatttaaaggcaacccttcttctcaactacccacggacatggctccagcatgcccctttctctcttatgcatcgtcagatttaatacatgctggagtaagctcctgtatttaaacaaaacatgacagaaaaaaaaaactccctggatgctacatttcccttcagatattgcctcttttcactaatcttctttatagcaaagcttctcaaaacaactgtccatgttcattacctctgctcacttttcttccagccgtcctctcctgaaacctcctcagttaggttttcacactcaccacttcactgaatctactattattaaggtcctccaaagacattcccattaccaaatacaataaccaattcctaaacctctccttacttgacgttattatttaagattcatttcatgcttttggctattctctcttctttgaatcattttcttccctcagcttctaacacactcctctctttgagtcttctccttcctcaccagcctttccttctcaagtccctttgcttgtccttaccaatcttcttgtcctctaaatactggaatgccccagagttctgtcctcagatcacttctcctccatgtctgcacttcactgcctgtgtagtgatttcatctagtctcatggttttaaataccatcaatatgctaattactcccaaggtattactccagcttggacctttccctggaatcccagaatcatatatccagctgcttaactggcagtgccacttgaattccaaataagcatttcaaacttattcaaaactcaactccaaattcagccgtatcttaccataactatacaaggccaagctaaaattacttctgatcaggattatcgcaagagtctcctctcccaacttgtctccctgtttccatcttgccttcctacagtcagtattccacacagctgctagagtgacccttttaaataaaagtcagagcctgtcacttccctgttcaaaaccatcacccttaggataaattccaaagcccatgccatgacctacaaggtccagcaagaagctacccttgacatctctgctctttctctcccccatcgttcttaaccagacgcaccgacctcccagtgcttctcagataccctgcccttgatctcttgttggggccactgcccacaatgctcttctccagcatagctcaaacactcactgcttacttcatgtctctgttccattgtcactggttagagaagccttccttgtcaccttctaatgcccagctctagccttattttcctttgtacctcctctccctgtccaaatttatattatttaccactctgattatctacctataatctatctccacccactagaccttaaaattgacaaatgggacctaattaaactaaagagcttctgcacagcaaaacaaactaccatcagagtgaacaggcaacctacaaaatggaagaaaatttccgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagtgagaatggcgatcattaaaaagtcaggaaacaacaggtgctggagaggatgtggagaaacaggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcggcactattcacaatagcaaagacttggaaccaaccaaaatgtccaacaatgttagactggattaagaaaatgtggcacatatacaccatggaatactatgcagccataaaaaatgatgagttcatgtcctttgtagggacatggatgaaattggaaatcatcattctcagtaaactaccgcaaggacaaaaaaaccaaacaccacatgttctcactcataggtgggaattgaacaatgagaacacatggacacaggaaggggaacatcacactctggggactgttgtggggtggggggaggggggagggatagcattaggagatatacctaatgctaaatgacgagttaatgggttcagcaccccagcatggcacatgtatacatatgtaactaacctgcacattgtgcacatgtaccctaaaacttaaggtataataataatacaataaaaaaataaaaataaaaaaactcacttattaaaagacaaaaaaaaaaccttaaaaggaaggttttaatcctctttttactgccgtagcccccaaatcaaggtctatgcctagctcagagcagtacccatgatattcattgagttattattattattattattattattattattatttagatgagtttgcccgggctggagtgcaatggtgtgatcttggttcactgcaaccttgcctcccaggttcaagcaattctcctgcctcagcctcctgagtagctgggattataggcatgtgccaccacacccagctaattttgtatttttagtagagacagggtttctccatgttggtcaggctggtctcgaactcccaacctcaggtgatccgcccacctccctaagtgctgggatgacaggcgtgagccaccgcacccggcctgattgaattatttaatgaatgaatgataccctatccacaaggttgctaggatgattacatgaagtaaatgatatagagtagtttcaagtacatggtaaggttctgaagaatatctgtttcttttaccattattattataaacaaaatggagctgggccatggcactggtacatggaagctaatcattttgtaacatctgtaacattttgtaacatcagggtttgcttctatttctgcatttcatatgttctcatctggcctctgctcttttagggataattagagaaagcatgttcctttgagttcatgtctggggcttaatttaacttgtaggtatttcttttaagattcccacttgaacaagtcacattaacttccaaaacaaattctccagctctagaggcaggcagggtccgatggcttcatacaatttccaagccacatcccccagagcaagaaaaatgtggcaggtttcctggcatcatacttgaacatcatacataaacttccagggaacacagaacaccacaccacatatgacgaagggtttgaaaggagaagtaaagcacatgagcacaggagggagacaagattggatgtgtgtaagcatcctccccgtcactttccctgtcctggcagcagaggccaagcagtgacatttgatgctttcctttgataaacagggcatgcatgctcttttatcactttttagaaatttgaaatatataaaatgaaagaaatagttccccaaaaagcagatttgctttcctgctccacatcctcactgatggccagaagtattgtcatctccctggaggtgggtgatgactctcctccactcctccatccatcccctaaagacccaccagcagtggaaagagcatggggacggggattggaggaaggcagattcaatttgaaccctggtcttgattcacagaatctgtgtgaccttaggcaagttgcttaaccaccctcagcttccatttctccaggggtaaaattgcatcttcactgaatggttgggaggattaagataggtcgcctggtgaagcacttagctcagctccgtattcctagctccttggttccccacttttgtcccccatcatccaccatccacttatatcctgtggagttctcagagggctctcccacacattatcctctgtgtccttcatgacagggtgggtgttattctgattttgagacatgagtagtcaatttattgaatcatctgaactcagtagggagcaaacagtaaatgattttgatttttctgtgtgatggtgtttactttgataaacctctccctgagttgcacatcccatgacaaaaccttggcagattctttaccttcctgttcattttaatgtattaaatgtccttctaaaataaaactccagtcttacctcctgtgtaagcctcccttcctccagcatcagtccagtttatagcctgaaggacttgaagtgaagagggtctgtactgctcctttgctgcatccaggtcctcacctcaaagtggctcaatctcaatgaatgattgtctcatagccccttctcacttagctttttcagagatgaggtgtcctcttcaaaaccaatgctatgctcccaaggacacaggactcactgccctgtatccatcaagatacactagcttatgcctcagcaacaagcaactccacaataactcagggacacctccttcttcccccttctttgacagttctgactcctctgttagtttgagctgtagggcagagggaaagggacaaaagtcttagctggctcactctttctgacctttctgcaggttgttacagcgtctctggctagccttttctagctgatgttgccctattagcagccctagtggggcttttcagagggctttgcagggcctcttttttgtatggctccctgaagtggacagctggcttcacacaaccacacctgacttcaggagggcaaataagtacaatcccaccacatgcatagcatgcaggagggtggggagaacagcattgtaccagttatctattgctgtgtacacgcaatagatacctaatttaatgacttagaacaccagtcatctttttagttgaagagtgtgtgggttgacaatttgacaaggactcagctggacagtacttctggtccatctagactcccttatgcctgcaggacagcagggtggctctgcttctggactctatcctagagtggcagggaattgactggaccatgtgtctcataatccttcaggctacattgggcagtttggtaggtttctagagggaggacagaagtatgcaaggcctcttaaggcctgggcttggaactgccttaaaattacttctgctgccttctattggttaaatttcagaaatcaacaatattcaaggagtgggaaactaggctccacttttgatagattgagatgcaaattcacattgcaaagtgcctggataagggaaaggggagagaactgcagtctttttgtagtctaccccaaacactaatgaccaccatatcttcctggacttttgaagtggaacttagggggttaagacagaggtggctgggcttggcaaggccatgtaaacttgcctgatatattgtgtagggggagtctgaccacacttatggagacccttattagacaagagtactgagcaccatttgtttctttttctctttttaaattacttttatgattttatttttaattgacataaaataattgtacctatttatggagtacatagtgattttgtaacacatgtaaagtatagtgatcacatcagggtaattagcatatccataacatcaaacatttatcatttttttgtgttgggaacattcaaaagtatcctccttctagctatttgaaactatataatgtattgttgttaactatagttatcctacagtgctatagagcactagaacttattcttcctatctagctgtcattttttagtaaaaaatctctccctatcctcccttctccctgtgcttgccagtctctagtatcctctgttctacttttaacttctacgagatcaactttttttagcttccacatatgagtgagaacatgcagcatttaactttcttttcctggcttattttatttaacataatgtcctcctgtcccatccatgttgccacaaatgacagagtttcattcttttttatggctgaatagtatttcatcatgtacatgtaccatatttcctttatccattcattgtgttgttggacccatagattgactccatatcttggctattgtgaatagtgctacaattaacatgggggtgcagatgtctcctcagtataatgattccctttcctttagataaattcccagcagtgggattgctgaatcacatggtagttctatttgtagcttttagaggaacccccatactgttcttcatagtggttgcactagtttacattcccacaaacaaaatgtctatgagttcccttttctctgcatttgttatttttgtctttttgataacagccattgtaactggagtgagatgatacttcactgtggttttgatttgcatttccctgatgattagtgatgttgaacttttaaaatatatttgtcagccatttgtatgtcttcttttgagaaatgtctgttcagatcattttctcatttttaaattggattgtttggaggtttgtgttttttttgccattgagatgcttgagtttcttgtatattctagatattaatctcctgtctgatgcatattgtgcaaatactttttcccattctataggttgtctcttcactctgtgtcagtggggatagtgccatgcacacagcagatctcacccccacagcctggatctgcatgatccattgatcataagagagactggtccatcattgcattgcagttctagaaactaaaacgatcactttctttcaagaccaagagtttatggagcaaaagtgctgacagcttcttccagtttcctttgctgtgtagaagctttttagtttgatatctgagcatcttttttctgcagctctgggccatacatgtttattccaggcaaaagaaagaactcccatggatattcaattacaaaaagaaaccaccttaaaggtgaagtgacttgttgctgggtgaaaagaaaaactatgtactaaggactagggatgagaaagcagagtaaacaggagagacttttaaaaggccactgtggggatggacagagcaaggtgcaccatggtgcaagctgtcatcagagtccagaatcttccagttcctggagccagaatagaggggtagattaaactcaaacccagtcctgccagaatcttgtgcttttccaaacctgttttggtgcttttttataagtcccagaggcaaaggagaaatggtctagtttgtcatggccaaaacaagagggagggcagcaggaagagcagataaagtcaaaaggataatacaatatgtcctatgtcctacacacacacacacacacacacacacacacacacacacacacacacacacacacacacacacagaggttacttatccatatgcttcagacccaagcagacttgagagttcctggtttgtgtcctgtggatagtttagcgagatggattttgagccagacaatagactcttctgctttgctgtgtgcagagacaagtggctgttaagtgatcataagagagaaaggccagctttacacatgtagcctttgagcccatgagtttgtatacttaatatttccaatgattcaaattcaaaaggcaaattatatcaaaatccaatgtggtgggacacttttacagcacactggtaggactttaaggaggcaggggaggaggagcaggggcagaatcaaaggcaaaataggacctctttctgctcatctggcttagtggcaggggcgggggaaattccctctttactaggcactgccatcaccccacccacacagggacatttatgagcctcctcaagacggagggtgtcagtggggactgtgtagtgcacacagcagaccttacccccacagcctaggtctgcttgatccattgatcgtaagagagactgttctgtcattgcattgcagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtgggtaaggcctcccacccctttctccagatcccagcacccccggaaagctgagtgagagtggtgtgccacgggtccaggtacctacggacagatgctaggcctcagagatttacatgtgggaagatcattcaggagtgctttggggaacaatatttgtgagaaggtaagggaagcagcactgggtagtgggagaagttgggttgtgatatagttgtaatcaggacttcagctgatcccctgtagatccctaaagccctttagcgtgttcttgcattgaggctcgaggtctgggtctttgaacacctgcatcagcctgtcactgtatatgggcaacaagtgagacctggaatgcttgttgcttccccaaaaaaaagccgatgtctgtcatatgtgcatggtcatatcagtgacatccaatatggcctggaagtcagggttctgcagttctccttaccctttgccaaggctcagttaaggggtaggatattcaaaatggtgggcaatattaacccttcttacaatcacacacaaggcttgttcttgttttcagaaaacctttatgtactcatgttctcatggtctagtccctatgactcattttcttcttttaaatggccacatttaggaacagtgcttgtatcggtcaaagatttccaccagaaagttgcctaaaagccaccctaaaaagtagttttaaagtgctgaaaagtttagaagttctttaaaaatggccatgttttactctcactcaggcatcttcagatcagctgagatttggctgatccagactcagctttgttattgcatcttctctctactccttatctcctgctctctccttgaaccagtgggctagtcacatcatgcacttctcatggcgaggacaactgggagcatgcaaagcctcttaaggccttgggccggaggtggcacactgtgacttagtctactggcatttcgttagccgaattaagttatgtggccaaatccatagtcaagacaggggcaaccccctagcccccacctgccgtctctagtagcaaggactgcaagccacctgacaaagggcttggatacagggaggggtggaaaatgggctcaatatgtaatctaccatttaggatgctctctggattactgatctttttttgtttggtagagtctgctaagtcttggcgctcccacccttctacttcacatctccatacggacttaatgcctagcatctgactgtcagcttggggttgctgggccgggggcgatggagggtctcatcacgtctcatgctcaacaatacttcagacacttcagcctctaacttagtttctgtgcctgcctggcttctgaatctgtgtcactttcaatttccacacacatttccaccaggccttttcaaggcagtgttattcataaataacccttaaataggtgatgatgagcctctattttagatctcattgtgatgagtgtgaaaagacagaggatgtgtttttaaaaatgagtaacagaaatgagttcacctctgaggaatgtcatagtcattaccctaaagaggattctaggtacatctcaagtacaacaacaattttgaaagactctattttgaatatcactaaaaaaaatgtcctatgctaaagagagttgcactgcacttttctcttgtcagaaataaatttacattgcagctgccattttatctttataaagaaagaaaaaaaagaatcaacgagtctcactgctcttttcaaggacagaaacaaaataaaccaaatattaggctcctttcaggaaagaacaaaggggtttagaaaggggatatggagcagaagggaaggggagagaaagaaaaggcgggaggaaggaggtgagaagaggaaaagaaatggagatgaagtaggggctggtgtatgctctaacttcctaaaacaataaatagggtattttaattatctgataatggagcacaattgatctgcctctctcgctttcttgacccttcagacatagcattctgtctccatatagattacctaaagatttctttccttcaagccacacgttatcctcatattctagattttagggaaagactacctgctattatccccttagaatgacatcccagaaaagatattaaagctgtttgttttttcctttctactgggaaccaaaggctgtataatgatagccaagaagaatcaaacctcatctgtgcactttccagctgacagatacttctttaaaaataaaatgaacctgacaccctccgtgtacactcacagttcagtttacaaggactcacatttgcgccttcccaacacctgtgccttgaagatggaaaggccacacccttgccataagatccctgatcaataaaagtagaccaggaccccagtctcatccagtgcccatccatttctaattttcttagcttcttattgccagctaggcccttgcccttggacttgatgcctgaaactgctacttaccaggctctcagacctgttgtgttaagcaggcaccgtggcatgccctccagctaacctaaccttgccttcaacacactgctaccctttatgatcatctcttaagctatcccttcccagaaactttggtcacctaagcaagccaaagatgctcaacccagctcttcatggagacatgagagaaataggcagttaggtgtgtctgtcagcttcaatgctgaatgcccctgcctttgagtcaccaggactccatactgagtcttagtctaagagacttctgagctgtctcttgtacttggctagaggaacatacttcctccaccaagcagatccactcttaggccttgacaatcagttaggggtgggagaactcagcttcactgtgtatcacctaaatgtattccatttatggcattctatcttacattgaattaactgtctacaatgactcatttcaggaaagcattaaatctgtgtgataatctgcatctcactgaaatttcaaagacttcaacaagtcaacatgtactattaatataactaactcaatgcatgagtctacttcatcaaataaggagatgtttctaagggactccattctgtttattgccagatatcttgtttcaaaaactatttttaaattaactaaatgtttttaattgaaattcacttagaagacacagcatattaaatggagtcgtatttcctaaacagatatttcgaaaaatgtatttcattgcctaaaatttcaagtttcttcatacagttgctacacaaagaatcattcacttccataacggcatccattgggggaaataataatgacaatgtcttaggaaagcatccctagaagtagggcctgagatggggtgtcttatgaaagggatttgttgtggggagtgccctcagcagaaggagagtcaaagaagcaggagaggcaggctaagtagctaagcaagggtgtggtctcagctggaatctgcttccgactgattccaccgagtggtcctaccttcagacaaaggactagcctttgtacatttctgtccctcagtcattggctatgtctgcccccaggaagtagtgagagtgcagcattccaggcaaggagcatccctcttggccaaggacagctccctggaaaaaaaaggggggcatctgtgagtcattggctgccaacactcacagcactagaatggtaaataagatcaagacaagggtacactatatctgtgaacatactttaatgctacaagatgaagtataaaacactccccactaggaacaaatttaaaatgcagatgaaccttgcaattgctgtacctaaaacattatattgccattataatgaataatatatcatgagaaaatactacattacactgagtcccagaccttcctgctgggctgttgtttgaccattaggttgttttctgacctattctgacctcatcccattgctcaacaaagccataagccattaatcaaaccttgaatggaaaaactatatatatgtatacacaccacacacacacacacacacacacacacacacacacaaagacattgaactaaaaagacaaagcaatgtttgctcatcagtgaagttgtctcttggcaagaaaggccaaagatcaaggggaatattaaaaagtaaatgtcaactctgggcattcttagaatgaaattgaatctctgaggttctgtccatcatttaattgaagttgttttaggaggtgtacagcttgtaaataataaaatacaaatgctctctaaaacttttatttttaatgtttcacatagatcctctcctttgggccatagtgtgtttccattttaaaatgcagcacccagaactcagtagtttgcccagtgcaattattaatctctggtgtccagaactttgctgctactttactactacaggacaaaaaatgcagtgtaatgtctggtccaacagatgcaaatagttcctttctcttctttgcacattcggcccacttgaaagaatcctactaattatggtcacagaattttattttattttattttattttattttactttattttactttattttattttactttatttaactttatttatttatttgagatggagtcttgctctgtcgcccaggctggagtgcaatggtgcaatctcagctcactgcaacctccgtctcctgggttcaagcaattctcctgcctcagcctcccaagtagctgggattacaggcaggtgccactgtccctggctaatttttgtatttttagtagagacggggtttcgcatgttggccaggctggtcttgaactcctgacctcaagtgatctgcccacctcggcctcccacagtgcttgaattacaggcatgagccaccgcacccagcctggtcacggaattttaagtgaaaataagtaaagctggaacatagtcatgctaaggagatggtgacccagcagataaggaatgtttgcaggaggtggcaatgtttggcctggaaaagactttgaaaactgttatcttcaaatagttgaaaagatctcatctggaagaacgtttaaactcacttggagtcccaagtgcaaaatgacagatgatactgtgaggcagagttcaaaacactaaaaagaggagtttcttaaagcagtttcagaagtaagctccactggcacagtagcttgcacctgtaatctcagctactgggaagggtaaggtaagaggatagcttgaggctaggagcttaagaccagcctgggcaaaacagtgaacccccccccccactcccgacccagtctctaaaaaaaaaataaaatgagtaaaattaaatagaataaagttagccaggcatagtagcacacacctgtagtctcagctattcaggaggctaaggcagaaggatcacttgagcccaggagttcgaggctacgatgagctatgatcacaccactgcactccagcctgggcaacggagtgagacttcatctcttaaaaaaaaattaagaaagaagatgtaggctctgtggattagaggaggggataaactatgtgcttggaaaatgctgtctagcctaccccctttggatattcacagcacacattagcattttgaagtcctgccatcctgaaaacaacccaggtgttctcagtggagaacagaggcagtgggacgaatggattgtaactaaggagttctctatcaacagctacttttccgtaattccatttggctgctattgaacacaatttggcgtgtatctccttaatatacataattcagagagaatttctaacactcgcaagggcagattcattaaagagttgttaagacttcaatataaggtccatccagtgttctcacagagattattaattataaatgacacacatgaacatgtggcttgtacacagcacctttcaactaaaaaaagcacaacatacttttaagttagtgtctgctattatttttctgaaattttatgcctgctgccaagtactgtgtattttaagaaatctctcattgaaaattacttaaatgaaacagtaacccacaatccttccagcaaagattgagcaaaaattgatgctggtagacttcaaggaggacgtatcctagagtctcaaacagaaatggaagtgacactctttaggggatactgttgtgctctggagcattgcgtgtcatcttaaaaaatccttgagctgccatcaaaagagaagacaggacaagaggaagtgaggaggcctgctcttgttcccatatttcccactgctctcccacaagtattcacttctccatggaatgtcctaatagtattttctgggcccatttttagccatttggctcttcctactggaacatctgaatgcccttccttcctactctatctttctatcaatccagtcctacatctatcaagacccaactaaaatgctttctgcagttctatggtgatcacttattttctctgaatttccatgttatttacagtgtagactttggtaagctccttgaagacacagccagctctaatttatgtgcctattcccactgaagctacacagcatacacctggcacacagtgattatttttaaaacagtcattagtaaatgggaaaaaaaatagtttgccttcaaataaaaacaacagaaatagaagcaaacttaagcaaaaatagaagaacaacatggaaacattttctgatttttctaaaagtcactcccaagtatatcaaggctccagcctgcccaaaaggcagcctgacacagataccctcttccctcatctgtcatctttctcttgatttctcctttgtgttgcatattttaatgcaaagacacttggtgcacaaaggtcataataaggatatcttcactgtgaattatatccatacccaaataaaatggcatcctatccagagtctcgctctgtcacccaggctggagtgcagtggcacaatcttggctcactgcaacctccaccttccaggttcaagcgattctcctgcctcagcctcccgagcagctgggattacaggtgcccgccaccatgcctggctaacttttatatttttagtagagatgggtttcaccatgttggccaggctggtttcaaactcccaaattcgggtgatccacctacctcggcctcccaaagtcccgggattacaggtgtgagccactgcacccggtcagtggcatctcatcccatttaaagcttctgtcattaattctactttaataataagatttccaccttagtttttttcatgtttgtttgataggcctttatctacatttacactcagccttttttgtcatgttctgtaagtgcttcttttgaaaataaacagaatttgtttttagatttcttttttgcccaacctgaatttttattctcaaacagaagaggatttgcatttcttgccatgagtgaaatatttggctttccttctgtcttatgatttacatgctttctagcttgtgtttccttccattttgtgtgtgtgtactgtgtttcacatgtggtttctgtgttctttctttttaatagcttctcatctttcggcagatatataatatgttcttctactaataattacctctgagagtttcaaaaaacattctttattctacatttctcaaattattaaaaagtaaaaataaatatggtattttgttcccctatgatttcagataaatttaccaaacttttcatctcaactcccacctccctagcaacagtatttctccttcctgtttttgcagattaatccagattttaaaaatcaattcagatttttattgttatttcagtgttttataattcatacttttgattgagaataaatcttaagatatatacaaattttataacaagatttatacatcttgttagatatttctagctttaaccagtttcaatattcaccaccattctattctattactatataacttcccaattctttttcttcttttctttccttttcattgatacataataattgtacctatttatgagttacatgtgttattttgatacatgcatacagtgtttaatgatcaaatcaggatatttaagttatccatcacttcaaacattcatcatttctttgtgttgggaatatttcaaatcttctcttctagctgtacttaacttcccttttcttaagctctttgttttgtttctcagttgttcaaagtttattttcagtaatattttatcaagaagaaaacgtgagtagcaaatacataagggagcaaattgtgatggatcccacttgtttagctaatgagtctcttgcaggtgggggcagattggtgagcagagattaactcagggctttctgctggctttactcagatccactctttagcattgtttccctgtctgctttgctctcactgaagttactagcacattcttgccttttatattagtctataaaacctaaagacctgggcactgctgctttatgttagcaattaaatcagctgcagtatcaggtctgtccttcactgcctctaagaaggatttggattgtgagattttattttttgcttccctataccccacacatcatttcagcatatttttaaaatttcttcttttgattcctttatcatactatctgattctcttgtattttattgccaaccacaagcagatgctatttataattgccttttgtttaatatagtataacctttcaaggcatgtctttccttatggcattgtctaaaggggtaaaggagacaggttgtgtaatgcagtcacatagactggcacatcgcaaatgtgacaacataaattccagagggcagacaccatggtgtgctgtgttctctgtgttctctggagtgtccttagcactaagcccgggacctatttaatagttggccaatatgaatttgttaagtgagtgaatgagtgttcaaccagcaagaaatattatcattagaaatatggttatgatcatttttatgatacataaggcaaaataccaagaattaagaaggtagaattgcagataactcaaataatcatttatccatcacacatggactaagcaccaactgtgtgaggggccctatactgatatctgggaacgccaagtctgacatcatcataaattcaagtgagagactgggaagtagcaaaggaaaggggaatagacattacctagaaagtggcagaaaggaggagcccctgccactataagccgaaggcctgtggggcctccttccatgactgactcttcagttgtaggtgggcaaggtgggctcaacaagccttctggtgctctccctggccttccaaggccatcccacccagacccctatccaggtgatcagaccggaatgtcctaaagccaaattgctaatgggaggatatctgaaccccattttgggtaccagtttgtggaagttgggaagccaaaggaactgttggagtctagtttatctcaatgactttggtcatcgtactaccacatatttctctaaatctgtttttcttactatgcatatgagaggtgacagcgtgctggcagtcctcacagcccttgctcgctcccggcgcctcctctgcctgggctcctactttggcggcacttgaggagcccttcagcccgccgctgcactgtgggggccccattctgggctggccaaggccggagccagctccctcagcttgcggcgaggtgtggagggagaggcgtgggcgggaaccggggctgcgcgcggtgcttgcgggccagcgtgagttccgggtgggcgtgggcttggcagaccccgccctcggagaggccggccggccccaccggccccgggcagtgagggtcttagcacctgggccagcagctgctgtgctcaatttctcgcggggccttagctgccttcccgcggggcagggctggggacctgcagcccgccatgcctgagcctcccaccccctccgtgggttcctgtgcggctggagcctccctgacgagcgccgccccctgctccacggcgcccaatcccatcgaccacccaagggctgaggagtgctggcgcagggcgcgggactggcaggcagctccacctgcagccccggtgcgggatccactgggtgaagccagctgggctcctgagtctggtggggacgtggagaacctttatgtctggctaggggattgtaaacacaccgatcggcactctgcatctagctcaaggtttgtaaacacaccaatcagcatcctgtgtctagctcagggtttgtgaatgcaccaattgacactctgtatctagctactctggtggggacttggagaacctttgtgtccacactctttatctagctaatctggtggggacgtggagaacctttgtgtctagctcagggattgtaaacacaccaatcagcgccctgtcaaaacagaccctctgggctctaccaatcagcaggatgtgggtggggccaaataagagaataaaagcaggctgccctagccagcagtagcaacccgctcggatcctcttccacgctgtggaagctttgttctttcgctctttgcaataaatcttgctacagctaactctttgggtccacactgcccttatgagctgtaacactcactgcaaaggtctgcagcttctctcttgaagccagcaagaccacgagcccaccgggaggaaggaacaactccagacgcgtcgccttaagagctgtaacactcaccacgaacgtctgcagcttcactcctgagccagcgagaccacgaacccaccagaaggaagaaactccgaacacatccgaacatcagaaggaacaaactccggacacgccaccattaagaactgtaacactcaccgcgagggtccgaggcttcattcttgaagtcagtgagaccaagaacccaccaattccagacacacatatatgctaatcttagaaagacatggatactatctcccctctccactccatccttaaacatctcatgactattaagaatgagaaagggaccaagtggcaagagaacatcttcatatgcatacaactttccagaaaataaaaatttgccaagttgtcagacactgcttgtatcttatcagtgtaagaaaaaaaaatacagaacttccttcctgtaaactgtttattttactattaatagtaattgactgaagtcttatatgatcaaattcagggaggggggaatattttttaagtcagccaaaggaaagaggctgtctctctcaaattacagctcatgatgtttgcaagtgctttggtgatttcttgaaccactgtgtagagatgatctttcaggaaagtaatgtttttcctgcccctaaaaagagacttgtattgtaggagccttttcagatcataccttagcagaaagaagtgacccacagaaacatattttcagtgactaaataatagaccagaaaggggagagtgtctgatcatttaaggtggtcttttgttatatttttagtcattccctagagttcaccaaattgacactatttagtaatatcacagcacatatattctgaatacatattttcacgttcttctgagacaagttgtgtttcatatattttatccctgttccatccaggaagaaatagaaatattgcccaggtcagaaggacaggaggagaaattatctgaggtggagttttggtgaagtttgaggtggacagaaagtagacacagcaatgaatcctggatgcacttaagagttttctttacttgaagctgcaaagccttttcctgcctgtgatattgctgattcctgccttcctgcctaaggttcagaccaagccatgacagacaaagttgagaggctgcctgccttttgactcattcttacttctgtgtgtaaaggctaggaatccacaggaataggacatctgcagctataaacacaaagaagatggagaccagttggaaaatgtcatcctgcactatcattcagctgccataacagggaatgctccactgacctactttagaatggtcctctttgttgtgcagccacagtggataccacatcataaaatgacagaactgggccggtagtataaaatagggccgtcctttgtaaatgtctgggactcagtgaaacaggcaggtgtgtgtgtgtgtgtgtgtgtgtgtgtctacattgtgacccacttattaaggatagagggaagagaaatatatggttaaatcctgttaaagtgttttctccatagcttatcaaacactatctgattgttcaaccacagaaacaaagcaagtatcattctatcacatgttaagcatagcttgggaagaaaatgcagaagcatatggcaaccctgcagcccctgcctcaacaacattataataaataaacataggaaggcccatacatacacatgtacatgtatgtgcatcacatacacacacgtgcgcacacacacacacacactcctgcctccagtcagggaagtatgtttctgttgtcatagcaagactgtggtttaaagggttcatatccacttcagcctgtaccagatcctttgcaatctaagatccagacaccatcccttcatttataatgtcataaagagaagtgccaagaatcacatataattcaaactgatgaaggacgatgaacgagcctgactctgttgacctgaaagaactatatcactttgcctgatgttatcctaatatttctgtttgtacggagatttcaaggaattccttctgagtatctattttcttattttaaaaaatagaaaaaagacacctatctaataggtgtgttgtcaagtttaaatgagccagtacccaaatgcagtcgtgctcagttattagtaactttcaaggcactttgcttcttccctgtcttaatgccttgctccctgctgtatagggaccatgcgaagctgctgtgggcctccctgctgtctggaggtctagtctcttacatcaactgccagaagtttgctgcccagatgccttcttggtgccaaaatgcttaaatacatccacagtgagacaaagcatctcctccctcagtaaaacttgccacttcactgatgttctctctcctctgagggcagatggcacctcatcctcagctacctggcccctttattgataaatcccttccatgaccacagtgtcagtgctacttctgtggcttttctctcattggcacccacttatcttccccacagctcccaccctgattcaagctttagtacatttcatacaaactctttcaagaacttcctaaattatgttatttccctctgtctatatctcctcatccacttaatatactgctgacatatctcttctggaaacaaactgacgtcacattactgcttttctcaagaatatttgcactacctcattgcccgaagaattacgatcatgctgcctagtttgacttgctcaaacctccggtaactaacaaaggttaagtaaaaactttgtctcattggattcatagaaagtaaaactttgttcagtgcccctaacagtcatcaacagtgccacaggtgatcatcagcaaatggatcatcacaaacaaacaaactcaaaatatagacctgcaagagacaggagagaggcaggatcatgccaaggagtcagagggttggtggatcaagtggtcttggacaactgatttaccttctctcaatctaagtgtctttaaaatgagagcagaaataacaatacctacatcatagaatttactgacaactacagtaatacatgtgaaagcattttgtggactataagacttaaaacctgttcactattattaaagctatctttatgtgtgaaaagcaggttgatattaaccgtatatcaaattcctaggaaaggagtctggaaatagggaaaaggggttgagcatgaattggccagtccattctttggagacctgaggatcaatacaaattcttcagccttgagctagaagagcaattctgaagcaagcacatgaaattgtgaacactgcagacttcagaaaagaggagaagaagacagcatagcagatattattaataccgggatcagggatggcaagtccagatgtttcccagatggtcgtgagaaaatgatcatccaggaggatacctcctcctaaaactttaagcaaaacacacaaaagagaagaaaagcctaccagccatggtattaggatgtgaaccagtgacccagagggcaaaggctgtggactccaaccacaaggccctcagccaacctaactctatttgctatttttaaagccaagtgcgggtgaggggcgggggaagtagaaagagtttttccactagtagtcaggaaccgaaataggaaagatcaacagaggcatttataaacaatgaatgccattaatttttttaaagctaagacagggttggaaaagatgtagtagagcaaggagtggggaacataggcagggaaagatggccctggggtcttcacatttttaaagggtcctttctgcttgcttgatggcatttcaaaagtcactgctgaattactatattattgaatttcctggaaaacttggaaaccatcttgttcaactgaacttggactaggggagagatggaatgggttatttttcattgaggccccatactagagttcaactgtgatagaaaatatgctccctttcttccccttaaatagaaaattttgtaactattgagagatatctaaagtttaggggcagtttaagttgtaatgatctaactccaaatatcaagctctttctaaaatatcacaatgagaagacagtgacaagtaatctaggtctcccgttgggatgatgagaaagagggcatttgtaagccctggttcgagccatgtctgcttaacttcccagcgtggtgtgacaagaagaccataagaccatgaggctggagattagtattttaattccagctctgcgtgaaggaacagtgtgatatctaccaaatcactttgcttctctgagccctagtttatcggtaaaatgagagggttggctagatctgggagggcaaaccaacttccatactaattgattgaaagtgcctcaccaaagaagcttctaaagctgcacctcaatttagagaaaaaattgtcatggattagagatgtttgtcatgtaccccaaatgaaggacttcaacacgtatgtatttgcatttcctaggctgctgatctataagccaggacatctcagaaatttagtgagtatctaagtcacccggaagtcttgttagaatacacaattctgatttagtggatctggttaggccctgagattctgcattcctaacagggtctcaggtaatgctagtgatgctagtccatgaactacacttttagttgcaaggctttaacatatctccctgacaaaattctctgaaactaaaattcagcaagtaacttataagagttatgtgaaaggcattaggtactggggagagagaaaaggaaatacaaaattagttgagaaaagaactaattttagtttttaataacatctttacttagtttcttgcatacatattcatctaattatttctttttttccccacagatgcttcatatatacagattatcctggtaaataattggggatacacataaaaacacctgaaccaaagcatatacaaagtactagggaaagccacaagtggaaacaatagttctacctcaggaggaagaggtcaatgaaagttccatgaagaatgtagtatttgagttgggtattgaaggatgaataggagttaatgactctctaccaaactatctacagttcttagcagcaatatcctgttgtgtaccaagaatcaaaacatcccatattttctttaaaataaaagcatgacagaatcaatttttaattttccagaagttaatacatagtgtacagattgctctagcttaaccattgtctctcttttaatgaactcctcatttaggaggcaccatatccaaaaggaaaatcaaatggtttcatgatttggttttcgtcagaaacagtattttaaaagacttctcggccagtttattcttttattcctgatttccaaattatgatagatcaaagaactggtatcttggcaaaaccagaaaatctagctagaaggtttcaggtaaggctagttgatgaaagagggggagaataactaagtaaaggacaccagacagaaatgcaatgtcaggtatgcattaagtcagacctcctttaggattctagctctaccactcactaactagttaatctagtaacattgtttaaactctctgatcctcaattttccatctgttaagtgaggaataatagctaacttcaaagaaccatgttagagaaagtgtatgcagtctctacttggcaaccttgagcacagtcctgtgtcaagtgaccttgatctttattatctctcagtttcaacccttcaggaataaagatgaatagttcttctatgcaaaggaaagaagagggaatctgtaatcaggatacctgtgttcagatctcatctctgccccattcttgccctatagccttagaccaagcacttccctcagcttggaagaacctgaggaacctcaagccaggttcctcagctattaaaaaaaatagctgaaaacaacttttgctctacattgctggttttcaactggagcaatttgcctcatactttagcaaataaaaagatacaacacccagttaaatttgaaattcagataaacgacaaatttttttaataggtcactggcaatatttgggacacacttgtcccatgcaatatttgggaaacactaacacacaaaaaaatttattatatgaaattaaaatctaattgaactttctgtattttatctggcaaccctacccccaggggacatttggcaatttctggagatatttatggttgttacaactgtaggagaaggggtgctgccggcattagtgggtagaggccagggatgctgctaactatgcacagggcagccctgcacacatacacagaacaaagaattaccaggcctcagtgtcagtagtgcagaggctggaaaacctcggtcagaaaatgtggattaaaaaacatgctttgaagtttataaagcattgaaaactaactaatatggttaaaagtccatactacccaaagcgatttacagattcaatgcaatccctatcaaaattttcaaatgtctttctcatagatgtataaaacacaattctaaaattcataggaaaccacaaaaaaatcctgaatagccaattcttcaaaaataataacatttcctttcaaaaatatgtagtgttttatttcttaatataagaaaatatgctcactatggaaaatgaggaaatatgagtaagcaaaaacaagaacaagaggaattacaattccacaatccagatagacatattattaacatcttggtgtgtgccctgctagacttttttacatgtatgtatatgcatattttgaatgagagttttctaaatattttgcatgtacttttcaatatttatttttagaatcattttatgaagttccccacccaaatcccattgatatttcaactcgaattctggtaaatctgcagaaccacttgaaaattggcatcccttcaagaaatgtttttcttatttaataagcatgctgagtattattaatatcagacacctttgcattttttcaaacttaaataggaattcattcagcaaatacttatggagtatctcctcttgtgctaaaccctgttctgaacacttgggatgcatcaatgaacaaaccaggcaaagatcttcgctctcaaagagttgacattttaactggggagacgatggatggatgatggatgaatggatggatagagatgaatagataggtaagaaggtgattgatgataggtagatagataattttctaaggtgataaatgatatggaaagaaggaaaatgtaaaacaaacaagaagagaaagaagtgcagaggcagggggcaggttgcagtatcacatgaggtggtcagaatgagagtcatcaagaagataatatgagtaaattttgcagaaaatgaaggaactcctgggaagaagcattccaagtgaatgaaacagctagagcaaacctcaaagcagagcatacttggtgtctttaagtaacagccacaggccagtgtgggtctaaaacagagagaataaagaatacagagtaaaggagcagagagatcttgtgcaactctgtaggccactgcaaggactttggcttttattctgtagggtaattaacaggacatggatctaattatacttgcaaatggttggtgttgctgttatgtgaaaaatagacttcaatggcgtgggggcgaggattgacgcaagcagaacagttaggaggctattacagtaattcaggtaagagataaaggtacagcaggaagaatagagacagggtcagattgttcatatattttgaatgactccaacaggattgattttctacatgttggctgtatgggaaaaataggagatggggatgcttccaaggtttctggactaagcaacttgaaaaatggagtttccatcaacttagatagggaaactgtctactataagttttggagtacgtgaagttgtgtagattctggagtatgcattgggggaaaattcagtgttagtcacgttaaaattgaaatgtttatttgacagccaagccaaaagaaataagtgtcaagcagtcaggtgtataagtaggtctggagtttgagagtcttgtctagattagagatataattttgaaataatcatcatataaatagtatttaaaggcataagacctttggatatgagccagggagtaagtatagacagagaagaggaccaatgactgagccctggagccctccaatgttaaaaagttgggtagaagaggaggaactagcaaagggactgggaaggagtgaccagtgtggtaggtgtaagccaagaaaatgtgttgtcttcaaagccaaaaaggaaaatagattgaggagagaatgatcagccttgtcaaatgttgttgatagctcaattatgggaaagactttgactgtggcacttagccaagtggatcatggtgtctagtaaccttgatgagagcaatttttgtggatggtaaggaagagattctaatgtttccacattacatatcatagaaatttatttcacatgtgtattccttattataatagggaagtacccttctgtcccatatttagtcacagtttatgtcagaatgagaagtctatttatatgattgttataatataacaattttatatgattgttaggttgacagctatttttcataataagtgatctttgcattcctgggaaaaaaaacctgacaagatcatgtgactcttctttctgtacaaggtggactttgttttgctaacattggatttaaaatttttacacttataagtaagattgatctgtagtttctcttctttgcttcgagaaattttggtttcatttttagtgcaacttataaaattaattaagaagcttttttgttatattgtgcaacttcatagaagggaattctctcaatgatttgataaaaagctattcttacaattgtgtagacaaggtaccttttggcaggggttcctgaaataatttttcttttaatttcatcctcagtcattaggctagtaaagtcttctctctgtcctccttgcacctttgatggaatatattggagccgggctttgaatccaggaatgtgtggctctaaaatccatccaaaatcctgaaacacaagaagcatacgtctgtgtctataacaaaatctctcattttaattttttttaattttttttggtagtttttctttttttttttaattatactttaagttttcgggtacatgtatgtgcacatcgtgcaggttagttacatatatatacatgtgccatgttggtgtgctgaacccattaactcgtcattcaacattaggtatatctccaaatgctatccctcccccctccccccaccccacaacaggccccagtgtgcgatgttccccttcctgtgtccatgtgatctcattgttcaattcccacctatgagtgagaacatgcggtgtttggttttttgtccttgcgatagtttactgagaatgatggtttccagcttcatccatgtccctccctacaaaggacatgaactcatccttttttatggctgcatagtattccatgatgtatatgtgccacattctcttaatccagtctatcattgttggacatttgggttggttccaagtctttgctattgtgaatagtgccacagtaaacatacgtgtgcatgtgtctttatagcagcatgatttataatcctttgggtatatacccagtaatgggattgctgggtcaaatggtatttctagttctagatccctgaggaatcgccacactgacttgcacaatggttgaactagtttacagtcccaccaacagtgtaaaagtgttcctatttatgcacatcctctccagcacctgttgtttcctgactctttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatattatttgcccactttttgatggggttgtttgtttttttcttgtaaacttgttggagttcattgtagattctggacattagcactttgtcagattatttttaatttatttttttatttcaatagattttcagggaacaggtggctttggttacataataagttctttagtggtgatttctgagattttggtgtacctattacttgagcagtgtacactgtaccaatgtgccgtcctttatccctcacccctgcaaactctttcccccaagtccccgaagtccaatgtatctttcttatgcctttgccttttcaaagcttagctcccacatattagtgagatcatatgatgtttggttttccattcctgagttatttccattcctgagttattggaacaatagtctccgattccatccaggttgctatgaatgacattattttgttcctttttatggttgagtagtattccatggtgtgtgtgtgtgtgtgtatttttttttttacacattttctttatccactagttgattgatgggcatttgggctggtcccacatttttgcagttgtgacttgtgcttctgtaaacatgcatgtgcacgtgtctttttcgtatcatgacttttcctcagggtaaatagccagtactgggattgctgaatcaagcagtacatctacttttagttctttacagagtctccacagttttccatagtgtttgtactcatttacattcctaccaacagtgtaaaagtgttcccttttcactacatccataccaacatctattttttaaatgtttttattatgaccattcttgcaggagtgaggtggtatcacattgtggttttgatttgcatttccctgataattagtgatgttgaacattttttcatatgtttgttggccatttctatatcttctctagagagctgtctattcatgtccttaaccgactttttgatgagattgtttattttcttcctgatttgtttgagttccttgtagattctggatattagtcctttgttggaggtatacattgtgaagattttctcccattctgtgggctgtgtgttaactctgatgattatttatgttgctgtgaagaagctttttagtttaactaagtcccatctatttatctttgtttttgctgcatttgcttttgggttcttggtcatgaagtctttgcctaagccaatatctagaagggtttttccaatgttattttctagaatattgtattactcagggttctcttagagggacagaactaacagtactaaaggggaatttattaaatattaacttacatgatcacaaggtcccacaacaggctgtctgcaagctgaggtgcaaggagagccactctgagtcccaaaactgaagaacttggagaccgatgtttgagggcaggaagcatccagcatgggagaaagaggtaggctgggaggctaggcccatctctcttttacaaatttttctgcctgatttatattcactggaagctgattagattgtgcccaccagattaagggtggatctaccttcccccgcccactgattcaaatgttaatctcttttggcaacacccacccagacacacccaggattaatactttgtatccctcaatccaatcaagctgacactcacattcagtattaatcatcataaatatttatggtttcaggtcttagatttaaatatttgatccatcttaagttgatttttgtataaggtgagagatgaggatccaatttcattcttctacatgtgacttgcaattatcccagcaccatttgttgaataggatgtcttttctccactgtatgtttttctttgctttgtcacagagatcaagtggctgtaagtatatggctttatttctgggttctatattctgtttcattggtctatgtgcctatttttataccagtaccatgctgttttggtgactatggctttatagtatagttggaagttgggtaatatgatgcttccagatttgttctttttgcttagtcttgctttgtctatgtgggctcttttttggtttcatatgaattctaggattgtttttttctagttctgtgaagaatggtgttggtattttaatgggaattgcattgaatttatagattgcttttggcaatatggtcattttcccaatattgattaaacccattcatgaacatgagatgtgtttccatttgtttgtgtcatctatgatttctttcagcagtgctttgtagtttttcttgcagctattctggaatggattgagttctttacttgattctcagcttggtcactgttggtatatagcagagctattgatttgggtacattaggtttgtatcctaaaactttgctggattcatttatcaattctaggagctttttggatgactctttagggttttctaggtataggattgtatcatcagcaaatagcgacagtttgacttcctttttactgatttggatgccctttatttctttctcttgtctgattgctctggctaggtcttccactactatgttgaatagaaatgttgaaagtgggcatcctagtcttgttccagttctcggggggaatgctttcaactttcccttgttcaatataaatgtgggctgtgtgtcataaatggcttttattaccttaaggtatgtcccttctatgcttactttgctgagggttttaatcataaagtgatgctggattttgtcaaatgcattttctgtgtctattgagatgatcgtgtaattttcatttttaattctgtttatgtggtgtatcacatttattgacttacatatgttaaaccatccctgcatccctggtatgaaacctacttgatcatggtaaattatctttttaatatactgttggatctggttcactagtattttgttgaagatttttgcatctatattcatcagggatattggtctgtagttttctttatttgttacattcttccctggttttggtattggggtgattctggattcatagaatgatttagggagaatttactgtttctccgtcttttggaatagtgtcaataggattggtaccaattctttgaatgtctctgatagaattcagctatgaatctgtgcggttctggactttttttgttggcaatttttttgttgccatttcagtctcactgcttgttaattggtctgttcagaggttttatattttcctggtttaatctaagagggttgtatatttccaggaatttatccatctcctctaggttttctagattatccacataaaggcattcatagtaaccttgaataatcttttgtatttctgtggtatcagttgtcatatctcctgtatcataggcaattgagcttatttggatcttttttcttggctaatctcgctaatgctctatcaattttatttattttttcaaagagccagctttttgtttcatttaccttttgtattgttttgttaatattgttatttcagtttcatttagttctgctctgatctttgttatttcttttcttttgctgtgtttgggttcagatttttcttgtttctccagttccttgagttgtgacctcagattgtctatttgggctctatcagactttttgatgtaggtatttaaatgctatgaactttcctcttagcaccacttttgctgtatcccagaggttttgataggttgtgtcactattgtcattaagttcaaataattttttaatttccatcttgatttcattgttgacccaacaatcattcaggagcaggttatttaatttccctgtatttgcatggtttcaagggttccttttggagttgatttctaaaatcaactgtgatccactgtgatctgagagagtacttgatatagttttaattttattgcactgtgatctgagagagtacttgatataattttaattttcttaaatttactgagacttgttttgtggcctatcatatggtctatcctggagaatgttccatgtgctgatgaacagaatgtatattctgtagttgttgggtagaatgttctgtaaatatctgttaaggccatttgttgtaggatatagtttaagtccattgtttctttgttgactttctgtcttaatggcctgtctagtgttgtcagtggagtattaaagtctcccattattattgtgttgctgtctatctcatttattaggtctagtagtaattgttttataaatgtgggagctcctgtgttaggtgcacatatatttatatatatatttatatatttataggtgcatatatatttatatgcacctgctgttatatttaggattgtgatactttcctgttggactagtccttttatcattatatatataaaatacatatatatgtatatatatataaaatacatatatgtgtgtgtgtgtgtgtgtgtgtttgtgtgtgtttatatttagaattgtgatattttcctgttggactagttcttttatcattatataatgttcctcttcttcttttttaactgcatttgctttaaagtttgttttgtcttatgtaagaatagctactcttgctcacttttggtgtccaattgcatgtaaaatctttttccacccctttaccttaagtttatgtgagtccttatgtattagctgagtctcctgaagacagcagaaacttggttggtaaattctaatccattctcccattctgtatattttaagtggagcatttaggtcatttacattcaatgttggtattgagatgtgagattctattctattcatcgtgctatttgttgactgaataccttttttttcattgtgttattgttatataggtcctgtgagatttatgatgtaaggaggttctattttggtgtatttcaatgatttgtttcaggattgagaggtccttttagcagttcttgcagtgctggcttggtagtggctaattctcagcatttgtttgcctggaaagactgtatctttccttcatttatgaagcttagttttgctggataaaaaattactggctgataattgttctgtttaaggaggctacaaataggaccttaatcccttccagcttataagatttgggctgagaaatctgctgttaatctgataggttttcatttataggttatctgatgtttttgactcaaggattctttcctttgtcttgactttacataaactgatgacaatgtgcccaggcaatgatcttttgtgatgaatttcccaggtgttctttgagcttcttgtattcagatgtctagatctctagcaaggccagggaagttttccttgattattccctcaaatatgctttctaaacttgtagatttctcttcttccccgggaagcccaattactttcaggtttggatgtcccaaacttcttggagtctttgttcattttttttttatttttttttatttttctttgatggattgggttaattcgaaagccttgtcttcaagctctgaaattctttcttgtgcttgtttgattctattgtcaagactttccagtgcattttgcatttttttaagtgtccttgattttcagaagttgtgattgtttttcatttatgctacctatttcactgaacaattttgcattcatatcctgtatcatgttttttatttctttaagttggagtgaacctttctctggtgcctccttgattagcttaataattgacctgaattttttttctggcaattcagagatttcatcttggtttagattcattaccagtgagctggtatgatcttttggaggtgttaaagaaccttgttttgtcatattaccagaattgtttttctggttctttctcatttgagtagactatgtcagaggggagatttaggattcaagggctgctgtgagattcttttgtcccacggggtgctcccttgatgtggtattctcctgtttcccctaggaatggggcttcctgaaagccaaacagtagtgatcatttttgcttttctgagtctagtcagccagcagagctaccaggctccaagctggtactggggagtatctggaaagagtcctgtgacgtgatccatcttcggtctttcagctatggattccagcaccggctccagtggaggtagctggggagtgaagcggactctgagtccttggttatgtttctgtttattgcactggttttgtgttggttggcctccagccaggaggtggcaccttcaagagcacatcagctttcatcagtttttcatgtgtcagggagtctgtagcagtgatccagtttcttcgaaaggtctattgattctctcagctttcctggtatgctcctgtggtagttcttagagcaaaagttcatgatgtgagtctgcacaagctgctgtctccccaagtgggatctgcaagctagtcctgcctcctgtctgccatcttcaaaatctcccattttaaatgctatcaaaaatgactgccaatgatttctcccaagaggctgatcttgccagattttgaagttcatgaagtatggccagaattcttgatttggtgcaaaaattttcacgttacctacttttatgtttaaagtgaacttttataaagcaaggatcaacttaattgcttataaattaagatataagggaggaatttggaagttgtttatagtggagagtagagtgctgtctatagacctgttgtattagtccattttcatgatgctgataaagacatacccgaaactgggaagaaaaagaggtttaattggacttacagttccacatggctggggaagcctcagaatcatggcaggaggcaaaaggcacttcttacatggcagcagcaagagagaatgaggaggaagaaaaagcagaaacccctgataaacctatcagttctcgtgagacttattcactatcacaagaatagcaagagaaagaccagcccccatgtttcaattacctcccacttggtccctcccacaacacatgggaattctgggagatacaattcaagttgagatttggatgtgagcacagccaaaccatatcattccacccctaaccccttccaaatctcatgtcctcacatttcaaaaccaatcatgctttcccaacagtcccccaaagtcttcactcatttcagcattaacccaaaagtccacagttcaaagtctcatctgagacaaggcaagtcccttccgcctatgagcctgtaaaatcaaaagggagctagttacttcctataatgggggtacaggtgttaggtaaatatagctgttccagatgggagaaattggccaaaacaaaggagttaagggcccatgcaagtccaaaattcagtggggctgtcaaattttaaagctccaaaatgatctcctttgactccaagtctcatatccaggccatgctgatgcaagaggtgggttcccatggtcttgggcagctctgcccctgtgggtatgcagagtacaccctccctcccagctgctttcataggctggcattcagtgtctgctacttttccaggcacacggtgcaagctgtcagtggatctaccattctggagtcttgaggatggtggccctcttctcacagctccactaggcagtgccccagtagggactctgtgtgggactctgtgtggggtctcccaccccacatttcccttctgcattgccctggctgaggttctccataagggccccgcccctgcagcaaacttttgcctgcacatccaggcgtttccctacatcttctgaaatctaggcggaggttcccaaacctcagttcttgacttctgtgcacccacaggctcaacaccacatagaagctgccacggcttggggcttccaccctctgaaaccacagcccaagctctacattggcccctttcagccatggctggagtgactgggacacagggcaccaagtccctagcgtgggggccctgggcccggcccacgaaaccacttcttcttcctgtgcctccaggcctgtgatgggaggggctgccatgaagacctctgatatgccctggagacattttccccatggtcttgggaattaacactgggatccttgctacttaagcaaatttcaacagccagcttgaatttctccccagaaaatgggtttttcttttctatagcatagtgcggctgcacattttctgaactttgatgctgtttcccttttaaaactgaatgcttttaacagcacccaagtcacctcttgaatgctttgctgcttagaaacttcttccaccagataccctaaatcatctttctcaagctcaaagttccacagatctctagggcaggggcaaaatgccacccagtctctttgctaaaacataacaaaagtcacctttgctccagttcccaacaagttcctcatctccacctgagaccacctcagcctggatcttattatccatatcgctatcagcattttgggcaaagccattcaacaagtctttaggaagttccaaactttcccaccttttcttgtcttcttctgagccctccaaactgttccagcctctgcctattatgcagttccaaagtcactcccacattttcaggtatcttttcagcaatgccccactctactggtaccaatttactgtattagtctgttttcatgctgctgataaagacatacctgaaactggaaacaaaaagagatttaattggacttatagttccacatggctggagaagcctcagaatcatggcgggaggcaaaaggcacttcttacatggcagcaacaagagaaaatgaggaggaagccaaagcagaaacccctgataaacccatcagatctcatgagacttattcactatcacaagaatagcacaggaaagaccggctgcatgattcaattacctccccctgggtccttcccacaacacatgggaattctgggagatacaattcaagttgagatttgggtgggggcacaggcaaaccatatagcctgtgctttatctgaggtcatgcctgatcacaggtgacatacctgagttagctatgtgcagttcagcctaaagaatctggaaatcatgacctcaggaaaatcactatggggaattgcagatgatacaccctctagccatcacaccacttacttttgcatggagatgtatgttttccaaagagacggccccttcattttcccattttgtgctcatgacagcctttctcagatgcacagactgaggctcagagatcaagtgcctggttcaaagtctcagagctgaatactattacctaagtttgttgatgccttaagcatgacttttaccactccgccatggtgtctttataaactatatatgtatgtacatacacatacatattcacatatgaacacccaaatataatataatttatacatagaggttttaaaaattggtaaaactgttatcctactttttttacttctgtattcctacatttgaacttcgtcaccctggcttcactcttcgaagcttttaaaagaatcaacaaagccgagaacattgtttttattaaataaggactttcatcaatatcattttaaaaaacaaaaataagcccctgaataggtaggtgtgtgacaaaactagaaagagcagcatacacttacattggctactgcatctgcacctttaacttctaatatgttagtgatagtgtatgtaatcaccagcttggagggcttagcaatagcgtgtgcatgctacatattttcaaaggcctatactgggctgtagtatatatagtgggctgtagaaccttataggaatctattatgggtacccacatccctacagcagctggccaccctgaaaattcctgttcacatttgtcaactatgagaccccatatgtaacccatcacaaatgtgatgagaatcacatttctcttccaaagagacaaatgtcccttccaaagagggtattgggccaggatagttgcagccccagaatcttctaaggtaaacttttggcacctgcaaactcttgctacttctctctcaacttcatcctcattgaccatggttacatatacatattttaattttatctttatcatagacagtgttgagagacccacagatgccctttcactttcagtggaagaaatctagaccagaacagagtagagatctctcagcgtgcagatggctggcagaggcaatgaggagaagggaagtgagctgggcttcagagttgtgtagacccagaccctagtcctgttcctgtcctcactagctgcatattgttgggccttcatacacaacctataaaaataaagcaatggaaatgccacacagactgctgagatcataagaggagagaaaagtttcaatatgagctccacagccagtgaattatatacccatcccaactcaacatttattcattctttccaatgaagttatctattatccctacttccctgttataataatattttaactataaaaggtaatgttcttttattaataaagcgaggaagcatccaggaaattgcctaatggtgcataagagttcaatcatttttaatcccttcctaccttttttccttcctattcaaatgtaagaatacagaagtaaaaaagtagaatcaggatgaaaattcaagtttctgacttctcatacaatggcttttctcgtgtgtgtgtgtgtgcgcgcgcgcacgcatgtgtgtttgtatatccactgacaaactctttcaaacttagtttgattttttcctcaattcattttttttctttcaaattaccctttgtctatatgagaaggggaaaaatcatgctcagtggcttcatttggtttagctagctttgtgtgatttcagaatcttagaaattgtctccacatcattacttcacatcaaagagaagtagcatgtgaaagtaatgaaaatacatcatgttatttttttttttaattctactatggagcattgacttcttcaaatcatcgtgatttcttagattttgaagccacagatttcaataatggcactaaggatgtataatttatgcattcctttgattgtggaactcaatattccaaacatgtgatcattcaggccattatttatgtgtttagtcagttgcctttgcattgaatcactacatgaaactatggctaaattgttatgcttccacactcctattattacatgtgtttaggtatatgatggcaggcatttctgggttatatatgtgaggtaaaagcagtaacagaaatctgaagcatctgtcaggataactaagcattcacagaggctgtcgtgggtcacccggggaggcatggtgaaaactcattctataaggaggaggcagaggccaacacaagctattaatagggagagaagtccacaagcaaaattataaaggtcaagaggcacagctaacttagttcttgtccagatagatttcaacatctactttgaggagagtaggaggatatgaagagccagtagcagagacagagagagtggctcccagaatcagctttcagccagcatcctaggtcaggcaggagtctgatggaacagtatctggcctgcacttcagggtacctgggaggttggagagttctagatgcagtcacattagaacattggaataaaaagcaaggctagccagctggaagcccatacataaagacctgtaggcagacttgaacctggtggtcatgcaggcctccaggagtcaggggccacgtaaagaagtccatgtctttccatagaattaaaggggcgaagccccagtattctcttggcctggacatttgtcctgcccaggcctgggtaggctaatctttcctgatggacagtgatgtactttgtaccaagcacttcactgaccacagggacccagaggtaaagaaaccaccatttcatgtcaagtcccacataatagaagaggagatgtcctgttgtaataggtgctctgagaacgatgaggggacagagaagagtggtgggttccctgtggagggaaggagggtgtgtgtgcaggaggctttggaaagtacttagaggtggttcatagaaagtaagactgtttaccagtcaaacaagaaaggcagggaaggcagcatgagccgccctcaagaggcgtgacccagccacccttaccagaaaccataaatgatctgataaagcaaaggaggaacccaaggtttcatgttgaaaatgaagcaaggaaagtagggaggggttgcatggtggagacctgcttcagtgatctccatgtgattctgtttcttccttgtgttagtgtatattcaaggacaaaccgctgatgaatagagctaactgcattattaggcctgtttttattgtctagcaccagttttgttatagcctttagtttaaaagtactgactctgtcatcattattactgtttgcatcatccttagcccttaaattcctcttgtctgccttggcactgaaaattatccattgcttttgctctcctctctccagctttaagacccttctgtgacatgatcatttgaccttctctgggctctgcacaacttttgatgcaggcatccctcacagcctcctctccgagccatgcccctgtactggtggacgttgagaggagtccaatagctaaacctggaaaagcagaggcctagaaattctttggactatcttgcctgtatttaccttagaatcacttatagatactttatataatctaagtaatatttatggacatttctatatatgtagttacagatttttaaaaaattttttcttaaatcatagtaaagagtcttttttctctaatttatactaatttcatcaaataaattataggactaattttatacttgtgtaatctggaagcagactaattattaacaagaattttaactgttgttcattgttgatctaagtactgtactgattacatttcttttcttatacaagtttatgtttactcattctccaaattatttttgtagttaagtaatctcaatagtaaatcaccattttatcctgttttatctttaactctgacatttatgaaattggattgaggattaagcaatgcttcaatggcaaaatcttatcaaaatgagtccagccaattattttacagatatatgtaattaatttcattttttaaaaaaaaaaagttgatgcatgctatttagtgtagtaggttcagccaccagcactgagaaaagcttttcaatattttcttccaacatttatgtacagatgtctttgtgctccaatatttggctctctgtggacagcttgcttaagcatagtggtaaatgataccacgctcataaaagagcccactgcctacctcctaatcagtgttgtattggattacattgatccattccaaactctatttgaacatcgtgactaaaatttttaataattttcagctgtaactcataaaactgttttaatttagcccagaacttcaaatgccccgggaagaactgatgacttatgtgatgagctagccccatgttttcgcaacatctccgtatccaaagagccacatcattccaagggatgacttgaccctgtttccagagacttcattttttaatctgctttttgtgacagtagttcatgagaatagtttaaaggcagatagtactgaaagttctacaacagaaactgtctcgtcccagattcgcgtctgaaaggcaaccacttttgtcctctttcattgcttcttctgtcatttatttcagcattcctaaatgctgtgcttctgctgctgtttattgattttgttggcctcctgctacagaagatgagggttgagctctcacatctccagcaacaccctttgtttctttcttccttgttgtcaccttccacaaagagtcatatcacaatctttgctcccttacttccatcttcccaagagttttatcacaattttgtgatacatggccaatttatgccctattgtgactattgttaacttctgattcaagtattgtacatttcttacaatcttaaacatattttatttttcctcaaattaaaaattgccttttttacttcctaaacatttcatgtatctataattatttttttcatatgccttcacagatttgtcaaatgacatatcatatactcaaaggtatcaataaacttttatttatttatttacttattttattgagacggaatctcactccgtcactgaggcaggagtgcagtggcacaatctcagctcactgcagcctctgtctcctgggttcaagtgattctcatgcctcagtctcccgagtaactgggactacaggcacacgtaacgatgcccggctaatttttgaatatttagtagagatgggttttttggccaggctggtttcaaactcctgacctcaagtgatctgcccacctcagcttcccaaagtgctgggattacaggcatgaaccaccgcacccggctagtttttgaatttgtagtagagatggagtttcaccatgttgcccagactggtctctaactcctggcctcaaactcctggcctccacccatcttggcctcccaaagtcctgggattatacacatgaaccactgtgtctggctatcaataaacttttaagtgctatttttttccaagtctgctgccttacttcttttgacgctccagtgtacaggtactacagagttatcatagtgggataccgcttacctttcctcagtgtcagttgtcagttcttctgttatgtactggatctgatattttcctctgtcttgatttagtctctcatttttctgagtcatattctctagaaatttcctaagaaaacgtatgtgtaaagtaaatattctgaacccctcaagattggaaaatatctttattctaccttcatacatgttaataatttggctgggtataaaattctgggttgcaaatctttttttttctcagaaaattttaacagcttctgaaatttcatcttcttctagtttccaagttgctactgagaaattcaatcttcctatcatctattaagttgcttaccgtatctccacttgccttttatcttccaaatatatgttaaactctcatctactcttgctatttctcccaataactttgttcttcagagtatatgctttgtttttaaattcctggactgtaattttagtagggtgttggtaggactaagtgggaaatttatatgaacagtccaccattgtttacccaaagttcagtggcatctttgtttccaggtatttaaacccatgcaatccttttgcataaattatcatactattctattagcaactctgagagtaggtagtactagtcccatttaatgatttagctgaggttccagaaatactagtagttttcttaaatttaaagagccagactgagacagattcaaatttaaaactatgttttttcctactctactcaggcataagggtcacttgcagcaatgactttgtgatggggatcactagtgataaaacaagtcagaccatggcttctccatatcttgctacaataaactaatgccactgctgtgatgtgaattattcctttgaactattctctgagctgcagaacacaagctttcctcttcaatcattcttgttattccagagtggacattgaaacatcagaaaccaaataattgctggtagtctggttcatacaaacagtgtactacatgtataagaacagacaaggaaactgaaatcatggtgtttgggtctgaataaaatatatatattttaacatataatgatgctatttcagagtccagcacacaatgaaataacttcctctttgaagcttttacttaaattcccacatagagcacaaatagcattctctaatttgaaaacgaaaagtaagtaattgctttcaaagtccagtcttttaaaaacatagcagtctttcagctaagtagttattctcaaaaaggaaaagggacttttcaatgagtatttataaacaagcatacatgcccaataatttatagtgtgtttatgtgtcacttcaactttctgtgaagtgattatgacagcagacacacatcatgttaaatgatgccatcctgaagaaagttttcaggtaacatacctcctgaagggttttaaactcttttctcattcagaggtttgcctgttgcttttccaggttgcatgccaggttcttacccccccttattttatcatccagttagccccaacgtcatcttcatgtaggttaaacaacccaaataaaaggaggaaatatttaggacaagcaatgaaagagtgaaactaggcaggaccttctccaacctggggcaaatcttctaccacttggacccttaggtatctcatctttgaaatgaaataatacaaatagatcttcaagttccccctttcagctcttgaatactatttatgcatcgttgattaatcaacttccacgaattatctcaaaccagccaccactgcttcagttcatgagtgaccatgaaaaatgttttcatcaggcatcatgctcaagagctgggaatatcgaggcaaattaacagacacagtccttagcctcattgagttcatggtccagagggaaaggcagactaaaacaaactttcaaataaataataattgtgataaatgatgtgaaagataaccacagagtgttgggagaaaaagtaagaggaaaaggataatttagacaggggtgggaaatgttttcaagaaagcttcattgaaatgccaagagatccacagactgaggggttgctagccaactgaagagtgatggaaacagcattccaagcatatgaagcagcatgtgtagagagctgaggaattaaagagctcgagtattcaaggaactataagaagaccacatggctaaagcatggagggattggcctgagattaagttaaaggtgggctcccaaagcctgcagagcctcgccagtatgatgagcaccttataatacatcagaaaggcagagagaacctgctgaaagatgtttaagcaagaaatagagatgatttgattacatttttaaaacattaccccaccactgcacacacattgagttggaggaggacaaaaagagatgaagcagtgagactggctagatggtgaagcaattgtagagaagagggtggattttgtaatcttgggacatcctcactttgggtctgtggatggctgtgctgtacagtggggtatcttgacttcatgtctcatactacctggacatattcattcctgtatctcccctctaaagagacttactttgttgaaatcctgttgtctctccaggttgtcatcttgcatagcattctacataatccatatctgatccatgagaatcacatacttgttggactcaccaacccttttcctaacaatcttttggagtgcaggccttgttcacacagctgtctcctcagtaggctgacaggacccctggccacccacgtctcttatttttagttttttccaagaatgggtatggccacagccatatgtcccacagactcacataggtcaagctgttaaaatagtctccttgaaaccctctcaggactgaggagacaacagagcacaccccatccttctcatcatggtaaaggaggagggataagactgatagtgcctcaacaactctgcaaagaaatactctctccactacctcacctttcttcctcttttctaatacatgagatgcttggtcatctaagagtggcaaaaatacattttggcacctttttgagacttgcctgggaacctaccatcttactttgggatatcagagcagatggcattctcttgtctgtgactagatgaaggcagaacacacccattttaacatccgtcttaagctttatccagccactttctgaaataatgaacaccggtgtgcagcacctgccatcttcctgaagcccccacaccctgccctcttattaggcctcccagttcctctccagtgctcctgccttgggcctttgtgcatgaagataccaggatggctctctgccttttcttctcagccttctttcttctcactccatgatagcaccctgtcccaagaagctaagtgactcaccgcagccacaatttcattatcattcgcatcttcttcctctttccccaggctggggttggcatctgattgagtcctctctccccttctttagaagactgtcagccccactctcacacagacctgcccttcccccttaatcagtcattttcctgagaatttatccaacggctcagttcctgtgatagaaatacagaagaaaatacatcaaatttcgggacttgcactactcagtaagacacagaaaagtagaattgagtaacctacatgaaaagcaaagaaaatggaattcactagcttgaattgagagaacaaagggcatggaggaggcttagagttcctggagtagtgaataggaaagatggagataaaccagagtgtataccttaggtagaaaatgcaggagaaagcaaaagaatctaccatatatattttttttctattttgaaagcttcatgaaaaagttgtaggaaagaattacctggggaacctcattttctgtgattttagactaatcagcaggaaatggcaggttgtatcctaaccaaagtttgccatgtacctgacaggaacaaatgctaagcatggactgcgctgcaaagcctgtaagatgagcatccaccacaagtgcacagatggcctggcaccccagcggtgcatgggcaagctggtaagggcttgtgccaggagtgaggcccacacctctctgctagggcacttgcctgctgcagtgagatcaccccctccaaaatccttccctgaaaccctgagcaaagcaccccagaactggctgccagcttggcttcctaattggcgtaatcagaaaacaaggacaagggctttgtcaacccaatcaacaatgccccaccttgaaagggagtcagggtcattaacagagtgaccaacttctcccaggttggcactttctcagttttaatactgaaagtcccacatcctgggtctgttcaggttttaaaagtgaaagtcatgcatctcaggaaccccctaagtcccaggcaaactaatggttggtcactctagtgcttccttggtggtcagctcagtgggtagcaagagaggacaagagctaagcccccacaaaagaggagagagtaataaatatctgcaccactttaacagaatctcccaaaccaagggagattgaatggcccttgagatggctgatcataccatctcaggaggatgggcttcagtcctggtgccacatattgattaagaggcaattcaagccaggcacaatggctcacgcctataatcccaacactttggacaccaaggtgggttgatcccttaagcccaggagttcgagaccagcctgggcaacatggcatgaccctgtctctacaaaaatttaaaaattagctgagtgtggtggtgtgtgcctgtagttccagctactcaggaggctgagattagaggatcgcttgagcccagaaggcagaggtttcagtaagccattattgcgcaactgtactctagcttgggtgacagtgagaacctgtctcaaaaattttttttcaaaaagcaatccagagcgcatttgagggtgtttgaaactaggatggccaaagaattgtagaaaggacgaagaatgtctaccctagagaataattagacaggacatcaacagctgtcttcaacaattttagacctaaaatttagaagagtaactccattgtcctttgaggctcctggggaaagacctaagatcagtggatactaagtcttaacaataaaagataatgtcttgcttccagggttagtgaatgctccttcaccccctcccatcactgacagtgtaacgacaagggacaccactttccaggaacattagacaggattctggaattctagaagggactgggccaccaagttcccatccagtaatggagtacagtcaagtccaggttcttagtttatctatttactctgatttgcaatgtctcttttctcaaacctctgcctcccctgcttccccttctccttctccagtggtgattcccataagccaagacagaccatgaaggagaggtcagaaaaacagagaatagaatccagattacagagcaaatgattctggctaaagctcttcagatatacaggagcttttaggcctccctctgaggtccacttacccatgcccaggccttttatttatattattttaacaaaccacaataacaaactgtggtgaaataatatgtggcagtccacttgtaatccaggaggcaatgaggatctgggatgcaaaggaggctgcagtgcactgcaggaggaggacagacacgactggggaggccagggccaggaccttgttttctggatagagtgtaacttgctagttgccactattcctccctgcctctgtgtccctgctgggattaaattgtggaattataggataagtcggcatgttaatgggagacaggagggtgctcctggagaaaccaattggttttatttagggagctcttgtatggttttctccatctccagtgacattaaccccttgccttcctcattctctctccagccaaaggggtttcggcgttactacagctcccccttgctcattcatgaacagtttggctgcattaaagaagttatgcccattggtgagttgggacattgatgggttgagttgagtttgaagcagcaaagttaacattaatggctactgtcctcccatggctgcaaaacccgtggggtatctctgtgtgtttgtttggtggctatttggggtatgactgtgtgttttgctggaagggaaacataaagtggaccaaattctccaggaattttcatcctctccctgatgaagctcagaaaacacctaaatcccaaaggctactgattagtaattccaccatcagcagcatggtggagtggaaagaacacggagaatggcttcccccagaccaggctctaagcccagctccctattgacaactgtgtgtctttgaacaagttacttgacctgtcaacccccacaaaatgagaacagcaattgctgcttttcataattgctataaaaaataaatataggttattcacccatgcttagtaggagctcagtgaatatattattctctaatgcagatcaaaagatgccctctatttattgatagctttggcttggattcttctctaacaatatctttcagtttacttctattattttttttctctctctgaaaatctcgacatctatttttgctttttttagggggggcaagttttaaactagaaatttataagttagaaagcttttaattagaaattaatgaagcccagtagtgacaagttatttctaaaacagttgcctcctactgcaaactttgtgtctcaagtctttgtaccttggtgagcacagcctcccagtagaggagataaagctgatccctgcaagaacctggaaatcagagaggaataacgaaagaggaaattcaatcaggaagaattcgggagcagagtactagctggtacatggcaggacctgcaaatgggagcatgctgggtgggggtgcatctgtgaggaacacttggccatgaaagccctgtctacccagaggctaagttcctctgcacagagcctgcttctcaggcgctgttcacccaggagatgtggtaggcagttggctgggtcctctcagatgagcttcctcagatgaactttctcttctgttgcagcctgtggcaataaggtggaccctgtctacgagaccctccgcttcggcacctccctggcccagaggacaaagaagggcagctccggcagtggctctgactcacctcacagaacctctgtaattatcctcttccttcctcggtttgtctgtggtggtcttgggcagagcgggcctcaggcactgcagtatggggtattccacctgactgcctcatgagggcaggtctgcagggagtcaggcacctgccaaagagaaacccaaagtgctttgagccactaaggattaacttcctgttgtcaacaccaagggattattttactttcctgtccaaagaccatccccttggcctcatgctccttgacccttcccatggaccccctctcctttaccctcccaccaacattagataacatatgagtcaacatacagaaatgtttggctcaaacaatggtcaggaacttggaaatcctggctatttccagttttccgtttagctacattccagttcaaagacacagctatttctcacatcttttgtcttttctctctaagagagggcacacctcttgattgcacacaaaaactgcactctcaaagttacttgaactgtgactctgtgggacactcactcttccaagcacctctcctaagttctatctgacttaaactgagtgttccatgcatctctgtgacctgttatcatcatcttgtctctggttgtttcaatcagaatttctataaatgctccaagatgccatacaactctgcagcccatgctgaaagccaccattcctccagcaaagaggcaaggaccttccagttcacatggccacttaggatagccagctcctagtttccatttccattgttgcagcccctgctggactggaagcttctaggcaagacacagatgagccttcaaatggtctgccccactgagtcctctcaacatcaagtgactaggtggattgtgggaagaggggcagggcacatgcctgggaggggttctcagagactgagttgaagcagcttcctcattgggtgcaggttaagccacaagattgtaggtaggtgaataggaatgtaggtcgggtaggcaagtaggtgggtttataggtcctctattgggtgcagtttaagccacaagattgtaggtaggtgaataggtcgggtaggcaagtaggtaggattataggtcctctgcctgatgccatgtggctatcctcaaagccatctttaaactcactgaaagccctgttcttcatgcatccactgatttctaagaggaaagaactaaaaataatttttactctttttccttactgtacataaaattgacatcagatagttctttcttctactcagttagcagacatgaatgaagggcctacagtttactagcactgtaggggacacaaaagaagaggaagtcatagcttttacccttagaattcacaacttatttctgaagaccaaaccaatagcgaagaaatttgacaatggtggcattgtttaccatttttaaaaaaatacacttttatatgtcttatcccattttattaagattgagaacgtaacatacacgtgttaaggatattataatgactgtgtcatatgagtactgaagcatttcatagtaaagatgaaaaatgtttcacttcggtagacattgcctcaaagcagtgaggggataatgtgtgtcattttaagatacctgatgacctccttagggaggagatcattgttatttggcatccacaagataatgctaattcttttactgaaagaaggataaaaatggtgctaaatgtgatgaaaatatacaaagcatacatgggtaggatttatatgtaaataaaggctgcttaggttgggtaacaataatatacataaagtgtttagcacagggcctgacataattgacactcaatgaatggaaattgttactgttctatattttaattcatttaaaaatattttttgagagatggggtcttgctctattgcccaggctggcctcaaactcctggagtcaaatgatcctcctgtctgagtgtactgagtagctgggattacaggtgcatgccactgcacccagctgtttcattttcattacgcatctagccttaacagtgttttctttgaacctgaattattgtgaagttaaacaaggaagtaatccattaacaaggcaaatatgttacctgagaagggcatttcccagagccactcatgcttgggcagtgttagaaacccctgacttactcgagggtaacttcgctgttctgctcagcccatctccttctctgatgtgtcctcctgtaactccttaagttggagtgttcccaggggtctgcttttgcttggtcttcttattctactctctttggttgatctctgtcacattcctttagttcaagcaccgtctctacattgatgactcccttaggtatttcctcttgcccaagcaccaaaccagtcctacagatattgcaaatcagcagattcagactaaactcatattccacgagtgattaggtcctataattcaaaactgagaaataatatcaaagatacccttagtatttatcaccagtactagaggtttgaacctcattatctctcacctagattattataaagaaataaccgtgctacccttttcagcctacccttgacagtaccccctgatttatcgacccttaaagaaaggctttgcgccacttccctaattaaaatcctctattaagttgcttatgtcagaacaacgatgcccaaactcttaggcatgggatatgagtcctgccattaccctaaaaacccactttcccctgaactccccaagccctataacatatccattccttagaacatgttgctccaccgagttgaaattttttaagacccactctatttttatacaaacaatgaagagtccccagactcccccatgcatggtgagttgctcctcccacaagccttcaagaattcctttcttatagaatatatatgattgcattgtaatcatctgcttttgtgtctattccctgaataaatactgagtatctagtgagtatctaggtcccgttccttattcatctcattacatcagggactcatagagtgcctggcacatagtgaatactcaagaaatgtgtgaagaatgaggaagaattaacaagggacttttgaagactgacctcagaatcctccgggatccgcacaacacttcatttctcacaccttaagctctgggcacagtttgccgttttctgcatagccatgctctgtccagacattcaaactatctccacctctgtcagacaacatctgtccaagcttctgggtctggttgggcacccacctcttccctggtgccccggagcatccagttcattaatccattagttatatattgcttagtaattttcacttttttgtttgatttttctctcactttcccagtcctctcctcaattagactaacctccttaaatgcaaggattcttttattcacagctttgtgttttcattactttataccagtgattctcaaatgctggggcatatcagaatcccctggagaattctgtaacactataaaggcccaggttctgccagccctttgtagagtgtcaatacatatgtggtgagtgcacgaatcaatgaatgaatgagcaccctcctcagtcaaaactgcctaaacttctgtaatagagggctggcaatgagctaaatcagtggttctcagtgtgtggtctccggatctgcagcatcagcatcacctggaaacttgttagaaatgcaaatttgggtttctgtctctcagaactgcaaaatctgaaaatctgatttggggagccgaacgatttccattttaaaaacccctccaggtgattctgatgcacattaaagttggagaattactgagttaaattaaaaactaaagtttgcttccaaagaaatcagccctctgtctctctcctcttcacctttgctcttactccctctctgtgtgaacagcatttgagtgacacatttacagtggccacaagcctggatctgaagtttgaaacagagatccaagaatgctaatcatctccctaaccccacgtaccacgttgcatctcctttctcaggggagtgaggagggccattgctgtcaatgagttgcttccccaaagccacacagagctcactctcagcttgcaaccatctccccttacaagtcaagactgtttgtagatgccacccagcaatcaaaggaaaagcacaaacaaaactggtcagagtagagagatctctgtccactttgaccagcattctgaacaagcctttctcaaatctttgatgagagccagtaggtcatctcacttcagtgcaagcctcttccatgcttgtgggaggctggcattggtggaagggcaactgaaaagccagcacatagaggcaattgcagagagacggctccacagagatggctctgatctatctgcacgagcagtagatggctgctcctgtggttctgagctttgctgacctatgacaaacagacctccttggaaacattccatagtaggcaatgaacatgtcagcctcctcatttgaggctgatgctaagaagcagcaagaccaccagagggacaattggggatgtcccagtttgctttcatctctaatatagctttgtctttagcaacatctggaccctacagactggttttaggagcaaaaagcatagttttctgaatgtcaaagggatgtccatttatcaccgtccacttatactggcactggttccaccagtagatatttgttggagtttagctctgtgaaggcattgttctgagagctgcagggagacaaagacaaaccaaattgtacttaaagatctgtcacttcactctttccccaaagtccaaccatcctcaaaggaagaaaatagaaacattgattggtattttaaagtgattttgcttcctgccagcaggtcagtaataatgaacttcagcatcctgcattttttattttatttttagtattcttatgtcctaaagttaacatatgcctgcatagcaaagctttgttccacagctttattttcttccaaggctgccgaggcatttgttttacattgttgagaagtcactgcctggctgtttccaaattgttatgttttcctcaatgtactttcaaatgttctaaaatataaaaggcttgatggctttgggaaagctaaaagaaaccaaattcaaacaacattctcggagttagttggctagtttatgaataatcttcagtttcataagattaaattaacaaatgaaattctgtacaaaccaacttctgtacagaaattgtgagcttcaaagggagcaggacatgagtgacttagagaccctgtgacttttttttcttctttctgctgtgtcatgatagtagcagtgtttgaaaaaaaatcttaaagctaaattgtaacaaaaatcagtctctggagggtggtgctaaagggctctagagctggctaggagagctaagaagataatttgtccctctccgataagatgtaaataaataattttttaaaatatgactgtcaggccaggtctggtggctcacgcctataatcccagcactttgggaggctgaggcaggcagatcacctgaggtcaggagttcgagataagcctggccaacacagtgaaatcctgtctctaccaaaaatacaaaaattagccaggcatggtggtgcatgcctgtaatcctggctacttgagaagctgaggcacaagaatcgcttgaacccaggaaatggagctgagattgcaccactgcactccagcctgggtgacagagcaagactccatctcaagaaaaaaaaaaaaaaaaaaaaaaaaaaatatatatatatatatatatatatatatatatatatgtgactgtcctcagaggccccctaaattcctcttgtgaagaggatagagccagttagactgaagctgggtcacgtggccctttgaaagaggcattcagtgtggtatgctagtaaatgtttaacaaccaagtcagaactggaccctgatttgaagcgtttgccagttccatggagtaaaactcctgtggtgatccatttcatgccaccagtgtgataaccatgagactctcaccagcccacaaagatgctttagcacaccaatgaataaagcacaatgcttaagagcacgagctctggaggcaacgcctgtgattcacagccccagctccaccatgtattaactatggggcctcaaacagagctactgattctctccgggcttcagattcctctctgaaaaattggtctatcataggattaatttggggaataaatgagatggtatctataaagtccttaaaaacattacatggtaagtgatcaggaagcattagctatttagagtgtgttattgttattattgttgtttttgttcttgttatttctgtaacctaagtggaagaatgattgtgactcactttaaaaagagagtcaggatacatattataaaaacaattaattttgcagcagtggaaacagtatttaacttgtacctaagtagtgcatccctccatagtgcatcccattctctaaaactaatatttaaaacacctgtagaaagagctagcgttttattgaaagttttaagtgacaggatatggacaggcattctgatttctctttgttgcctattcctgggaagaagcctggctgtggcctttgcttctagacattcatgaatattcaatactcactggatacctaccatcaccaagcctgagcctgctatagacacctgaagggaggtacagtgcccacgagtggacatagcttctctgaagttagccaaacagccaagacagcaatcactgggtccttatgtgtcatgcaaattctacctaagctctcttacaccaaagtatctgctcaattgaccacagatataacattgttcatcccatgctctttcttctttcctccaagacttcagatcttgtggaggttcctgaggaagccaatgggccaggaggcgggtatgacctaaggaaacgcagcaacagcggtgagtgagggagttggcacagcacaaatgtgatcacatgagtcagggtcagtgggcaggccaagttgatttccagtccccttgctttctctgctagctctggaatttaatcagggcgagtgttcaatgttctggagagaatgtgagcattgtttctggtggatttcagtgatttgctctaatatgttcctgagttctatatcctgagttctcatactttatgagagtatatttactcttatgagagtatatatacatatatatatatataaactgagctgtattggggtttaagagtcgcttccagaactttttgtgaatacgtcattttctccactgagctagattagattacattagcaaaccgtaccacagagaagctaatttgtgctacaccttaggtacctgaaaccaagtggtggtggggcccaggagagaagtgtgggcctcacatttggctccttccccagcagagacaactaagaagctcaaaaaactgatatgtacaatccagccaaacattctatattaaaattatttaatctaataatttaagcctttgttataataatttctaaagtatttattaaatgctaacttcatacttccacttgctgacattaagaaagagccacctctggccgggcgcggtggctcacgcttgtaatcccagcactttgggaggccgaggcgggcggatcacgaggtcaggagatcgagaccatcctggctaacacggtgaaaccccgtctctactaaaaatacaaaaaaaattagccgggcgtgatggtgggcgcctgtagtcccagctactcgggaggctgaggcaggagaatggcgtgaaccctggaggcggagcttgcagtgagccgagatcgcgccactgcactcccgcctgggccacagagcgagactccgtctcaaaaaaaaaaaaaaaaaaaaaaagaaagagccacctcgtaatccagagcttaaagacatgtgaccagatccttatggatgcattcttgctaggccttttggacatcaataactacttaaccttcactagtttatcaaaaaatatttatgaagcatttactatcattagcaaaagtgtattagtcaaagtcctgcaggacctgagttgcattgttaacttgagctgaatgcattctcatggcagaagttatccctccaaactccactccaagccctgccttttccagcctggatgcagaaattcctcattcgataccacatagcagttttgtcaacagctgtctgatgaggtatcacttttacttccttcactctgggaattcatttatggctcttctttagttaggactatgcctgtgtgattcccacaaggcaccatgtgctcagctgccccaggattttccttcctaaataagtgccagtgttcaccatgcccccccttgccagacccacacacatctactaaagctcaccactggggtaaggattctttggcatcacatgagggaaactgtacttttagataatgcaaacaaccactgagcacttagcagtgccattagagagacaaattagagggtattggcttcgaggggaacttcatagcaggtcagcagcacagcagggccatcccagcccaactgtctggcactgcaagaccagcaactgaatttaaacagcaaccctaaagtttctcaatatctgactcaccagagacttgcatgataatgctttaagtgtgatcagctgctcagtcctgagtctgacctctgctttcccctttcccctgacactcttctcatcaacatcactgctggccttctcctcactaactgcgctggaaacatttggtccttggcccattgttgctctggaagcagagtgctagacttcacttaatgctcatgtgatcccaaagcagtgacctagcctctctctgcttcaatcacctcatctctaaaatgaagataataacaccaaatccatagggttcttatgatctttggatgacataatgaatgtaaatactatccatacattgatgattcaaacttcatcttcagtattaggcttccttgctgcctccagatgcctatcacctattggacattgccatctgaatgcagaatagtcatctttaagttaacctacccaaactttactcttgatcccctcacccagccacacattcagactggctcttcccacagttgtctctgctcagtaaataggaacttcattcaaccagttgattaggccaaagtctttgacatcagccctgactccctcttcctctcacacctcagacgtaatccatcagcaaactctatctgctgcttctcaaaattatgcccagcatgtgctcactgcttaactctctgcctcagccatcctggcctggctctgtctatgctgttgctcaccaattccttgaggagttagaacacaatttacactgagggtttcttctctcaaaaggtggtcttaataggattttaaaataggaagggctatatttagcaatcattgctatgtagcatcactgctattagcaaagccatcatacagtcataaagtgtcagagatgcaggtagagcctcactaccctaaatgtggctcatggacaactcacgtgagcatcacttgaaagcctgttagaaatagcaagtttcaggccattccacacctgctgaatcaggatctgcatatgaatctgtggttcataggctcattaaagtttaagaagtaggactagaggtcacttagtccaattccctccccttcaatacacacacatgcacacaatatcccccgtatagataaggaaactaagtcacagagtagtacacacaaagacatcaagttgacaattttccatctcttctgtgttaaggggcattttcacagcctttctcaaagagatctggtgaaagaactgagcaagcaataaactcccaaaaagtgttggagatgtattaacaactcttttgatcagcaatagctttctctacaatgcaccctgagaagctaggtggattaattatgcagcaatttgcttcaaaacactttcccttgattggctttaatgtcctgtccatgcagtttgagaaaccacatggagaaaacaccctacatatgtggtccaagttcccacagatcttctcactcatgcaaggagggtgttgctgttcagaagcagtgtctaggattacagtcacaaccagttctgcattacatgttcatttatgtcttaaaaaatgcagtgcatacaggtgtcatttcttccagccagctattatgtcaaattccttgaggaatatctccaaagccaccttggaaggaagtacaattcatactaatttctttactgctaagagtacagtctctcctttctctcttataaatgatccttggcaggtctgagtatttatggttgttgttttgaacactattcctggatgcatcataaatatacatggaggaaattgttggtcttcacctttggcttaactgctagaagcttcactcataacaaagtaacaagcaaagagagaagtaaaatctcgcctgaagtaaaatctggcctgcctatttcagctccaaatgccaaataataatgttattggctgccttcagtaattgcatttcagaatgactctgtgtgatcataattttcctggaagagagacagaagaggacataagcaatacaaattcctagaattttcttcaaaaagggctgggttaaccacagccacttaaggatattacaaaatcgaatattacctcactttgcactaaagcaattttattctaaaaaaaaaaaggcaagctcagatctggaaaatatatcctagcctttagcatgtactaattcaatatctcaaattttaaggtgtcaaaaagagcagatattttcctggttaagttggcagatgcccctggttttggtaccactccagtggatatttctacattacagatgcaaatatttgtggtatgtttctgcaacacatgctttgtatcaagttcaggtaaagatctttttaaagttgaacagaagattccctttccagcattgtggagaactggacattcagaggaatttttcccagtttagcactcctaaaactgttaagagaaagaattgttctaaaaaaaattctagttaatgcatggctgagctggcagcaaaataaggcaattccttagagtctaggaatggcaataaaacatgaattcagagatacaagcaggtaaaggatttactatgcacatccctagagccttagcttgggaaataataggccccatttatgaacaatagacaataaaatggggagtggccagggtattaggttggatgaaagacccttttgaaacatattaataccccaaaagatacccttaggatcactggacaaacaggattccctgcagaggaatatgctataccagccttaactcaggtggaaaagaatggaaacaaaaaagtggagaggaaaggaaagaaagaaagaaagacaggcagaaaaaaggaagggagggagagaagaaaggaaagaaaggaggaaagaaagaaacagtcttcttacttggattttagggcctgaattcatactacctgtatgggcaaataatataataatatgaaattttagtttaatgtagtttaaagtggcccaggtacagtaagatcaccaggcatttggcagaaacaaatataaaccctctctagaggaagaaaattttaaaccagacctcaaaaacttctcagaaatgaacactcaaagaacacaagctaacaatcaaaattcaccaaacacatgagaaaatgagccgtgatgagtaagtattagcagaaacaaccaactttatggtcagattttcaagactgtacatgtaagaattatcaaattaagaaatatataactatataattgtatacatttaaaatgttaaaaatggaccataaaacataacaaaggaaaaagagactatcagaagtaaacaggcaagcttgaggaaagtcaaatagaacttcgagaattttttttaagtagaaatttgattgatgggtttaacaacatattaggcataaagagagaattagttccctaaaatatagaaccaaagaaatgttagggtatagttaggaagccaaagcagtagaatttgtgagattaaaagtgacatgaaagatgaataagtccaacatgcatctaagtgacaatttagaagtacataaagagagaatggggccccaggcacagtggctcacgcctgtaatctcaccactttgggaggccgagataggagaattgcttgagcccgggagtttgagaccagcttgggaaacattgtgaaactccatctttacaaaaaatacaaaattagccaggcgtggtggtgcctgtctgtaatcccagctagctgggaggctgaggtaggagaattacttgaacctgggagtttgaggctgcagtgagccatgattatgccactgtactccagcctgggagagacagcaccagaccctgtctcaaaaagagagagagagaaagagaatgagagagagacaatatgtaagaacatacttgtggagaattttccagaattgattaaagacaccattactcaaatttagaaatctatacctagacgtaggttgctgaaactgcagaatttcaaagataaaagaaaacataaaatgcagtataaaagactgattacctacaaagaaatgaaaattagactgttacttcttacaaattacagtataagtgaaataacagtagaatgctatcttgagtttgctgaaagaaaagtgattcttaacctagaattgtaaatgaagcaaaactatctttcaataatatatttttcagacaaaaattgtatttacagttcaattaagaaagacctatattcaaaacattttaaaaagatgtacttcaaagaggaaaatatgacctcaatggaaagacggaaatgtaagaagaaataaagagcaaagaaagtggtaaacatgtggttaaatctaagcaaacactggacacattttttaaaataatgtttttaaaaagttgttaataaaacattagctgaaatactgactttatgtgggaaatgggcattcagagattatgtattgcttgggaggcgattaaatatactatttcactttctattttgttaaaacatatctcataaaatttctaagatgactgctaaaggaataaaaatagactcaacttaccaaaccagaaagggaaccaaactgaaagatgagaaggagaaaaaaatcaatcaattcaaaagaaagaagggatggaaagtggcaaaatagaagaaaaagcatagaaaatttgggacaaatacaaaataaaatgttaggaaggaatcccaatttatcagtaatcaaaataaatgtaaactgatttaagcactctagataaaagaaagattttcagactagattttttaaatgacctatatactatttataaatatctaaaacataaggatgtagaaaatttaaaaaaacaaaagtttttttttaactttctgcagggggaagaaagaaaaacataggcagaataaataacttttcagacatagaaaccaaggggcaaccacaggcaaatattaagcaaaaaaaaatatatagctgtattaatgtgtgaaaaattgactttaagaccaagaaagcattactagaatttaaaagtgttatttacatggtcatgttcacttcatctgaagatataaattctaaacttgcatatacctgatacatagcctgaaaaatgatagaaactcaaggagaaattgacaaaattattccaaattcttgagtgattttaagatgcctctcagttattggcaaaccagatagacaaaaatattctgtacagatatagaggatttgatgacacatttgacaatcctaatctaatttacctaaaaaggacactccatgtaacaagtagaagatgcacattccttttaagaacacatgtggtacatatacaccatggaatactatgcagccataaaaatgaatgagatcatgtcctttgcaggaacatggatggagctagaagccattatcctaaacaaaccaatgcagaaacagaaaaccaaacactgcatgttctcacttataagtaggagctgaacaatgagaacacatggacccagggaggggaacaacacacactggggcccgtcaggcgaaggaggtaggggagggagagtattaggaaaaatagctaatgcatgctgggcttaatgcctagatgatgggttgatagatacagcaaaccaccatggcacatgtttacatgtgtaacaaacctgcacatgtaccccagaattaaaattaaaattaattttaaaaagaacacatggaattatttaaaatactgatcacccactaggtcataaagccaatttcatgaatttcaaataattattattatatagaatacatctttctgaccacagtgcaaattagatagaaatcaatagtcaaaagataactaggaaaaccaataatttgtaaaataaaaacacttctaaaatttttatagcttggctgggcatggtggctcacacctataatcccagcactttgggaggccaaggttggaggaccatttgatgccaggagttcaagcccagcctaggcaacttagggagactctgtctctacacagaatttaagaaaattagccgggcagggtggcatatgtctatagtccagctactgtggaagcttagggggaaggatcacttgagcctggaaggtcgaggctgcagtgagctataattgtgccactgctctccagcctgggcgacagaacaagaccttgtctcaaaaacaaagaaaaaacaaaatcatatgttaaagggattcataataaagactggaatatatttaaagctaaataagaatgaaaacatatcaaaacaacacgtatccaaagtgctaaagttgggatttgagtatttagctttaaaatgagtgttaaaaaaataagaaagtctgaaaagtaatatctaaacactatacttaaggaaaataaaatagaataaactcagaaaagcagaaggcaataataaagacaagagcagaaattattaaattacaaagatagatcaataaatcttgagtgttttttaaacaaaattacaatctctaatgattttttaagataaaagagatgaaacaaaaataaatacaaaaaagagaaacataacagagattgaaaagaaaaccaaagaattttataaccaacttcatgccaatgtactttaaaacatttttaaataggcagatataaagatagatatcaacgattaaagcctgactcaagaataaatagaaataggaaacatgaattttcttataatatttatagaagctgaatcaatattttaaattttgcacaatgacaatactaggcctgaaaaactttataagtaaattctacgaaacatttaaggaagagaaaattttcagattacataagctctttcagagaaacaagaagtagcaaggaggaaggacagcagcattctccaactcagtttatgaggctagaaatatactgacttgaaacccaaacaaggatatcatgaaaaaggaaaatcactggccagtctttctcttgaatacagatgcagaaatctcaagcaaaatctcagtaagaacccataaagtatttttaaaagacattgtgtaattacccagttgaacttattccagggatgcaaatttggattcacatcagataatccagtaatgtaacttgctgcattactaggttaaaaaaataataatctaactaaaaaacacagtggtcttgggcctcacaggtctgcaaggtaaaaaacaaaagacagcatataggataggaaaagaagaaagttctttggggatgtggtaagaactaaaggttcattttgcttctgtaacattagaaactatgcctacataatagacatattctttgaattcttgttatgggtgaaataaacgaccaagttatttttcatgaaataatttaaagcaccaaaaataaaaggtgtatgatatgttttcggtagttacctttcttttctccgctttcattaactcaaagtcttataaatggttggaataggtttaaaaattatttttgcaaccttccatttcttcttgcaaccatacatgaaaacatatatagggtcacttcaaatatttttcagcaaagtttacaaagatgatacacattttgagccagatggccagagggagattcaatacaaaaattaaaacaatgtgaaattacaaaattgtaaaatcaatccacactgaacattgtatatgcactttatgtagacgcccttttaggccaaatcaagaattttctaggaagattctctttacatttccattcaaatatttaatattctttcagaggtgtccagttttatacttagggaatcaagtgtttacagcaggatttcagacagtcatacattaccagaaaaaggttttgctaatctctactctttttagactggtagacatcaagttgagtggccaaatattgaggcagacaagattcatagaaccgggccttcgttttctggttacttacaaaccagagctccaccaatgactgcatattggcttcctagggataatggaattgcatccataaactctggaactataagccaagaagaatagatatttgataagcatcagtacatttacagaggctcttgttctgaagcacgttttctatatcactgttgttgaggctattttaagaacagtaaagactgtcagtgcactaatgaaataggttatagagctttctgtggtgatcccctccctctactgacatttctttgataatctgaagggaaatcaaagagaagaataaagcagcaatgtataatctaaaaatttcaagtcatcaaaatggtagagtaatttaaagaacaaagctttattatataaacttggaaatatttaccacatttttgtttaaggaaaatacatatgatgagaatgataaagctatgacataagttatggatgtaggttaggctgaccaaactagataaggcagaagtcccattatccatcaggaacctcccacagctgggtatgtgaacaatgaaaactcttgctcattttgtttattgttttttgtttttttgtttttgtttttgttttttagatggagtctcactctatcacccaggctggagtgcagtggtgtgatcttaccttactgcaacctccaccttgcaccaggcttaagcgattctcttgtctcagcctcccaagtagctgggattacaggcacatgccaccatgctcagctaatttttgtattttagtagagatggggtttcaccaagttggccaagctggtcttgaactcctgacctcaagtgatctacccgcctcggcctcccaaactgctgggattataggtgtgagccaccgtgcccagccttcctgcccattttgtgaagacttgtccactatcaaaggctacagagtggatacttaaatacaaaaggaagaaaattatacttcccaagaataaactaaaagaaaaaccaaatagtagccccaatgcactgacaataagaaatcaaggaaatattttgaagtttaaaactaaagctttaatcttcaaaatataatgtagatatcttcaagaaactacaatcaagataccgaatatagattaaagaatcatatttagaagaggcagctcaaatacaactaaattggactatatctcaaccaccaccccattaacaagcggtttgatgcattcaacaaggacaaatgctcctgagaggtacactaccaaatgagatcaaatatgaacacactactgccaatcattacaagaggcaagtgctagtcaggcatgtacaaaagttgtgggagcacagagaaggtggtgcagaatgctgcatggggaggcaggagaagagacatgtggaagaccacctgaacgctgggtcacagagggtgaggaaaaggcaataagtagtaaagtagaagctatggtacttagaataaataaagccatctttcaggaatatttgtttaaatggtaactagattcatagagcacctgctttctcttgtctccttcagtgtttacatatccagaaaatggcactgatgatttcagagatccagcgaagaacataaaccaccaggtatttatggatgtcacagaagacaagtcagacaggagtccttagatagacctgcaggtcaccatccaagtgggtcatgaaatcaatttagtgagtccagaccagcatctttagagaatagaataatatagcacaacgtaccatagcatggaataaacagaactagcacagtgcataaaaggtaaaaagagtaagcattgcactgtgcaccttttgtttctgttatataatgtgtagattatagaattatataatatattatcactgtattttatagcatatatgtcatattttatgttcatttacatatctaaaatttagacaaactagaataatattatataatgtacctgagctttgaagagcagagtgaattatagataaaaagatatatatagttgtgtacagcttttgtgtatgttttctataaatttatagcatgtatttatattagtatatagttagatatatgatgcaactatatatgagataatatataattttaacttgtttattataaagcataaatgtttttatagcattaacatttatttggttagtaataatagctaatatttatatgatgcttacaagagtcttttatcatctgtaaattggggacaaaaacagaatctacctaacggagttgttgttaagttcaagtatgctaatgcatgtaacataatgcctagcacacaacaaactatcaaaacagcagcttgtattgtcattattgcaaggtttcattgccaatagatggtggtaccctgatgtaaactaaatcagtctcatgccaaaacctatgcttttttctcaacataaatgaactaattgccagatgaatatacctggttccctttgatatactagataccaacttttcggctaactgataaaacagttaattttaggaagtgagagttatacactactattcatgtgtccctctttctttagaaagaatattcccatttctgaagtctaacttgtaccatttttcatgaacaactatattatcaaagaaaatttatttgaagaaaattgcaatatttctgacaaagagttccaaataattgttttcaaattgtttatagtgaaaccaacctcggttaagaaattaaaaataaatgcaaagttgacagaaaatctttaataatggttagataacacttacgatccatacactgaaattacattgcaatgacttctccatttcctgttttctttctttcctctctcaatttatttcacctttcttttctcatttttcttttattttctctttcagggatctctttccaaagacccattacagatgaacacctatgttgccttgtacaaatttgtaccacaggagaatgaagatttggaaatgaggtaaaaaccttctgtaaagaaaaaaaagagtaaaattttaaagtcagtatttctccatgtgaaaaagtaagtccatctgtgcccctcctaatgctttatagctgtgattctcaaactttagcatgtatctaatgacctgcaaggctggttaacacacaggccctgtccccagagtttttgattcatcagatctgaggcagggcctcagaagttgcattcctaaggagttcccaggtggcactgacaatgctgtccaaggaacacactttgggaagcaccactttagtacatgctcaacagaactgctaatgggagttttcatgaaggttgaacgttaaatgcacttggcatctggtggggcctaatagggaatcaaaaaatatatttaatcaaatatcagatagttgctgatgtgtggtgttatttctgaggcctctgttctgtaccattggtctatatgtttttgtaccagtaccatgctgttttggttactgtaaccttgtagtatagtttgaagtcaggtagtgtgatgcctccagctttgtgcttttggcttaggattgtcttggctatgcgggctttttttggttctatatgaactttaaagtagttttttctaattctgtgaagaaagtcagtggtagcttgatggggatagcattgaatctataaattactttgggcagtatggccattttcaggataataattcttcctatccatgagcatggaatgttcttccatttgtttgtgtcctctcttgtttccttgagcattggtttgtagttctccttgaagaggtccttcacatcccttgtaagctggattcctaggtattttattctctttgtagcaattgtgaatgggagtttattcatgatttggctctctgtttattactggtgtataggaatgcttgtgatttttgcacattgattttgaatcctgagactttgctgaagttgcctatcagcttaaggagattttgggctaagatgatggggttttctaaatatacaatcatgtcctctgcaaacagagacaatttgacttcctctctttctatttgaatatgctttatttctttctgttgcctgattgccctggccagaacttccaatgctatgttgaataggagtggtgagagagggcatccttgtcttgtgctggttttgaaagggaatgcttccagtttttgcccattcagtatgatattgggtgtgggtttgtcataagtagctcttattattttgtccttccatcaatacttagtttatgagagtttttagcatgaaggggtattgaattttattgaaggctttttctgcatctattgagacaatcatgtggtttttgtcattggttctgtttatgtgatggattatgtttattgatttgtgtatattgaaacagccttgcatccccagatgaagctgacttgatcgaggtggataagctttttgtcgtgctgctggattcggtttgccagtattttatgaggattttcacatcgatgttcatcagggatattggcctgaaattttcttttttgttgcatctctgccaggttttggaatcaggatgatgctgacctcataaaatgagttagggaggagtccctctttttctattgtttggaatagtttcagaaggaatagtaccagctagtctttgtacctctggtagaattcggctatgattccatctggtcctgggctttttttggttgatagcccattaattattacctcagtttcagaacttgttattggtctattcaggggtttgacttctttctgatttagtcttgggagggtgtatgtgtccaggaatttatccatttcttctaagttttctagtttattggcgtagaggtgtgtatagtattctctgatggtagcttgtatttctgtggggtcagcagtgatatcccctttctcatattttattgtgtctatttgattcttctttcttttcttctttgttaagtctggctagcagtctatctattttgttaatcttttcaaaaaaaccagctcctggattcattgatgttttgaagggtttttcgtgtctctatctccttcagttctgctctgatcttagttatttcttgtcttctgctagctttcaaatttgtttgctcttgcttctctagttcttttaattgtgatgttagggtatcgattttagatctttcttgctttctcctgtgggcatttagtgctatatatttccctccaaacactgctttaactgtgtcacagagattctggtacattgtgtctttgttctcattgctgtcaagtaacttatttatttctgccttaatgtcattatttagctggtagtcattcaggagcaggttgttcagtttccatgtagttgtgtggttttgagtgagtttcttaatcctgtgctctaatttgattgcactgtggtctgagagactgttatgatttccttccattcttttgcatttgctgaggtgtgttttacttccaattgtgtggtcaatattagaataagagtgatgtggtgctgagaagaatgtgtattctgttgattgggggttgagagttctgtagatgtctattaggtctgcttggtccagagctgagttcaagtcctgaagatccttgttaattttctgtctcattgatctgtctaatatttacagtggtgtgttaaagtctcccactattattgtatgggagtctaagtctctctgtaggtctctaagaacttgctttatgaatctgggtgctttacatattgggtgcatatatatttagggtagctcttctggtggcattgacccctttaccattatgtaatggtcttccttgtcttttttgatctttgttggattaaggtctgttttatcagagactatgattgcaactcctgcttttttttctttccatttgcttggtaaatattcctgcatccctttattttgagcctatgtgtgtctttgcacatgagatgggtctcctgaacaaagcacaccgatgggtcttgactctttatccaatttgccagtctgcaacttttaattggggcacttagcccattttcatttaaggttaatattattatgtgtgaatttgatcctgtcattatgatgctagctggttattttgcttgttagttgatgcagtttcttcatggtgtcaatggtctttacaatttggtatgtttctgcagtggctagtaccagttgttcctttccatatttagtgtttccttcaggagctcttacaaggcatgcctggtggtgacagagtctctcagcatttgcttgtcagtaaaggattttatttctccttcacttatgaagtttagtttggctggatataaaattctgggttgaaaattcttttctttaagaatgttgaatattggcctatactctcttctggcttctagggtttctgttagtctgatgtgcttccctttgtgggtaatccaacctttctctctggctgcgcttaacattttttccttcatttcaaccttggtgaatctgacgattatgtgtcttggggttgctcttcttgaggagtatctttgtggtggtctccatatttcctgaatttgaatgttggcttgtcttgttagtttggggaagttctcctggataataccctgaagagtgttttccaactttgttccattctccccatcactttcaggtacaccaatcaaatgtaggtttggtcttttccatagtcccatatttcttggaggctttgtttattccttttcattcttttttctctaatcttgtcttcacactttatttcattaagttgatcttcaatctctgatattctttcttctgcttgactgaaaaaaacaagcaatggagaaaggattctctatttaataaactgtgttgggaaaactggctagccatatgcagaacactgaaactggacccctgccttacaccttatacaaaaattaactcaagatggattaaagagttaaacgtaagacctaaaaccataaaaaccctagaagaaaacctagggaataccattcaggacataggcatgggcaaagtcttcatgactaaaacaccaaaagcaatggcaacaaacgtcaaaattgaccattgggatctaatgaaactaaagagtttgtgcacagcaaaagaaactatcatcagagtgaataggcaacctacagaatgggagaaaatttttgcaatctatccatctgacaaagggctaatatgcagaatcgacaaggaacttaaacaaatttacaagaaaaaaaccccatcaaaaagtgggcaaaggatatgaatggacacttctcaaaagaagacatttatgcagccaacaaacatgtgaaaaaaagatcctcatcactggtcattagaaaaaagcaaatcaaaactacaatgagataccatctcatgccagttagaatggtgatcattaaaaagtcaggaaacaacagatgctggagaggatgtggagaaataggaatgcttttacactgtttatggggctgtaaattagttcaaccattgtggaaaacagtgtggtgattcctcaaggatctagaaccagaactactaccttttgacccagcaatcccattactgggtatatacccaaaggattgtaaatcattctactataaagacacatgtacacgtatgtttattgtggcagtcttcacaatagcaaagacttggaaacaacccaaatgcccatcaatgatagattggataaagaaaatgttgcacatatacaccatggaatactatgcagccataaaaaaggatgagttcatgccctttgcagggacatggatgaaactagaaaccatcattctcagcaaagtaacacaagaacagaaaaccaaacgccgcatgttctcactcataagtgggagatgaacaatgagaacacatggacacagggagggtaacatcatacactggggcctgttgggggttggggggctaagggaggtatagcattaggagaaatacctaatgtagatgacgggttgatggatgcagcaaaccaccatggcacatgtatatctatgtaacaaacctgcacgttctgcacatgtatcccagaacttaaagtataattaaaatatatttatatatatatatatttaatctccaaattaacattgatagaaaaatcaaactaaaactatcagagtcaatcaggaactatccacttggtggtaactgaaatactagatagaataggtgagccttgtgaccttctcaaaatctaaaccattctcttaccacagcttgaggttcctcgtgtttcaggggttgttaagctagagtcaattctgggttcacatcctacttgttgtgtgaccttaagcaatttataaacatctcatttctctgatttctttatttataaaagaataataatgatctcttccccttaaagtatttggtgagactacaatgatagaaaagaaattaaacacattggtgcctataatcataaacactcagcaacgagtacttatcacagtttttataatgtggtgttcactggcctatctcaaggaaaagacttctgcttccatgcattcatgaccccaaaatgtgagtaatctcatgacaggggtctctgtgttttcccatcctagagcaggatagaaaaggctacttttccagtcaaatggtcccctggaggttcattctttcctcttctaaaaaaaatgcggagataaattagcactcaaaactatttaattgccagagcattgggaaaatagaccacatttggaggtagacgccacttgtctgaatgctgtgccagccaaattatcagtcaccagtcactctcttcacatggcttctggaaagcctgcctctccacactggagcgacctgggctttcccaattcttctggtttgtgtcatttcccacacatggtccaccacctcagtgaaattacccttctcctctttcacctacccaaactcttataaatagtgagagccactgaaatgcttcagttagaccctgtttcccaggctccatatgctatcaggatcggttccagcagctccaccacacctcatggtggatataatatctagcaagacatcatagcagatttatttatcctgctggagtctcacaactctccctggctcacaccctgaggtcagctttgtttcagaattaggttgagatctgctgccaggtgattcttgggtctttccagaaaaaagtttgggggcctgagtcctggctccttagatttgtagagacaattaaggtcttgtacatctgagttttctctattgctgagtaaaatcgtcatgctgaactcactggctgaagttgtaaatattacctgaacagtctagcataatcagtgggagaggaggagacgggctttatcaagtaaagccgtgttctgttacagacatgacaagccctgtgagccagagcagagcctgcctagaattcctcgctgggatgaagccatgccttcagcagatgacccacaattaactatctgctgatgaagacaagggtggcatatatttactttgcaataagtacaccatattgggtccttttgagattgtcatttgggtgtgtaacatttaagatttaacagctttctattatagagatcctacagctttatattagaagattattctgaagtcataacatttttttaaaaaagtaatttcagaaaaaaaaaagaatgttactgggataatgaggaatgatgtctagctgcctggtggtggtcatcactctgcgtgcttattttagttggttgcaggccattagaagtcaagttgtctggtcacgaatgaaacgtttacagtctgcttcaaggcaatcaggactatccattcccaggagtgaaatgtctgcattgcatagactgcaagattggagtgataaatcacacatacttttttttatttttttgccaagagtttgtaggttcccattataaaagccaggcacttgatttagaatgtgtaaggcaatcctttgggaatgctttgggattcagcataactctttgaatgaactggagctttgtgaattacctttttctcctcagatcataaggtagaaaaaaattccttttaacaaaatagcattcttatccacccaccttctgatccaggggagtacactgggtattgacctcaggaaagagaacaagggagtgagggtacaggaaatgttaggagtgtgagcttgaagacaaagacgacccaactggcaaagacagcagttgtcaatcagagcagatgaatcatcacatcagcaaatattcattatatatctgctcaataataagaaaagcttctaccaaaggccaatgctccagacctctccccgaacctccagattcacttacccacctgcctaccccagcaatgtacagagcatcgcagctctgccctctcttccacaaacctgccccttaggatgaaagatgtcaacctctgcccaggcctcaagccagccagggagaggactcactctacttttgcccaaaatgtatttgatgctcaattcctactcttctctttgcctaaaatcaactgtatctatccccaccttcatatcttacctggactgttgtaaaagagctttcctggtctctgtgttttcagtcttcctctcccttcctatctactatgggtgatagtgcactaaggtaacagtacagtgttctgggcttcatctcatctttggagtcacacagaatgattcacatcccttctctactttctaataataaggcttactaactaactttctgaatctgttttctcatcttgaaaacagggataataagtcctgcccttaccgcccttagatctagcatcgatgtgattatataagatagcaatatctggtacatagtaggaccttaataatattaattccagtcagttcttttttgtatttcaaaagtagatgcttcctttccagaattaaggagggagagagggagcaaaagggggggaggggagaagagagagagagagaatatatgagcattcactgaatgtttaagaataaaaagtgtgggcatcagttgacctgggtttaagtcctagccaagccactgtctagctgtgtgacccccatgaatcctgaaaaagttaccctaaccatctgagcttctgcttcctgacttgtaaaaggagataatcactttgcctgccctaagtctgctcgaaacacacatatttgctcaaaactgtccaatgtcctcccattgccctggggtaaaatctagaatatttatggggactccaggacccacagtctcatccatggtgacctctctgatccatctacactggccttctttttttttttttttttttttttttttttttcacaaaaggaccacaccgcccacttgccaaaggatttttcttcctgcagagtctgcttctccctccatcctcctacccacaaccatcaaacacacacattcacacacacacaggcacactcttccagttgactctgattcatgcactagatctcaggtcaaatttcatttccttgttgcagcctttcctgttaccctactttggattacattcttctgttatattctttcatgatgccatagttctctcaaacacttatctctacttgtatttatatatttctggaattatttggctagtctctatctctcctgtaaactccatgagaacaagtctgtaattactaaccctcatatccctagagcatgagctcattcttgaaacatagtagatgcatagtagataataattatttgacaaatgaatgagtattgtggagattaaatgaactaatgctatgcctggcatatacacttagtgggcaaatcaagtctatgataatataatggaaactgtaggccgggcgcagtggctcatgcctgtaatcccaacactttgggaggccaaggcaggtgtattgcctgaggtcaggagttggagaccagtctggacaacatggtgacaccccgtctctattaaaaataacaaaaaaattagccaggcatggtggtgtgtgcctgtaatcccagctactcgggaggctgaggcaggggaattgcttgaaccagggaggtggaggttgcagtgagccaagatcacgccattgccctccagcctgggtgacagagcaagactctgtctccaaataataataataataataataataatataatggaaactataaatgaggaagcaaaccaagctgagggtggttagtcagggggcctgtttcctggaacagatgggcctgagcctaggataaatgttattcatcaagaagaaattgtaaagggggaggccaaaagtagcctgtggttccattcacaaataacaatggttttaagacaacttggaagaagccctgctaagcctttactgaagctctcacagctgagaggaagggtggcctcagagagtataaaccataaactgtttgagacaggtctcagtcaatttagaggtttattttgccagggttgagaatgtgcctgggaaaaagagatgcaagctacagtaggataagtggtctgtgctttttccaaaaagggttttgaagacttcagtgtttgaaggggaaagggcatcaggaaggtaaggaggaaagaaaaaaagtggggagggtaggtagtgagatacgtgatgacattcttgtgagactttgattaatgctcactgaatccacatgttacaagtgaaagcgggtagaggaacagtcagttacccatttgtctggtgttcagcagtaaatctgcattttacataagatatgaataaacacagagtagaggaagcagtcagatttgtctcaggtaggtggagggatgctttctagtcttgtctttgtcctgtacctgtgaggaaaagctgttaacttatattgtcagggtgagattcaacagaactctgttttagggtagagtttggggcccacaaggaatttccttgtgagcaatttgagggagcccacctggggagatatgtggccttctatctttgcaactatccgtttaggaacaaaaaggaaggcagttgttgcgtgactcagatcccaagcttaacagtttttcatttttctcctttttttttttttttttttttttttgagacagagtttcactcatgttgccctagccagagagcagtggcgcaatcttggctcactgcaacctccacctcccaggttcaagtgattctcctgcctcaggctcccaagtagctgggattacaggcacctgccaccacgccccactaatttttgcatttttagtagaaacggggtttcatcatgttggccaggctggtctcaaactcctgacctcgtgatcctcccgtctcagcctcctaaagtgctggtattacaggcgcgaaccaccgtgcccagccctcatattttccctttgacatagtgagcttagagtcctgagattttattttcctttcacaagaggaagagctggttgctgccctcttgttcttaggtgagtgaatacttttcttagaagtgccatggacccatcattagtctccaaatcccatataaaggcagagactttatacagtctcctttgctacagttccagtgcaaaataaacttcctttattttttttcacactgccatgaaaaattagaaataaacttcctttataaattaatttgctatttcccacctaaacctctggaggtaatgcagaccatgataattctctatctttccaccatcaagggcagagagcaggacagcaagctggcaagacagaaaagagaaatttctggcagtcagataggcctgggtctagtttccaactctgacactatctgtgtcaattttagcaaactgtttaatcttttagagcctcagttttctccttcctaggaagactgggtattaaacaggataatataaataaaatgtggaatttcatgcccagtacaaagtgaggtcacagtagattttagataccttctcttcataattacatcttttcacaatgtattttctctcctagtcttctgaacaacctcattaacaccaccctaaggatatagagtagagaaaacacagttaaagactctccctttgagcaggcccaatgagaccttgtccaactggtccagcaaaaaggggctgtgatatccaatatttatcttgggagcaggttttgcagttgctgacatgatgagctataatatgaaattttatcactgatacccaagctgtgatgccatcatgcatggggtctcgaacattgctgacaatttgaggcctgataacattaaagggctacccaggttctcctatcagggtatagcagggtggtatagtggataatctcctgaaattaagagtcttggacaggttccaccaattacccttattatcaacttttttgaagagccctgaaaattacactttatggactgccagtttaattcatgaacaaagctcttaaatgctgctaaaaatacatggccaagtgcagtggcttatgcctgtaatcccagcactgtgggaggccaacgcaggtgtattgcttgagcccaggagttcaaaaccagcctgcgcaacatggaaagacaccatctccacaaaaatagaaataaaaaattagccaagcatggtggtgcatacctgtagccctagctcttcaggaagctgaagcagaaggatcacttgagcccaggaggttgaggctgtagtgagctatgaacacaccactacactccagcctgaatgacagagctagaccctatctatctatctatctatctaaattaattaattaatgaaaatagaatacaaactggagaaccctattataatcagcactgttgtcattattatcatatactgctctgtgaattaacatagaccatatgtcacatcatccttctggccaagtgggtgtgtacatgtgtgtgatacacttatacatgtaaataacctcccacacacactcacagtcacacacacacacatacatgcacatacacacacacttatacacattcaagtacacattcattcacacacacacaagcacacacacattgttagccaaagcttgataacccacacttagttttgatgaaattaaatcctgccttcaacacttacaacgtaaccagtcacattatcctcactgcttttgggctcagcagtctgcaaaacagagtcttggagttatcacttattattcacaccaaggcaccttttttaagctgataaaaacttttcaatcaacaatgactttcatgactttgctgagttgatattttatgtaaataatcagcagatataaatgacttcaagtaaacataaactcctaaaacatcttagggacactgtaacaaaggattgagagtaaataaaagatttaaaggtttaaatgcatattttagcaatcatacaatgcctgttccaaataattaattttgacttcccacatctaaatcattttcgtttttattagctctcctcaaacagatttatatgataatggccatttttcataagggtagaaaaaagaaggaaaaaaaaagactataagccaagagaggaaaagagggaactgctctttcagtattattaaatcctaaaataaatacaaattaattactacttcaatgtatgtcagaacacctaaatttggggggcttcaaagaaaacctatcttcttttgtaacgccaagtgcaaatttagattcatgaacggccgctcctggaagcagcaagtctcagattctccatgggcaagtctgaatgaaagcaagcaatcatttctcccattagttagtatttgccagaatttctggagatgggatggcctgaattcatctctttggggtattttcaaagcactactttaaaaagagttaaaagtgatgtgaactcttgtatgctatttccaggatttacttcatctattcacctctcatcgcatgatagccaagcatctgctcttttctgggagaaccattcacaggccctgttctcaaagagctcaggcagtcatgggccaggggaccagcagaagagtagatcagaagttacaatccagtgtgcagggctgtgggtgtgaggtagcccaggtaacttacagcagcctcaaagggacgtgaaagaagctgggattccagaaggaagaggggtcatgggtggctgggaagccttgttagtgagcagtcactctctctccagtgaggaaagcataagggaataatggggttaaacttcagaaccagataattactttaagaggtgccaaatcaggggcaaaggcaagccccattacaaaaagaggtggtgaaaattcatggcagaggcaggagcatatttagataactacattaattccagtcttgattctgaaagactgccttaaaacttggcaatgcttagtgaatggacgcttggctgtttagctcatattccagtgagaaaatgtatggttcttttttctctttctggaggtgaggtaggagaaccaagcccaataatttacaggtagaaaatggaagcttaggactagaacccttggaggtgactcccagtccactgatctttctcctccaccacacttttgatcctaggttcattgttctaagttttctctctgataaagctgacaattctattttaatcagcaagagtaggtaacactttatccctttttggcccctcacatcacttattttaagtgcattaggtttgttaagtatggttgctaagaccaggaagtttgtgatctacagagcatgttactgagaagtcactccggttaaaggataattttttaaatttaagataaaaacatgactctcgtgcaatataaattgaacacatgtcagaatttttacatggctcattaattaatgagagaaccagtaagatgctccaccttgttcaaatgagaactcaatatatcacatatacataggcaatgaggaatgctgacaggaatttacaaatagatgcaaaaccagtcagtagtcacaggataaagggtaataactgactatattccaccaggcaaagttcacttgcatttctttggacaaaaatcatttgcattaatatcagttttctacgacttgcttgagatgtaaaatagctcaaaggcattgaaaaaggggaggtaatctgaaaggatatgccagacgggacatccagatcagtcatgttttttgcccatttcaaagtctttcataatttttcctagcatcctcttgagttcttttaataaatctcagaggttacccaagcaagtagtatttcacagaggagaaaacttgagttagaatggttaagtcacttgttgcaagccataagaatctcctaaaaaatattattaaaatagagattcctgggcttcacctagacctagagagtcaaatcctacttggaaatctgtatggttaaatgtcctcctggattctgattatctgcactatctgagaacaactgtgacttatccaaagataggcagtgggccagtggcagactcaaaaaccagaacagaggtttcccgattctgtcaatgctctgtgcacaggtctgcattggctttctgacctgtgacttgtgtacattctaatgtccttcaccctgcaaggtttcaaggcagagtaagacagaataaggctcccttggtgtctcgtttctattctctaagtacattactgcttggcaaatgcatcaacttaattaaaactaaatgtaattctaatgcaccaatttgatttaaaaataatcttcacagtcaccaggacatcaaaatgcaattaaggctatttgaggaaagtctctgatgcatattatgctctgatgctgcactatgtcaagaaacccagatcttcccaaatgtcactaatgtgtttagcagcctccctctcactcaaatgcctctctcatttaggttctggagagcgtgatccatgacagttcaagaacatttaccaaattccttccaaattgcccttcagttgaatgcttttctctgagctggtctatggacttgggaaagtgcaggcagtctcgtggatatcaggcttaagacaaaatcaaaatgcaaattcaggagttccttattacatacccatgtgccaagactgtaaaagattctggaccaagataatgtaaattgggaaataagtctggtgaaaaattaagtcatagatctaagattaatggagccatttggctggctcctttttctgcccccttcagcttggtttttcaagggtatctatttttgctgagtgactggttgctataaacttgatttaaggttcgttttgcctaatgaatgagaaagggcaggaaatattaaagaggctcaaaataactatatagtaaagtgggcagttctgatgagttttgacacggcatgggtggtgcaagaggcagcttgatttagtggagttagttatagattcaaaccttgcctgtaaatggtgaaatctctcttagcctgcctacttgtatgaaaatgcaactgttcatgacaacatttagtgaacattgccatcgccctctaggctcaaccctgccaacatctccattacaatcagccacctgggtaatagaatactaggtccagctcctgggccctgatacacctttgtggtcactacgtggagtggacaaggaaggggaagagggacagtatgaagagagggagaaggttttccatagctccgaatcacaccaaatgttagcgtctgaagccactgaagtcaaggctatttcattaaccaaccatccctgccaaaaacctaatgagacataaacgtaaaaggcaatgattagaataaatcttctaatttacaagtggaaaaatgcaggtttacatgaaaattagcaattttaagccctactgtatatcaatcacagtgataaagacttaactttgaggccaggcatggtggctcgtgtctgtaagcccaacattttgggatgctgaggcaggaggatcatttgaggccaagagttagaaaccagcctgggcaacatcgtgagatcctataaaaaattttaaaagttagctgggagtggtgtcatgtacctgtagtcccagatacttgggaggctgagcaggaggattgctcaagcccaggaggtagaggctggagtgacccatgattgcaccattgcactccaacctggacaacagagtgagactgtctttaaaaaaaagaaaaaaaagatttaactttgcaaagtaaatatagctcacaataatttatcatgcataatatataagtatataaatataattgagatagccaatcctcaaagagacatgtatttgggatttttgtttgggatcagttctatatttgtttgtcatctccccaccatgctagcatttgcttctccctcagggatgacccttactttaaacagtttattgtctttatcctttgaaattactgacatcttgaaggcagtaactatgtctttacaataacagccaccatctaatgggcgcttatctaaatatgcattacaaatattttgtcatttagtcctcaaaaaatattgatggggtaagtgctattatcctaaccttacagataagaaaacccaggcttagataatttttttgatttttgtatcccccaatgcacacccaatacctgatgttttataaacattcagaaaatacttgaatgtcatagagttttcctaggataaatgagcagaaatggaggagtgagacaagactccttttctttgaattttaaaacattcagaaagcaaaggccctagggcattctgcttttaccatgtgcttcccaaagtagggccaatctgaggtctcaggttgtctcagatagtagagaaaatgtttctctcagaagcagtgtcctcatctggagggtgtcgtgtctcctctcctaggaatttgtgctctacttggggattggagagaggctgggctgggcgggggatgcctcagggcaactcatactccttcctccaagaccccaccctggaagatcaaaccatctttctaacatcttgcagaatagttccatgtagctggccaagctcagctcatatcattcataccctttgtgtacactgagtccctgcagacagtttacctggtggtggaagagatggttccaatgcccatatgaaaaactgagaaataagagagacaggactgctgagaatgaacccagaaagcaaccattggttctcacgcacatgtgtgcaagtacacacacactcaaaattaaaccctgtcctcctcactggtaagccataattctgtagttgcttttgttattttattctaattcttgtgagctcacagccctttcaccatttcaagagttcctataaatcattatataactaacttgcaaatcttcctctgggcctatggcaaattttactgagcaaacaaaagcaaaaggccagctgtggtgctctgacctcttttcactaaaggaaactgatgcttgaattgtttatgaattgcattatactttacatcatggtatacaattgtggattacaatgtaagcaaaacctttacctgaatgtacaatgctctgattgaactaagcaaaggaaatgttttttaagtaactgggggcccatcaagttggtcccaagaatttggaaatagagttaaattgtaaactctagacgtaatgtatcaagaacataaagtctcctaaaagcaagagaataactattaagccagagaaggacttttctcaaatgtgcctgtagtgtgataacctgaatgaagaattattccatggaaagggcctgacagccacagaagcatgaaacaactgagggcagagtcatggattagccaagtctaacctggggaaaggagaattttaagcattaggccaccattcctttgggaccaatggcacggctctccctaaattgagccagttggcagaatgttttcatttgtttctttgatgacatcgcacaacacaccaacaccatggcaagagaagataactaaattaagaaagggttcagaagaaaactcacagttgagagtgaagggttgccactaagggcaacacagaaggttgctgtgggagtcagggtaacaggaagctggagctacagtaggcagattatgtatggcaggctgtggggtaggctaggtttccaggggctccctgtagattgattaatttgaataattttcacaggttccagggcacaggggatgtcccacattatctagtacctggctctagaatgggacattaggggtggtacagagtggcccagagtacaagagcccccatcaaggagttgttggggtgcggacttagtcagctgcttaagaaggggaactgaccagcctccagctagagcctcaaaactgggtcaagactaatttttaacaaataataataagcgggccaggcgcggtggctcacgcctgtaatcccagcactttgggaggctaaggcaggcagatcatgaggtcaggagttcgagaccagcctggccaacgtggtgaaaccctgtctctactaaaaatacaaaaatcagccaggcatggtagcgggcgcctttcttcccagctacttaggaggctgaggcaggagaatcgcttgaacctgggaggcagaggttgcagtgaactgagatagcaccactgcactccagcctgggcgacagagtgaaactccatctcaaaaaaataaataaataaataaaatatatgtatataaaaaataataagctatgttacacagagtggtttcatcttgcatgcctactcagatccaccacctagagcccagtgttgaaaaggattctaaatcagaaggcaggctctgtgggaaagagtgctgagattgttgggtgatgcctggaaggatatgggggcagtaaaaaatcccacaagccacagatttgctggcctagatgttagagagttactaccttggattcaagggctaccctcgagcaagatcctctctatagtgaaaaagaggcattagctatctctgccaggtacttagagcgtttggctaatctcaagaggagtctactggtcctttttggctacatcttctaacttccctcatagtccttatgccaatttacaattatatacttaataattatacatatgtgatatgtttattattagtatctatttattaagtttttttatctatttacttgtttattgtctatctttctcactatactattagctctagtgaggattttattcaccagagtaaacccagtgcctagtaagatgacactctttcagagcccacattctataaatatttgttgaatgagtgggtaaacaaaaaccaaagaaataataaatggataaataaatcactcaccaagcaattttctgatcctggtggagctcttttttaggaaaggacagaaccctcatcacacttccagaagtatgtctggtatttctcataagattatagcctgttatcccagtgagtgccttattctaatgtgtaattcagttaatgagggtcaagtgctggggactgtccacctctaggcacagccaagagtgagtctctcagtagactataaaaatagaggtcggattgaggcagcaccctctttcacccttagggaaaggtacctcccacagtctgcctctttcactcttagggaaaggtacctcccccagctttattccctatttacagtttctgccagagcagcagcaaagtcattgtgtttgatactgactcatggtttcttaggttactggtttaaataaaatctgctggggcttagaagatttttctacattgactttcatccttgctgcttaattaaatccctgacctgggaaagagtgattttcagccacctcgctttctgcggcatcagcatgaaactgtgactgttgaaataccaaaatgccagttgtgcttaatgctgcagatgtgacaagcctgttatatttggaatccctgatgaagatagatattaactgagaattgaaaatgacagcaaaggagattggatcagaatagcaaaatgaatacgcaaatctacttttgctccaattcctaaacatgtcagaaaatacattttttttaacacatctataacagtactagaaaacaagaacgcatgctaagagagaaccagaaatcttgggaatttcctcgcagactacagcaaatgcagttgaattgtgaacaatgaagatgaccagagaccaaagaatactcaggacaaaacagctatagaagggggagcacatttaaagagacccggaatgcacaggacttcactgaaaagcgtgagagtctgcagtggattgattgcattaatggccctaattattcaccccccctccccatattcatgcccctgtcatgggactttgcagttcctcccaaaacagaggtggatggagcctgttaccctatcccttgagtctgaactggccttgagacttgctttggccaatgaaatgaagcaaagtgacaatgtgtcagttctggatctaagccttagaggcatcatgtgctttgcatgtttccacgcactgctcctgaactttgatcattgctatgaaactgaccttccaaggaatgagaaatgtggaatagggcaaagtcaccccagtcacctcagcaaaagccagccaacacccaggcctgtgagtgagccattggggttttgtggctgtttatcacacagcattactgtgacaatacataagtgatacagtctcaactgtattcatagcaccgcattactacttataatgaacaattggcagcaatgatgttgaactccagaattaagccaacacctatactctaaagaaaaagaacccatgcctaaggagggctcttatgtgagcatagaagcctgggaaataagaactgtgttgagataactctggaccttcagaccttctagagggcatggaaaaaaggaaaaggcagctctacttaggagaaaaataagctgaccttttctctcaccagtggtaagaaaatcctccttgctacagctattaggataggaggaggaggcggcaccatactgcttatctgctatacgttcaagtatccaaaagggaggagacgcaccaattgacacacgctgctcccttaaacagagcctgtaaatagcccttgcacttgaaagggagacccatggcagaccataggtatagaatagcggagaagcctgtccacatccacctacctccattttccattttcagtctttcataaaaagagataaccaagaaacattagattttagaaaaaatacttgacataaaaaagaagtaataagataaaggataggccaactaatttcagaggaaacaaatattcagtaaaagaaagaaatattgttttgaaaatataataatctctatacaatccattataacattgcatccatgatggaaagccactttcagaactctttcagaaaagaataaggaaataatgagaaagaaagaaaaatttcagaaataataaagaacccttagaaactatttttttctaaaaatgttttctgaaaactttttctaaaacaattctcagtattatgataaataatagaagacaagcccaaatacaaaataaatgatcaggaaaataaaattgagaaaaaaatttaagaacatagaggaaaataagactgtaagtgtgtaagaaagacaaaaaatgtgaggatggattcagaaggtccagtatgtgttgacaagaagttccagaaggaaagaagagagaacatcatagatgggagaaaaacatgaaagaaatagtagagaaagttttcccagtgtgaaaaataacagccttccaattgtcacagctgtgttgaatagaaagaattaaacaacaaaaacacattagtcttcagccaaacccaagtaattcttgatgaatgatgtagaatgttgacacacacacacacatgcacacatacacaaatctagtacaaaactccaattacaccagcataaaagatggcagacaggaaaaatggagctaagcaaaagtgtgctaggttttgagagggtattgggaaggtgtagataatgataaagataatgaccaattctagatgtcaatactaaacaaaaaaaatacatgaacatatctatgtataaatgtaagtgtgtgggaaggagtctagaaggacacacaggggacgggaggtagatcatggggctgagaagaagggagatttgtatcttgaaattttggagcttcatgatcatttatgtatcaaactacaggtaacagttatttttggctgggctggatgactcacgcctgtaatcccaacactttgggaagccgaggcgggcagatcgtgaggtcaggagattgagaccatcctggccaacatggtgaaaccccatctctactaaaaatacaaaaatgatctgggcatggtggcagatgcctgtaatcccagctactcgggaggctgaggcaggagaatagcttgaaccagcgagtcagaggttgcagtgagccaagatcatgccactgcactccagcctggcgacagagcgagactctgtttaaaaaaaaaaaaaaaagagttatttttaaaatacagcataaaatcatgtttgccttcaatgtgtaatacagctattttcttggtaggaagaactggtaaaagttatatttactttatttctatttcttttaagactatttgtgtaaatgagaaatgattactcctgactttaaagtatgttatttttctttttttttcctttacctaactcattcattcttcattttaggccaggagacataattactcttttagaggattccaatgaagactggtggaaagtaagtgttcctctttctttaaaaaaaaaagagaaaatcatttggtaactattataatacatgctacaattgtggatgcatgcctcctttttcctttcaggggaaaattcaagacagaattggcttctttccagccaactttgttcagagactacaacaaaatgagaagatttttagatgtgttagaaccttcattgggtgtaaggaacaggggcagataacactgaaagagaatcaggtgagtaaaccacacaaacacattccagatatgagccaaatagggtgtcattttaataaacttaataatatgtataaatctgaatgagtggggtcacattcaaagtattcactttgagaaaagatatacttactccaatgatgtcagtgttgtaggagctaaacatgcaaactaaaattttaggaatctcacttggtgatacctgttcataaacgaaacgtgatagtggcaggcgacgacatctcgtcccccatgctcttctcagaagaccaccggtctctgatgtggacagcttctctcatttgggctctgagttagcgtccaacaaaggtgtggttaattcttcagtgctctctaacaaatacttcgttattagttgttgctattaggaacctcttgggttttcttatctggactccaagtctctacctattcactgaagcccataacaccttcatatcattgcaaaagacacggactaaatttagataaccagatactatctcaggctcataaatgaacaatctctgtatgtctaatctagaggtgcctgtcaccatcttgctccagggccatgttgaatgtagagttctctttgatgctgtcaattttcctgagaagtaaaatgtgaacccccacatttgtatgtctttaagctccaccatctcatggctggaatgttgatagagacaaagaaacagcattctcacactttagctctctggcctactcttcctgtctttgtcttccagcagagagaggccttcctaccctgccttcttctctgactgcagctcccctcaggtcatgtcctgtgtcctcactacagagtaaaataatatgcttggacttacggcagggctcggtggctcacgcctgtaatcccagcactttgggaggccgaggagggcagatcacgaggtcaagagatggagaccatcctagccaatataatgaaaccccatctctactaaaaatacaaaaattagctgggcgtggtggcacacatctgtaatcccagctacttaggaggctgaggcaggagaatctcttgaaccagggaggtggaggctgcagtgagccgagatcgtgccactgcactccagcctggtttgttcttgatatattagtggaggatttggggaattaaaaatttatttcctctcctaataaagtctcacagaggactttaattttcaactttggaagtcaaaaatctttcctctgtttctttctgcattcttggtataagaattttattatttcccaaggtaatgaatgcctgaagttgaaattgataaggctcgccctacaaggaagttcacaatgaaaaaggcattaataattttaatacatctctgttcaacagagttgccgaaaacacatcttgaatgccttttttaggattgcctcaaagatagtttctaagtcacacaagaaaatcagtcattaccttaaaattatagctatttgtaattttaaaaattgttttgtcccacttaatcaaccattgtatagtccacatgtagctttaactgactttatcattttcaaactaacaaatatatcctcaaagaataataattcaccttttcttttttttttttctttttttttttttttttttgagacggagtttcactcttattgtccaggctggagtgcaatggcacaatctcggctcacagcaacctccacctcccaggttcaagccattctcctgcctcagcctccggagcagctgggattacaggcatgagccaccacgcctggctaatttttttatatttttagtacagtcaggatttctccatgttggtcaggctggtctcaaactctggacctcaggtgatccacccgcctcggcctcccaaagtgctgggattacaggcgtgagccactgcacctggccaatttaccttttctttatggctattcaaaagaatctttaaaaggaaaaatctaaagaaaaatgataatatggaggacagcttttttaaaaaaatgtaactcaccctccctttaaattcaagtaaatgaaaatcattgaaaacaagagaccaataattctgagtattattttccctatatattttaacaaaggtggagatggagtcattgaaactggcactttcataaatgctgggagacattagtccactcatttggttactgatttggtaccacgtatttagagccatgaaattgctcaacttcatgaatacagtaattccattttctgtaatgtatccaagaaaataacctaaagtaaacagggggagactttatgcaaaaagacagtcatcagagtgatattcatgatggtaagaattaggaacaattgcacaaacaacggaagtgattaactcaatgacaatattttctttaatggacaacgttaggaccctaagcaattttgatggtgttatgataatattatggaattggaatagtggaatccgaacccagatcccagtcactgttctcccaagataaacacaaatggagagatgcagacagggcctgaagccctgttttcattcatggaaccatagtaaaccagacagagtaccagatgtgatctagagacctaagaggtctcaccacagcccacccaccttaccaccaccaccatgggctggtctgaatctgaggatctaatggtaccagatgccccatgggagaaagggagcagaaaggactgtagcaaaactggcataagatggcccgattccctcccagaaggaacaagagaggaggaagctttaagagacagtgagaaacccctggcacctgtggtgcaattagatcttctgcctttggagaagtgaggagagacctaggagagagggcagatatcttcaaatattgtgtcaccatcttaaatgatcataaaccatgaacaaataaatattaatgatacaatggtagtaaaaaacttaatggctttgttctcttccatttaaattactttcatggtatattttacaaaaataaaatttaaaagtagcacaatttaaaatattcaattttgtcttttgaatctaataacataaaggtacacagtgttgctgtggttttcctgggcctcaactttgcacatgtgtacacaaatgcacacacacaacacacacatcaccatatccaacaattgctatatcgaattacattatctgctgctgcttatatagatgcaataaccccaagaggtgtatgccatctaacgatttttggttgttaaaatctctaatatccttaggaaattgggtcactgggctctatggtttcaccctggttttacagttttacttgaaattgacatacttcccttttataaaaattgcttatatgatatgcccactttaggacacattgcattttgtaaattgcacaagctctctttcatccagttgcttgtagacagactctatgtttaaaaagatcaaaagtcatcaatgtgctgacatgaaatatacctcactcaagagcacccgatccttcattttctgcccaaagttgtttgttccccctggggctgttatttgccaacctatcacttgcctgcacactccccaaagaggtaacagcagaagccagcatctgcctataaagagcagtggcatccaaagattccccttaatgacaatacccctggaaacctactacccctacccctggaagactgcactgaccactctgtctcccataaaagtatatgcaaaccccacatgactattcctttttggatgtgatgacctgttttggggtctgctttttgaaagagaacattttatctctagcccctggctcacagaaaaggaaagaacaaattaatactgtcttaaacattgtcacaataataattgttataagaatcataattattagtcattatttaaagtcatacagacacactgtataaataaagtttatacacatgccctgtgaattttatggattcattatttctattttataaatgagaaaacaaacactcatagaggttatgtgtcttgctcaaggggcaaaagcctagtaagtgtccagaatggaacataaacacaggtctgcaaaccccaagtcaaggctttccactagccatgtgcccttaacaatgtggaaagaactctgaacagtaaagagcagcttggttcccaaggatgaagagtgtcataaaggaagttgtcttgggaccaaaagactccttgaatacaagttcttgctcatgtgggctccctattgggtcattcttgattccaggcacaggcatcatcatcagactgacaccccatctctgatgcgatacacaactcgcaaagcaaatgggcacttttcccagcttgattccatgccaacacttcaaccttccccaagtttacccaactgtatccttcctgttccaaaaatttggaaagtctttgaataaaataaatttgggaagaatgttcatctttattggcaaagtgttactcaataatcttgctagcatgtttttttttttttttttttttttttttcagaataatcttatgctttcccatttgaggtcaaacattgtttttatgttattaaaatccaatcagtgaaaccagaaggcaaattaaaatttgctcaagttgatcaatttctacaagcagaacatctgttcagtgactcccaccaattccttggcatattccccacaattttttttctgggactgggcctcatacctgcattctctgccctcatggttaaactgaatctgctagggtttggggtgtggaggaggtaaggcaaacaattcagcctcttcagctagacacgttcaagatgcaacagagcatttcagcctgaacctggaaccaaatgagtctgctcataattattgtcttcttttattttaggttcaggggtacaacatgtgcaggtttcttatataggcaaattgcatgtcacgggggtttggtgtacagattatttcaccactcaggtaataaagatagtatcaattttttaaatacatcagccatttcaaagaaaaaaatgcttttaaaaatcaattttagaaacaaatttcaaaatttgtctccactttagtgtcctaagttattttaggttgaagatttcaaaatatgcttgttaattgcagggagtatgtaatagaaagagcacagatactagtgtcatacagaaatggatctatatcctgtgtgattttgacaaagtagcctctgaatgtcaaccttctcatcagcatagtagcatctctctcttgaacttgatgtgagagttaaatgtgctcacctatataaagccttagcacagtgcctggccaccacaaatgcatagcagaagtcattttcctggctaccgttatcactaaagagtaaagcctaaatgaggaattcatctgcagtggttaatgccacctaaacttacccagtaagcaccagaaaatagccaatatgatatttataaccctacaaatatgaagagacaaatggacattaacaagaaaataaaagaaatttgattctaaagataaatgcaatgcacatctttgattaaatcacattttctacttctggggttaatctgtctcataattattgtattttttttttgcagagctcttgtttccaaatatagttatccatttgttatgaacacaatgagagtttgcattgatacaagtatgttttctgtttcctcctcctccttttcctcctcttcctcctcctccttgttgttcttcttcatcttctttttgtgaggcagggtctcactccctaggctcaggtaatcctcccacctcagcctcccaatcaactgggaccacaggtgtgcactaccatgcccagatgatttttgtatttaatgtagaagtggggttttgacatgttgctcaggctggtctcgaagtcctagactcaagtgatccccagcctcccaaagtactaggattacaggcataagccactgcacctggcctcttcatttttaaattttaaaatgtatccttattaaatcgactttaaaataccataaaacatttctttaatgggaataacattgaatctataaattactttggggagtatggccatttacatgatactttttctttctatccatgagcatgggatgcttttccatttgtttgtgtcctctcttacttccttgagcagtggtttgtagttctccttgaaaagatccttcactcgccttgttagctgtattctaggtattttagactctttgtagcgattgtgaatgggagttcattcacgatttggctctctgcttgtccgttgttggcgtatagtaatgcttgtgattattgaacattgattttgtatcctgagactttgccaaagctgtgaatcagcttaagaagcttgggctgagatgatggagtttacttgatataggatcatgacatctgcaaacagagacattttgacttcctctcttcctatctgaatacctgttgtttctttctcttgcctgattgccctggccagaacttctaatactatgttgaatagaagtggcgagagagggcatcttttttgtgccaattttcaaggagaatgcttccagcttttgcccattcggtataatattggctgtgggtttgccataaatggctcttattattttgaggtacgttccttcaatacctagtttattgagagtttttaaaatgaatggacgttgaaatttattgaaggccttttctgcatctattgaaataatcatgtggtttttgtctttagttctgtttatatgtgaattacatgtattgatttgcatatgttgaaccagccttgcatcccaagaatgaagccaacttgatcatggtgaataagctttttgatgtgctgctggattcagtttgccagtattttaccaaggatttttacatcgatcttcatcagggatattggcctgaagttttctttttttgttgtgtctctgccaggttttagtaccgggatgatgctggcctcacaaaatgaattagggaggggtccctccttttcaattgtttggaatagtttcagaagaaatggtaccagctcctttttgtacctctggtagaattcagctgtaaatctgtctggtgctgggctttttttggttggtaggctatttgttactgcctcaatttcagaacttgtgattggtctattcagggattcaacttcttcccagttcagtcttgggagggtgtatggccattgacattcttcacagaattagaaaaaaaaactactttaaaattcttatggaaccaaaaaagagcctgtatagacaaggcaacctaagcaaaaagaacaaagctggaggcatcccgctacctggcttcaagctatactacaaggctacaataaccaaaacagcatggtactggtacaaaaacagatacataggccagtggaacagtatagaggtctcagaaataagaccacacatctacaaccatctaatctttgacaaatctgacaaaaccaagcaatggggaaaggagtccctatttaataaatggtgcttgggaagtgggctagccatatgcagaagattgaagatggacccctttcttacaccttatacaaaaattaactcaaccattcaggacataggcacaggcaaagacttcctgacgaaaacatcaaaagcaattgcaacaaaagcaaaaattgacaaaggggatctaattaaactaaagagcttctgcacagcaaaagaaactatcagagtgaacagacagcctacagaatgggagaaaattattgcaatctacccatatgacaaagatctaatatccagaatctacaaagaacttaaacaaatttacaaaaaaaacaagaaaacaaaaaacaaaaaaaaaaaaaccccaataaaaagtgggcaaaggacaagaacagacacttctcaaaagaagatatttatatggccagcaaacatatgaagaaaagctcaacatcactgatcattagagaactgaaaatcaaaaccacaaagagtaccatgtcactccagtcagaatggtgattattaaagagtcaagaaacagcagatgctgatgaggctgtggagaaataggaatgcttttacactgttggtgggaatgtaaattaaaccattgtggaagatagtgtggcaatttctcaaaaacctagaaccagaaataccctttgacccagcaatcccattactgggtatatacctaaaggaatataaatcattttattataaagataaatgcatgcatatgttcattgcagcactattcccaatagcaaagacatggaatcaacccaaatgcccatcaatgaaagactgaataaagaaaatatggtacacatacaccatagaatactatgcagccataaaaaggaataagatcatgtcctttgcagggacatggatggagctggaagccattatcctcatcaaactaatgcaggaacagaaaaccaaacactgcatgttctcagtcataaatgggagctgaacaatgagaacacatggacacagggagggaacaacacacactagggcctgttggggcaggggcgtggtggggtagtgagagggagagcatcaggataaaaatataatgcacgtgggcttaatacctaggtgatgggttgataggtgcagcaaaccaccatggcacacatttacctatctaacaaacctgcacatcctgcacatatatcctggaacttaaaataaaataaaaatttttaaaaagaaaacaaaaaatactgatctaaaaagtggactttaaaatacttaggaaaattaactaagtccataaattgaatatttatgtggaattcagtctattttactctagttgaccaaacattaattaaagatcctcctgaaaaaaaattatttaaattgatgcatagttttattgcacctatagaaccattttcatttattatttgtgttctatcaaagctttaaaaaaaaacagaaaaaaatattttatattacaaaaccaaaatgcatttattttggagaaaatttgagggaaaatatttttaagaggtataaaagataaaatagagaccataagcaattcaaccattaaattattaccaacataaacactggcatatttcatgtcaaacttttaattcatattttgatatcatatcctctttagtttcctaacatttaaaaaatttagtcattaaatgtttatcaaaacacaggttttaagaaagttttattagaacatagctaaatttattcatatatatatggtctgcggctgctttcatgctacaactaaatagctgagttgagtcactgcaacagagaccagatggcctgcaaagcctacaatatttagcatttggccctttatagaaaaagtttgccaatccttagtctagatgtacaggaatgtgtttaagtttctcttgttattggatattcagagtttttatttttaaaactgttattgataactgcaatgaacatctctgaacataaatatttgtctctaactctgattattttcttaggatgtactttggaatttagcggaaaacagatcaagacgtgtacaattcttgatgcatactgccaaattgcattcagaaaggtcgtgccaacttacacactcacaccagatgttcatgagcatatccagatcatcacatgcttgcaagaatttaacattattattttttgttatgtcagtttgatagattaataatatttcatgctaatctgcattttctggatggttaaagaggcttacattttatctcatatatatagggcattttttaaaataatctatttatgtactttgcccattttcttacattatttaaaaagttttctacctttgaagaatatttatgtctgctgtaccacatgtgaccaatattttctctagtttatcatttgcccttcactctcaatgcctctttctccaggagcttaatcattctttggttggatcatttctggtttaccatgtttcctttatagttttagtgtctttattattttacacttctctatctctctctgattcctcccaagagactgtttcaagatagtcctcacttcactttgatttttctgaagtttcaattcagtctttcattgcttctaatacatgttagtttagtatttatttcccggtagacttttcttctcagtcagcccctttcttctacagaatattttcttttcttttctttaacttttattttaagttcaggggtacagtgcaggtttgttatatagttaaacttgtgtcctggggttttgttgtacagattatttcctcacctaggtattaagcctagcacccattagttattttttctgatcccctccatcctcccacccttcaccccctaaaaggtcccagtgtgtgttattcccctttgtgtgtccatgtgtcctcatcatttagctccaacttacaagtgagaacatgcagtatttttttggttttctgttcctgtgttagtttgctaaggacaatggcctccagctccatccatatccctgcaaaggacatgatcttgttgttttatggctgcttagtattccatggtgtatatgtaccccagatttggggtacatatattttctttatccagtctaccattgatgggcatttaggttgaatctatgcctttgctatacagcatgttttctttgtgtctcattgcatcatctctttacctcgagatattttctccttataacactgaggccaagtcttccttcaacctactgcattcagtatgtctgaaaggagaactctgagacatacatgcatattttctgtaatttttaaaatgttttattgtaatagtcttggtccttttatcctgtggtaggcagaataacaactccccaaagatgcccgggtcctaacctccaaaacttggaatatgttactttatatgacaaaaggaattttgtagatgtgattaagttaaagattttgtgaccagtagattatctggattatcagggtgagcccagtgtaatcacagagattcttagaagagggagacaggagggccagcgtcagagaaggagatgtgatgatggaagccggggtcagagagagagagagatttgaagatgctatgctcctggccttgaaggtgaaggaaggagctgtgagccaaggaatataggtgatgacctctagagctggaaaagacaaggaaacagactctctcttagagcctctagaaagaatgcagccctgccagcaccttgttcttaggacttctgaaccctagaactgtaagataataaatttgtgttgttataagccaccaaatttggggtaatttattgtagcaacaacaggaaactaatccagagtttacacaaaagggactttgcagatgtgatgaaggttatggactctgggatagggagataccctagattgtctaggtggaccaaatctaatcacttgagcccttaagaacagagaaatgtatctggctagagtcagggagatgcagcagaagaggacagatgaaaaatgaggtaaaagtgtaagtcaaagagagataaagtatgagaaagactcagcctaccattaatggatgtgaagatggagaaaggggaccacaagccagaggatgagggtggcctctagaagctggaaacaggcatctcagtcctccagccacagggagctgaacgcagcaacatcctaaatgagcctaaaattaaataatcccctatagaaaaagcaaagaaaggaaggaatagagcccttttgactccgtgattttggccttataaaacccagagcagagaaaaccagccaagtccgctagacctacaaaactgtgatataataaatggtgttgtttaaggcttctaaatttgtggtgatttgttacaacagtaatagcaaatgaataaacatctcaagttacaaaaatcaaactcaaacttaaagggtctattttactcctataataaagagtctgatagaggtcagttcttgggttgataattcagtggcttgatcctctggtcagagaaccaaattcttccacatttctgctaagctatccttgaaatgatagctacgtcccctagtggtcacagatggctgcagccactccaggaatccttccagacaaagaaagattttcttcctaaggcatctcttttaataggggggaagaaaaaaaaaactttcccagagtttccctagcaggtatttcatcttgcttcattggctggaactaagttctatgtaaaccactaagaatcactaacaaggaggacagaaacaggacttggatcaattaaatttacctaagtcacataggatagggatgggcaacagaatgaaaggcaggactctgcttcgtgggaaaacgacagaaatgaccatgagtaccaatcatcagtgtttgcctcaaggttttagttatcctagaacagtgagtgattgatgcagaactaaggttgcccagctgaaatggtgagtgaattagtctggctccagctcagtttccacaaaattcaaaaaccaatgtagaggacatggatgtgtgatcaggagtctaaaatatcaaagatggaacactgaatgttaacatttaactccaaagcaaggacctccaagccattaaagagtctaggctctggagaatgagattgggaggaaattgagtaaggcattcgaatccagaagaccgtaaactgcctgtgtcccatactaggaaagcaaagtttctgagagatgctgaggagctggccatagctgagctacatggttaggtatgtgctgggctggctagagatgggatgctgtgtatgtgaggtgcctctgctctgcatatgctgcacttaccttggtgttgggacatccagcttaccactgctgcatacatgatgctcatgtcaacaagctggctggtcaggtcaggatttatcagtatgggaagaaaatttgtccagctttcaggaagtctctttatgttagagagagggaggaaggatggagagagaatgggtggcaggagaaaaaaacaggacagataaagatgggaagggaaaggaggaaagtcaagggtaggggagaggagaagaggaaagggaagggaagagaagggaggggaaaggagaatagaaagaattgttttaaataaatctgatcaccttattcctccaattaaaaccttttaacacctgtttgcccttttcccatgctgcagagccctgattttgttctgttgtccacctatatcttaaatgactcaggcaatgctaactgaattgatcccattctccttgtcggtgatgactttagtggtttgcttgtggcccaattctagtccatgagacagatcagaaggtcagccaaaggtcttagcagaatttagcgtggcttgcatttcctgcatactctaggctctgacagattttgtggcttcatcttacacccattagtccctccatctctctgttctggtacactgaattttttccattacttcaaagtgtcccagtctcttgaggctggaatttttctgattctagtcttattttcctccttcctacacctttttctctttctttaaatatcacttcttcaagaaggtgtttcttaccccattggctagatcaggtttccataagtatttccattagtactcttttctttattcattaagtcatgcaaaaaaatattatgttttatgttgtcagtcagattactaaatgttgtccacaggacaatcagccatcaaaacagccacagcccttgcactcaccacattgttgatttctcaataaatgtcagctgggacagctgtacccagaaatctctgtcagggatccgtctgtcttgtattgcactagttccccagcatttataatggtatctaacacatagtaggtactcaataaagagttgttgaatgagtgaataaataaggaaagcaggaaattgaggatccttaggcaatgaaaatatctctaactgtacctgatgagtaaaacatttctgctagggagatcaactgttcaattacagtttggaattgaagggttttgaaggacttaggactttcagtgctaatattgagaatgtcctgagcaaaccgagacaagttggtcaccctctatttatggccctccaaaccaaaagagttcccctgtcctcactttccactcttttccacctgtaactaatcttctgggaagatatttccattctgcctctaaatgaatggaaatgtttcaggctctgccattgtttcctaaaatggtagattctcaaggctgagaggttatgtattttaccatcagaattttaaattctggattcctcatttctggatagagtcaaagcggctgaagcctgtgttcagccatttgtactcatcatcttcaaaacttctcatccgtaaaaaggtctcccaaaatcaaagcactttagagatgccaaacaggaaggttgaaaataagccagtgcattcaacaaagcatgaaccattgtgcttcttggcttcctatttcagagacacttccgaacaactcttccacagcctctagcaagcaatgtttctcttctacataaaaaccttgaaagagaagagaaaaaagcaaaggtctatcttatatataggcacatatttgaacctcagtggtgtttttgctccaagaactgaaattcgttcttcacagagataatgaaatgctctgaaaatgacccaaaagacattttttgggtcagtccaggttttgtttgttccaaggcatggagtaatggtgtaaggctcttagctctggccagaatttcaatgttctgactccttgcccagtattctcactcttccacattaccacaatacagcattcttgtgtgtatatgtcaataaattgttttcaagtttgattttttaatttaaatatttaaattcaacatgttttcatggttcatgtttcacctagaaccagcatactcaaagggcgggtgtttatatttttattgatgctgactggtaggactcatattaagggttgttgaattttgacacgtagaagtaggtgagaaaacacactctttggcaaattataaaggtaaatcctcctctcaaggcatttttgtgtgttcttccaagacacactccctgctcatcactggagcctccccctttcagtattactggcatgggcaatggcaggtctcagctttgccacccaggctggagtgccctgatgtgatctcggctcactgcaacctctgcctccaaggttcaagccattctcctgcctcggcctcctgagtagctgggattacaggcatgcaccatcacacccagctaatttttgtattttttgtagagatggggtttcacgacattggcccggctggtcatgaactcctgaccccaagtgatccacccatctcggcctcccaaagtgctgggattacaggcatgagccaccgcacccggccaggtgtctgcatttatttatttatttatttgtttatttatttattttgtggaggtacaagttttcattctgattagaccctattattctgagggcaaaaactatgttttgtgctccctttgtatcacctaggtcatctggtactatgttgggcatgtatttatttatttattttatactctaagttctgggatgcgcttgcagaacgtgcacgtttgttaacaaacatatgaaaaaagttgtaggtctcagcttttgaaaatcaagtattccatcccttttgaagtcatgtcaagggacctaacatgacccatcagctacttctctcacaagtgacccacatctgctcttcatgaaacagtcaacacatccactactcttacaaattatcttctcttcacttcactgtctgagcctctatctagtcaagtttctcacacagtagatctctgaagcacgagtcagataccagtccattgtatgtcccaagctccaggagtcacaaatcaagctctttgagtgtcctattcaagccccttcttctacatgatggaagagcccactgtggtggcttctgttggagccttgctcagatccctttcaccaggtgggtgcactcatctcccagttgctatgttggccacgaacaactcacagctgcccttctcagggagggccttatgagacagcaggaccctctctcctggaaggttatgcccatcacactacaggccagccaatggccaatgactgactgacatggggttcaaaagtctgaaaccctagcttcaaagtgagacaattctgtgatgcaattcatgctccagagctcccaggcgaaccaagctagactgctttccagctgaaaacctctcattgctgggctccttcccctgccccatcctgcatccctcacttcccacctcctgagagcacccactcaataagtcacttgtacaaggaaccctgtgtcaggttctgtttctggggaatccaacctaagacaaggcctgtcatccatggaagcaggtgaggcaagagaaactcacaacacaacaatagttctgttcataaacctcttctaattttcatctgcccacatccacccttctatgcccttcagtggccaatgagtggtgagtggcaagagtatccaaatgaatgtttaccaacccctttttaaagtctagcataggtggccttactttagaatatgggaaatgttagcatctatttgcttgaggccaggagtgaaatagttccctttgacttcctgatgttatatgaggtgcatataaaattctgagcacatgacaggagtctgctgaatgatagctattattttggtcctttaaaataatgtcctgagaattcattgcatgccacatgctaggctccttgacaaacattattatctcattctgtcctcacagtgactcttcagagggtcacagtactattaatcctcattttattgatcctcattcataaagctaaatttcagaaaacattcaatgcctgggcctcattccaaacctaggtttttgcctaattttttatcaaacctttttctcactgtgctggtttcccaccctaaaactgctctcccttttccagtttgttgctcctgcaacctcagtcagcagggattcaagctgcaggttctaacttcgttcttgctgacagtaaagtattttgttttttttcttccttggcattcagatctgcgtgagttctgaagaagaacaagatggttttatcagagtcctcagtggaaaaaagaaaggcctcatcccccttgatgtactagaaaacatctgattgctggctcctcctccgtttgcagtaggcaagctctgctgcgatgcctctgcctcatctcacactgcgtcaacccaaaggagctgccgcactgacccagccccccaggaaacagtgagacaagaatcaagtatctgagactgtggagtaatagccacaaaacagagggcccactgcacagcatatccaggctgccacaggtggggacgaggctgagagagtcagcaggcagagccagatgccatgcttggcagcagcagtaggactataaaccacagctgtcccccaggatcccactcctttcctgtctgtgtggtgtaagttaacacactggagtgtgctccagtttgcagggtagcccagtgcaaggttcagatccatgtagctaagtattatcctgcttccagacctatgtcaccagtaccaatcagtcagtgtcatcacatttcaggccccaagcaatctctgtgcaaagcatcagaaagacctgcttcccagcccccagcattccagtgctctccaggcttcctctctttgtgattgtgctgtccagagtgtccagcttgttctttctttctcttcagtcctctgagtacatctggtggtgtgcattagatgtgagggctatgttgacatggcatcacctccaaagacctgacctgcctaaagactgatgacaggccatccttcctgctgttctaggtactggcctgggtgacagagcaggacatgagacatagatacagtggggaggagaagtggggaaaggtggagcagagagttcttacttattgaagattatacagccctttcggttatgaagtccctgcttgaaggcaatggacctggggaagagactatcacaaaaagtctccattttcattttacatcctctctattggaggcagcacttttccctcatgctgtcctataggactccactttgaaggttgtgcctacgttgcagggaactaggaacatggaggggaaccaacaacagcatcttagaagaaatgtagccaaattggagtccattcttctttagggcagtatatgaaatcctagcagatgtaaaatggaaaagaatcctaatgcttcttccttcagaaagtagaggaactaggggcccaattagcatcatctaggggaatctctattactctgtacttatactaatgtttacaagaatgcaatatactgtgatgccttcctactcaagcctcctagcattcaaacttccatcctattagtcattaacatggttaaacttcaattcacaatcaccttggaatcaatgtcagtttgatttattttgttacagagcaataaaatcattagaacaatggtttttaaaagacttaagtggatgcatcctatgcatgtaagcattatttcccaaaccaaagcatcattcatctccatttatttcttttgttcccgctcagtgtgaagttgggaactgagaggggatggctgctggtttcacagaagtttggatgccttactcttatcttaaagccagcatccagaatttcctccctctctgatgccacatgcaaaaccaggtgtacgatgtcaagatggattctttgagagccagggtagatcatatgactgcctttctgtaaaattggatgcctagtacaaatgctctttgcctctaattcagtattccatttaataaaaacaatacagtggctggaaaggagcatcag

SEQ ID NO: 36798 - DNA, 6024 bp, Homo sapiens
tcctgggcctctcaaagtctgagccccgctccgctgatgcctgtctgcagaatccgcaccaaccagcaccatgcccatgactctggggtactgggacatccgtggggtaagcgagggtcctctggtgggtgggacagggggcggaggcggggatgtgtggagtagctgcaggactggctctagggaccgttcctcttcagggctgcccgcctcagaagggcctgtgcatgacgctgtgtgtgtgtttgggggtgggggcgggtagaggaggcgacgggtacgtgcagtatagactaggggctggcctggtgcagagaaagtcaccaagtcagggaccctccatctctgacccgagccgcgggccatctctcccagctggcccacgccatccgcttgctcctggaatacacagactcaagctatgtggaaaagaagtacacgctgggggacggtaatggcaccctcgtgtccgggccctgcccactcacgctgagttggcaccaagcaacccatggtggccacctgtggctgcctctgcaggcctcccctgctggagctgcaggctgtcccttccctgagctcccgtgagtgagccctctggccttgcaaggcagaatgctggggcgggatgctggacaccctgtctaattgggttgggtgtccctcagagcttccctaaaccctggaagccttagccgttgtggggtccagagccctcagtgggattctttctccctgaaccctgggatgtgggactgagtggtcagattctagatccacctgtctcagggatcttgccactggctccttgggagggtccccgggaaggagggctgggctctggggaggtttgttttcacttcttccccaccacagctcctgactatgacagaagccagtggctgaatgaaaaattcaagctgggcctggactttcccaatgtaggtgcaggggaaggggcggttttgggggaaagtgcgacgtgtctctgactgcatctcctctccccaccttagaggtgttaagatcaggagtcttctgcccaattcctctcactcttggctgtctacacagcccttgcatgatgttctgtgtcccagctcatttattagtgtgacagtatttctatctcaggcctgccatgagcaggccctggtctcctctctgcccttgcatatgggaaggggatgctggggagcctggtggcccaactgagcttccccggtttcccatctatccagctgccctacttgattgatggggctcacaagatcacccagagcaatgccatcctgcgctacattgcccgcaagcacaacctgtgtgagtgtgggtggctgcaatgtgcggggggaaggtgacctcctccttggctgggctgtgatgctgagattgagtctgtgttttgtgggtggcaggtggggagacagaagaggagaagattcgtgtggacattttggagaaccaggttatggataaccacatggagctggtcagactgtgctatgacccagattttgtgagtcccacaccccactcccagtcacccatttccctgccttttggcccagaccagggagggacttccaaagtcaggtctgtagcagactccggccagctgactggagacgtctataacctggttctccaaaatgtccacacgaatcttctcctcttctgaagattcttgtggacattttggagaaccagaccacggacaactggatgcaactggtcatgatctgctaccacccagagtttgtgagtctccccagtgagctgcacctggcagagtttggatttggggccaggactcttgcattcctgcacgcactggtcttttcttaagtccttggtaccactcatcctccaagtgctttcccatactatcagcagttattctcacgactccaatgtcatgtcaacaaaagcagaggcaattcccaccaatcttaggacacgatccaggcatcccacggtggaaattcaattcctagatggtaaaatttgtgttcagaatctccttcatctcctctggcctctggcctctgtcatgggtcatttctgtcagttgatttatatcacctacctgctcctagaatatacagactcaagtacaagaccaaggaatgtaatggcaccctcaaattgcatcttctcctcaaagttttccaagtgctgtcattgacatgcaccgggatctgcgcattttcataacagacagctcagaggcagccagagggcctttattcctctccctccttcctttcaacttgaacttctcatctccctggaaactagtcaatgttcattgttttcttctgtcaccccattagaaggaactttctacttctttccctgagctcctttagttctttgcatccttgattctgcccctgtctggatccagaggctgccaggtgctcgggcgctcatgcggctgacccagaggctattgggaggccagtgaggacagattcaggaagagcatctcattctgatcacttcagatagggtctggcacccagtcagagtctaataaatgctgatgtatccaattgaagcctgggcactgccccggttttagttgtggggaagatggctgcttgcctgtggccagcctgggccatctacagccctggggaggccacgtctgtgcagggagcttttgtctgagggtggtgacagctgttttctgcctcaggagaaactgaagccaaaatacttggaggaactccctgaaaagctaaagctctactcagagtttctggggaagcggccatggtttgcaggagacaaggtaaaggaggagtgatatggggaatgagatctgttttacttcatgtgtttcggggttttcagcccacacattcttggccttcttcagatcacctttgtggatttccttgcctatgatgtccttgacatgaagcgtatatttgagcccaagtgcttggacgccttcctaaacttgaaggacttcatctcccgctttgaggtgatgcccccatcctcctttctctttgatgccccttgttcctttctctcctttcagatgctttcccagtcctggagctacacaaagaataactcgtatgtattgagtacgggcttcatgccaggaatcatgcccagcacattatacctatcgtgtagaatttgaaatttccaacattcctacagggtgacagaattatcttgcccattttagagataagaaaactgagaatgagagggtcagtcctttgctcagggtcccagagccagtggaggctgtgctgggctccctgtgagcctctggatctatgggtggcagtcagggctctcccatttgtgacaaaaggagaagcctcaggcctcatccagcctgggtttcacagcccagaacactttgaaagaggcagagcacttcaggaccacggatgcagctggcaatagtaggactgacacacagtggcattgatgttgagtactaaacctgcaggcagtattcatagccacccccagaagctttgcatgatcggacccccatgtggaaaatcctgagatccggagctgtggctggagctggattagggtacatatgtgggtgcccctgttgaagcagtgtgtgttgaagtgctctgtgctggggcactctccttctttatctttcttcctctctttttttccctccaatgttccacgtcttccccctgtgagatgagtagcacactgattttactcctattcaccgaccttctcctctgcatgaggcagggtgtgaggcacagtgggagttgcatagatgactgccccatcctggaaatgagtgcagtgagaggcctgcaggcagagcagcctgtgaggtgtgtgtggcaccacctgggtaccgggcctggggcctgcccctcactcacggggaaccatccctcacctgtgttgaagttgtttgagagcagcaaatcctactttagtacagatttggggatttgaggcattagtccaacaggcttctgagcctagaatctgtttccctttcccactccccatcaagaaatctgcttgctcagctagttcccatcagctctggttctggtccagcctgagcagccttggggttatgtaagaggtggtgggaggggagcggtggggaacagccgagggctggggcatggagcctgcctgggcctggccctggccctttggggagagggagccctggatctctttgaattctttagaagttacatggtcattgaatcctggtaagattgtgtgcagcacacctgagtgtcatgtggcctggctagcagtagtagggctggagatgtgatgggggcacagggacatagggagatttagctcaggtaccaggtggagaagtttggactttatgctttaatgggaatgattagagcctggtctggccttcctttggtggttcacccttaccctattcagtttcatccaggttttgctaagtcattgggtgagatctgtgctctcttcttggctgcacaggtgtgttctgagcccctttgttctgctggaggtcctttctgtgtgtgcaatcctaggcaagccaagaacctccctgtgaaaaaggagaatgtttgtgccgacaaggagtgacaggatctggcatggggtgtggctgggtggaagaggaggagaatttggcaaaaacatgctagaactgaagacagaaccaggctatattccagccctgtcccacttactagctatttgagtgtgaggaagttgctgaacttctgttcttctatatgagaaacggtgataatagaactgaccatggagggtagtcgagtggattttctaagcctgtgttgtaatttctgttggatataaagcacccagcacagtgtagatctttcgtaaatggtagctgttattatggtataacattacttaaaggaagttggaagagttaacttagaagagctggggacctaagagaccgtgtgatgctccagcacttgagcccacatggaaaggctgtggccagggccctgacctgctgtgcctgcagcaaagctacttgagcccttctagacagcagacctggctctggccccttcttcccgccctcagggtttgaagaagatctctgcctacatgaagtccagccaattcctccgaggtcttttgtttggaaagtcagctacatggaacagcaaatagggcccagtgatgccagaagatgggagggaggagccaaccttgctgcctgcgaccctggaggacagcctgactccctggacctgccttcttcctttttccttctttctactctcttctcttccccaaggcctcattggcttcctttcttctaacatcatccctccccgcatcgaggctctttaaagcttcagctccccactgtcctccatcaaagtccccctcctaacgtcttcctttccctgcactaacgccaacctgactgcttttcctgtcagtgcttttctcttctttgagaagccagactgatctctgagctccctagcactgtcctcaaagaccatctgtatgccctgctccctttgctgggtccctaccccagctccgtgtgatgcccagtaaagcctgaaccatgcctgccatgtcttgtcttattccctgaggctcccttgactcaggactgtgctcgaattgtgggtggttttttgtcttctgttgtccacagccagagcttagtggatgggtgtgtgtgtgtgtgtgttgggggtggtgatcaggcaggttcataaatttccttggtcatttctgccctctagccacatccctctgttcctcactgtggggattactacagaaaggtgctctgtgccaagttcctcactcattcgcgctcctgtaggccgtctagaactggcatggttcaaagaggggctaggctgatggggaagggggctgagcagctcccaggcagactgccttctttcaccctgtcctgatagacttccctgatctagatatccttcgtcatgacacttctcaataaaacgtatcccaccgtattgt

SEQ ID NO: 36799 - DNA, 54149 bp, Homo sapiens
atacgactacacctgctccggagcccgcggcggtacctgcagcggaggagctctgtcttccccttcatctcacgcgagcccggcgtcccgccgcgtgcgccccggcgcagcccgccagtccgcccggagcccgcccagtcgccgcgctgcacgcccggggtgaaccctctgccctcgctgggacagagggccccgcagccgtcatgctttccgccatctacacagtcctggcgggactgctgttcctgccgctcctggtgaacctctgctgcccatacttcttccaggacataggctacttcttgaaggtggccgccgtgggccggagggtgcgcagctacgggaagcggcggccggcgcgcaccatcctgcgggcgttcctggagaaagcgcgccagacgccacacaagccttttctgctcttccgcgacgagactctcacctacgcgcaggtggaccggcgcagcaatcaagtggcccgggcgctgcacgaccacctcggcctgcgccagggagactgcgtggcgctccttatgggtaacgagccggcctacgtgtggctgtggctggggctggtgaagctgggctgtgccatggcgtgcctcaattacaacatccgcgcgaagtccctgctgcactgcttccagtgctgcggggcgaaggtgctgctggtgtcgccaggtgagccccgaggatcgccctgccctggcaccagggcttctcggcgccttgactgacgagccacagcgtggcataaggggttcgcagagggaggttcagatcggaactgtaggtatagaaaaaggttggcagtgtttccttgaatcgcaaataatgatcttttaggaccacctgttgtggaagctgataatgtgctaggttctgtgttaagcactctacaggcagtgtggtttttaatcctcacaatgggtaggctttgttataggacttttatagatgagaccactgaggtcctgagaggtgaagcctcatgcccagccatctatctccaaattccaagctcttaatcaatacttataacatctgcattaaaatgcagaggatcttgagtgcgaactctagtggatccagaggggctcttctcacctctgctgcttgactggctgtgtgatcatgggaaagtcacttctcctctctgtcccttggtttgctcctctctaatgaggcaggcttcaatgttgcttccagctctcaactgctgttagcatcctgtcccctccctgcagaacaaaggtgaccccacctgatccccagggagaagatactggggatctgctacaggaccgttgtgagcccccactgcatctatcacaatagtgaccctttcagttctgtggttagctcctgccacatttcagccagacttgaaacagtaacttaagtgatgacaaggtcaggaagtgacagagaacctgttactcacagggctgatggctttcccctcccagagagcttgtctctgcacttgaataaggaccaagggttccttctctcagtcagtaagaagaggcctacacaggagtgggctgaaagacctgggtgacagggtaggggtcgagggagccgaggagcctcagctttctagaatgcatttctgtgctaagccctatagtagatgcttttattaccccgggagataacatatcactatccccaccaccaccaccaccattatacagttgagaaaactgaggcttaaaattccaacctagctctatccaacttcgaagccatgctctttcctacatcttttttttttttttttttgacagtctcgttctgttgcccaggctggagtgcagtggcgctatttcagttcactgtaacctctgcctcccaggctcaagcgatcctcccagctcagcctctcaagtagctgggaccacaggcatgcaccaccatgcccagctaattttttgttatttttggtagaaacagggtttcaccatgttgcccaggctggtctcaaactcctgagatcaagcgatccacccaccttggcctcgcaaagtgctgggattacaggtgtgagccaccacacccagcctctttcctacatcttattgttttcctctgcatggatgtaaactgttaagtgtgctggaagggatgaagtgtccacttgctctaccccttcatttcatagctggggaaactgaggcaagctaagcgggttacagaaagatgaaaggttaattcacttgtgagaaaccaggaatcttacacacctgcttcatgtggcatgaaataaataatccaaaaaatataggctttgtataaaagtttaaaagcagaaagccaaattttaggctgggcgcagtggctcaagcctgtaatcccagcactttgggaggccgaggcaggtggatcacttgaggttaggagttcaagactagcctggccaacatagcaaaaaccccgtctcgactaaaaaaaaaaaaattagctgggcatggtggcgcgtgcctgtaatcccaactacctgggaggctgaggcaggagaatcacctgaacccaggaggcagaggtttcagtgagccgagatcatgccactgcactccagcctgggggacagagtgagactccatctcaaaaaacagaataaaaaaaagacaagtttaaaggtggctaaattatttggaagagatggtcctttcaagaaaattcccattaatttctagctgcctgagaaaagcgataacttcactactttgtaactagaagactctcctaagcctattactttaccagcttgcttggagggaaattattaacacagtgatctttgtaccacttcaggaagcatttaaattctgtttatcactttagtatcccaggtcccctgagagggaggtcacagggtttggagttttgttgacaaagaagttcaggattaaatgaccataatacagtttgattctgcaataaagtcagaattacaaccagataccctcttcccacccagctaacagttgtctgccatagagctatgtgtttacatagagaatatatgggaatttctatattaaactcaaacgtgaaccagactttacagtggacctaaggcactctctggaccgtcaactgacctctgagggaggccacatatttgaaaaaaaatcagtttttccaaatcactgagatacctttgcacatgaagcaaaattacagtctgtcacagagttgcatgtttactaaacatgcccatgggaaaatatgttgaatggactgattcttagaattctttggtgttggaagggaccttagagatattctaaccctataatcctgtaagtttaatgaatgtgttatactttaaaaaaaaaagtttacagaagaaactttaataagcccaagaatcacctaggaagcttacttttttttttttttttttttttttttgagacggaatctcgctctttcgcccaggccaggctgctgtggcgtgatctcggctcactgcaagctccacctccctggttcacgccattctcctgcctcagcttcctgaatagctgggactacaggcacccgccaccacgcccggataattttttgtatttttagtaggggcagggtttcaccgtgttagccaggatggtcttgatctcctgacctcgtgatctgccggccttggcctcccaaagtgctgggattacaggcgtgagccaccacgcctggccggaagcttacttttaaaaacattctgaggctggacactatggctcactcctgtaatcctagcactttgggaagtggaggagggaggatcacttgagcccagaagttcgagactagcctgggcaacatgatgaaaccccatctctacaaaaaaaaaaaatacaaaaattaactgggcatgatggtgagcacctgtggtcccagttactggggaggctgaggtgaaaggattgcttgagcccgggaggttgaggctgcactgagctctgactgtgccactacactccggcctgggtgatagagtgagaccctgtctcaaaacaaaaaaataaaatttctgagatcatccccaaaaatgctgattcagtaagactatgttggggcccaggaatgtgtatttttataagaaaccccaccgccaaccctaggtgattttgaaacaaatggtctgaggactaggctttgagaaacagtctagtttcccattgtttttcattgttgtttgtttgtttgtttgtttgtttgtttttgagacagtctcgctctgttgcccaggctggaggtgccgtggcgcgatctcgactcacggcaacctccgcctcccaggttcaagccattctcctacctcagcccctcaagtagctgggactacagatgcccaccaccatgcccagctaatttttgttattatcagtagagatggggtttcaccatgttggccaggatgatctccatctcttgacctcgtgatccacctgcctcgtcctcccaaagtgctgggattagaggcgtgagccactgctactggccttctcattgtcttatagctgtataaacaaaggcctagagggatgatatgaattgcccatgatcaagtggatagttaggaacagaaaggtagagatagaacccaaatatttttttctcacttacgaggcactgtttattctatcacaccatcttgaacatgatacataaatgtcagtttgattccatattttgagtttcagcccagggcttgtggactagtaagagctcttgagctccatctgtcagtcaaattctgcagtatatgtaaaggaccagcacagaggcatttatcatgaggattgatccagttgttatgaatttgggggtttctttataacacttaacaggactcaaccctatcaggaatttcagtactcaattactcttttcaattttactatagttacagaaagtcaagactcataaacacttccctgaatcaagcagcagcactgtttcccagagaatatgactttctctctgttgtacatttcaggatcgttctccagggcagggtatgatctaggtaatcacatgggaaaattgtctccaaggataagaacctgtatcaatgttgtaactaataaaagccacatggctgggccagtagtttttcacccaactttccaaatacagaatatgggtaaaacagtaaaacatattttatttcacacaatatgggatattttataaaaacctacaaaagaggcctgaaattgtacatttgttccatttccatttatcctagcatcaagaccatcaataaactagctcttccactgggtagataacccaggtctcctgagggtcccttcatcagctcactggcagggtatacactgcctaactcaacacagccatgcgaggctcccacagtgtaggcactactcttatgcaaggctttagtaacagttaaagatactctctgttgcaaaactgagtcccaggtaagttataaaacgttccagattacctttgacctggttttgcaaggttgcagaaaacaaaatttgacctcctttaaacaatgtgataaaggaaaaatgcttacaatagctttcaaaaatattgcatcattaaaagctataagactgaagaacttcattacaaaacaagtgttgggaccaaggataacccttgtcatccaaacttttgagattagattgagaaaaactgatggtacaacaatttgattttcaaagcaagaaacatttagagggaggagaggccaccaaaaaaaaaaaaaaaaggagagagagtcccaacaaggtacaagctagttttctctgtgccatgatgggatggagaaataagatgaattagttcaaggatcttacagtccagtaaaagaactaaaccgcatgcacaaatgattgtgacacccagtagaatgtgctcagtgtgctgggagggctacaagtgctgcaggaaaacaagcagaggtcaagagaaggctttttggggcactgactattgagctgaacaaatgcagtgggggagggggcattccaggcaaaaggagcaccagaggcagttctgatcaggtgcttaaaacagtgagatgcttcattaaaggatattgcgatgtaagaacaatggcagtctggacctaataatagtcatttttttaagctgtttcctgaagggacaggaaatggaaaaaatagggactcagagagtccaaagaatggccaacagcagtggcctcacttccacagaaggaaatatttaattttctaatgccaactttagtccagaatcaaggcacagaaataatctaatctacactcttcccaactctttggactgcccaaggagtaacttaaatgagttgtttcaatgcactttgtctcaaaggcttagaattctctcatatatctttgaataattccctagtaatgtctagcacatagtaggcaggcagtcaataagtgtctgttgggcagggcacggtggctcatgcctgtaatcccaacactttgggaggccaagatgggcagatcacctgagttcaggagttggagaccagcctggccaacatggcgaaaccctgtctctattaaaaatacaaaaattagtcgggcatggtggcgggcatccgtaatcccagctactccggaggctgaggcacaagaatcacttgaacctgggaggtggaggttgcagtgagccaagatcacactactgcattccagccgggatgacagagtgagactgtctagataggtagatagatagatagataaatagatagatagatagatagatagatagatagatagatagatagatgcatacaaacatacatacatacatacatacataatggatagataatgtctgttgaattaatgggttccattattctggttgattgtgacaggctttctctcctgaagcttaaggaccactgggttgggcatgagggcctgaaaaatgatgtaacaaaatcagatgtgaaaaaatccatttaaactcaatctaccccaggcccagccttaccctaccacaggcttacttacctctcaaaggtcctcctaatcaatgactctgtccagctctctggcagtacatggtaggacagcggtgctctccttgggtctcagtgcagcaagtaagcaggtggtgagcacaggatgggctggaaaggacctgtgagtagggtggtggaggaccctgtacaaggacagaaacccagacaccaaatgattaatatatccaagggctgggattcccagcctagtagcccaaggaaagatagcttaaagatattctctaagatttttcttctctccctgctcttaactaaagcttgcaaaggaggtgattgtacatctccatccaagaacaaaactagcactttgctggcatatatgggaatgcactttattttcttcagaaacagggactgaagaggtaaaaacaaactctgaatcaggtgttgttattgaatctgaaagagaaggatagagttcagattattctatataataggtgctagtatttgaaaaggaccttcccacagcctctgagaaaagggaagtagatcattggtagaaagatgacatggttgcttacagatatcaaatgctaacaattatgtaaggccttatgtgacctggtaactcatgataaggaattacctttgattccagggctatttagaaagcaagagttcatataagcaagaactttaacttggagaaataaaaattaacatcaaggagattactacttaattacctaaatgtaaaatgagtatgtatttccttgttaaatttttgcttactcctggtggaacttaaacatttttatgacctccgggtgatttgtgtggggaagaaggaggagcacatgcatgtctctctctctatatatagtattataatgtgcatcatcttgctgtacaaaatactgtcattccaaactgccaatgattgagatgcaaaattacagttacaaatggcattttaggaactatttttaggttgtcttcaaggactatgttattaatagcaccagtttgcatttcagttgcttttctgaatgaagaaaagagataaatcttcaagcttgacttgctcatcaaccaaccatttcatgatcagagtacatttcctttcactaccttccttttggaccttaccttcttggtaaatatttctggggtgttttgtttaatccagtcagttactcattcactgaggcagtctagtagcagaacaagctactagactgaatgttttcctattggaaagctgcaggtttagcctgagcacctgacaccttagtaatgaagattgattcagctcaccacctacccaatctctctgccttctagcaatggacttgtttattcagaaaattcttcctttttccttaaaaaaaaaaaaaaaggcaggggcagacttaatatgctaccttaattttttaaaattttctttgaacagactttaaaggggatgggggagtagtgttgtaatcacttgatttttcaacacccaagtgtgtgctctttctctgtgggtttatttcagtctacaacttaaaactagactgatgaagaaccgactgatggagctgctctacacccttcaggcaactttctgtgaccactgtttctcatactcaaacttttaataaagcttgaggttttgctcttcaagaaaagatcatccatgttactcattaaatgcagatccacatgattgaacaagcactgagcagaaggccaagcagccagcctcttccaagaaataaggcactttgctagaacttaatctgaatggctcatacaaggaggtgggaacctcagaagcccagaatgattcttttcattttgcatgtgaccctccatacactgacttggtgagcctcttctcatttgtagaaataagattactggtatctatatcacagagttgttatgaaaattatgtgaagtgatgtatgtaaaactataccaacagttctatgcaaatgaaaattttaaatgtttgttattagtaaagagagaggtgggtgcatgctctgatgtgccacccagatccctgctttaggactgacggactcactcttcagctgctgggagctctcagctgagacctctcccaggacttctccttggttgaagagagacactttgcccaaggttaagcaccaccaccccagcctgagtccattggactggtcaatgggcaggtgtgaaggcacagcctacctcccttaatttaggaggtaactctgaagggcatcccaggtccagagtccccttaggattagaggatctgctgagggagacttctgttgtgactgcattacagttcaatgtctccctctatccagtctgcttcccttgcagcctcacaggtcccattcccaagagcactcctgcatgcacatctcggagtctcagagaacccaaccttgacaaatagaattataggagcttacatgttctgattgatagatgagcagactttacaataaaaattataaaaggtagatagatattttatgcttgcattagaaaatatgtaggccaaccaggcagtggctcatgcctgtaatcccaacactttgggaggccaaggtgggcggatcacttgaggttgggagttcaagaccagcctggccaaattggtgaaaccccatctctactaaaaatacaaacattagccgggcatggtgacagccgcctgtaatcccagctactcgggaggctgaggcaggagagccgcttgaacccaggaggcagagattgcagtgagttgagatcacgccattgcactccagcctggatgacagagtgagactccatctcaaaaaaaaaaaaaagaaaaaagaaaatatgtaggcccaaacatatctacaaaagactcaagaaaataaaagacattaaatatcaactagatagttgacaggtagattcacatccagaatttcctttcaaatttcttttttctttctacatctttaagggaagaaaggcttccatagtgtgtccagatatggttggcaagccgctggaaactcaagtctgcccaaataacaaatctacaccaacagcctagaggagatggaaggagatggtgtagggcaggggcaatggccctcccttcagattagatgacttgcataaaaggtcaggaatcacaaactacatgcctgcagagggccagctgggaacatgaatgaagtacacatgaggtgaagttgcttggactgtgatcaagcatgacaccagcttaattacatttccttttattattaatttttcatgctaatacctgagtacatttttctttttttttaaattttttttttgagacagggtcccactctgttgcccaggctggagtgcagtggcataatcatggctcactgcagccttgacctcccaggctcaggtgatcctcccacctcagcctccagagtagctgggactacaggtgtgcgccaccacatccggctaatatttctttgtgtgtgtatttttttgtagaggtgttttgccatgttgcccaggctagctgtaagtacatttttcttaaaaaaaaaaaaaagaagaagaagtacagaaaaacttaaagtcccttttgacctaccattttcccctcattaagatgattacttggaggtgaaaaataagaaaaaaaaaagactgttgctaagtcctatctactctacctaccagatatctcttaagtacattcacttctctctacccacactgctgcctacacagtgtagacaagcatcatctaacagctggtctccctacctcttctcccaaccttattcccctccaactctacattccagtcagctttaacctcttttagttactcaggccccaggctgcgttggctctgggcctttgcataagccgttccactgcccagactcaggcttagtcagtcccagctgatcttcatctccaccgtctgctcatctttcaggtctcagtttacagggcacttcttctaggtcgtctttctgccccccaccacctgctccccaaataccttctccttcccctgttgtgacacctgtggcaatttattttgatttttgtttgtttgtttctcctctattagacctgggctctatgaaaacagggagagcgttttgctcactgtcatatccagcatgtagagacctgcctggcacacagggaacactctttaaatagatgttgaataaatgttgggagggagggaatgagaatggatccaggtaacttatgaacggattgtttgactatggaccctgagtctcatgacaggaggaaagaaaggagatttcacaattctttagcagtaggagttgttgttttaaaatttgcctctgtgggcccttacttgtaagcaaggcatacttgtatctcagaaattatttcatcttacattatgtttcattaaaggtttatcaactgccagatctgaatcctttaagcagctttaccttattcctctgtgtcttccacactaatatcatattttgtgcaaaattttttcaattataaacatttattgagcacttatctagtagttctgggggtacaaagatgatttgattattatcttaatttcaaagatctccctgtctaatagaggagaaaatgaattaaaccacatccaccaggcatggtggctcacacctgtaatcccagcattttgaaaggctgaggtgggaggatcacttgagctcacaagtttcagatcagcctgggcaacgtagcgggacatcatctctacaaaaagttagctgggcatggtactcctgtagtcccagttacttgagaggctgaaatgggaaaatcacttgagcccaggaggttgacgctgcagtaagccatgatcacgccactgcactccagcctgggagacagagcaggaccctgtctctaaagaaaaattaaaaaattgaaccctatcatactgtgtataagcgccctgataattgtaaatacgggctcctatgggagctgtagaagggagcagctaactttgcagagggagggaagataacagaaaagaagtgctacctacactgagtcttgaaggataagcaggagttttccaggtgaccagggggtgagagaccatgaaacaacctgggcaaaagtaatgagacgtgagcatacaggtaccttcagggattttccatagatcaatgtggttagaggaaagagggcaagaggtagagagtaggagatgacacagaaagcacgcaggagtgggaccgggaggcacctccggtcctcccgaataaggagagtggattctatcacaaggaatgaacagccctgaaggatcttaaacagggtggcaacaagaaattggatgagagtgaagctgataaattagaagcaggaagagactcaagggcaggacattggtcaggaggctatagcaataatctaggtaggaaataatgaggacatgagccaaggcagtggcacaggagtggatgctaccactcccgtttctacaacagtcatatttatggtaacctttctggagtgctgaaggattagagagcaaccagacaaaattttttaaaaaatgtaaaggaggggaataaagattcttggggcaaaagaaaaaaaaagaactgttcaagaaagtaagtacaattatagtactttacttggctccgtggtgaatattttcatagtcacatttatgttgattctgattattggttttcagcttctagagcaaatccataaagctgggaagacagaataatggtatcagaataaatataaatgctattaccctagacaatgtaaagggaagataataactgtcagaaatgaacagggtgaaatggaagtagggatcaaaattgataggccaagaactagcaggaaatgcatattttttggtgatggaaaggtaattgccagaagaaacagcttttaaaaaattgacagtggtgggccaggtgctgtagctgatgcctgtaatcccagcactttgggaggcagaggcgggcggatcacgaggtcaggagatcgagaccatcctggctaacacagtgaaaccccgtctctactaaaaatatgaaaaaaaaaaaaaaaacaaaaacaaacaaattagccaggtgtggtggcaggtgcctgtagtcccagctactcgggaggctgaggcaggagaatgctgtgaacccgggaggcggagcttgcagtgagccgagatcgcgccactgcactccagcctgggtgacaaagtgagactctgtctcaaaataaataaataaaataaataaaaaattgacaatgatttcccctaggcattagctttagttgtgaggaaggcctgggtgaggacttgtttattttcattgtaaacacttttgtactatttgatttattgttaccaggtgcatgagtcttttgattaaaatatttttttaaattttaaatgcatctatcccggtgatatttcttgtctttatggagatatcatacacaaacatctgaaaaacaaagcatatcagatgaattaggtgtagcctccccaaggtaataccctgggacatttagtcaccttcctacccagcactttgggaggccgaggcgggcggatcccgaggtcaggagattgagaccatcctggctaacactgtgaaaccccgtctctactaaaaatacaaaaaattaactgggcatggtggcgggcgcctgtggtcccagctaccgggaggctgaggcaggagaatggcatgaacccgggaggcggaggttgcagtgagccaagatcgcgccactgcaccccagcctgggcgacagagccagactctgtctcaaaaaaaaaaaaaaaaaaaaaaaaatatatatatatatatatatatatatatatatatatatatatatatatgtatgtacattcacttccgttatcacaattcaagacaagtaggcttaaaagcagtctcactttacggcttaaaggcacaaaatccaagtagcaagcatgaaatgtggtttgcatattaaatcggtgcctttaacatttttgaccttaacccagtaagaaatacttttgtgcgtgacccagtacccacacacccacataactgaaacaaaacttttaaaaatgaacagccctgttcatctattaggaataattcctaaaacagtgttataggaatactgctatctggaagaagcaatattaagagtagtgtgtactaggcatttttcaaggagctctataacatttattgataagattctgctaccactcttgagatgagtactatttttattccattttagagattcagaaaatgatgcttagagaggttaagaacttctcaagataagcggtagaactgtcagtagaactgttaccttttactatgctaagatgtgcttcaaaatttctatttccttaagtatttttcatttttttaaatatcgctcagtttaaatgattttaacaatccactactgtaattatgacccacaggttgggaaacactgctctaaattaatcactccttttttttccctcagattagaaaacaggcttttgaaatttagagcttatttctcagatcagtttaaccttcctaggaaattacttgttactgatgcataagaaaaaattgttacataaagttagcttctatcatctttgttaattagcacggctcccttcttttcatttctcttctccttccttaaaattttctctttttttcatctttagtcctgtgtggcacatattaggaatagccaaatttatttctggagtatatttagatatacatcagttacacacggatatttcttgggttttgcccatatgtctattggtttgcacttgccacaagaagtacagatttcagccaaccatctgctatgcttgtgaaaccatcaaaacccaaccttccctcaaatattggaatcctgtgattttttttttcaaatgtagtaaatttcatgtttaaaatgcataatagggctgggtgcagtggctcatgcctgtaatccccacactttgggaggccaaaatgggagaattgcttgaggccaggagttcaagaccagcctggtcaacatagaccccatctccattaaaataataataataatataaaatgcataacgataagcatcatttgtcatgcccacacatttaagcaaaaaattatgctgaaaataaaattatgatgcttgttgaagcactaatagaactttaatagactgatttagtttgttttgatatttttcttattaaattaagaactacaagcagctgtcgaagagatactgccaagccttaaaaaagatgatgtgtccatctattatgtgagcagaacttctaacacagatgggattgactctttcctggacaaagtggatgaagtatcaactgaacctatcccagagtcatggaggtctgaagtcactttttccactcctgccttatacatttatacttctggaaccacaggtaaaaataaaggggggattctccaaaaaaattaatctgaaggagttaaatgttgacacaggttttcaaatctctttctttggcaaaacgtattgggtaactaatacttcaggagatttagttatttgcctgcgggaactgatcttatttcatagcatgtgatcccatttgcgtttctccaagctatgcatattttccgccagttggtatagaacagataaagaggttaaccaagaactacagaagtagttatgatgatgaatgagatttggcactgaatgggtagttggaattttttttcatgcttgttgtattttgattatattacatccagagtccatatagactgtataattgattataaatggaacacaggagaagaccagtgaacaatgaggaggttctatttatataaatgttttaaccgttatcttcccatgcaacactgatttggagctgtttggtgctgtggatgtggggtggctgtagcataagacctaaaatactgtatttcatcaaatctaggatgccttcaactgtaagctgccccattatgagccactaagaagaaacactgccaattaacaatgttatgggaacactgctgtatggaagaagcaatattaagggtagcatgtgtactaggcattcttcaaggagctttacaacatttgttgataagattctgcccccactcttgacatcggtactctttttacttccattttagagattcagaaaatgatgcttagagaggttaagaacttcccaaggtaagcattagaactgtcaggattcaccttgcaggctgattccacagctcatacaattgacagctctaccccagtaccttcttgtttattcgtgtgatagatatttagtgtctgcctactacaggccaggaagaccaaaatgtaataatatgaagcctgagggatatatttaaaagaaggacaggaagccagccccagcatgccaattattattattaatattggaaaattgaatctatgagtcttttacctctgttgattaaaattttaatttaatttaagcaggtaatacaggtcttctccttgttaaataatcaatagaccaggataaaatttccttgagccttttatctcagctgcagctgacaggaactgtctccttcacctcgacaggccctcagcacccacctgagctcacagttcctggacctgagtttaacctgattgttgacttcacttcatacagtcacttttgctaagtatttaagtaaatgagaggaagccaggaatgacatattaaagctggtgcccaaaacataatgtctatctttttttttttatttttattgccaggccaacagaaaggtgagatggcacaattaaccaattgcttctgctgcatgcagacactcccttaacatatgggacttttatcatcatttcttaatagaatggtaaaattaaattgtaaatgtttataactttgttacaatgcatgttttcacagtcaaatagaaaaccccttttattgggaggccgaggcaggcagatcacgaggtcaggagatcaagaccatgctggctaacatggtgaaaccccatctctactaaaagtacaaaaaattagccaggtgtggtagcgggcacctgtagtcccagctactcaggaggctgaagcaggagaatggcatgcatgaaccagggaggcggagcttgcagtgagccgagattgcgccactgcactccagcctgggcgacagagcgagactctgtcttaaaaaaaaaaaaaaagaaagaaaaaaaaagaaaaccccttttagggagaaaaaagagaatgagcatcctctgatttaatctcgtaagtcagaatttatatttaattggaagacaattagaagggtgtttattttacttttttcattttctctgaatcaaatatttgctaggccaagcacagtggctcacatctacaatctcagaactttgggaggccaaggcaggaggattacttgagcccaggagtttgagaccaggctgggcaacatagcgagaccacatctttacaaaaacattaaaaaattagctggcatagtggtacaccttgtagtcctagctacttgggagactgaggtgggaggatcacttgagcccaggagtctgaggctacagtgacgtgccactacaccccatgctgggtgacagagcaaggcactgtctgtagaaaaaaaatagtgctaagttactcttgtaaacattaattaaaagaatttgtttaaacagttggagaataaatgttcctgctcctcaaaggaagtcattagcacaaaattatataatagttaccagatattctcatttattcattaatacaaaatcttaatttaggaaagttctgaaagtacttcaaggcaacaaagatgagcatttctttttaaaaatttcagaggccaggcatgatggctcatatctataatctcaacactttggggccaagatgggaggctcacttgaagccaagagttcaacatcagtctgggcaataaagcaagaccttgtctctacaaaaaatataaataaacagccaggcatggtggtgcacacctgtggtcccagatacctggggggctgagacaggaggatcacttgacctgaggctgtggtgagccttgaacaccactacactccagcctggcaacagagtgaaagcctatctcaaaaataataataataataataataatacataaaacaaaacaaaaaactgggccattgtcaaagaaaatgaattttgaattgtgtttacaataatggtaggttgctagccatatttgtctgccttgtaacaagttgctgctatttgggcactatctggtgaaggtaccaccaagtattgaagaatctgagtcaacagagatctgtcttcctcttcacgaagtctgtttacccactcagatcttaaactcttagtccccttcccagtgacttcatgccctccccaattgaactgttcttccatgggaaacaacataagcatacacttacagaagaaaatcttacaaaaaacgtatataaattatggttaagaaagtgcaagcgcatttagtctaatgtactaaaactacactgagatacggtttttcacctttcagactggcaaaggccccaacatttaagagcacacattgacaaggctaggaggaaacaggcacactcatgtattgctgataggagaatgaatggggacagcccttataactggcaatgtggaagttatctatcaaaattacaaagactcttactctttttttgagacagaaactcattctgttgcccaggctggagtacagtggcaggatcagggctcactgtagcctcaacctcctgggctcaggcgatcatcccacccaagtagctaggactacaggtgcataccgccacacccagctaatttgttttactttttgtagaggaggggtctcactatgttgcccagactggtgctgaactcctgggctcaagcgatcctcctgcctcagcctcccaaattgctgggattacaggactggccaacttttatcttttgacacaacaatctcacttcagtgaatttatccaaaagatatggtgtcattcatagtgtgaattgccacgtggacgagcttcttcactgcagcatcatttataacagcaaatagtataaataaattataatacacttataaaaggacttgaaggagctgagaaagagaataaataaatgaataaataagggaaatctttatgtacaaacatgaacaaatctccagtaaacattgttaagcagcagagacaaaaaacatgcaaaagagtgtgcatatttcttttttttttttgagatggagtcttgctctgtcacccaggctggagtgcagtggcgctatctcggctcactgcaacctttgcctcccaggttcatgccattctcctacctcagcctcctgagtagctaggactataggcacccaccaccacgcccggctaattttttgtatttttagtagagacggggtttcaccatgttagccaggatggtcttgatctcctgaccttgtgatccgcccgcctcagcctcccaaagtgttaggattacaggcgtgagccaccgcgcctggccaagtgtgcatattttttaatggaaaaggcaagaacatataagcaaatgttcatatttgctttgtttgtataaaataactctagtacgtaagaaatctctctgactctcagccttcacatctgtggattggagaatataattctgtttatgtcatatataaacttgttatggatttttaaaatgtcttgcaaagtggtagccacagggcagaaattcaatggacagtcattcctctgtttctgtttctcttcagattactactgtcataaccatctaactcaggagttagcaatctatggcttgtgggccaaatacagcctcccacctgtttttgtaaataaagttttattggaacacagccacactccatttatgtatgtgtatggctgcttttgactacaatagcagagttcagttgttgcaacagagattgtatgacccacaatcccaaaacatttactccctggtcctttatagaaaacatttgtcaactcctggactaactggtcatggcccttcccagtgcaattctcaaaatacagggtgatgaatcttcctaagccagatctctctcctacactgtaaatgcccaatcttggttaactcatgccttctcttgtatatttacaaaggtcttccaaaagcagccatgatcactcatcagcgcatatggtatggaactggcctcacttttgtaagcggattgaaggcagatgatgtcatctatatcactctgcccttttaccacagtgctgcactactgattggcattcacggatgtattgtggctggtaagctttttctacaaaatgttggaggcgagtgcacatttacattttcccagaaggaacagtaatacaaaatttggctacgttgctgtctgctaggaacagttttcaattttgcattaacaataaggcaatttgaatcacatattacaagcaagcatctaaaataatctgtttttcatgcctgcctatctaataatgtaatgctataattgttcagtatatcaagagacaaactcctttaaaatattttagggctgggtgcaatggctcacacctgtattcccagcactttgggaggccaaggcaggaggattgcttgaggccaggagttcaagaccagcctgggcaacatagcaaacctcatctctaaaaaaaatatatatatatatatatatagccaggcatggtggctcaagtctgtagtcccagctacccaggaggctgaagtagaagaattgcttgagtccaagagttcaagattgcagtgagctgtgattgcaccactgcactccagcctgggtgacagagtgagaccttgactgtaaaaaaaaaaattttaggttatgacacttgagtcttagattctatgtcatgtcatttccatctttagaaacttgcatgttaatctccatcagctttaaacttctgcagttgtgtgcactcttctgtaatctcccatttccacagcttttcagctctactagaaggagagaagatggcaactccatcagaatacttggcttggcttggcttgccatctcttctgtttccttctcagactttactattcaaattggagttgccatcctctctccttccaggaggattcatgtcacttgtatacattaccgcaaagttcaatagccaactcttccaggaagctatatgtaactttctgactgagctaaataaacaactttttctctcatgtggcatttcattttaaataatcatatatgtatatataaaaatatatacacatatgtatatacacacacatatatgcgtgtgtgtatatgcatgcatgttatggatggatatttgtgtcccccaaaaatgtatatgttgaaatcctaacccccaatatgatggtattagcaggtagggcctttgggaagtaattgggtcatgagagtagtgccttcatgaaaggtagtgcccttatcagaacaggagacagccagcttctttcctgactctgttctgttccatgtaaggacacagggagatgatgaccatccccaaaccaggaaaaatgccctcaccagacaccagacaccttgatcgggacttcccagcctccagaactgcaagagataaatgttgtttaagccacccatctgtactattttgttatagcagctcaaacacacacacatacacacacacacacacaatccaaaaatttgaaatccaaaatgctccaaaatctgtaactttttaagcaccaggacaccacaagtggaaaatactacacataagtacttaacacaaactttgttttatgcacaaagttatttaaaatattgcatgaatgggccaggcacagtggcttatgcctgtaatcccagcactttgggaggttgaggtgggcgaatcacttgaggtcaggagtttgagactagcctggtcaacgtggcaaaaccccatcccttcttaaaaaatacaaaaattagccaggcatgatggtgtccacctgtaatcccagctacttagaggctgaggcacgagaacccacaaggcagaggttgcagtgagccaagatttcaccactgaactccagcctgggcaatagagtgagacccgggccaggtacggtggctcacgcctgtaatctcagcactttgggaggccaaggggtacagatcacgaggtcaggagattgagaccatcctggctaacacagtgaaaccccttctctactaaaaatacaaaaaatttgccaggtgtggtggcacgcgcctgtaatcccagctactcaggaggctgaggcaggagaatcacttgaacctggggggcgggtgttgcagtgagtcgagatggcaccactgcactccagcctgggtgacagagcgagactctgtctcaaaaaaagaaaaaaaaatagagcaagactctgtctcaaatatatatatataaaatacatatatatgtatgtgtgtgtgtatatatataatatatatgtatgtgtgtgtatatatatgtatgtgtgtatatatatatacttgagacagagtctcactctatttatacatatatttagtatatatataatataatatatatatatattgcatgaaatctctttccctctcccctccctccctcttaggacttcatttgaatctcttactgcaagctaacttttattaaaatgacctttgtatgagtcttctcctccatagattggaagcccctatcgaacaaaaccatgtcttactaattttttgcatttgaatataaggtactcaatacttgtttgcaaatataatttatttttaaatttctaccgttcaaagttgacaaattaaacataactgggagaattttttccaccatttctttcttgacactttctgtgctttctctgtaggtgctactcttgccttgcggactaaattttcagccagccagttttgggatgactgcagaaaatacaacgtcactgtcattcagtatatcggtgaactgcttcggtatttatgcaactcaccacaggtaacactccccccgttttactatcattttgaaatgggtaagatggaaattcaagtcactttgggttgtgctaggcttcaactgatttgcatatatcagttttgagtttaggatacaattatcatgataaagtacttggcactatacctaccatatagaggggacttagtaggtgggagttaatattattattatgatgatgattatttcctgcctttttacttgttttcacatcttactccccacctagcatatcctgcatttccccctctgcttactaaaagccagtgtcaaagcccagttcaaatgatacctcatacattaaacatatttgggtcactccaacaaaagtcattactcttctcccctacgtcattttatttctaccctctgtggcccttgtcatgttgcaggagtttgtgttcatgtctcccatccttccttggctgtaatatctttgatggctggaaccacatcttgtctccttgttttctgttataccgaaggcatacaggaaacttttacttaatgctgtttaacaaataaatctctgtgtgactttgaaaccagccagccaagtctgtcaccaagctgggaacagatgccccagggcatctccaatggccttggatctgccctgtttgcagatgttcagctctcgatggggttgttctcaagagctcctcctgcccagtccctcaactctcatcagagatctggtatcagataggatttatcaatggtggcactgctgacattttgggcttttaattctttgccgcgcggacttattctgtgcattgtagagtgtttagcaccctttggactttgcccacgagatgccagtagtaacctccccacctccccaggtcatgatcatcaaaatgtctccagaaactgccaaatgtctcttggcagggaaatgctaacctagttgagaaccactgtactagacaatgcagtaaactcaccagattctaatccctttcaccagattctagttcctttattcagtcagtttaaactcaaaggatcactaagttgataaattgctattgataagcacctgttgtactcacctaacataccagctgccgtgtgacgcagaaagaagtgtcagatgctcttcccccaggtctctctcacctcactttactcagtctctgcccagatgttgcctcattagaagacaggcctcttctgctaataatcaaacatatcatctgcccctcactgtccagcttgtcactgcatttcatggcacctgtcactcctgacatagtaaaggtttatgtgattattgtctgccccccctcgccccaattaaatgaaagccgcatatgagcaggggctctgtccactaccagatctacggcaccaagatctgtaaatgacacatcataggcatcaacagattttgtggactgaacctctaaatccttgcccctgaaaaatgtgtagttgagttgagggagctaaaatgtttccccaaaatgtttgggcttagcacatattattctgattttttggcatattcaatagattctcgaggatcatcattagcagtgagttgggttagggtattttccacagcagttctgttcatgtcattattgaatttttttcacattaatattccacgtggcctccaagatagcatgtctctctattaaaatccagaaatccatatgggacccttctgctgggcttttcttctctaccttaaaggcactcctttgtcagttagaaaatctcctggggagtgtgtgttgtttctgtatgttctaatgggagcttcctttggactggacgaaaataaatatgtttgtgtgtagctgtcttcaggcccacacatatccacatatacacatgcacacatacacacatgcatgcactctcccagtttttctcttactgttgtctcaaatactggaaaacaaagacaatttcactggggttttacaacttcaaaatatactatgatttaatgcataatcttgaatgacccctggacttcctatttgccagtgcttccccacccctgagttctgtttggaaaatatttataaaaagtataataaaagatcaaagttatctcaaaaaaaaaccttcagttaaagatttttttaaattataggtcatcagtccaggcacggtggctcatgcctctaatcccaacactttgggaggtagaggcgggcagatcattcaaggtcaggagttcaagaccagcctggccaacatggagaaacccagtctctactaaaaatacaaaaattagcggggcttgttggcacgtgcctgtaatcccaactactcaggaggctgaagcaggagagtcgcttgaaagcaggaggcagatgttgctgtgagccaagattgcaccactgcactcaagcctgggcgacagaacaagaccctgtctcaaaaaaaaaaaaaaaaggaaagaaagaaagaaaacaatcatatgtcattagacaagcaggagatctatgcaaatttttttaaatttaatcataggtcatcataggaagtagaaagtacagattgtatgggatgtagggaaagattatatcaaaaagactttgcaaaaaaaaaaaaagaattggataaaaactagaatgaatgggggaagggcctggatcaatgtaatcaggaacttcttcacccttagagctgcctagaatacgctgttgctggagggactaaccccaccagcgacccccaagcactggatgccagggaggcaacctctgccttagcagaacagctaaaccaagtgacacccatccacagacatatatggcccagctcatcaggagaatctggggccagtgttgggaggtagaagccactgtgcttctctgccctcttcttaaccatattcagtagcttctctagtagagcagtgggctatggagaatgcttccagccctgctcaggtcagtggttcagatttggccccaggtacttaaagtaatgctgagagcaagtactctggagttagtcggcctgcattctgactctggcattggagcaggatagttaacctctctaaatctcagcttcccgtcagccaacaaggagataatagtacctacctcacatggggtctatgaagacaacctgagatgatatatataaaccacatagtagctggaacttagtaaattctcaacacatgttgccattattatcattatcactttccatgcctaacagtgtgtagctcataataagtaccccatacatatttgttgaatgaatcaatgaaaattctgcccacttacacaaaggaagaaataagggaaaacattctacttagttaatcactctcatctgaggttgagtaggggatgggatagcaaagctactgacttaagtgatttttaaaatattatagtgaatattttctattttgccgtcttcccgcattgtatttgggcctttgctttcaaagcgactgtttgtaatgaaaggccattctgattcatttcttgcagtgtatggttgtcagctcccattcggtttttgtagttgcctaaaaacaatgtcatctagggaaagttatttattggagcatgatattgctaaagctcagtgtttctttcctccagttacagactgaagctacagtctgtactggacaaggctccagtacaggggtctcaatgaggctttatgacacctgctggagtgtgggaggaggaagacagaaagggaaccaaaaaagagttccaggggccacacatagaaccatgatatttggaaggagaaataatattggccagaaccctgaaaaagctgaatagattcaacttacctctagtgttgactgcgtccccccagaattagataacctctgtggtcccttctagcctaaaatttctgtctctgcatcagcttcattctgttcaaaaaagagaatggatggatctgttgcagcacagagtggagagtggccaatatgactggggcccaagacagagggaggccaaaagaaagagggaaggggagcagaatcaggaaggttcgccagggaaggtgggctttgaagagtacggagaagttctgcagccaggcaagaaaagaagggcttctggctagcaggaaaatcacgtgagcagtgagatgaaggacccagcacactgggaactgcaagcagtctggcaggaggtgaagctgaggggctgggtcaggtggcaagggctttactctgctgagactcaaatgtgaacatgacaagccatgactaaagggccttacatggaagagcaatgtgggagatggcatttttagacagtccttttggctacgatgtgagaatacacagaaggatgaagggcctcttctgtaaagcaaacaggtggagccttgtccaggcagaagtgtaacatattaattattaagaacagggactctggagtttttctaaggtgataaagaccttcttccctttcacctcttggaagtcaccccaaaacaaggcgatgagaaaaacacacacaagcaccatcatctcagaaactaagagacattgcaaccatgaactacatagtataggaagctaaaagataacagtgactgacatagtaggctgagaagggtgaaacttaagaggcaagtcccaacaggaaggaagccagttgccttcctgaaggctgagaaattgcaggctttgaatacagctgaaggtgggatgaagtgtcagacttaaaacaggggagttatttgaaaatctgtgtaagaagtaaaatacggaggacaggatcatggcgagcgggaggcaggactagattgtggctccagacagagcagcatgagaggctcacattgtgaattttagctccagcttgactgcaagaactaaccagcaaccccaagaggacccacagaccctctgaaagaagtggattgctcctagaggacccgggagacaccccaaatactgtgatcgccccaactgcagaagtgggaaagggagaccctcatctcccgaacacatactggagaagctgaaggtctgtttgtagaacttcccgactttacctggagcctcgtcaagttagagagccaaaccgagcaaaatacaaaggtagaggaagctgcagaaaggccctgggagctcactggctcccctagcagcccattcccgcctggcaccacagggatccatcaggagggtggccagaggagcagggggcaaaactccacagggagaaggaattctctagctaaactttgggataatttgaacggggcaagaagactcctggccagaactccagggagggtgtgaatctggcttgcagactccacaggcggagaagaactaaagccctttctttaacagctgggaggcagaaagccttgggcaagttttcaagcctgactcgccctccacctggaaacagactcggggccgttgagggggcacggtgggagtgagaccagcccttcaggttgcctggaagctgggtgaggcctgtgactgccaactttcccccacttccctgacaacctgcatgactcagcagagacagccataatcctcttaggtacacaactccagtgacctgggaatctcgcccccatcccccacagcagccacagcaagacctgaccaaggagagtctgagctcagacaggcctagccctggccccacctgatggtccttccctatccaccttggtatcagaggacaaagaacatataatcttaggaattctagggccctgcccactgctggtgcctgtccacactattacagctgatgctttctggaaagtaccacctcctggcaggaggccaacagcacaaaacagggaattaaaccaccaaagttaaggatcccatggagtcattgcatcctctgccacttccactggaacaggtgctggtatccatggctgagagacccataaatcattcacatcacaggactctgttcagacaacccccagtaccagcccagagccaggtagacttgctgggtggctagacccagaagagagacaacaatcactgcagttcggctcacaggagccacatccataggaaaagggggagagtattacatcaaaggaacaccccatgggacaaaattctgaacaacacccttcagccctagaccttccatctgacagagcctacccaaatgagaaggaatcagaaaaccaaccctgctaatatgaaaagccaaggctcatcaacatccccaaaagatcacactagttcaccagcaacgaatccaaaccaagaagaaatccctgatttgcctgaaaaataattcaggaggttagttattaagctaatcagggaggaaccagagaaatatgaagcccaatgcaaggaaatccaaaaaaacgttacaagagtgaaaggagaaatattcaagcaaatagatagcttaaagaaaaaaacagggccaggcatggtggctgaagcctgtaatcccagcactttgggaggctgaggcaggcagatcacaaggtcgggagattgagaccatcctggctaacacagtgaaaccccttctctactaaaaatacaaaaaaattagctggagtggtggcaggcacctgtagtcccagctactcgggaggctgaggcaggagaatggcatgaacctgggaggcagagcttgcagtgagccaagatcgcgccactgcactccagcctgggagacagagtgagactctgtctcaaaaaaaaaaaaaaaaaaaagtaaatgaaaaaaacaagcaaaaattcaggaaactttggacacacttttagaaatgctaaatgctctggaaagtctcagcaatagaattgaacaagtagaagaaagaaattcagagctcgaagtcaaggtctttgaattaacccaataaataaagacaaagaaaaaataataaggaaatatgaacaaagcctccaagaagtctaggattaaaagaccaaacctaagaatacttgatgttcctgaggaagaagacaattctaaacacttgaaaaacatatttgggtgaataattgaggaaaacttccaagccttgctagacctagacatgcaaatacatgaagcacaaagaacacctgggaaattcatcacataaagatctttgcctaggcacattgtcatcaggttatccaaagttaagaccaaggaaagaatcttaagagctgtgagacagaaacacctggtgacctacaaaggaaaacctattagattaacagatttctcagcagaaaccctacaagctagaagggattggggccctatcttcaaccacctcaaacaaaacaagtgtaagccaagaattttgtatccagcaaaactaagcatcatatatgaagaaaagatacagtcgttttcagacaaacaaatgctgagagaattcgccattaccacgttaccactacaagacctgctaaaagaagctctaaatcttgaaacaaatcctgcaaacacatcataacacaacctctttacagtataaatcacacaagacctataaaacaagaatacaagtgaaaaagcaaacaacaaaaaaacaaaagttcacaggcaacaaagagcatgatgaaagcaacagtacctcacatttcaatactaacattgaatgtaaatggcctaaatgctccacttaaaagatacagaactgcagaatggataagaactcaccaaccaactgctgccttcaggagactcacctagcacataaggactcacataaacttaaagtaaacaggtagaaaaaggcatttcatgtgaaaggacatgaaaagtgagcagaggtagctattcctatatcagacaaaacaaactttaaagcaacagtggttaaaagagacaaacagagacagtatagaattgtaaaaggccttgtccagcaggaaaatatcacaatcctaaatatatatgcacctaacactggagctcccaaatttataaagcaattgctactagacctaagaaataagatagacagcaacacaataacagtgggggacttcaatactccactgacagcactagacaggtcatcaagacagaaagtcaacaaagaaacaatggatttaaactatactttggaacaaatggacttaacagatatatacagaacatttcatccaacagcagcagaatacacattctattcaacagcgcataactttctaactttcaccaagatagaccacatggtggcccataaaatgaacttcaataaatttaagaaaattgaaattatatccagcactgtctcagaccacagtggaataaaactggaaattaactccaaaggaaccttcaaaaccatgcaaatacagggaaattaaataacctgctcctgaatgagcattgggtcaaaaacaaaatcaagacagaaatgaaaaaattcttcaaactgaacgacaataatgacacaacccatcaaaacctctgggatacaacaaaggcggtgctaagaggaatcttcatagccctaaacgcctgtaacaaaaacactgaaagagcacaaacagacaatctaaggtcacacctcaagaaactagagaaacaagaacaaaccaaacccaaacccagcagaagaagggaaataaccaagatcagagcagaactaaatgaaattgaaacaaacaaacaaacaaaaaaaaagataaatgaaacaaaaagctggttctttgaaaagataaaattgatagaccattagtaagattaaccaagaaaagaagagaaaaaatccaaataacctcactaagaaacaaaacaggagatattacaactaacaccactgaaatacaaaagatcattcaaggctactatgaacacccttacgcacataaactagaaaacctagaagagctagatacattcctggaaaaaatacaaccctcctggcttaaatcagattaaatcagaattagataccctggaacagaccaataacaagcaggaagattgaaatggtaatttaaaaattaccgacaaaaaaaagtccaggaccagatggattcacagcagtattctaccagatgttcaaagaagaattggtaccaattcttttgacactattccacaagatagagaaagaaggaaccctccctaattcattccatagagccagaatcaccctaataccaaaaccagaaaggacataaccaaaaaagaaaactgcagaccaatatccttcatgaacacagatgctaaaatccttaacaaaatactagctagccaaatccaacaacatatcaaaaagataatccaccatgatcaagtgggtttcatgccagggatgcagggatggtttcacatatgcaagtcaataaatgtgatacaacacataaacaaaatgtaaaaaatcacatgataatctcaataggtgcagaaaaagcattcaacaaaatccagcatctctttatgattaaaactctcagcaaaatcggcatacaagggacataccttaaagtaataaaacccatctataataaacccactgccaacataatactgaatggggaaaagttgaaagcattccccctgagaactggaacaagacaaggatgcccattctcaccactcctctttaacatagtactggaagtcctagctagaccaatcagacaagagaaagaaatacagggcatccaaatcagtaaagaggaagtcaaactgtcactgcttgctgacgatatgatcatttaccttgaaaactcttaaggactcctctagaaagttcctaggactgataaaagaattcagcatagtttccagatacaagattaatgtacacaaatcagtagctcttctatacaccaacagcgaccaagcaaagactcaaatcaagaactcaaccccttttacaatagctgcaaaaaaaataaaatacctaagaatatatctaaccaaggagtcaaaaggcctctacataaaactacaaaatgctgctgaaagtaatcataaactaaacaaacaaatggaaacatatcccatgctcatggctgggtagaatcaatattgtgaaaatgaccatactgccaaaagcaatctacaaattcaatgcaatcccatcaaaataccaccatcatccttcacagaattagaaaagaaaattctaaaattcatatggaaccaaaaaaagagcccgcatagccaaagcaagactaagcaaaaagaacaaatctggaggcattacattaccccacttcaaactatactataaggccatagtcaccaaaacagcatggtactggtataaaaacaggcatgtagaccattgccacagaatagagaacccagaaataaagctaaatacttacagtcaactgatctttgacaaagtaaacaaaatcataaagggggcaaagtacaccctattcaacaaatggtgctcagataattgccaagccatgtgtagaataaaactggattctcatctctcaccttatacaaaactcaactcaagatggattaagaacttaaacctgacacgcgaaactataaaaattctagaacataacattggaaaaacccttctagacattgacttaggcaaggatttcatgaccaagaacccgaaagcaaatgcaataaaaacaaagataaatagctaggacctaattaaactaaagaacgtttgcacagcaaaaggaacagtcagcagagtaaacagacaacccacggagtgggagaaaatcttcacaatctatacacctgacaaaggaataatatccagaatctacaacaaactcaaatcagtaagagaaaaacaaacaatcccatcaaaaagtgggctaaggacatgaatagacaattctcaaaagaagatatacaaatggccaataaacattaaaaaatgctcaacatcactaatgatcagggaaatgcaaatcaaaactacaatgcgataccaccttactccttcaagaatggccataatcaaaaaaatcaaaaacagcagatgttggcatggatgcagtgaacagggaacacttctacactactggtgggaatgtaaactagtacagccactatggaaaacagcgtggagattccttaaataactaaaagtagaactaccattgatccagcaatcccacttactgggtatctacccagaggaaaagaagtcattattcaaaaaagatacttctacacgcatttttatagcagcacaattcacaattgcaaaatcgtggaaccaacccaaatgcccatcaatcaacaagtggataaagaaactgtggtgtgtgtgtgtgtgtatatatatatatatatatatatatatatatatatatatatatatagtatagtttgaagtgaggtaatgtaatgcctccagatttgttctttttgcttagtcttgctttggctatgcgggctctttttttggttccatatgatatatatatatattccataaaaatatatatattccataaatatatatccacaaaatatatatattttatggatatataaaatataaatatatagtacatatatccataaatatatatatattccataaaaatatatatattccaaaaaatatatatatattccataaaaaggaataaattaacagcatttgcagtgacctggatgagactggagactattattctaagtgaagtaactcaggaatggaaaaccagacatcgtatgttcttactgatatgtgggagctaaactataaggaaacaaaggcatgagaataatacaatagactttggggacttggggggaagagtgggagggggacgagggataaaagactacaaatatggtgcagtgtatactgctcaggtgatgggtgccccaaaatctcacaaatcaccactgaagaccttactcatgtaaccaaataccatcggtacccccaagaacttatggaaaaataaaaataaataaataaaatctgtgtaagaagtagctggacctgctattcccctcttccactgtgtgggagacaggaggatttttctctggagagctaaagaagctttgactgaaggaccccaagaacagaggagagcagggacgaggcactgaaaacagagattaagaaagtatctacgtactaaccagggagaccccaccagctcctttcccctgcacagatactggaactccagtagccaggttatgcttgcaggcaggatattgaaggagtgtaattcttaggaagaactaaactttcccggaaaagacattggacatgggctcactgcctcgtcaaccagcagtgcagcccagctagcagtagccccctcaccctgcccccacagaactgcctaatcatctttctgttgcattactcttaaatctgaacaaacatgaagaatcaccaagcacctgaggaacgcctcctacaggaaggatcatcaaaagaaaagaagcatcaactcaaaaaacagaagaggccaggcacggtggctcacgcctgtaatcccagcactttgggaggctgaggtgggcggatcacaaggtcaggagttcaagaccagcctggccaacatggtgaaaccccatctctactaaaaatacaaaaattagctgggcacggtggtgggcgccagtaatcccagctactggggaggctgaggcaggagaatcatttgaacccgggaggcagaggttgcatcgagccgagattgcaccattgcactccagcctgggtgacagggcgagaggcgagactctgtctcaaaaaaaaaaaaaaaaaaaaaaaaaaccgggagaaatgtttttaatgtatcattaatatcctcagagagactggagaagatattgtatccataaaacaagaatagtgtactgttttaaaagaaaaaaagaatcagacttgaaaactaaaatgatgtttaaaaatctttaattcatagaaaagttggaagataaagctgagaaatcttacagaaagttaaaaagataaattgatggtcataaagggagagtagataggaaaattagagactaatcaaagaggtcccatatatatttaattggaaatcaggaaaagagaatagagaaagtggagaggaggaaatgatcaaagaaatagtacaggaaaacatccgagggctggacagactgaaagggctaatggagtagccaataaaattagtgcaggaaaaagaaattgtgccatgatgaaatttaagactaccaaaaaaagatagtgaaagtttgactgtcagtagcaacactgcaagctgaaaaacaaaggactggtgctttcaaaattctagatacaaattattgcccatctagaattctatatccagccaaatcatcactcagatatacaatattcagatattccaagtctccacaaaaaaatagtaaaaataaaattaaaaaaacttaccatgtacatactccccttcgggaatttactaaagaaaatattccatccaaacagaatgaaaaaaaagcagaggaaaacacaggatcaaggaaagagagacaaagggaccccccaggcttagaaaataactagtccagactggagcagaggagacaaagaagcataatggaaaacaggaaattccatgagcagatagatttcaccatgaggaaaattttagaggctgttggaggataaggggaaacttaccaatagaaactaaggaaatgaagcaaattggaagaaaggcaattaattccaggaaaaataaaaatttgttcatagtgtattacttggctcctcagtgttgtattatgggcagaataatgtgaacactgaatattggtttaaccaaaaattgtgatactggaaaaatgggagagagaataggaaagaactgaatcctcatctaccacaataggaaatctgaaattgacgaaacaagagaaagaagtataagcatttaatttagaatttaatttagaaatatgcagatagcaagaagcagctacaagagttaactgtctgcctctgggtggtaaactgggggtgaagggtgggaacaggtagatggcgtgaatacagcattgttcacttaagggtctttcaggactatttgtttcttatcttacactatgtgtgtggcactctctctttgttgctttttttccttttttcttttttttgtggggggtggaatttattggtgggcatgagtaaggaggggcagcacagtggacgccctctcaagtgcagggctttaaaaaaaaaataaggaaaagagctctctgaagccacattgattcagatttgaatcttggagcaaccgttttgctacctttgtgatcctgggaaaataattttaagcttcctgagtctccatttcctcaattgtaatatgaggcaaatacttttattagctatcacctttcatagggttctttagaaacaggtcaactgcctgacccacagaaaagccttcaatagaagctttctgcctgtgttaattacctggcacccttcattcctctctggacatcttgacctcttgctcctcatcagtcccccaggtgtgtttgcatgtttcaccttagctctaatgtgacgaagaaggtttttttcttgtttaaaaaaaataagctggtgacccttgatctagaaatcagttcctctgaggagtagctttggtgatggagaaacactgttcgccctatgggaaaggaaaacttgagtcatactctttcagccactggtgagcaaaagcttaggtgagaaccagacatcttagaagcctccaggatctcccatttgtgcccacaaacatttccagccttaatcccttttgctgatgtaataagattcttcagctggatgatgaaaactgagcccatggtgttgtgattatgagctcagctacctgctactggcaggtgatagctgcacctgtgaggctggtcagcttcccacacacccagggtgcctgcggcctcctgcaccctaagccctgccctgacctggccactaattattgaacagggagtgaggtttcctggtagagattatctattttactgccaggattatgctctatgcaaagcacaggtccaggcactggggatgacatagagatacatgtacatttggcctcaaaggagtttaccatttaatgagggagatagataatcaccatccaatagacaaggaaataaacgaagtgggtaggagaagggctgctggcgggctgcatgtgggataagtaagaccttgggtctacatgtgggaatgctgctttggagcttccattgcaagcctgggagcaggtgagcacccagctcaggtgatcttctttaagcaaaagcaagtcttcaaatatgtgtgatgttttatccttggggcggcagtgggagggggtggtctctgaatactgacagtccttatggaagaggatagtgccttgtgggcagggtgaccctacaattcagtatccaaacagggacacttgagagtgaaggtaatgaaagataaccagcattccaggacacgtatagccagggcttgccctggcaaaccagacatatgatctctggacttaacgggagcttggtaattataaagcggggtagagtcagtgacctagggaccagaagagaatagattctggctgggcacagtggctcatgcctgtaattccagcattttagggggccgaggcaggaggatagcttgaggccaggagttcaaaatgagcctgggcaacatagtgagaacttcatctctacaaaattaataaataaattagccaggtatggtagcacgcacctgtagtcccagccactcatgaggctgaggcaggaggatcgcttgagcctgggagttaaggctgcagtaagccataattgcaccagcctaggcaatggagcaagaccctgtctcgaaaaaaaaaagagagagagaaaatagattcctactcagtctgaatgtctaggtctcatgcaggttcaaaaggcttctcaggcagctcccccagacaccctgggtaagagccactggcggtggggtgggggtgggctggtctctcttgacacatttcctcctcagaatgactgctcaaggggcccattttcaccagtgaccagcatcagtccacctctctgggtgggactcctcaaaaagccgcatatgttctggccaagctacttaaagattaaatgtttattttctgcttccctggcgccttagctcctcctgcatggaaaccaattcagagtttgccttggtgtggtttttaattgccatgccaaagtcccgtacccttatagtgcttttcaaagagtaattcttattccaaaaccacttcacagtgatttcacagtgtaagaaataatatagaaaaagctctaaccaattgctgttttatcaaagaaattaacagttgatgtgagaggacagccctaatgacctagcactgttaccccatttcattctgtatcctgatagaataaaggtcatagagtaacagaatttacaacgtaaaattatacctatttatttgtctcttccaccaacctgtgatttcctggaggacataaattacattattaacataagatattaaaaccatcaccgggctggtctgaaggtagtgagttacctcaattgattgttcacagttatagatcaaacttcttgttctactctttcccctcttctcactactgtacttgactagtctttgttaacaattaaaaataataaaataaaataaataaaaccatcattggcatggacatatttgtggggtctcctaaatgactgtggttgaatggaaggcagcctggtcatagccccacctctcttgctgacaccagagagactcctttcagtccttacacccaaaacagactttcctttgtgatctttacttacagcaaatcatattcttcccaggccacctgaggcaactgggaggtggcctcctccttctcttcccctccccatcccactgggacagttttgttgtctcggttcagctctgcctgatcttatgaacactggagtctacctgttaaatggggcagggcatggtcaagactcttccctgcagttcccacaggatccaactgttgctctttaatggctttgtggaaaatggctttctctctctctctgtcgctcactggactgtgtttcctgttttcttctttattgtcataaaaatcctagacactgctcagggtcccactggtagtagattgtgcccatctctgacagatctttcccatgtggctcttcctttctggaaattcaccagtgttcaccagccccatcaagaaaactatgaacatattatacacattattctaactttagattggatatggattaaatgttggcatcacctggttctgtcagattgcctcatctggctccttagaaaccaaaatgggagaattcacatgttttggttgttaaatcatagttccagctgtcagaccatactgcttgtgctagaggaatagggaacgatgtgtgtgggtggcaggaaaaaggcagacactaaggggcatttataaccaacataaatatgtaataaaggcaatgtcagtataaattaaatacatacaaaataaaggcaattattaatatgtaagcataggctccagagatgtttcagtttggtctccttcttctcccccaccacagaaaccaaatgaccgtgatcataaagtgagactggcactgggaaatggcttacgaggagatgtgtggagacaatttgtcaagagatttggggacatatgcatctatgagttctatgctgccactgaaggcaatattggatttatgaattatgcgagaaaagttggtgctgttggaagagtaaactacctacagaaagtaagtacattgaaaaatgagagcatacgtagccagttttcagaatacagagacttcttaaaagccaagtcatgatgatgttatcagaagtcaggcagcatcagagccatggcccattcctatcaccaagagaagttttgctcattctctgtgatgatgacttcaaaaaatcagatcctccaattaaaagcatctcaacttctattaagaacaatccattgtgcccttgccatctgcaacttaggtgaagtcttcctgatgccatttatacttgcatgtgataaaacacctgaaggttacaagttccgtaagctaatcgtacactgtgaaacatagtatttccctttaattgtgtcgtgcagcaccatcacctggggagttttttttatatgcacagatgcaaggaccaacccgctaggctttggattcagttgttctgaggtggagcccaggcatctcagtgctaggatctggtgaacatttatgtctacctaataattccaccagaaagatatttgtaagccagctcacatagccgtctcttttccctgtcagtcattttattgctcatgggtctctgttgtcttttttgtactcaagcagtcagtcttccagataaccaacaattctgcaaatatccagaaatgttcagcaaatgctgagcctcctttggcttgagaagtcactgcggtcattgtgcctctgggcagctcatcctttctggccatgaaacagccgcaccagaactcccacgcaacctgtgtccccagggacaggccagcagaatacagaggacagtagttcatgtgcgtaagagccctggctgtggagagcaaatctcagtgccaccatatgctagctgagtgaccttgggcaggtcacatatgctcctcaggcctcaatttcatcatctgtaaaacagagataacaagagaaaatattgaacccagtgcctagcccacactcgataagggaaaaggattgttgaaaggattaaacagccaggcgcagcggctcacgcctgtaatcccagcactttgggaggccgaggcaggtggatcatgagatcaggagatcgagaccatcctggctaacacggtgaaaccccgtctctactaaaaataaaaaaaattagccgggcatggtggcgggagcctgtaatcccagctactcgggaggctgaggcaggagaatggcgtgaacccgggaggcggagcttgcagtgagtcgagatcgcgccactgcactccagcctgggcaacagagcgaaactccatctcaaaaaaaagaaaggattaaataacttatgaaaaggcccttagaggctatagcccaatgcctgtcatttaacagccttgaataattgttagccgtaatgatgataatcactctatttcttatattctggcctaatctcaaggtgttcccaagttcaaggaccctctctgacaatgacagctccacctacgctacacaagtccctccacagtcctctagacctgcgctgtccaaacagtagccactagctacatgtggctacttaaatttaagttatattaataaaagtttaaatccagttcttcagtcacactagccacatttccagtgctgaatagccacgtgtggttagtaactaccgtattgagcaatgcagacagagaatatttccatcatcacagcagattcctgggcagtgctgctgcagactgagaatcgatctcctacaccccactggaactgctgctgagggtcagctaatgctgtatattacccattctttactttctcatccattgattgccatattttattgtcagtttttctactttaagcaaaacattaaaaaaaaaaactttaaaaaccggatgatcccatgcaattgatgtagaaaagaacatttattactacctataaattttttacattcctgcaaataagatctacatttgttgaccataaacaccacttgtttttttaacaagtactagctgtctgctaatactaaagcatatgattgtttgcttcatcacatagacttgaatataaatttgaaatagacacagtaatcatggctaataattatatccaaatactgtcatgtttgcatttttcttccaacaaggaaaataatatatttattattgctcttactgaattgctgataattaaattcttatgctttgaattatatgttaaatatgatagagttttcataattttatagtcatgggcatgaaataattatggcttcgattctaaaatatattagataacatttccttagaaacatgaaaaatctaatagtgtcatattaatataaggttatacaagattttaaaaacccatttgtgatacatccaccaaaagacacaagaatgttcataacagctttatttataataggccaaaactagaaataatccaaatacccattaacaggaaaatagataaataaatcgtggtatgtttatacaagggaaaattgcatggcaataaaaaacaccaacatggatggatgaatattatagacatatttagtgaaagaagcagacacagaagcatacatttatttcatttatttgatatttaagattaattgacagcagtataagtcagaatagtagttaacttcacagaaaagggcaggaggaaactttctaggtgaaatgaaagttttctctgtctctctctgggtggcagttttaagggtatatgcaaatgcaaaatttcttcaacctgtacgcctaagatatactttgtgttataccacaattaaaaagggaaaaattataaaagatttatactcaaaattattttaatcttgctagaaaatcataacttatgacctgattaaatatgatgtggagaaagatgaacctgtccgtgatgaaaatggatattgcgtcagagttcccaaaggtacagtggacttttgttcaatcaacctgtgccccttcttatcttgatcaagtgacttttaaggactaacatattattgccacatggtaaaatttatcagagtggggaaaaggggggtttatttaagtaccctccaatatacaggaattccaaaggtgctaatttaccgctgcatgtaacataattctagttttaaacatagcttaacaacttcttgcttatgaggtaatgttttgtgggaagggatatgtaattgtggttgcaaaactatagttttaggtggcctttacctttaagctttaacaactgtgcgtttgtgtaagtgtgcataaatcattattcagtaaaaaattagcagtaaaagaattacaggccaggtgtggtggctcacgcctgtaatcccaacactttgggaggttgaggaaggctgatcatttgagataaggagttcgagaccagcctggccaacatggcaaaatcctgtccctactgaaaatacaaaaattagctgggcacgatggcacacacctgtaaccccagctacttgggaggctgaggcaggagaatcccttgaccatgggaggcagaggttgcagtgagccgagactgcaccactgtactccagcctgggcaacagggcaagattccatctcagaaaaataaaaataaaagtaaaataattaggccatatacaataatgtacagtatatgtgtgtgtggtgtatgtatgtgtgtctgtaatatatatgtacatataattcacaggtatacatgcatggaaaatgatacttcctacagccagcttgttgccagcaggttgtatggcattagttttaagagaaggttgatgtataaatttgacctctagcacataaaataagtttactttcttctgtcttaggtgaagttggacttctggtttgcaaaatcacacaacttacaccatttaatggctatgctggagcaaaggctcagacagagaagaaaaaactgagagatgtctttaagaaaggagacctctatttcaacagtggagatctcttaatggttgaccatgaaaatttcatctatttccacgacagagttggagatacattccggttggtttttctgaatcattgagccaaaaacaaacacacgcacagtttggcttactcctagtggaatcgcattccactttggttatggtgcatttccttctctatctttggcacatcaggtcaaactcctgtgttcccagagaatgaggaatgaagtgcatgaagtgtcactctgcagtgcacggttaacttggctgagcaacaccagatgagaataaggcaggaaacctgtatctgatttctggagacaaaagtacatttaactcctcttgtttctcctgcattattactggtcactcttaggacagccaaggattttcacctttccaatcatggaggtgtttagataaaatcagatgcaaattaatgtggagctgatctagttgaagaggaggtgaggggttcggagccccttcccccaacccctttcatccccaaccagatggtttcccacagaacccccaggtcagcacaaggaagtttggaagtccttctaacagaccatggaattaacttccaaccatagcacagtcctccagcctcatgacacagcttccttcctgtgtaaactccctgagggcaggccctgtgtctgcctgttcacccccagcacctaccatggtgcctggtgtcattttttgcatgaatgaatgaggaagggatggaagttgtctaactgcagtagaaagacagcaggtggaatgaggagaaccaggctcacctctcccactgagcagcagtggtatcaagacagataaccattctggacctcagtccttttgcccttgagatgtgggtcacgatgattctcagggtccttccatctctactattccatgtcttaagatccatatcactttatgccatcttcatgttattaagatgatacttctgggagggctaaagaatttttaatgggccaggcgtggtggctaacgcctgtaatcccagcagtttgggaggccgaggcgggtggatcacctgaggtcaggagttccagaccagcctggccaacaaggtaaaatcctgtctctactaaaagtacaaaaattgctggacatagtggcacgcgcctgtagtcccagctacttgggaggctgaggcaaaagaatcacttgaacctgggagacggaggttgcagtgagctgagattgcaccactgcactccagcctaagtgatagaatgagactctgcctcaaaaaaaaaaaaaaaaaaaaaaagaatttttaatgaaaacaaaatttaactctttattaagtgaaaaatagcacctggttgggccttaacattagaatctccctgtaactaaagtgtgattttttttttcctttcttgttgccgtgagaccctgaaataaaatatgaagttctattaaaaagaacttcagaaactgaattaagtagcaactgagttagtaaatgagaaattgagagacctaaacagcagaaaatcgttgagatttctttctaatttccactgcctttcttagctagggctgtattttaacattagaacattattctgtgtattgtgtttcatgtggcaacattgaaattccatattttgttatctaggtctatacttttcccttttatgcctcaaacaagataccccggccaggactaagttggggagtttgaggggccaagatgaggaacacgagatcaggatcatgcagaaatctaaaggaaacaccagctctccgacattgcaacctgggccagaaaccaccagtgacctctgctaactttgtcctttcttccaggtggaaaggggaaaatgtggccaccactgaagttgctgatacagttggactggttgattttgtccaagaagtaaatgtttatggagtgcatgtgccaggtatatacaagatatgatctgtacctaacccatagagtaactgaacataattttggcctcaaggcgaagtttgtcattgctttctcccgccatccagagttaaacagttctttcagctgccagggagtaaggagcttatgtctggcttatgttccactataaaagccaactcagtgcatctgaacatggccttctcttcatttcagctcccagccattcttgggctctcaggcaaacaaagtctcaaatatgggagctccatgccacatttggcacacctcgagaaaagtcgtgtcatgcttaagagctgggaaatgatgtcctagcctctgaactaggaggcaaaaagaagagccagtgcagttgctagaagaaaaagctggggaaaagtggattttgtacagcctcttctttttaagatttctaagcccagttcaccacactaagtttcagaatcatcacacaagaacgttgtcaccgcagcttcatctgcagatccacttctgccagcagagtcaggagggccagtgtctgaccttgaatcctggcttcaacatctgctggctgtttgactgcaggcaaatcactaaaattaaggataatgccagccctgcagttaagcttgtcaagagaacaaattcattttaattacatcaacgctaagcatatatttatcaaatatatatataagggttgttgtgacaataaatcacattaataatagacatcagagaggattccagcctcaaaattactgtccaaatataaggcattaggggtattattattcccccacaactcatatttgggattcccacccatattcaaagtagaaatctaaaagtccctttttcccaagctctgacacttctacatggccctgtgcttgttattttttaaagaatattcaaggccgagcatggtggctcactcctgtaatcccagcactttgggaggccgagacgggcagatcatgaggtcaggagatcgagagtatactggccaacatggtgaaactccatctctactaaaaatacaaaaattagctgggtgtggtggcacgtgcctatagtcccagctactcgggaggctgaggcaggagaatcgcttgaaccagggagtcggaggttgcagtgagccgagatcgtgccattgcactccagcctgggcaacagagcaagactctgtctcaccaaaaaaaaaaaaaaaaaaaattaagtccggacactgtggctcacacctgtaatcccagcactttgggaggccaaggcggatggatcacttgaggtcaggagcttgagaccagcctggccaacatggcaaaacttagtctctactaaaaatacaaacattagccaggggtggtggctcccatctgtaatcccagctacttgggaggctgaggcaggagaatcacttgaacccgggagatggaggctgcagtgagccaagatctcaccactgcactccagcctgggtgacagagtgaggctccatctcaaaaaaacaaaaagaatattcaagaatatctcttgcttgttcctccccaactcagggacaatgacacgaggggaaatatggccacatcttgatgtgagaggggacagaatggaagggggtgtgaatactcccattggagaactccccaggccttatgctgagttaacacaagggtctaagttgtggttgtcagccattgtgccaccctacgctcttgcagacccttcctcaaatgttgtgtaaacatctaaatgcttgattttaaaaagaagaatcatacaaaagagtatgtgtgaggtgagagaatctagaagatgaaacagaaggatctagcctagtgttcctcaaagtgggtccccagatcagcagtgtcagcatcacccaggagtctgttacaagtgtaatttctcaggcccaccccgaactaccaagtcaaaatctctggggtggggccaggaaactgtgctggcacaaacaccccagagattcttaaaaacattggaagtctgatttagggggtgatgaaaatgcactagaactagatcctggtaatgatagtacaacattgtaagtgtgtaaaataccactgaattgtacacttttttttttttttttttttgagacggagtttcgctctcgttgcccaggctggagtgcaatggcgcgatctcggctcactgtaacctctgcctcccatgttcaagcggcaattctcctgcctcagcctcctgagtagctgggattacaggcatgcacgaccaggcccggctaattttgtatttttagtaaagatggggtttcaccatgttggtcaggctgctctcgaactcctaacctccggtgatccacaccccgaccttggcctcccaaagtgctgggattacaggcatgagccaccacgcctagcaaattgtacactttaaaaatgagttggaatgataaattttatgttatgtgtttatcacaatttaaaaaaaaacacacacactgaagtctgagaagcactaaagcccagtggttccaaaaatttggccaatcatcagaaccatctgggaaactttttaaagcctggatctaatggaccagaagctctggagtatgggactcagaatctgcatgtcttttttttaattcccaagtgaatctaatgatcagtgagttctgggagccactgaaacagaacaaagggaaggagattgacagtcttacagtgttggcagacagtcagataggatgaggagcaggtgtgttctgtgctgctccagtgatcagaactaaaaccaatggattaaaatgaccagggagccagttttagcctgagaactcccctgtaaccaaaggaaccatcaatagaatgggcttgtctcccaggataggaaatgcccccaccaactagggcatgtaaagagaggctggatgtccacctgggatcctgggagaactcttgcagcagtgaaagattagagataaattctaaagtccctcccaactttcagattctgtgattcccagtgccacaactgctgctgtctggccccccatccacagaggccagtcccattccagactagaaatgcagcagtactgtctgaagtaaggcatcattccactatgggtgattctgcacaaggcaatcacacacctcagctttggaacaggagagaatttccaggtttgggcctggagaggagttcactttttctaggtgtcacacctgaactgcccaactactctgtagaactttctgcaatgatggaaatgttccatatctgcactgtccagtatgatagccaatagccaccatgtcactatggaacacttgaaatgtggctagtgcaactaaggaactgaatttttcataatatttaattataatttattttagttttaatagccacaaataaccagtgggtgtcatattagacagtgcagctctagagaacccttggccaaaattgacctttacaattagcccagagctcctataggctggaaccattccccctgaagctgaactagtcccaaaccaccctccgagagttggggcagaggcctgagacctgacaggcccatttgcccgtaggtccagcgtcgctactaccagagcaagaagcaaggagacggtgaatgtggaggatttctgttgcatgagccttaattctaaaaggagcttattggagacacttgagatttctaagacaggtgctagggaccctaaactaagaggatctggtgccactgcctctctccctcagacaagaagcaaaccaaatgagggggcatctttttttccttttgctgtttgccttctttagagctataggtaaacacacaatcaccataggagagatttcgaaagctggggcccaggtaaccaagggaggctcctgtctcctctctgattacagctgagtagtttagggaagtggaactggactcccgctgggtctgctggatcaggtagaagatacattaatacctaattaccactgtcctcacaagaaggcagtggtaattgttggaaacttctctgggctaaattccctgatgtaggatctgttctctctgtggagagcacatcctcttgggactaatgggccttaatgggagggcacaaaacagctcctccctgtgcctgccttcacctcctgtcccacatcctctccaaaatgcagacaagaaaagccattagaaccttgattagataagtaggtctccaaggtggtatttgtgcccagaagtgcaacaaacctgacattgcaacctgaagaacaacccaagctcagtaagtcatgcatggaggtggagcaaggactttcactggagtctaaagtaacttcctgtagccaccagtccaacctactccctactaagatgtgtttgtataggctgctagaaagaaggatgatggttataagcacaggatctggagccaggctgcctgaattcaattctgtaccctgcctagtatttgctgtctgaccttgaataagtctcttaatgtctttaagcctcagtttcttcatctgtaaaatggaaataatatctacatctcttcagaaggttgttgtgaggattaagtgagatcatcaatacaacacacttagtatagggcctggaatataataaagattcaaccaactgttattattgctattagtattagtacaatcactttacagtatcttcatgtatttttaataaaaattccagctatccaaatgaaacccatgctataaatgttgtctgagcccacagttctttgaactaataaagcatcataaatagccttaacacttctaattttttctcactttatttctagatcatgagggtcgcattggcatggcctccatcaaaatgaaagaaaaccatgaatttgatggaaagaaactctttcagcacattgctgattacctacctagttatgcaaggccccggtttctaagaatacaggtgagatctcttattatccagttcaatgatctgtcctcttggagattcctaccacttagggaacaactcgccttctcccaggatgactacatttgccaagttttcaccgcactttccaggaagctcagaaaagtgtcatagaccaataaggaagtggtaatatcaggctgggtgcggtggctcatgcctgtaatcccagcactttgggaggccgaggtgggaagattgcttgagctcaggagtttgagaccagcctaggcaacgtagtgagacttcatgtctactaaaaatgaaaatttttaaaaaaggccaaacgcggtggctcacgcctataatcctaacactttgggagacagaggcaggtggatcacctgaggtcgggggttcgagatcagcctggctaacatggtgaaacccggtctctactaaatagacaaaattagctgggcgtggtagtgcatgcctgtagccccagctactcgggaggctgggacaggagaatcgcttgaacctaggaggaggaggttgcagtgagctgggatcacgccactgcactccagcctgagcaatggagtgagactccatctccaaaaaaaaaaaaaaaaaaaaaattagccaggcatggtgatgtgcacttgtagtctcatctacgtgggaggctgaggcaggaggattagttgagcctggcaaatcaaggctgcagtgaggtatgattgcaccactgtactccagcctgggcatcagagcaaggcccagtctaaaaaaaaatatatcagaaaacagctagaagaaatccaatcctaatccctttctccttacaatgacaggccagttcattcagcaagagacttagcacataactcacaaagtctgtttggtgagtcctgacagatagcgcaaatagaaatgctctgaccctgtttgttgtttccagttttaaagaacacagaaatccacagaagttctacacctttctgtggtgtgaaatttaattggacattagccagctggaattgcctaagacttaactatcaccgctaggaggattttttttcttcctccaacattaaccctttggttggtttaatactctcacttttagactttgagctctgtgattctgtagctgaagacttgacaaaggaggtcttaagattccagatattgtgtgtataggattattcctgttgatgttcatagggcaccaacatttgctttgcaaccagatggtaaagtggcatgaaaatgaaatatcctcagatattttgattaacacataattgaaggaaaaatcagtcttcaatctaatctaatagacaagcagactgagaaaacagagttgtctgtaaatgatccctccttctaatcccaccatgaatcaggatatcctagcggtacctgaagccttaccaagaaataggcaccacccctctgctcagaaatctatgcacaggtatctcatccttggcaggtcctccctccccacaggtgatcctaaagctttaagggaataaaaaatacctcacaaagggctccctaatggagatcctgcaaacagaatgtatgggtatcatataaaactttcacttcgctagaaaatgtaaagagtggatgttacttgcccctaccacaaaaatgatatctatatgaagtaatccatttgctaactagccaaactattccacgatgtatatgtacttcagcacatcatattgtacatgagaaaaacacacaatgttatctgtccatttaaaaataaattaaaatggaaaactttattttaactttcacttcccagctctcacatgagccagggatgctaatgatttgctagatccccatgccccacccctaccccttgctctgcatcctaatctattgcaaaatgcaaccaaaatgtggattatttgatgtttttcaggacaccattgagatcactggaacttttaaacaccgcaaaatgaccctggtggaggagggctttaaccctgctgtcatcaaagatgccttgtatttcttggatgacacagcaaaaatgtatgtgcctatgactgaggacatctataatgccataagtgctaaaaccctgaaactctgaatattcccaggaggataactcaacatttccagaaagaaactgaatggacagccacttgatataatccaactttaatttgattgaagattgtgaggaaattttgtaggaaatttgcatacccgtaaagggagacttttttaaataacagttgagtctttgcaagtaaaaagatttagagattattatttttcagtgtgcacctactgtttgtatttgcaaactgagcttgttggagggaaggcattattttttaaaatacttagtaaattaaatgaac

SEQ ID NO: 36800 - DNA, 39085 bp, Homo sapiens
ccagatcgcagctgaaggatctgttgagcgcttcaggaaaggcggtgagatccggtaccgcagcagagcactctcagctctgggtcttgcaggcgcagggctcccccatgccagcagaaagatttcctctggtgaagaggaccgtcgaatctgtcctcctcaagacacctcttgtacagaatttattcgaatgccacggccaaggtcttccttgaaaaatgttaaccgatgtgtgctttttgtcttttgtcatcctttctttaggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggtacatacatctcctagtcccttaatacttgaaaccctccctgcaactaggtgcatacgacagtttatcttaacagtgtcaggtggccgggcgcggttggcacacgcctgtaatcctagcactttgggaggccgaggcgggcggatcacgaggtcaggcgatcgagaccatcctggctaacacggtgaaacctcgtctctactaaaaatgcaaaaaaattagccgggcgtggtggcgggtgcatgtagtcccagctactcgggaggctaaggcaggaggatggggtgaacttgggaggcagagcttgcagtgagccgagatcgccccactgcactccagcctgggtgacagagcaagactccgtctcaaggaaaaaaattaaaaaaagatagttaaacttattatattccaaagaataccagccacctttattgatctccaaactgacatgcattggatttgctgggtttgcttttatttttacattttttgaaggagaatttttattctttttatttacagaaaattcagcagtgtacatttaacccagtttagtggcaacttctttcacctttcccttttccactttggtgattcaaacccacagatttaggacccaggacattgcctccccattggcagcgaatctcatcatatctgtccatgtaattggttctgaaaactgccaccaacttagccacacctcctttgtcttcctagtgaacctgtgtgaaggcaacgtcgtgcaggtcttcctgtggactagacatcccaatcttacctcacccttgataatgcagtaagggacccccattttgggacacagggcaggcaggaagacaaccagctcgatgggatccgcatcgtgtgcaatcaccaccagctgagtcttcttgttctccaccaaggtggtgattgtgttaacccctgctggaaagacgggtggtgtctcgatgggggtatcccctttgctagcagctttcttctcagtccaggacaacagtctctgcttcttctcttgttttgtctctggtctgtgcttgtgggcccgcgtaagcagtcagtagctgtttggcagtgcgaagcctgggtgaactggttaatggcaggaagtgctttcagcagcttataaaaggatagctctttgctgctgcaacctgatataggggggccatctgacaaagagggtgaggtctctttggggctgtatgtcctgtccaatgccaaaattcttaggctttttctcaaacagaggattcacaacttttttggcttcctgcttcttcactgatagcaggggcgggggccgccttctttcccttagccttctttcctattggcatcttgggtggctagaggagaacgggtttgcttttaagctagttttctgaacatttaatagtattgaggtgccctagataagttttacgtttcatatttcataaaaactaacacattgttggccagctacataaaagtggctttatagcatttcttagttgaaccgaaatacaatccttttgcaccctgactctgttttggggactaattttatgtgacaatcatccttattcagatctggagtggatccccttagctgacctgcatacgtgtatcatcatcagtcttggacatgggctaaaagcctgttgtttttagtaaacagcagaaaattctgctcttaaaatccagccacaatatggtatggaggttaagaatgcagtcttaggctcaaaccttatttctgtcacctactagcagtgtgactttgggcacatcattaagcttctctgtacctgtgtttcttcatctttaagaagtggataataatagtatccactttatagagttattgtcaggagtaagtgaatggataattatgccaatcacttacaacagtgccaggaacatagtgttacatgttggttattattcagtaggcctaggatgggactcacacatgtggtgtctttactaagcatcttagccagttttggcagttactgaaaaggcatgaaatcaattgaggatgggaggaggttgggagggcatccatcatcttgtctgattatcaagtttctggtttttatctccaatgtggtttaaacttattctctgctaaagacttaacgtggaggtttttcttctgattatccacttggcaaaattttaacactttgtaaactgcttccttgaaaataaataagctgtgtttcatcataacgctctgacttctgttccaacagaccacacctgtgtggttcaccgttatatttctagagccaagcatgtattctactatctccattttttaaagctccccagatgattccaatgtgcagacaacagttcaaagagagtttctattccatgggattttgaaaatctgacaggaacagaagccccaaactgtcctcattcctcccatttaaatttttctcctttcttctgtccttattacttcttccaatcccatcagttccaatttccccaacttccatcccctgctctctctctcttttctttttaggcagagtctcactctgttacccaggctggagtatagtggcgtgatctcagctcactgcaacctctgcctcctgggttcaagtgattctcatgccttagcctctcaagtagctgaaattatacacgcactactacgccttgctaattcttgtatttttagtaaagatggggtttcaccatgttggccaggctattctcgaactcctcacctcaagtgatctgctcacctcggcctcccaaggtgtggggattacaggcatgagccaccatgcctagcctctcttttcttacacagacttcctgctcaaatgtgtgagccttgtgcctaggtaggaaatataatcagtgtatagagtttgtagagagaagatttattcatcaatggtagaaaattgtaaaatgcaggagcagaagcttctttttcttctactcactaacccaatactgctctgtgctcactcttttggaaagcagtggattggcacagtggtaaaccttacctaagttccaatcaggtgtttcgaaggacttgaaggatgttgttgacacaggataacacttgttgtggttagtgatttgaaaaagagttgaaatataggagtacctcaaagaggtgagatctgtcattcatttcactcagtgatcccaacagacctgctgtggataggatggctctactctttgtaaacgttgaacttttggaatacacatacagacttgcatttatcggtacctcataaagtattttattacagagggactttctaaatatctcttgaatgaataaatgaaatgaaattcagaagttaggaacatgcctcacctgctctccatacagcaaacatcttaattccaaaatgaccttgccattcattaatttaccttaattaaaaaatatatacacttatgtacaaacatgtttaaataagcttttaattttagaacagttttagacttacaaaatttattaggaagataatacagagaattacagtacacctcatgtccagttaccccattttacattagtatgatacgtttttaaataatgaatgaaccaatattgatacattattattaactgaagtccatactttattcagatttactcagtttttcctaatggccttttgctgttccaggatcccatccaggatactgcattacatttaatagtcatatctccttaggctctttttggctatgaaatttcttagactttccttgtttttgatgcccttgatagttttgaggattacttactggccaggtatgctgtagaatatccctcagttgggatttatcttatttttttctcatggttaaattggggttatgacttttggggaggaatattataaggtgccattctcctcacctcccatcaagggtacatactatccacattatacccactgtttttttttttttttttggaaacttaaaactcattttatgttattataagtaagaaattagcattcaatatatgccacaatatatctttgttgaagtgtaagtttgttccacttttctatttttcattttccaacttttattttaggttcgggggtacatatgaaagtttgttacaaggataaattgtatggggctggtataactgctagccatatgcagaagattgacactggatcccttccttttgccatatatgaaaatcaactcaacatgcgttaaaaagttaaatgtaaaatctaaaactataaaaaccctagataatatcactattgatgttaaccttgatgtcctggcttgaaatagcatttgtcagtttttgccacactgtaaagttgctccttttttctccattgccatactatactctttggaacaaagtcactatgcacagcccactattaaggacaaagtcttctattctaggccttctgtctttccatatgaactttagaatccatgtgttagcttggattctaaaatagcttgctgggatgttgattgagattgcattgtatctataggtcaagttggaaagaactgacatcttaacaatatttaatcttctagtctatgaatcagaatatctctccatttatttaaatcttagactttcttcatctgtgttttctaattcatgcttataaatcctatacatattttgttatgtttatacctacgtatgtaatttcaggggtattactatagatggagtttttaaaatttcaaattccagttgttcattctagtatataaaaaagcaaatgactgggtgcaatggctcatgcctgtaatcccagcactttgggaggccgaggtgggtggatcacgaggtcaggagatcgagaccagcctggccaacatagtgaaaccccatctctactaaaaatacaaaaaattagctgggcatggtggcatgcgcctgtagtcccagttactccggaggctgaggcaggagaattgcttgcacccgggaggcaggggttgtggtgagccgagattgtgccactgcactctagcctgggcaatagagcgagactctgtctcaaaaaaaaaaaaaaaaaaaaagcaattaacttttgtatgttaaccatgtatcctgcaaccctgctgtactcacttgttgactctaggagtttttttctttttttcttactttttttttttaatcctttgggattttctacatagacggtcaggtcatctgcaaataaaaagttatctttattccttcccaatccgaatatcctttacttttctttcttctattattgtactagctaagacttctagtgcaatgttccataggagtggtgagagaggacatccttaccttgttcccagtcttaggggaaaagtgtctaatttctcactgttaagtatgatgttggttataggtattttgtagatgttctttatcaaattgaggaagtttctctccattcctagtttgctgagagttttcaccatgaatgggtgttgtacaaacaacattttaacaaaaaaaaaaagaaaaagaaagcaatcctactgccttaataagtcgactggttttctgtattttcacatttttttctatttcaaataaatgaagtatactcaaaagagacatgtctaacagggagcgattatacaagtataattatatacccatagatagacataatattacatatttggtgattagaatgtaaatttaattttacagttccctttgtacttcattatatcatacgccatttttaatgttcctgcacagacttcaaaatcatagtttttggtgtctccaaattcaatttccataattcattaactaattcatttcaaagcatttattgcacatccaatacacaccaggtcctgataatagagatttaaagaaggatatggctactctcgggtttctcacagtcatggaatcaaatgcctgataatatagtgtgtttaagttatctttatagaaatatgaacagagagttttgggagcttggaggatgaataggggaatctaattctatggagaaattagaaaagtcttgttgaaggaagtgacatttgatgtaactcttgaaggacaggaaattttccagatgaagaaatagtaatatttacgaaggtttaaagttgtgcaagagcctagagtgtttcaggaacaatttaatgacttagaaatttgagattaaataaggacaacactggatgaagattaaaagataaaccgggctagattgtgaaatgtgctaaatttcaaaataaggaattttgttttccatatggaatcaagagaaactattaagcagtggagtggcaggatctactttgtatttatcaggatacccatggagtggtgtggaaggtgaattctgcatgttgaggctgagcgcggtggctcacgcctgtaatcccagcactttgggaggctgaggcgggcggatcacgaggtcaggagatcgagtccagcctggctaacatggtgaaaccccgtctctactaaaagcacaaaaaaaattagccaggcatagtggcgcgtgcctgtaggcccagctacttgggaggctgaggcaggaaaattgcttgaacccaggaggcagaggttgcagggagctgagatcgtgctactgcactccagcctggcgacagagtgagactccatctcaaaaaaaaaaaattctgcatgttgagatactataatttactaaaccattcatctattttgggaacatttaacattgttactaattaattgctatttaagttatacaaaaatatatctatgcatttgactttatattattttgaaatttttcttgggacaaaattttgggagatacatatatcttattgaagtctttttgagataaatgttgatgtattttattagttttcttatgcattttgtgaaacttacatcttattctgtatatccctttctcaatacaatttgatatgcatccattaaacatttattgagtgctatttatcattgtggatgctgtggggaaaaccatgagtacaattcaaggggcttacaatctagttggagagataaggaatacactacaaaacattatggaggtctttgaatcctaagctgagaaataggaactttattctgcaggaaatgggaaaacatctaaaattttaattagggcagagatttagtccagccacaccttagagagaacactttggttgaaacaggtaggctagattagaagaagagacttcaaaggagtcttatgaaaatgttattagcagttaaagaaatgagatgttggattataggtcagagaaatgggaatgatcaatttaggattcctagattgaataattaagcaataaaaatgggagaaaaacaatcctaaaggtggacaaagccaacaaacaacaaacactctcctttgtggctatttaatgtttcataatactcaatatctcaatatctgttcatttctagaataaaaagggaggaggagatccaaattgattaaggtgattttccatagtcaaaacaatttttgaaaatctaaaaatttgaaaactcctcatttgtgaaatctcggtgacaggctgggtagattgcatcattgcattactttatgtgatcaccacaacaatgctataagatagttaataggaagtttttttttctttttctttttttttttttttgagacggagttttgctcttgttgcccaggctggagtgcaatggcgctatctctgtcaccgcaacctccgcctcccgggttcaagcgattctcctgcctcagccccccgactagctgggattacaggcatgcgccaccacgcccggctaattttgtatttttagtagagacagggtttctccatgttggtcaggctggtcttgaactcccgacctcagatgatctacccacctcagcctcccaaagtgctgggattacaggcatgagccaccacgcccggcctcaataggaagtttttgaggatgcaaagaagtttgttgtaggggaaagaacactgaattgaggattaatgtcatttaatgcagtgcatctcagtttgcatgagcatctgaattctgaatcacatgaagattttgctaagatgcaggttctgattcagtaggtctgaggtggggcctgagagtctgcatttctaacacaatctctcaagggaagccccagctgctagtctacagaccatactttggtagtaaggatctagagcagtggttctcaaatttcagttgtttttttgggcatttagcttgtctcatttttgtattatgaataatgctggtattaacatcctttaacataaatcttcctaagcgatgctgaatatttttttaaaaggctaggtaaattgcaaggagtttcatatacattttaacactgctctccagaaaacgctggagatgttatactctttccagtatatggaaactgttacactctttcctgtgtatcttcccattttgcctcattgttactcatttaaaagactattactcagtgttagtaactttctgttcacatgtttagaacttcagctgggatagaatagaataggtagaatttctggggactggccatatattttctgtcccagacattctcttcatgtggtgaggctggacttcctcaagctatggtgatctcatggtagttggatttctcatatggctgctagcttctaccagagtgagctttctgagacccaggcagaatccgcaaggctacttatgacttggtcttggaagccattcagtgtcatttcaactgtatgctgttggtcaaaagcaagtcataaagataactgagattcaaggggaagggactacataagggcacaaatactggaaggtgtgtgtgtgatttaattgacacttctttcagaaaactttttcagatgtctattggctattataaaacatgaagatgatcctcaagttgctatgaatactttctatttattgcaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaaggtagaaaattgtgtgggtatctttgtgtttgaagttgtttgccaagtaaatgaataacgtggtttcagttacctatgtttacttctaaagattggcttgatttgcacatgtatttatcctacccaggcaaaaactccattctttgtcctcctttgctcctcaaaaatattcaagggacagtctctctttcatatattttggctgcagatacaggaagccacctggcagagtgttttcattaccttcatttcacattatttgattgcaataaacagatgaagggaaatgttttccccattacagaagggaactgataggtatgggaactttaaaactctctggttccacaacttgtccattactgcttagcccttttgtactttctgaagtactttccaatatatttgtttacatgaacatcataaaaacccagtaaagtatagctcttgggtagttaactctggtgtagaggggagaacatggaattgcagaataaaaacctgaattctggtgcttgccctaccactaactaacttagatgttagacaagcaatttcctcaatttcaatttttaaaaattttcttgtttgtaaaacaagatgattgtaccagatcacttctgtggttccttcctgctctaaagtattctaggacttttctataatttctgatcacgaccataaaagaattttatggtcagatatttctgacagctggcaaaaagcccaaaccttctgccttctgatcatcctgctaagtcatgcctttttctgcttaatgacaataagaaaatgaaaacatctagtgaacttctaaagtaagtcatttacattccagtggtgcttctcttcatttatttaaacaatacttattgaacaagtttgctaccatactaagcattgaatatgcaaagacaaaaaagaaaaatcagtaactttatagtctagttaaggggataaaaatgaagaaaaattttattataaatataattaataaaaatagagagttacatggggacaaatgctagagatctatacgttgcagctcggaggaaagatgttgaacccatcaggacatgaaatatcaggttccagggaagttttcttaaagaagataaagttttcttaaagctgagtcttgaaggatgagtaggagtctaccaaataaggaataaaagggtgatctcggcagaggcaccagcctgtgtaaaagaacatgatagaggaactataaatagtgctggattgctagtgcatgcaggggtggtttgtctctctttttttttttttgtttttttgttttttttcagacagagtcttgctctgttgcccaggctggagtacagtgacacgatctcggctcactgcaacctccacctcccaagttcaagcaattctcccgcctcagcctcccgagtagctgggattacaagcatgtgccaccacacccactaatttttgtatttgtagtagagacggggtttcgccatgttggccaggtgagttttgaactcctgacctcgggtgattcacctggctcagcctcccaaagtgctgggattacatgcgtgagccaccgcacccggccgggatggtgtctctattagtccatgaagacattatggtcatgggcccgtagaagcacatagtgtttccttaacctaagtagggtaacccatatttattattttttataaagctaaaaatcataacactatcctgtttcacagcctctttctttatagttctttgtaaaatgggtatttatgggagccaaagggagattcatttatataaaatgagagccactgaggtgtttttctaccctaccaggaaaaggagccctatagctcagtcacttatttaaaggtagccaggagaagagaacctagggtaagaagacatcagaaggtctcaggacatataggggtcaggagaagaataggcatttagtgcatggagtgtcataaaagcacaggagaagcccaggctttactcaggtgttacagtgccttaggacctggaccaagagacctagtgacttgcacttttctagaagaggagggtacattagcctgccaacactatgttatttttttctgtcttgtggaaattttctcattctgactacagccccaaacagttcttatttgtggagtatgaaaatcaaatatccctgcatgggtcctattatgtgatagtgcctgtgatatcagccctttgtgtaacactatgcaaggagagtcatgtcagggatgtcccctgtggttatcacttttcttttcagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggtgagcagcttaccaggaaggaagacccttgacccatgcctgtgacctgacccctgaggaatgggaggattgtggtctgagtaattcctactttggaatgaagtaagacttatcctaattattcttgttccccagaaggatgttggggtaacttgtattactgccatttttgtaattttggagattagagcaaaatttgcagtctatttagttttacaatgactttagtcattgtatcaaatgactggagtatcaaagggaagaatgtggagttcttgaggagcattaggtagaataaggaatttttcagcagtaaacacaaatattgagtttctaaggaaggaatgaaagcttgaagaatttcagtctttggcctggattttcatttaaaaaaaaaagcactctatactctaaagtatataagaatatatgtgctgtaagtgaaatgcgagtaggtatttaaggggatgaaaagataaaagagaatggaggttttctgaggcagtttatatttatatctctaaatccaaaatacaaacacatcctgagttaagcaaagtacatatgacaaggaaatcacaaggtactactctgaggctatgggaaaagaaaataggcaaaaatactgagaaaggcaagaaagtagctgagtaaagagaacacttggagaatatatgcttaaacttaagtctgcaaaaaaaacaaatgacttgacaaatgatatctatcatgtaaaccattacccaataattattttcccttctcttgcaggaattgagaagttcaaagggcagtacttccacagtcgagactataagaacccagagggattcactggaaagagagtcattataattggcattgggaattctggaggggatctggctgtagagattagccaaacagccaagcaggtttgaatcactcaattattatttacgttgcttaactctagcttcagtttctccaaggaagctgcaggtggacccaacagagaatagggatacctgcacatagcccttcagtgccagtggcaaatatagggcttcgtttcattacctcagttggcaacatggtgattggtgctaatagaggagttaaggctaccagttagagttccattgtgcaactagcctcacaccaaggaactggatcagctaaagtctgggctcattatcctaatcaggcatcttctcagagtgtgcctctggctttgataaagacaaagtaattgctgggagaggttgttagaaagcagtattgagagcgaggatcttcaattggccagcagaagtgctatgttcttacataaaggaaagcacgcgtgatcattggaaacttttcactcataggatggtgcttgaattttcctttacactccccaaatggaaaaaagtatcaattttatcttcccaaagacaatgtgggtatccgtatagcgtccaaactgtagcacatgcaagcagcttgccctggcctttgcatacagttaggtaactcagataacattcattctaaagcaattatatctccttggctttttgttttgtttgttgtggtttttgtatagcagactttgaactgagaagcaagtgtcttcactataaattcctggaaaaagacatgccaatattgtattttgttattaatgtctgtgttgaatcaaactctattggcaataggtaaatgtcttggttgttctttagtaactttaattaagccatgcttctctataaagatgttttaaattgttttattttaattagaagcttagtgctacaattctgttaaatgactcttactcagcaactttgtttgaaaaacacttcttctcattgctatcctcatctataaccacaaaaattatttcatatgatacttcataaattaattcaacagacatttatcaggaaataatcatataaacaaggattaaaaataattaaaataattatataaacaagggttaaaacgtatgtgggtgttatggtagaggaatgtgcaaaatgtggagtggggacccatggcgagagccatctttaatatcattggcttgtcaaatgggcagttctaagggagcttggccttacctgctctggggaattgcaggttgccacataacaaagcatttctgtgtgggtacagataaggtggctgtgtctgtgagaaagcctgggaaaatgcaaaggaaaactatgtctgcatagcagaggcaatactgtcacaccactaatccaagctgaagaaactcaattgctgagttctaactttttactttacttgtaaattgtattcatgatgatttgtttataaatcaaaaactttaaatggacctatatatttcagtatatcatggaagtttttcgtataattcttgtagatgcttttgtaaagagaaaacattcctttttttcaatattaatttcatataagattacactgattaaacaattttccttataaatctgatttgtaaatgttatttgcttaaaacaaggtatagatggaaaactgaaataagaaatatgacagccattaagcacttatcaagtgtttactatataccacaccttttacaaaaacactgcttaattatcacaacagccttgtgatatatgtattattattattactatttcataaataggaaatcttttcattagggctctgagcgttttcattactcagcagaagttatatagccagcacacaaaattgttcagtttctaagaccatatatgctctttcaactgtgactgtggaagtacataattatcagagtgcttacagtcactttaggcgagataagatttgtgaagtaaacaattatccctctgtagacaggtcattttagacaaaaagactatgaagcaatgtgcgtatataacttaaaatctggaagccatctccagagagtttcataatgtaggaaaagtgattcttttgccaggtaactgcatatcaaatctttatcagttctgaacatgaactttagccagaggaggacacagaaagactgactagcttcctgttgttccactagcaatcttatttttctccattaaataatcaatcaaacatttcttaagcacaggctttggagttagtcagacctgggttggaaattcacctctgccacttactagctctgtgatctcaggcaagttattcatcctttccatgcccctcatctataacatgggtgtaataatactttcctcaagaggttgttgtaatatagatgaaggacctagcacaatgacttaaaggtcacaaatcccaataaatggaagtgatgataatctgctgtggatgtgtaggctttatctcctatccttgagaaaacacatttgaagaaacagaaattaggagtgtagaaagtttaatatcaataaaaatgataaatagcaggggtttttgtaataatgccaacaatgtcaatggcaaaagaatgagggttttagattaaatggtctccagctgctttcaactttaccagtacatgatttttaatgagttctacaggtgataagtgctagagaaattcagaggatggagagaaaattgtcagcctgaatagtcagcggtttcttcatggaggaggcagtcttgatctgggtcttaaaaatgaacaggcttcgcagagttaagaggaaagaaggcatttcaggcaggcataatagcactaaacagaaatacaacggtgtattagagcaaaacatattcttggacagtagatacaccaatttaattctaagtttagtgtttgggaaggaaaatggcaggaaacaaacataaaaacccacaaagattgtgcaggggctaaaaagccagactaatgagtttgaactctttttttttttttttttttttttgagacggagtctcactctgttgcccaggctggagtgcagtggtgcgatcttggctcactgcaagctccgcctcccaggttgacgccattctcctgcctcagcctcccgagtagctgggactacaggcacctgcaaccacgcctggctaattttttgtatttttagtagagacggggtttttcagtagagacggggtttcactgtgttagccaggatggtctcgatctcctgacctcgtgatccgcccgccttggcctcccaaagtgctgggattacaggcgtgagccaccgcgccgggcctgaaatgattcttgaagaaaatgggggtgcttttgaaggtttacgaatctgagtgacaaaagcaaacaatttcttccatgccccaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacaggtatgttcccaggatgggagtgcagggatagtggccaaagcacaagaataaggactcttcacactggctaatagtaaagccacctctacccatacattaagaaaacccacagtggctgggcatggtggctcacgcctgtaatcccagcactttgggaggcggaggcgggtggatcacctgagctcaggagtttgagaccatcctggccaacacggtgaaaccccatctctactaaaaacacaaaattagccaggtgtggtggcacctgtctgtagtcccagctattcaggaggctgaggcaggagaatcacctgagccctggaggcagaggttgcagtgagctgagattgcaccactgcactccagcctgggcaacagactctgtctcaaaaagaaaaaaaaaaaaaaagaaaagaaaaagaaaagaaagcctatagactcatagaatctgaaatcagatttctaacttgtacccacagatgtccaagatctattggtctgtgggtttttaatctagaattctctttggcagtaacccttttctcattcccccaggtatcagttctttttgcatgatacccaacaacaaaatgatagctgaggacagtgcgtcatttactcattgagtacctgttatgagccaggcatcatacatgggcatgaaatacagagagaagacataatagtaatagtaatagaaataacactcacctttctgaggactttctataagataagcacagtgctaaatgagttacatgcagtatctcacttaatcctgacaatagccctataagttggtactatttttgtttcacagtgaggaggtctatgcaaacctaccccaaaggctgaggaagctgagaggctgaagaaagaagctgacagattcagtttcttagaaacatttcatagggacttatgaacagaagccatgtctgtctcaggcagtggtgagacaagatggtagatccccataccattatctcctgacccagggatgatataccacaggggaggggcacacatacttcagagcgaatgggtaggagtttgccctaagggtgggatttacagtaagtacatactattaaacaacagattaactggaaatctcagaggtattcccgaaaccagggttgatcagaagtcaatatggtagattaacttctaagatggagttgctttggcctccacaatttttgatctacattttacaaatataaaaactgagatgtagagaaactaagtaattttcccgagggcaacagaaataataaatggcagactcaaaaaatagatcttaccttaaatactctaatgagaagaaagaggacagattataatgaagaaatacatacagtgttatgaaagtacaaaggatggggtcctcagagaaccagggagggaaaacatttctagaggctgattttaaatttattttccctccaactttttatttttgaaaatgttcagatctacagaaaagttgcaaaataataagtacaatgagcacccatatatccttcacctggattcacctgttaagtttgctatatttgcttcctttccccatctctgtagataggtccatacatatagagcatacatacacaagtacatttttttctgaaaccatttgagtacgttgcagtcattaagacactttaaatacttcagtgtatattgtataagaaaaagggcattctcctacataaccatcatataattatcacacgtgggaaatttaacattgataaaatacattaatacattggcaatatccccagttgccccagtagtattttttatagctttaaaaaaatctttttaaatctagtatcctgtcaggtaatcaatcacaccattacatttagttgtcatgtctctttaatctctctttttatatatatatatttttattatactttaagttctagggtacatgtgcacaacgtgcaggtttgttatatatgtatatatgtgccatgttggtgtgctgcacccattaactcgtcatttacatcagatatatctcctaatgctatgcttccccactcttcccaccccacaacaggccctggtgtgtgatgttccccttcctgtgtccaagtgttctcattgttcagttcccacctatgagtgagaacatgcagtgtttggttttttgtccttgcgatagtttgctgagaatgatggtttctagcttcatccatgtctctacaaaggacatgaactcatcattttttatggctgcatagtattccatggtgtatatgtgccacattttcttaatccagtctatcattgttggacatttgggttggttccaagtccttgctattgtgaatagtgccgcaataaacatacgtgtgcatgtgtctttatagcatcatgatttataatcctttgggtatatacccagtaatgggatggttgggtcaaatggtatttctagttctttttgaggaatcgccacactgtcttccacaatggttgaactagtttacagtcccaccaacagtgtaaaagtgttcctatttctccacatcctctccagcacctgttgtttcctgactttttaatgatccccattctaactggtgtgagatggtatctcattgtggttttgatttgtatttctctggtggccagtgatgatgagcattttttcatgtgtttttggctgcataaacatcttcttttgagaagtgtctcttcatttcctttgcccactttttgatggggttgtttgtttttttcttgtaaatttgtttgagttcattgtagattctggatattagccctttgtcagatgagcaggttgcaaaaattttctcccattttataggttgcctgttcactttgatggtagtttcttttgctgtgcagaagctctttagtttaattagatcccatttgtcaattttggcttttgttgccatggcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatcaagtttcagctttgtacatacggctagccagttttcccagcaccatttgttaaatagggaatcctttccccatttcttgtttttgtcaggtttgtcaaagatcaaatagttgtagatatgtggtattatttctgagggctctgttctgttccattggtctatataagaaataattctctctttgacatgggctttctttttaagaacccaaggcattgttttgtagagagtctctaaatttagacttgcataatttttttcctttattatattcaggttaaatgtttttgacacatatactacataggacatgttgatcttagtgggtcacatcaagaaccacattatgtcagtttatctcacagtaataatgctaaatttgaccacttagataaggtggtatagataccatcaagtttctccactataaagatattttttcccgttgaagttaatcagtggggtgacatttggagactgtgtttcctaaaaacctttcacctaattattttagcatgcatgtttttggtggttgcaaaataaattgaggctttgttgaataataggagatagccaaacaaatagagcaagggtatagcattctaattataaagacaaagtcttggaacagcaaaaaatacattatgctccaggacttgcatgtagtctggtatggctggactatatagcaaagatggaagagtgactgaatgtatctccaggttcatcaggcatgaaaacctttggttcctccgcggtcttctgagcggtcacgtgaacggcttcctgcaggctggccatggcgcttcaagttcccaaggctccgggcttcgcccagatgctcaaggagggagcgaaacacttttcagaattagaagaggctgtgtatagaaacatacaagcttgcaaggagcttgcccaaaccactcgtacagcatatggacgaaatggaatgaaaaaaatggttatcaactacttggagaagttgtttgtgacaaatgatgcagcgactattttaagagaactagaagtacagcatcctgctgcaaaaatgactgtaatggcttctcatatgcaagagcaagaagttggagatggcacaaacattgttctggtatttgctggagctctcctggaattagctgaagaacttctgaggattggcctgtcagtttcagaggtcatagaaggttatgaaatagcttgcagaaaagctcatgagattcttcctaatttggtacgttgttctgcaaaaaaccttcgagatgttgatgaagtctcatctctacttcgtacctctgtaatgtgtaaacaatatggtaatgaagtatttctggccaagcttattgttcaggcatgcgtatctatttttcctgattctggccatttcaaagttgataacatcagagtttgtaaaattctgggctgtggtatcacttcctcttcagtattgcatggcatggtttttaagaaggaaacagaaggtgatgtacatctgtcaaagatgcaaaaatagcagtgtactcttgtccttttgatggcatgataacagaaactaagggaacagtgttgataaagactgatgaagaattgatgaatttaagtaagggagaagaaaatctcatggatgcataagtcaaagctattgctgatactggtgcaaatgttgtagtaacaggtggcaaagtggcagacatggctcttcattatgcaaacaaatataatatgatgttagtgaagctaaactcaaaatgggatgtctgaagactctgtaaaacagttggtgctacagctcttcctagattgacacctcctgtccttgaagaaatgggacactgagacagtgtttacctctcagaagttggagatactcaggtggtggtttttaagcatgaaaaggaagatggcatcatttctaccatagtacttcagggctctacagacaatctgatggatgacatagaaagggcagtagatgatggtgttaatactttcaaagttcttacaagggataaacgtcttgtacccggaggtggagcaacagaaattgaattagccaaacagatcacatcatatggagagacatgtcctggacttgaacagtacgctattaagaagtttgctgaggcgtttgaagctattccccgtgcactggcagaaatactctggagaaaactctggagttaaggccaatgaagtaatctctaaactttatgcagtacctcaagaaggaaataaaaatgttggattagatactgaggctgtagtccctgctgtaacggacatgttggaagctggtgttctagatacttacctgggaaaacactggtctatcaaactcgctgctaatgctgcagtcactgtacttagagtgggtcaggtaatcatggcaaaaccagatggtgggcccaagcctccaagtgggaagaaagactgggatgatgaccaaaatgattgaaattggcttaatttttactgtaggtgaaggctgtatttgtagtagtattctaagaatcgcgtgatgttttcttattctccttacattaagaggtattttgtgtttgtattcttggctggatgttataataaacatattgttactgtcaaaaaaaaaaaaagaaaacctttggtctactaaataaaaagtatggaatgaagacagtccaaagccattcaaagatttaggcaagtgagtaacataatcatacctacattttagaaagaccattttgaaaatggtgtgggagtgggatgagacaggaggtcctaaagacaattgtatcatctggttgagataacaaggagtagataaaactatcttggggatgttaagaggagaaagggaaaaggcttggtgaccagatatataactcatggttttgtgggttgggcaactatatggatggatggtggtactgctggtgaaaaggagtaggtttggagaaaaagatgaaatcatgaggttggaatgcagaacacaatcgacctagtgtcaaagcataactaaatgcaacaaaccagtagtggtaatttaaacatataaaattcctgaggccaggacagctctgtctgaagatgagttaatatagtattcaggcattaagactactttttaggccaggtgctgtggctcacgcctgtaatcccagcactttgggaggctgaagtgggaggatcacgaggtcaggagttcgagaccagcttggccaacatggtgaaaccctgtctctactaaaaatacaaaaattagccaggcatggtggcaggtgcctgtagtccaagctactcgggaggctgagacagcagaatcacttgaacctgggaggtggaggttgcagtgagccaagatcgtgcgactgcactccagcttcggcaaaagagtgagactctgtctcaaaaaaaaaaaaaaaaaaaaaaaagactgctttttagaaagctccacgatactagaaaccagccttattattattaaaagtaatggcaaaaaaataagcaattacttttgcaccaacccaatgtttccagtatccgtatcctacgctgtccctaggaaacaataacaagcccgaagtataccaagataattcactgaaaacaactttgagataaattctaaaatcctaggctgtgtatcattggacaagtcacataacttttctaggcctcaatttcctcatttataaaacctggataatgacacctattctgcttccttcatagagttttgtgagagtcaagttaatgcatgtaaaagcaacttataaactgtaaattgctacatacatgtaatttatcatacagtttggaaaacagtggcctaaacctagctcttgagcctttgaaactggaaatgagactgaacagaatgttgacagcttagttctgtcagacttcttggtatgagaatacaaactattgacctgtggccttatcatatcacacacagaatattattgttacttgagaaatcatatatgcactcctcaaacaacactcttccttcactcctccaacactctccctttcagtgcatccagggtccaacttcagatctgatcttgatctgtgccaacctagtataaattagaccttttccaaacttcatgcatagaccaaggggaagattattggcattctgtttacctccaccaaagcaaaattttacttatgtggtactgatttctctttctctcatttctccacttgatctttgtcacgactcacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccgtttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtaagtgaccatgcaaatagactacttaattacttggtgatatgtttacctctgtttaggtacttgtttttaaatagctagagatagcatgtatgattacaacagtgcctagcacaaagttagtacagaaaaatatatttttgagtgaatctaaagtagcaatttataaccatggacatacatcatacctgggaaatttttccaagctatgcatgctttgacaccatccttgctgatgcttatttagttagtctggggtggggcagtcataacatctttgagaaaaatattccccagtaattccaatgtgtactccaaattagaatttactcatctagattttaggcaactggcatatgtttctgaagtaaaatagttttatcttctttcattatagataaaaataaaatatagaaatagtatgactttatttcggccgaaaattaagacctggttgcagactagtcaatattgtaggatattcaatcccccaaattctcacttttctccttttatgtcccctctttcagttttggctaggaatatatgaaaaaaaaaaggggaataggtttcatatgagtcagtagaatgatatagcttccaaagaaataattaaatctagcatcattaaaaaactataatgttctagaacattacaactgttgttctctaaactggccagaccacacctaatgatacattttaaaagtgaagctggagtgcgtttaataaggagagagagaaaaattttttaagggatttgaaaacatgccatctgaagtacaattgaaaaagccggagagagatttagcctggagaagataaacttcaggagagatatgagaatttccttcaaatatctgaagggaaggcacatggaagaaggattagatttactcagtatagcttcaaagggtcaaaccagaatcaaggagtgaaatcttgagggttacacatcagcttaccattaagaaaaaaatccaaaacctttttcctatcagccaatgccatttcatgatggaaccagctgcctctgaaattctaagcagaaaaggaaaaggatgccaaatgactgaatgctcactgggccggggcaggagagggggaaggtatggagtagattcaagcctcaggatagagagaaacaagatgatgtttaagggtccttctaaagaagaaattcactgattctatggttgttataacaaaatttgctattgttactagcatttaattaaaactactcagagttcctgttggaattacaccttttttgttttcactagtgaaaatcttcacagttgcagagaaaaaaagaaccaatggtattacagttgatagttcaacaacctttctaaatttccccaaatttctattacttccagtcctatccagcagattatgtactacctgagagaactatacaagtagtcaaacgcaaatagcccattaagttggcctaattctagtcatattaaagtgatcttttaattgggtcaattacataagcggagaacagttcattaaaacaggccacagcatcttagtatactttaagcaactgggactcttttccaagaccaagtgaattcttgagaggaaatagagaaaatgagtatttgcaagagtctgcattatggttatgagattatgggatcttagggaaaatgtacaaaaagcccagcttcctatgctagcagaagcctagtgctaattcctccagcttttttctaacacctggaaggaagaaatcttcagaattctctaactttaccagacttccaacaggaactctgggttttttattctgtccatggccaatctgtctgcctcccacattcttgcctttctcttccctgaattatcccttcactatgccaattttaaaccctttggattagcttgtttttcccatttttttcatgtctgcccaacaaagcctgcctccttccttgtctgttccctaccaagccccattttccttcttcttctgttctctggaattattgttctcttgtcaagaaaatattctactcttttctagaacactgaatttacttccttgccttgactgaaatgaaacatagtttctgttttgattgcgtcttttgcagcccttgcaagtgttttattttcactcagcaactttctttccttcaaaactatatcaagttacaccaaatctctggatcacaagaagtcattatgtcataggctggcattaaagttcctccacaaattggatacaacctccaatttcaggcccatctttctttctttctttctttctttttttttttttttgagatgcagtctcgctctgtcgcccaggctggagtgcagtggcgctatctcggcccactgcaagttccaccttctgggttcaggccattctactgcctcagcctccccagtagctgggactacaggcgcccgccaccatgcccggctagtttttttgtgtttttaatacagacggggtttcaccatgttagccaggatggtctccatctcttgacctcgtgatccgcctgcctcagcctcccaaagtgctgggattacaggcatgagtcactgtacccggcctcaggcccatctttcactagtctttaccatacttcctacaatactctagatgcactggatgacgtacccactaagcagcaaacacagcaggtacccttgtaccctgtgcttttgcttccactgtgctttcttcttgatatgccctccttttactttttatttctataggaaaagtctatgcatatttcttccctccctttgtaatatagtgatagctccttaagtaaaggactcatgtttatttgcctttgtattgcaagcctagaccactgcctagcacataagaggtatctaataaacatctattctaagaaatgtcagtttagccttgaggtaaattaaattctaaattctgatgtagaaacttcttatttgaggatctcagcttatgggctaccttagccaatttccagttatgttaaaagcctgaactggactgaaattgcagaatgggagccagatctcttttctctcataacattagctatacactgaaatatgcaggagcaagtcaggattacacagatacaacctgctttaggctgacagcagactgaaggcctaccaccacagaactctaattcagactgtcttccttcccaccttgtcttggaacccttggaagatctctgaacttcagttcctcactgttcttcaacattcttcagataacatatactgaccttttagtatgtaccaggccctctgctaggggctggagaagcaaatatgaccatacagaaaatccctatctttctggaatgcagagccaagcaaggaagactgtgttagcccattctcatgctgctataaagaactgcctgaggctgagtagtttctaaaggaaagaggtttaattcactcacagttctgcatggctggggaggcctcaggaaacttacaatcatggcagaaggaacttcttcacagggtggcaggagagagaatgagtgctgagtgaaagggaaagccccgtataaaaccatcagatctcgtgagaactcactcagtatcatgagaacagcatgagcagtatgagagtaaccaccccatgattaaatcacctcccaccaggcccctcccatgacacatggggattgtgggacccaaaattcaagataagatttgggtggggacacagccaaaccatatcaaagacagacaagtaaacagatgcttaatgatttgttcattcagcagatatttaactatatcctaaacaagtgctccagtagcaatgcagaagagctgccatgagagcagtgggcaataagtacccaattctccctacaactacataggaatttactaaaaggacaaggaaatattgaccatagaggggaaataatcactactgtttatgcaaagttagatgaaagtgacagaacaaatagagttctgggaactgcaagtagttcagaatgctggtaaagtgttataggaatgaaggaaaatgaaactagaaatattcacaggcaatatcaagagtttgcatttaaggtacaagttggagaaccactgaaggattttaactggaagaggagtcaaatcagatctccagtttagaagatatgttagagaggagtgaaatgggaaataggtcagtacgagcctgtggtaaaagtctaagtaagacagcatgagagctttaaaccaaggtaatgacactctaaaggaattggaggagccagacttaaatgaaatttcacaggcaaatctgaagaatttggtgacagaaagcatgttggagaagagagacagaaaagaatctgttcaggtgttgaggccattcattggaattgggaaactaagacagggagcaaagacatggagggagataagaaatatggtaaagctaatgtgtctaaataaggaaacactgcaaaaacaaaatttatgaattaagacataactgtaccacagagtatacacgtaaaaagatgtatacatctttttaaaatttttaaattttttaaaattttttcaccccatgagctctagactaagatgtatatacctctttatctatctatatatagacagatagggtaatagatagggttttttgttgtttttttctttcttttatgaattgggtgtctcccacaatcaagaaatatacctcctccttcatgtttctagctaatagaagtaaaacttgtggttgtgtagaagtaatttggaaattgactctcaaaacgcttattttgagtatccgaagagacctatgattaagcttaaatgaagcatttcagtgtttcctaattgatttatgacgataaataataattcccatggctaaaatgtaaaaacacatggaaaacaacagaaggctatttgagagtgatgaacttctgagttccatattttaagagggatacaccaggatagttattagagtatgcttagtgaagggcaaccaagatggcagagaatgtgaaaaccattatatgggaaacatgtactgtttagcctgataatgagaagacttaaaggagttatgacaatcatttccaaatgtttcaagagctgtcatgtattaacattaaactctgtggctccagaaagcagagcttggtccagtggtgcaaatgcaaagagtcagatcttggggtcaataaaaacaataatgttccagcagccagagcagtcaaataattatataatcacctcagatataattattatagatacccatcaccagtgatgtttaaagaggaatgagataaccactaggttagagtacttgtagaaagaatgcttgtatcaggtaaaatatattgccattctgaaattccatattccacaattttatggagtgacaccttaggactggatgtggccaaaatcttctacatggcatagtccctagttataggggcatacaactaattgtttaagcttagcattgttcatactggcttaaatactattaagccttagtctagccctgtccttggtgtataattcctacaactggaactgtttgtgcatcttacttaaatttatcagttaatattaggtattatgagttccccttggccttaacccctactcttatcaaagaaacatgtttagaaaatgaagcttatcttccacaggactttaggcataaaatgtgattaagatttattttggctgggcgtggtggctcatgcctgtaatcccagcaccttgggatgcagagacgggtggatcatctgaggtcaggagttcgagaccagcctgaccaatatggtgaaacctcgtctctactaaaactacaaaaaaaaattatttgggtttggtaggatatcagtgatggaagatgaaaggaatgaaatgaagtgagaagggaagtttagagaaaaaagaataaaaagaaacgaacaaagcatccaaggaatatgggactatgtgaaaagaccaaatctacgtcggattggtgaacctgaaagtgacggggagaatggaaccaagttggaaaacactctgcaggatattatccaggagaacttccccaatctagcaaggcaggccaacattcagattcaggaaatacagagaacgccacaaagatactcctcaagaagagcaactccaagacacataattgtcagattcaccaaagttgaaatgaaggaaaaaatgttaagggcagccagagagaaaggtcgggttacccacaaagggaagcccatcagactaacagcagatctctcggcagtaactctacaagccaggagagagtgggggccaatattcaacattcttaaagaaaagaattttcaacccagaatttcatatccagccaaactaagcttcataagtgaaggagaaataaaatactttacagacaagcaaatgctgagagattttgtgaccaccaggcctgctctaaaagagctcctgaaggaagcactaaacatggaaaggaacaaccggtaccagccactgcaaaaacatgccaaaatgtaaagactgtcaaggctaggaagaaactgcatcaactaacaagcaaaataaccagctaacatcataatcacagaaccaaattcacacataacaatattaactttaaatgtaaatgggctaaatgctccaattaaaatacacagactggcaaattggataaagagtcaagacccaacagtgtgctgtattcaggaaacccatctcatgtgcagagacacacataggctcaaaataaagggatggaggaagatctaccaagcaaatcgaaaacaaaaaaaggcaggggttgcaatcctagtctctgataaaacagactttaaaccagcaaagatctaaagagacaaagaaggccattaaataatggtaaagggatcaattcaacaagaagacctaactatcctaaatatatatgcacccaatgcaggagcacccagattcataaagcaagtccttagtgacctacaaagagacttagactcccacgcaataataatgggagactttaacaccccactgtcaacattagacagatcaacgagacagaaggttaacaaggatacccaggaattgaactcagctctgcaccaagcagacctaatagacatctacagaactctccaccccaaatcaacggaatatacatttttttcagcaccacaccacacctattgcaaaattgatcacatagttggaagtaaagcactcctcagcaaatgtaaaagaacagaaattataacaaactgtctctcagaccacagtgcaatgaaactagaactcaggactaaaaaactcactcaaaaccactcaactacatggaaactgaacaacctgctcctgaatgactactgggtacataacgaaacgaaagcagaaataaagatgttctttgaaaccaatgggaacaaagacacaacataccagaatctctggaacacatttaaagcagtgtgtagagggaaatttatagcactaaatgcccacaagagaaagcaggaaagatccaaaattgacaccctaacatcacaattaaaagaactagaaaagcaagagcaaacacattcaaaagctagaagaaggcaagaaataactaaaatcagagcagaactgaaggaaattaagtcacaaaaaacccttcaaaaaattaatgaatccaggagctggttttttgaaaggatcaacaaaattgataaactgctagcaagactaataaagaagaaaagagaagaatcaaatagatgcagtaaaaatgataaaggggatatcaccaccgatcccacagaaatacaaactaccatcagagaatactataaacacctctacacaaataaactagaaaatctagaagaaacggataaattcctcaacacatacaccctcccaagactaaaccaggaagaagctgaatctctgaatagaccaataacaggctctgaaattgtggcaataatcaatagcttaccaaccaaaaagagtccaggaccagatggattcacagccgaattctaccagaggtacaaagaggagctggtaccattccttctgaaactattccaatcaatagaaaaagaaggaatcttccctaactcattttatgaggccagcatcatcctgataccaaagcctggcagagacacaacaaaaaagaattttagaccaatatccttgatgaacattgatgcaaaaatcctcaataaaatactggcaaactgaatccagcagctcatcaaaaagcttatctgccatgatcaagtgggcttcatccctgggatgcaaggctggttcaacatacacaaatcaataaatgtaatccagcatataaacagaaccaatgacaaaaaccacatgattatctcaatagatgcagaaaaggcctttgacagaattcaacaacacttcatgctaaaaactctcaataaattaggtatcgatgggatgtatctgaaaataataagagctacctatgacaaacccacagccaatatcatactgaatgggcaaaaactggaagcattccctttgaaaactggcacaagatagggatgccctctctcaccactcctattcaacagagtgttggatattctggccagggcaattaggcaggagaaggaaataaagggtattcgattaggaaaagaggaagtcaaattgtccctgtttgcagacaacatgattgtatatctagaaaaccccattgtctcagcccaaaatctccttaagctgatgagcaacttcagcaaagtctcaggatacaaaatcaatgtacaaaaatcacaagcagtcttatacaccaacaacagacaaacagagagccaaatcatgagtgaactcccattcacaattgcttcaaagagaataaaatacctaggaatccaacttacaagggatgtgaaggacctcttcaaggagaaatacaaaccactgctcaatgaaataaaagaggatacaaagaaatggaagaacattccatgctcatgggtaggaagaatcaatatcgtgaaaatggccatactgcccaaggtaatttacagattaaatgccatccgcatcaagtgaccaatgactttcttcacagaattggaaaaaactattttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaagggagatatagatcaatggaacaggacagagccctcagaaataatgccgcatgtctacaaccatctgatctttgacaaacctgacaaaaacaagaaatggggaaaggattccctatttaataaatggtgctgggaaaactggctagccatatgtagaaagctgaaactggatcccttccttacaccttatacaaaaatcaattcaagatggactaaagaaactaccatcagagtgaacaggcaaccaagaaaatgggaaaaaattttcacaacctactcatctgacaaagggctaatatccagaatctacaatgaactcaaacaagtttataagaaaaaaacaaacaaccccatcaaaaagtgggcaaaggatatgaacagacacttctcaaaagaagacatttatgcagccaaaaaatacatgaaaaaattctcatcatcgctggccatcagagaaatgcaaatcaaaaccacaatgggataccatctcacaccagttagaatggcgatcattaaaaagtcaggaaacaacaggtgctggagaggatgtggagaaataggaacacttttacactgttggtgggactgtaaactagttcaaccattgtggaagtcactgtggcgattcctcaggaatctagaactggaagtaccatttgacccaaccatcccattactgggtatatacccaaaggattataaatcatgctgctataaagacacatgcacacgtatgtttattgcggcactattcacaatagcaaagtcttggaaccaagccaaatgtccaacaacgatagactggattaagaaaatgtggcacatatacaccatggaatattatgcagccataaaaaatgaagagttcatgtcctttgtagggacatggattaaactggaaaccatcattctcagcaaactatcacaaggagaaaaaaccaaacaccgcatgttctcactcataggtgggaattgaacaatcagaacagatggacacaggaaggggaacatcacactccagggactgttgtggggtgggggtagtggggagggatagcattacgagatatacctaatgctaaatgacgagttaatgggtgctgcacaccagcatggcacatgtatacgtatgtaacaaacctgcacattgtgcacatgtaccctaaaacttaaggtataataataaaaacaaaaaatttatttttacttcattctctttctgttgatataaggtccctttgttatcaagaatacaggtgcagctgtgttttcccactcccctgccctttaactttgtaactaattttccatatacctttaagtccattttctcatgtccatatttcatttcccaactgaaagactacattagggaggaggcaggtattggttggaagtcagagtaggggaaatcccttccaaagacaaagaagaataggtagagtaagctgcagatgttaatattatattgtggtggtggtaaggtgatcaagtgaattgtaacctccttgagtacaggaaacttaccctgtatttctttgaattctccatagcatagtaattgtttataggattattgttccttctgaggtaattttacagttaaaatgttaatttttgtttttaggtctaaagacattgccctcacagagtgaaatgatggcagaaatatctaaagctcaagaggaaattgacaaaaggtaagaaactctcccaggaagatatatggttacatttctacttatttcttaataaaagaaatattgtactgtatttaactgcctcatgttagcttaaggatttagattctattatgaagaaaaaaggaaaaataatttgtgacaatagaatggagaaatagcactagtagtctaaatatgggtaagaaaagagagaaaagttttaggtgtctaaaatcatatgtttaatgcctaaaaaaagtcacataggaaaatgcatatggaaataaaatcagaaggcagaaggtatattatttttgtgaggattacttgaagtgctagtagacttgccagaggaaggaagagtgacagtaaatgaatgagaggtagctatgggtgaattacaaatctgtaggtagatttacaagtctgcagtggccgctttgctggcaatgctcatgtgacagcacactcaagtcacagtggctcatggtatgaatagtcactgtgagttgggaacatggtaacagccagctgcttagtgttttgatgaacacaatcatttagcagtctgaatttcagaacttaagctcaatcgctgggtgttttttatttggacaaagtggaaattgatggtaagtctctaaatttctgtggaaaactgagagacacaatcattccaggcctaaagaggtggttatcttcaactgatgatacttgcataactttcctttgtgtgggaggaggagaaagtaagtttttatttaattccgttacaacttccaggtgctctcctattttcctccttcctttcactgccaaacctctgcactaaattttctaaattctcaccttttgctgcctccctaagccttctgcattgttaacttccatccttactccttaaactgccttttttttttttagacggagtctcactctgtcactcaggctggagtcagtggcacgatcttcgctcactgcaacctctgcctcctgggttcaagcgattctcctgcctcagcctcctgagtagctaggactacaggtgcacaccaccaaacccagctcatttttgtatttttagtagagatgggatttctccatgttggccaggctggtctcaaactcctgaccttgtgatctgcccgcctcagcctcccaaagtgctgggattacaggcatgagccaccgtacctggccggaaactgctctcttaaaggtcacctgtgaccaacttcattttccttcttctcactactgagtttggtgcttttaaacatttcttccttcttgcagtgctttcttttctggctctaaagtatcttattttaactttcctcctctctttcctttgacttatttttgtctaaccacctcctgaacctgagtagtcagtaacccaaggatataatgtaaccttttttttttttaacttctgaaatagtaaatatttatttatttatttattttatatttaagttctagggtacatgtgtacaacgtgcaggttttttacatatgtatacatgtaacctttattaaaggccgactatgtgtatacattgttttatatgagtttatttaatctgcataatcaaggcaggagctagtgaacctcttttgtgaaaccttcatgaatactatagctctttttttttttttttttttttttgatatggggtctcactctgttacccaggctggagtgaagtggtgtgatcttggctcactgcaacctccacttcctggagtcaagcaattctcccgcctcagcctcctgagtagctgggactacaggcatactaacaatgcccagctaatttttgtgttttctgtagagatggggtttcgccatgttgcccaggctgatctcgaactcctgagctcaaagtgatccgcctgcctcggcctcccaaagtgctaggattacaggcatgaaacaccacgcccaacctcatgaatagtatagatcttgacctactattataggataaataaatgcatgtctacaaactcttgagccaacatattgttcataagggaaagctctcaaattctttactgttttacctttttctctcctaaatctagtcccatttcaataaattcctacttgaccctctatcaggtcctctgaaattccatctcaccagttctacctcaaatttattttctatcatttttttcctgtccctgttcttggattcttcaatctcaattggcttgacttggcttttctcttcctctctgtcctacagttctttcttttcattacagaaagtaaaaagtgaaagtcactcattagctcaccaaatcccactccaccacacagatatcactgttaatcaaccacattttcccctttaaaaagcccttttaaatctttaaatctgcacttggtgtaataatttcatttgtctccatttggagggctacttcctcttgtggaataaatcattctccctcatcctttcaggattccaaattaacattggcgctgggaagtcctgccctgtggaccctgtcaccactgccctcatcaaataatagaggatgccatacttgagaatttttgtgatgggttttctctttctcataacatcagagtcctttgtatctagatgtgctatacctgcccctcatcttatctgtatctttcacatccttcaagaacctaacgattacagctctcttttaactatcccctctccacatttctatttggcagtctgaaaccactcagaagtctcgcttcatgtttatctgtcttatctccttttgtaagtcctaagatccttaaggacagtgaccaatgttttatctttcttctctatattccacagctcctagtctgatattgagccaatagcaggcactcagaaggcagtaattgattgactgactgattgaattattgacaggccatggtttctgtcttttctactttaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgaaaagctatcctcaccacagatgatcgcatcaggaagcctctgatgacaagagtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgtcactcttccttgtggtaatccctagactgggagctcaggtactcttttagtcatctttgtatgtctttagcagagttcttgacatgtggtaggtgcttaataaatgtttgttgtttatcaaattttatggtagggagagtaagtcagcatcggtataaaatcgcttactccacgtaactcttcttctgatagggtttgattttctattagaagctcaattttagttttttttcatattataactaaatatgtttcctgagagataagagaaataatgttcctacaatagttgtatgtatctaagataagacatatagatgcttaagacattttgtttcacttgctattcactagtgtacttgaaacatggtcatttttagcccttttccttaggaaccatgtctttattttctcaataaagaaattactttcaact

SEQ ID NO: 36801 - DNA, 18961 bp, Homo sapiens
gacacgaagcctcccgggtggcttacagacgctgccagcatcgccgccgccaggtgagtgcccccgaccctgctgccgcccgctgctccgcccagctcgagcccggcggttagcgcccaggccgcggcccgggtgccgagcggctggaagtgtggggagccgtgcccaggttttaccgctccagcaagtcgctggcggggcgacgtctcgggactccggctccgaaacgtaccctctctgtccggggctccaggtccccgacgggcgatcgtgccaggcgcggcccctgcgggcctcagtctccgcgcctgtgcaatggggtggtccctctgcgtctcgccgcgacggctggacgccccatcgccgccgcacagtcctccagtgcggcttccgggcacccggctccgaactctggggtcgtgcggacccggccagaccgtagcgcggcaacgccagcccacggccgcggccgcacagccccggtgcccttaaaagagggaagatggcgtcgtgcccggtgccgccgggaccggctcccggaggcgctgcgcacctgaggaagggccgaggaaaggcttcgtaacgggacgcccagaaagtccggaacaggaacgtgcacacggagcggcgcgcagccgcccgccctcgcttgcccacgcgccctgcacaggtgcgccccagactgggcggggactagagcccggctggggcatgcgaccttgtttggtaaattggaggtgcgcccctgcgggtgacccgcgagggggccccccgcctgcggggcgcggtcacgacaaggcttgtggggttcggagctggtcgtcgtctgggctctggcctcctaaatgcgatcgctttcaagcccttcattgtcaattttgctagaatgagccactcgtggggtaggacgtggttgttgatgttactgttgtagctcttactattgtaacatttttgttgctgttttaacgcagtgtttactgtggtctgggagcccgagcttcccagggagcattggtgtcagcctcatgtccccgcattaggaggagcgcagtctggtgggcactagcgccgggaagttcttaacatctgtctgcccctgggagcaggaggcctcatcttccaggtggagaaacagagatttcagtcccaggaggcacagaaatgccagggttgtctagctagaagccaagggccctttatggaacccaagccaaaacctctttccactctccagccctgtggcctcggaagggccactccatctctctgaacctcagtttgttctgttcactctgcaaaatgtatccctgaggtttctggccaggtgaaagcccctctcaagttagtagcctccctggagttaagactcaccccgatttctacttaatttgggcacgcctttggaataagttctcaggaatggcacagtttgggtgttttttgtttctttttgtttttttttgaaacagagcttcgctcttgttgcccaggctggagtgcaatggcgccgtctcggctaactgcaacctcggcctcctgggttcaaacggttctcctgcctcagcctcctagtagctgggattacaggcgcctaccacgaggcccagctaattttttgtatttttagtagagatggggtttcaccatgttggccaagctagtctcgaactcctgacctcaggcgatccacccgcctcagcctcccaaagtgctgggattacaggtgtgacccaccccgcccggcttgagtgtttaaatactcctgcctcagcctcccaaggtgctgggattacagacgtgagcccctatgcctggccctttttttttttttaattgtcttaaggatgttaagactaagattctcacacatttgactcgtgcctgtaatcctagcactttgggaggctgaggcaggaggattgcttgagctcaggagactagactgggctagaccagactgggtaacatggtaaaaccctgtctctaccaaaaatacaaaaaattaaccgggcatggtggcatgtgcctctggtcctagctacgcaggaggctgagttcagaggcctacctgagcttggaggggttgaggctgcagtgaaccctgatcatgccactgcactctagcctgggagacagagtgagaccctgtctcaaaaaaaggagcattaggctgggcatggtggctcacatttgtaatcctagcactttgggaggccgagggagatggatcacctgaggtcaggagttgtgagacgagcctggccaacatggcaaaaccagtctcttttaaaaatgcaaaaattagccggtcgtggtggcgtgtgtctgtaatcccagctacttgggaggctgaggcaggagaactgcttgaatctgggaggcagaggttgcactgagcggagatcacaccatggcactccagcctgggccacatagggagactctctgtcaaaagaaaatttaaaaaagcatcaaatggtagatccccagtgtctgttacagcttgggtactctatggctggatagagaggctgcatacatgttagttattgtaagtttgtttgtttttttgagacggagtttcgctcttgttgcccaggctggagtgcaatggctgggaatacaggcgtgagccacctcacccggctcaagattcttacacatttgacttgcctgtaatcccagcactttgggaggctaaggcgggagaattgcttgaacccaggaggcggagattgcagtgagcagagatggtgccactgcactcagcctgggctaacgtgagactccatctcaaaaaaaaaaaaattacgtcttgtgtcacagagctgcagataaaccagagactactcataaccgtgtactttttttttcccccatttctgatcccgtctcaacggaaggatgtaattgaggaagggcttgattggccagtgagtcttgaagctgacaccactgctggtggtattttcccctctccctggaaagcatcctgtttttagtgaacctattaaatgtgtagacaattaatggctttttgcttcccctgctgcagacttagcggatcccatgagattttgactaccgtctgtgctcagaacagtttgagccgtatggaggaagtctccgcaccagtcttactgttggtggtcaccaggaagccagcagtgtgtctgaactggacacatgtggccacttcctagcctccctttgtcctgccactggttggttggggctgggccctgggagaaacatagaatgtgagcaaatcagtccgtggcccctaagttccttgttggccccgaggcaggcaggagaggggcgggcacacagggcagctgattttcctagtgtcaatattaggatgtgacaatacaaaacaccactgggcctcgccaggcactgcatggtaaacctgtttttctgggggtgggacagaacttggcacccagttagccaaactgaaaagccatgcagcaaagagagaaaagctcacttgtttatttgagtgagggtccctgtcattttggatatttaagatcaagtattcttgaccgccccctccccgagatggagtcttgctctgttgcccaggctggagtgcagtggtgtgatctcagctcactgcaacctctgcctcccgggttcaggtgattctcctgcctcagcctcccgagtagctgagattacaggcgcgtgccaccacaccaggctaatttttgtatttttaatagagatggggtttcaccacgttggccaggttggtcttgaactcctgaccttgtgatccgcccgcctcagcctcccaaagtgctgggattacaggtgcgagccaccgtgcctggccaagagatgacatttattgtgtgtgacagtatcttcgagattagaggctccctttcatgtgagggcaaagagagctacctgattccaggaggagctgaaattccctgtgcagacaatggcgcatcatgaagataaatccgagctcggaccgtgaggtggtcagcacgggtgtgcgcctcgcagagcaacaggctcacagaatgagagctgcctcttagtgggcacttactgcataccatgcatgcagcatttcacctccttctcagggctacatctgcccatggggctttccctcctgccctttaacagaaggtgatactgtccagtccagggtctcccagccaggaacagcctgccatcgtgagcccagcaccagagtaaccccttccctcattctcaggattttgcagtgaactctcaggctgtctgcatcctctcaccggctttcactgggtccctgctctgttctggggccatgcaggttcccgactggctggggcagacacacaggtaaacatttaacgagaccttgatgggctgagtgcccaatccaggtctgtttacccaaggtgctgggacaacacagatgaggagcatttaattctgtcctggggagggtggggaggaagtgacttgtgcctgagccccaaggaagcagtgagtcccccgtgcctgcctgggggatgttggtaacagagggaggatgtaaaggaggagctggggtgtgaaagggctgggtgcaagttcataggggagacccaaacactgaagtggagcccaggggccgtacctgcctctcaagcctcagggtcggggccagggtgagcagtcttcatattcttcagcctcagcatttcagaacttgttttattttttttttgagatggagccttactcctgtcgcgggggctggagtgcagtggcgcgatctcggctcactgcaacctccacctcctgggttcaagtgattctccttcctcagcctccctagtagctgggattacaggcgtgcgccaccacgcctggctagtttttgtatttttagtagagatgaggtttcgccatgttggccaggatggttgtgaactcctgacctcagttgatccacctgcctcaacctcccaaagtgctaggattataggtgtgagccaccgcgtctggcctattttttatttttgattgagtcttgctctgttgcccaggttagagtgcggtggcacgatcttggctcactgcaacctctgcctctcaggtttaagtgattctcctgccttagtctcccgagtagcttggactacaggtgcccgccaccacgcccggctaactttggtatttttagtagagacactgtttcaccatgttgaccggggggtcttgaactcctgaccttagttgatccatctgccttgacctcccaaagtgctgggattacaggagggagccaccgcgccccggcccagaacttgttttaaatatgaacttttgaaacttaacaactgtaggcccaggtggtggcttggcattctctgcttccttcatggtgataaaaaggcacaggcttcccctttttggggtcatttcaaaatcagtcaagagaattattagtctgttagacttcctctacggttaggattatttttataggtgttcgaacaggaaaggacatagaataaaatctcctcccctaacttattgatacagggtctcactctgtcgcccaggctggagtgcagtggcgcagtcacagctcactgcagcctcaacctcctgggctcaagtgatcctttcgccttgtgctcttaaagtgctgggagcctccaaaaggctaagctgtgacgttgggtaggttacatgtattaaatgcatttttttttttttgagacagttttgttcttgtcacccaggctggagtgtaatggcataatctcggctcactacaacctctgcctcccaggttcaagtgattctcctgcctcagcctcccgagtagctgggattacaggcgcccacccccacgcccggctaatttttgtatttttagtagagacagagtttcaccgtgttagccagaatggtttcgatctcctgacctcgtgatccgcccgcctcggcctcccaaagtgctgggattacaggcgtaagccaccgtgcccggcctggtgaaaccccgtctttactaaaaatacaaaattagccaggtgtggtggcgtgcacctgtagtcccaggtacttgggaagttgaggtggaaagatcacctgagcccagggaggtggagactacagtgagccatgttcatgccactgcactccagcctgggtgacagagagaccctgtctcaaaatagtaatactccatattgggcctctcacaggggaatcttggggggagctgcagctcagggtgactcccatcttgtcactagccaggtgaccccttcattctggagccttagctctgaaagccgcaggtgggggtgccgtttcagatgccccttttccatttcaaaggctctgattctagatcttgaagccggatgcggcactggcacttggcttcagtttccactgtgacggacggaggtctcccaggcccagcccaggcagccaagcccatcctggaatcagaacacgctgagcacattttgtagggtggcacctttttatccaagttactagctacacatcagtgtttaaagagaaaaaagtgagctgtcttttttttttcttgaaacttgaggaaacaaggtacatactacggatttttttttttctttttcttttttttttttgagacagtctcactctgtcgcccagaccggagtgtggtggcatgatctcggcttactgaaagctctgcctccagggttcaagccattctcctgcctcagcctcccgagtagctgggactacaggcgcccgccaccacgcccagctaattttttttgtatttttagtagagacagggtttcactgtgttagccaggatgctctccatctcctgaccttgtgatctgcacgcctcaacctcccaaagtgctgggattacaggcgtgagccaccgcgcccggcccatattttttttttttgagatggagtttttcgctcttgtcgcccaggttggagtgtaatggtgtgatctcggctcactgcaaactcctcctcccaggttcaagcgattctcctgcctcagccacccgagtagctggattacaggcgcgcaccaccacacctggctaattttttttgaaacggggtagagacggagttttattaccatgttagtcaggctggtcttgaactcctgacctcatgatctgcccaccttggcctcccaaagtgctgggattacaggtgtaagccaccgcggctggcccatttcatatatttttaaaattttttattgttaatttatttttagagagggggtctcgttgtattgcccaggctggtcttgaactgggctcgtgcgacgtgcccgcctcggcctcccgaagggctgtgatgacagcacagcggtgcctgtgatctatggcttcaatttttcaaggctgccaggtccatgcaggggtgtgtgtgggatgcatccctagaaatcaaaggtcatgtgcgtgtgtgactggtggatgctgatggtcacactaccctccagaaaggcagcaacatgttcagtccaccgtggcgtcctgagctgtgagtggcctctggtctcctctcttctaaggctgttgattgtgttaaccagcttttatggagcccctgctaggtggtggaaaatgggcagtagtgtatgttttcatcctctcagcagccctggaggcccggctgtttctgcaaggctcagaggtgagctggttgttctgcctcacacagcaggggccgagcagggggtggaactgaggtccagcctggctgcaggctcagggcgtttcctgctgggttacactggagttgtgtgcgctccaagggctttgtgccaccccaccctcatggtccagggccaggctgtgactgggagggtggcacgtggaagactggaccagggttttctagctgggcccactcagctggccctccctgtgaccccagcgtggcccctgaccctctcggtttgcctgcctgtgaaacaggaagtgtcagatcccgcctgcttggctttgacaggactgggcgaggtcatgagagtctgagggtccctaccaggagttcgacctcatcctcaggtccagccccatccacctctgcccccaaccccgctctgacactcctgcagcctcggccctcgaacacctgctgagggctgagcagaacacatctctacttgcttgtgcttctgggcaacctgggaggggcttgggaggtagatggcgtttccccatcttccagatgagccataggcgagctgtcgagtgcagagctgttcaccaaatgtaggctgctctgtccagaacctgccctccctcccactcggagccctgcaggtgccctcaaggccgtgggtgtggtactcttttctgcacatactagatttgcatcctaacctcttagggtaaaatagggcttctgactggcgcctggtgtttccactggtgagtgtgtaggaggctaagtgcgggctgtagcctgggtggggacacatggctaggtgtgtcttccttcaccaaagaagggtttcaactactcatttgcaagtttgctggaaaaaaaaagataataaaaaccagtccagtttcctgtatctgcagctgcagtgacctcacagtgggtcctctgggaataggttgccttcatgtcttcagtcaacaaacatatgtctgctctatgccaggccttgggctgacaaccagaaactgataagagcagcagcccctctcttagcggtttactctgtgccggatcatttcatccccacaacagtcctgtgcaataggtgttactagtatctccattctaattttttttttttctgatatggagtcttgccctgtagcccagcctggagtgcagtggtcagctggagccagaggggagcagagacaggggctgcaggacccccaggaggcccccaagcagactctgagggtccaagaaggtgatgcccgaataggccagcctcatacccatcctctcagtactttgggaggcccaggcgggagttgaagccaggagttccgagacaagcctgggcaacaaagcaagaccctatctctacagcaattctataaaaatgagccaagtgcagtggtacatacctgtcgagttaccctggaggctgaggtgggatgattacctgagcccaggagtttgaggctgtagtgagcatgatcaggccactgcactccagcctgggcaaacgggtgagaccctgtctgtgaaaaaaataataataaaatttaatttttaaaaaaggaccaataggcgtaggcatgggccggtctgaggttggctggtgagctctgcacatttgaagactttggaggcatggcaggaccaggcaccatccatggaaagcatacttgagtgtggttagcgcgggaaccaagattggggtggcagggccacagggggagggcctgttagtggatgtggcacaaccccccacttgtttttgagacaagtcttgctctgtcacccaggttggagtgcaatggcgcggtctcggctcactgcatattctgcctcctggattcaagtgattctcctgcctcagcctcccaagtagctgggattataggcgagcgccaccacacctggttaatttttgtatttttagtggagatggcgtttcaccatgttagccaggctagtctcaaactcctaagctcaggtgatccacctgcctccacctctcaaagtgctgggattacaggcgtgagccgcactgcaccaggccaggtctagggagccgaacagagcagtgacagggtcagggttgaggctgctaccttgagattaggttggagagagctccactgaaggctggagaccagtaaggcattcagagctggtgccaggtaggagctgacaggactgggcctcccttgggctggtggggtggccaggagagaccagagcaggaggtcgctgctgcaaggaccctcctgggcaggctccccaccttccgctccctggctccacacttttcccatgcagatctgggccctaaggccagcctaggcccagttggtgatgggatctttgccattcatatcaagtcaatctgagggcctgggcccagaggccagatggttaaaggttcagattaggtcccttctttgtggtagagggtaatgggtatttaataaattaatccaaagtgctgtaatcccagtactttgggaggctgaggcgggtggatcacttgagatcaggagttgagaccagcctggccaacatggtaaaaccccgactctactaaaaatacaaaaattagccgggtgtggtggcatgtgcctgtaatcccagctacctgggagtctgaggcaggagaatcacttgaacctgggaggcggaggttgcacctgagctgagatcacaccactgcactccagcctgggcaatagagtgagactgtctcaaaaacaaacaaacaaacaaacaaaaaaacactaccaccaacaaaaacacaatagatggggaaactgaggctggtgcaggaagggttgggctagggtatcaacctaaggtgagatgtggtcctgggtctactcagatggggaggttggcagggtggggagcttgaaagggtcttgcaggcagagcgtgggtgactgactcctcaggtaggcctgacctgcactctgctgcagaccctcggcagcgcagcccactctggtggctggggccttcttcctatctggcgcctaaggattctcggaatgcctgctgggtaagggggctgtgggcacagtgggtcaaggcgaggctcggtgcagctcacagctcagctcacagtgaggtgaggttccactgttgctctggctttgcggggcgtggaggtactggggtctccaggagcacaaagcaggagactgccttttcgaggggaagggaaaggggggaaaagcaaacaagggctggagctgctttcctagggaaatgccatttgcatagacacccaaggcagctggaagttctggacacagttcttctaatgccagcttaacacgcacactgctggccgtctatacaatgtaaaacatctcatctgtgaaaccttattttttctttttgagtcagaatctagctctgcctcccaggttcaagctgggattacaggcgtatgtcaccacgcctggctaattttgtatttttattagaggcggggttttaccatgttggccaggctggtctcaaactcctgacctcaggtgatccgcctgtctcagcctcccaaagtgctgggattacaggcgtgagccaccgcacccggcccatccatctcccttgaatgctgaaagcaagtcgtgagcacacacttgtgcctaggcctgtgggagggcggcgctgtgggtcctgcctgccgtcagttttctctctcctgggggtcagggagacttggagctctgtcccttcttggcttagtcatgaacctctctaagcctcagtgtcctgtgtgaacaaacagctcagtgagatggtgggagggcggagtgtcctgtcagcaggcatgaggaattaaaaattaagaacacccagggcattatggtaagaaaataatgagttgaagcataaaggtaatggttagtgccaacttcctcccagcgtgccaggccctgttcaaagtacatgaaggagttccttatttcgtcttcccaatagcccagggcggggctctcagaccatgaaacccatttcacagatgaagaaattgacacactgctgctaactgccagagccgggctttgaactaggccattagatttccgtgccacagtcatcgtcattatcgtcatctacatctaaggctgtttggtaccctgtagggtaaatgtggggtacatgatggtgaatcaggtcgcagaacccttctctgccatcatgatgaaacatgtactggcatgggattcgcaatgatcatagttaggaaggcctttggtggcaaagaagaggaaactcagtgaatggtgatgaggacacatttgggttcatttttcttacacacagttggaggagacagctcagtgacaccctcaggcctggccgctctctgcctccccactctgctcttcttggtcagccactgcagctccatctttgaaggagctgccctggctgtgtctactccctggcatccaacccctgcctccagcctctgagccctcattgaccagaactgggttacatggttgtcaccagctgcaagggatgctgggaagctgagggagaggagggccatggttggcttagatgaatgaggatgcagggccaccccgaagaaaattggggttctatcagcaaggagccaggtggaatggatatcggagaggtaaatagcatctgccagtaaagaaggctgtaagacactgtatggggtgatcccatttgtgaagaaggatgtgtgatgcgcacaagtgtttaggaaaaacactagaagaattagcgatggtctctctgggaatggggattgtgatacgtttttctcatgctgcctctctgcctttcttctcaagagaaacagcagacaccaaagaacaggtgtagccttctgttaagtggtacagaggaatcgccctgcagcctggcctctgtcccctgtgctgacagcaggtgcctgggttttctgctttgacaggttcttgagggctggtgtccgaggagaacttctaatatttatttatactctgattttgtttcacaaagaagaaaaaggctgggcgtggtggctcatgtctgtcgtcccagcactttgggaggccgaggtggggtggatcactttgaggtcaggagttcaagaccagcctggccaacatgatgaaacccccgtctttactaaaaatacaaaataattagccaggcatagctcatgcctgtagtcccagctactcgggaggctgaggcaggagaattgcttgaacccaggaggcagaggttgcagtgagccaagattgtgccactgccctccagcctccagcaagactcagtatccaaaaacaaagaaagaaagaaagggcccttatgaatcatcttcaagttcctcccttccaagaacagagatgctaggcgacttgcccagaggcacacagccagcatgtagcaggattcatgcctgtgggagctggggttgggggatattgacggctttagcggatcaaaagagctggtgagtagggctatacaatctgggggtcatcctgtgagagagcccccagactgctcagttcttaggggtccagtcatatgctgtctttttgccccagaggagaaatgtctgaagtaagacccctctccagagacatcttgatggagaccctcctgtatgagcagctcctggaacccccgaccatggaggttcttggcatgactgactctgaagaggacctggaccctatggaggacttcgattctttggaatgcatggagggcaggtaggtccccatggcctgccctaccccctgcctgatagtgacttcaggggtgggctggatgagcagacattctatgagcgggggagcgcctgcagatgcctcccaggcagggcctccgagaggaagatttcccggatgtgggcatggaggcttctgccctgggagcggcttcactttgctgccccaccctcccctgataccagctcacagacccctggacagccagcatgttcacagtctcaagatggacctggggcccctggctgtcaaaatggcacagtgtttgggcctcagggagctagacaggcccttagcgacctgctgaggacatcagggcctcttgaaggaggtgactctgttgccagaaaggggacccgatccagatcccaagagagggttcttagatctcaagcaagaaagaatttgggccacacgcagtggctcgcgcctgtaatcccagcacttagggaggctgaggcaggcggatcacttgaggtcaggagctcgagaccagcctggccaacatggcaaaaccctgtctctactaaaaatacaaaaagtagctgggcctggtggcacatgtctgtagtcccagctagtcgggaggctgaggcaggagaatctcttgaacccaggaggcagaggttgcagtgacccaaggttgcaaaaatgcactccagcctgggcaacagagcgagactccatctcaaaaaaagaaaacctactctataggcagagcagcggcatgggctgctcaactgaatatacttatagttatttcctgattacatgctaaacaaggggtggattattcatgagtttccgggtaaggggtgggcagttcccggaaccgagaattcctcctccttttagacaatatagggcaacttcctgacgttgccgtggcatttgtaaactgtcgtggcactggtgagtgactccaacatgctaatatagttggtgcacaatgaatagtgaggatgactggaggtcacttttgtgcccatcttggctttggtgggctttggctggcgtctttgccgaatcctgttttatcagcagggtctttgtaacctgtatcttatgctgatgtcctatctcatcctgtgacttagaattcctagcctcctgggaatgcaacccagtaggtctcagccttttgttacccagcccctaatcaagatggagtcgctctggttcaactgcctctgacggctctcattttagaaaaccagaaccgggccgggcgccgtggctcatgcctgtaatcccagcactttgggaggctgaggtgggcggatcacctgaggttgggagttcgagactagcctggccaacatggtgaaacccaacctctactaaaaatacaaatgttacccaggtatggggccgggggtggggggatgggcgctggtagtcccagctactcaggaggctgaggcaggaaaatcacttgaacccgggacgtggaggttgcagtgagccctgagattgcaccactgcactccagcctgggtaacagagtaagactccgtttcacaaaaaaagagaaagagaaaagaaagaaagaaaaaagaaagaaaaccagaacctatggaagagcctgaggaggccatgcagttcctggtcccggcttcaaagaatcactgaggcatgaagaagggatcttccttggactgacaaggaccctggaggcagcaggatttgcctggggtttcaggggccaaggtccagtaggacctgacccttgcactctgccaactgctcccagctatgtccagcacacggcagcatacccagatgtccaggcacacccggccatcccagcggcaggaaggacctgcactttttttttttttttttgagacagagtctctgtcacccaggctggagtgcagtggcatgatcttggctcactgcaacctccacctcccgggttcaagtgattttcctgcctcagcctcctgagtagctgggagtgcaggcgtgcaccagcatgcccggctttttttttttttttgagacggagtctcgctgtgtcgcccaggctggagtacagtggcatgatctctgctcaccacaagctccacctccctggtttacgccattctcctgcctcagcctcctgagtagctgggactacaggcgcctgccaccacacctggctaattttttgtattttcagtagagacagggtttcatcatgttagccaggatggtctcgatctcctgacctcgtgatctgcctgcctcggcctcccaaaaagtgctgggattacaggcgtgagccaccacacccggccaggactggcactttcattcttcccctggtacagatgaggaacgtgaaggcccaggagcagctgacctcagtagtttctaccctgagcctggaagagaatggtcaggcctgacctgggctgttgctttctgctggggaatcctgtctctgatgtggcacctcccacaggccagggaccagctccatgttccacaggattcttttctgctcaggattttttttttcagcctcaggatttttagtcattaaggattttagaactggaggcacctgtccattaatggacaaggttggaggacatgaagcctggggcagtattttcctgaggtttcccagggtaacagaaggtaggaccacagcccccaaccctgattgccagcccacacctgtacccctcccacccgcatcccctccaagtagggagtgtaggcccagggcattggcaggtcaggtgggtggggccagggcccagggccggcctcagctcagggcccctaggagtcccacttccctgggagttcccccggtgtagtcactgggatggaatgcacacaggtccctggtagaggcccagaccagcaagctgggagggtggggagtgtcttagtctttgtgtgggagtgaatgcgggtggggtgtaggatcaaggatgtggtttagtggggggcctactaggggcttcttagtccccccatttggagaggggtggtgccagcagggctggtttcaggattgggaccaggacacaggtcttagagccccctcacctcccacaaaggaaggtaagctgcaacccctgtgggaagggggctcaagggggctcagccatccgggggactcagcaccaccagacctgtccattccccttggtcagcctcagccatccgggggctcagcacccccagacctgcctgttccccttgtccaccatttccaccaaagcccacaggtgggcctgccccaggattctttttgaaatagcttgcacctctggggccacccacggatgggacctcatgggtatctctgaatccaagtgggagccggaggagggatacagggaggcccactcactgcctgccccaaatctgacaccatctcttatcctctgggccactcccagctgcacacaatccgttggctgggtgggtccaggtgcatgtggcctccacggcacagccacacccgactcctgtgtgtgctccctgcagtgacgcattggccctgcggctggcctgcatcggggacgagatggacgtgagcctcagggccccgcgcctggcccagctctccgaggtggccatgcacaggtagccggcctatgccctatgcctctacacctggggaggggccctgggcggtgggtggaggccctgaacacagcacagggctgggccctgaggaagctctgtgggggatgtgccttgacactggggctatactgaaacccttggctgcttcccgcacctctcctgggagcccccagctcctggcactcgccccctgccacctgtccctggcattcctgggcaacaaagcagagcccagggcccttttctctctcgccgtcctcattgagcccagatggtacatttccaccgtggtcttaagagggggtgctacgtgagctcggatcctagatcctgggggctgggcctctcagcgagtctccggtgggggaatagagtgggcagtggcttgtgagggccctgtagaatgggggtttattttccacgtggccagctctggaagacagggccaaacacccggtgggctggcgggcggctggctggcggaggaagcaggaagttggaatgaatttgaccacaaacagtccataccacgcggcccctgcaggtggaggcgcccacggaaagggccccgggtggctgtggggtgggagggcacaggcccctgctccccacagctgtgatggtgtcatctaagtacaggctgcccctacctgctcctgcagtaatggctttgtccccccatcctctttgtctatagcctgggtctggctttcatctacgaccagactgaggacatcagggatgttcttagaagtttcatggacggtttcaccacacttaaggagaacataatgaggttctggagatccccgaaccccgggtcctgggtaagagccttgagatccctgaccctgacttgcgctgcggccagtgggggctgtcagagccgctccttggggcgccacagtccccaccactccgtatcatcatctgtgtcacctgtgtccacatctgcctgatcccatgggcttttgggtttgagatgcctggttctgagtgcacaaaccagtgcatggtcctgggtctccctctggtccgagagccttcacctggcaggcaggactcccgtctcctggccagggcaggggcctccctgagcagccttcctggtagcctggtcccatggtgtccactcggcaccgcccaccacaagggcagctgactgccctcacctgtgcccaccgggtgtctttgcctgtgtcccgcagactggcaggcccaggccacgctggcctctctggccacgtcctcagggccactttccccctctcctgaactccttccttctctggtcccctcgagctccttcccagtccccaccctcctgggcttccccttggcactccgctgtcacccgtctggccccattgccggggcctgccccgagcctgactcctctgctttgctcccacaggtgtcctgcgaacaggtgctgctggcgctgctgctgctgctggcgctgctgctgccgctgctcagcgggggcctgcacctgctgctcaagtgaggccccggcggctcagggcggggctggccccacccccatgaccactgccctggaggtggcggcctgctgctgttatctttttaactgttttctcatgatgcctttttatatttaaaccccgagatagtgctggaacactgctgaggttttatactcaggttttttgttttttttttattccagttttcgttttttctaaaagatgaattcctatggctctgcaattgtcaccggttaactgtggcctgtgcccaggaagagccattcactcctgcccctgcccacacggcaggtagcagggggagtgctggtcacacccctgtgtgatatgtgatgccctcggcaaagaatctactggaatagattccgaggagcaggagtgctcaataaaatgttggtttccagc

SEQ ID NO: 36802 - DNA, 64065 bp, Homo sapiens
acgcgctcacacacagagagaaaatccttctgcctgttgatttatggaaacaattatgattctgctggagaacttttcagctgagaaatagtttgtagctacagtagaaaggctcaagttgcaccaggcagacaacagacatggaattcttatatatccagctgttagcaacaaaacaagtaagttactgttatttgtcttttaaaacaatgctgaatgttttctaaaagtttatctctttttctgattttagtactgagcaggaaagtaaagttacaagatttttgagccatgtaactatagtaattatgctgtagaacataaagataaggttgaagttctccagagcaatcctgacatttaacttaaaaaacctgggcagttcaggagaaaataattgattaaccacaaatgtaaaagcatataataaagaagtctagggagaaagcagttacactttgttagcagtaattgtaaaaacttaatttaaatcaatagttctgagtgcagtatggttctcacaaaatagcaattggaatgaatggtacagtcatattctgttttgtctctactcatgcataaattttataaatctacacataaagtggtaaagattttgacatcctctgtgaaggctgttttaaatgtatcttcaaagaataacctatactgtattctaatgctactacttacccactaaaatttacacatacaattttttatcttcctctctcctcccctccctattcttaatctctcattgcaaacagaagtcaaatagcaaacagcgtcacagcaactgaacttactacgaactgtttttatgaggatttatcaacagagttatttaaggaggaatcctgtgttgttatcaggaactaaaaggataaggctaacaatttggaaagagcaactactctttcttaaatcaatctacaattcacagataggaagaggtcaatgacctaggagtaacaatcaactcaagattcattttcattatgttattcatgaacacccggagcactacactataatgcacaaatggatactgacatggatcctgccaactttgctctacagatcatgctttcacattatctgtctagtgggtactatatctttagcttgcaatgacatgactccagagcaaatggctacaaatgtgaactgttccagccctgagcgacacacaagaagttatgattacatggaaggaggggatataagagtgagaagactcttctgtcgaacacagtggtacctgaggatcgataaaagaggcaaagtaaaagggacccaagagatgaagaataattacagtaagtaattttaagtactgctcatgaaccttagcaatctgttaatggatcaattttcaggtgatatgttttctcatcttccttttgcttcttggaaaaaaaattaaataaaatgtcacctaatttctctaaattgaactatgttgaactatgcccctaaaaatatctcttttaacagggcaaatctacttacattatagttggacctgataatccaagccaatttgaaaatatatactccttgtcctgaaaatgctcataagttaagcaaaatgtaaataatattattcacaccaaaatgtgacttaatattgtctaagcaaaactcattaagatatctaatttagaacttcataaattatcactaaaagctatttatcactagtttaaagagtagggaaattatttttattaatttgattttctttgaaataatattttcatgatgtaaattaaaatacttaatctgtgctaagatatgcattcctttgcaattgtgtataatgataaaatagaagggaatctgtggtatccttattcatttgagtcataatgagcttgtattaagttgatgacttatcaacttaggcagaaaaacagatctctcctaacgttttccttaactaaatcttttatgtcataaaagttctgtgctatcttaagaaaaatgtaaaggtgaggggaaaaaagtgggctggaagagatggtaattccatgtttttcaatttaaagccttacatttttcccaagaatcagttattcttcttatgttaaaatatcagggttgtgttttgcatttaatggttatgatgaataaccaacttcaatagtattaaatgtaatggaataagatacacacctcaacatgtacattaaggatttaaaatacttagtaaaaataaattttgtttacattactagcactcagaaaacattgttattaatatataatttcatattaattgttttaaagtcatttgaaaaagaatgcatggggagactggtgtaaacatgtgcaaatcacagtgccaggcttgcagcaattactcaaacttttgttgcctgtttactgaatgacttttagggttctgaactaatcaaccaatcaatgggaatttcagagaattatgtttccaatatgaaaatgagaagaccttctttttaaccataattgatatagaatgttaaggccattttaatgactggacagttatggttttattattattatttattattattactgagattaataaaggtatcatgttagttctagaagatcattcttattatactaaagtttatctaaggaaatgactatttggagaaaatttttttgatatctacttctatataagcaacagaatttggcttataattaatttatttaaaagttgctcagatttatcatggataatatcatggatataataacaatattatatattatcatggataatatatatcaataataatatcatggataataaaacctggtggagacgacagagcctaggtaaaaattatgacacatggggcaactccctgtctacgaatgatctggggacaatttctttgtttttctgaccctcaatttttcatctataaaatgtgggataggtacagatgatttccatgatactttccagttcttatagtctattctattttaaaccgcagaatatatttcataaatataaagaaacctaaatacccattgtataattatctcacacaacgaatgagatgaaagtaataggataagctgtcagaactaatttcaaattatagcaataaggttaccaaaccttaactgtggaattctacatgctgactactccttttgaatccttttaccaagtaatgaaaaagcaaaaaagtagatgtaaaatccagtgaaaatgaatagtatgcataattatttaggatcaacaatatcttcaactggaatacatttgcatatgtaaattttattttgtttgtgttaaaatttcttgaaacaatgaaactcaggtagtacacatgcataaaatgctaaaattattttatagtttgaaatacaatttagtgctaactttgagtaaccctaaagccaattttgtaaaccatctcctctaacaccaattctatagcacaaaagaaaaaaaaaggaagtcgccctatattgttataaattagaatgtcacaataccagtgtactaaaaagacaagatacacatcatgtaaataatttttacttctataaactttttaataggctgtatatatggtatactttcttgatatcgttaattatcctggaaagggaaactttcatcagaatcctttaagtaaaccctaaaactgtcgtaaggttatgtggctatcttattggagaaggagtcagtaagatttctccaaagttaaaaagaggataagccactcttttttttctataggaagtccttaggtacagagggaaatgctacaatgaagaatatatggagaataacatgttagaagaaaattctgatagccatttcctattatttgaagggtagccttactataataattttaagagtgaatgtccaattgtgctaattgacacatgtgaagttgaagctgctatattaggaaatctaggttcaaaaaatgctcagaatttgtttaaaataacaagaatggaaacttgaaattatgacatttgaagattgtttacattcctcaatcattaattgaatgaatggacaaataaatgaatgaaagaatgtttccttcctattttcattaaaatgagagaaaaaggtaattggattgtctactagaatgaaatgcagcaggattctgattaaagatcagaatcaaactcagaatttcattttcaatgttttgatgccttaaattttttcaacaggttgtcatgtcaatcacctttctttggaggtcttttaagttagtatagattttagtgtcttggaagataaaattttacatgaaaagtaatatgccagctatgcaaaatataattattcttctggttaccaaaagaaagtccccaatcttttctcatgacttttttttgaatgactgacctgagaatgtcaataggcttcagaggactactcacttcaccagcagaagcaatgcttccacacaggaatgtggttttttaagatactagtaaatatggattggagctagcaggagaagtaaaatatctagatgtataattctgcttccacaatgttttgggctcgggtagatggttggagggcatggagaaagaaaagggagtggtgggcaagtggatgtgactgctcatgtctcataactttagggaattttaaaaaattacttaagctatcctggattgtgaggttgtcacttactttagtcttaccttaattactgtgttgttttgtaaaatattttaagtttagattagaatgaatatattacagaaagagtgcatcaaggaacccaacggaaataagacttgtattagtagacatataaataagaactatgaagatgggggaattcatgagaggccaagagatactggaccacatttctgactcttgaggggacagaagctgctactagagaactggtcataaggattgtgtactactgttacccaggaggcagaaagtctctcccctttacttatctctctggtggcttcacatttagcctaacagtgggtttccaggtgatgaaactagtatctaaccttaactaataataagaatactaaaagcataaaatgtccctccaaagtacacattcaaaatgaagtaaatattcattttctctgcagaagaagaagagcattgagaacatcataaaagggtgaaatgaatggtcgatacttccacttttgttgtcagaactctccccatggggacaagatcagagggtgaatttagattactgctgcaccaggcagtccaacagcagacagaggctatcattctgcacctgacagaaataacactgctctttaagctgagtattgaggtgccgagtgagagaaagcagcagtgcactgggcactcagtgaccgccttgagagacagatgtggaagacagaatccaatccctcaggataattttcatgcttttggtatccaattactaaaaagttgtgctcttcccaataatagtcaatatcatctactccttttaagaatttcttgtcataaattgcctcacttgattataatgaagcactgttagttccatagcaagaaaagggttagccattctgaaaactggccaatgatttggcaatattctcttttggactgttagactgtgatgggatatggcctaacaattggcaaaaggcaaataaacacagcgttgctgaatttgactttggctacaaaaccttcagcgactcatttgtcaacaattctttggataggctcctacttaacaataatgtgttagaagctagcaaatacacatattgcctctgaatatggagatggtaaatttgcttatattctaaacagttcttagcaagttatctaaaagaacaataattcacattatcagaatcaaaaatagcaatgtaaggacaacccctgcctttaaaaaaatagataataagtaacatatctacgcagtcgaaccaaaatcctagcaattatagacaaggtagaatcttgtagaactggtgacccgcattcccttaagtaacttgttagggctttaaattatgaagaatggataaactgctggggagcagatttgaaaatattagccattctttgattagtttttaattttataatcttttctttttggctatcacatgtgcctggcacttatgaagtgctaataagttcattcattgccacgagtgcatctcttatcatctcttttctcttttgtaaatcctcatctagactgacccttatgactcagctgtacaataactctttaacctacagttctagagcattcagaggcccaagtgaattacagagaatggaagaagtcagctcttagatatattgaaagggttgcctttctacatttttctatctctcaaccttgtctaaatattacaatcagctggggaactttaaaaaaatactgatgccagtttccacccacaaaaaatttttcattaaattgatctgaggtacagtctgggcatcaggaattttaaaagcttccccagataattctgacatgctgccagggatgagaaccactggactaaggggatcacattagattactggggaattaagtcagaatctcacaaaggtgggaaggaccaggcattagtatttgttaaagttctccaatgattctaaagtgcagctaaggttgcaaaccactgcttatggagaacaagaattctaattcagcctggaccacctcaggggtcttgggaatgtttcagaccctgtagagggattcaaagttaacttgaaccctagaggattttgaaataggcttgattaggcataaatctctgaattatgcaccaagagggttcttctgggctcatctgacctctctgacaaatcttagtggctccaacatttggtgaactggcctggaaatgtacgtgatgatagctctgtagctactatgttaagaagactgctttggtgaatgagttagctgcagggaagaataggttctgtaccacagcctcacaatgacaggcaggtctgcatctcttctgacactttaaagtggtgttgcagtagggtacttgaagtacaggcctcaatgtctgcttattctgcacttaaatgagccaccttatgactatgaactcagatgctcccagattaggatctcacctctcatggccacacaaccaagttcaaaggcagaggtttaaggagacaacctctagcctaggaaacccagggggagagaaccacaattctagagggttggcttagtctgctttgtgttgatataagagaatactgcagattggataatttataaagaaaagaaatttattcttcacagttctggaggctgggaagtccaatatcaaggtaatggcatctagcaagggcctgcttgctgtgtcattccatggtggaaggtagaagggcaagaatgtatgagagtaagagagtatgagacagacagggctgaaatcattttttctaacaacccattctcttcataactcacttctgagaaaatgacattaatctattcaggaggttgaagccttcatggcctaatcacctctcaatggtcccatctcttaataccatcacaatggcaattaaatttcaacatgagttttggagaggacattcaaaccatagcaagggtctatccagatcagagaaaagacataaagctagaggactgttctctttttaagactggaatgatgcacaacattagggcaaagctttttttattttctaaggatcatagctttcttcctttgtatcacacaatttttggtagcacaataacttctctaacatcactattggaatacaatacttttccatttttaaattttatatatctcacaataaaattatgtatacttaagtaatatggagaaaaatgactcttgttcaatgaaatagactttaatataaactcctttactaaacaacatctaacatttttacccctcaaataggttgtaaatgaaaatcctctgccttccacatgatttggaaaattgtgttaaagagtccctgaatgtttaaccgcttttggaccaagttttttatctgcatttgagattatatctggacatatctttagtagagaagtcgtgtcaaattcactaacaaaaatgtcattaaagttccttaactatgtgtatgaaagggtttgtgtagtaatatgtaaagacaaagtgattaagatggggagtgagagaggagaattatccagtacccatgcccaagtaaaccttgtctttaggcaggcaacatcattctcagaggaaaaaaatttgatgtatactggggagaattggctctagagattctccagttgcttaacttccctccagaagaaagtaatctcttctactggagtggtcatgagtacttgatagagtcattagctagtgtccatctaaaaataaagaggaagaaaatatctttgtgaacaggaggaaaaagagcaaaagagaaaaggaaaaagactttacataaaaattattggattttaaatcttctgtaaacttaaaatgaagcaaagtttctcataaaatatagccccactaactttcttgatgcacttaaagaatgagacaatggaatgacaagatagtagaaggaagaaacaaaaccactaaaatgctgggggttggatttaactagaaattgaaataacaatttcagataataatacagaggggttgaaatgataataaattattacaggtattactcaaataggtttgaatctcttggttgattttgtgccgaaaactgtaataatctttgcttatttatcagaattattctgaaactgaatttatttttaagattaatgtaagagaaataagacatgtttcaatatcctcaaatatcacatttgttatattctattgtaatatttcccattttatctggctacttgaactttagatgtaactgtaagtaatgctaagaaaatagtttgagaccaaattcagaatgaactcagcttgcagaattttcttaaggtaatatttccaaactgtgtttctttataacactagtgccccctgagatattaaggctgtttcctgtagcacagcttctctaactaacctgctgagaaatattaggttaaataaaattgaacaattttctttcagcagaatttctctgagtctatactatactaatgagaatttttaaaactctaggaaaagagtatacatgatttcttaaacttatttgacaacataacactcctcctctccctcacctccattcttagtccctggtttgggtggaatatttaaattttattaaatttcaacttgagagctattgtctaaggatctatctttggtgttgtcaagaactaaacgaagttgccactaaattgtttgaatcaaataaaaaaactatacaattgacctgaaccaacattttaataatgaccaactaagcatgtatgccaaagtcagaagattatatatgatttcggactattagagtaatattttgtgcatgaatactggacagaaatccagggatttgcagtgggatttaagcctaatttaaaattctttctgagttctgagcagatttataggaccaccctcctgtaacaagaaatgatgcccaacagctattatttgggccaccgataaactaaccaaaaacatttcctatgctataacctaaaaatgctttaggatcctaatatgattgaaaaattcttactgtatatatctaaaacaataaatttttacttttcgaaaaagtagttggagcaaaatttgttgctatttcaattatttcaataaagaaatgtttcatttactggctaaaaattatttagaaatttaacataatctgatgaaaggactacaaatttaatgaattaatctccacattcttcaaagaaatcaattatttgagattttcaatacagagccagtaatggtcttattctctttctgtgccccaattgcttttctacctgtgtacagcacatctgccttgtcttatgattctttctgtttgcatttggcactgtcactagaatgtcagttctgagaaaataagtaccatatcttactttttattttttttaatcttccagtggtagaagcagcagcacttagcccagtgtaagaggtgaaagggtaaaagaggggagaaagattagtgatcactcaatatatttatcctttaatttattacacatttaaaattagatgtaaataagaaatagattactaaattatcatgaaaatttaaagtgggcaagaattaaaagccttgctgaaataaaagagaaatacacctcacttccctctcattctctatcactaaaaaaaaatggcctccagaaccaatttgatttaatgtctttctaggtgatttcaaggaactggtggaaaatttggtttattgtagaggccaactatataagcagacacagttaccactggtgacactggaaggttgattggcagggcatagtgaagaccaattctagaggagctgtggccctccatgacacccatttttgttcccacctgactgccagctaatccatgcatgccaaaaactataaacagaaaaaaacagtaattcatagttgatattggtttaaggaatatctgcattagagacaaaaagagaaaaagtctttaataattaaatgagctatactagaaaacaagcagtggactgataattttggggcaggggtctgcctactaatattgatcctggagttggtgatcagcactgaagggaggagagggcatatgcataggaagagagaactggggagaagtcaagaaagttggtgaatccactctcaattcgttttagtgccagtagcctgatcttcaggagtcttttggtatcttacggggtctctaactgtacttctgaccataggcctagtttatctggttcatattgaggcagctctcataggaaggtcacttgtaggtgttacatagtttccgcctttgtttgcatgaataatgaagatatgcaaaattttaaaggttaatgacttttttttttaattaattcaaccaagttatttatacctccttttgctagactaagaatgcaatagtaagcaaatatacagtccatgcttttacagaattaacagttgggagtcaagggagaactccaagtcagagtgagtaagtttagggcacatcgcaggttgtcaaacccaacacaaggagaagggcatggaaatcttttctgagaggaaatagcctgaaggatgaaaggacaaaagatagaggacagatgtattatcctcagaggaaatgctttttgtagatgtttggtagtaacagtactgcaagattgggaaatgaaaagtgatttaacatctttccaagtatcaatgctaaactcaccaaggtaaaggttttttttctattaaaaatataagaacatttactctttattaatttgcatgcttcgaatgattgctatgtttattaaaaacataactaccagcaacttaaattaaatctaaaaacatagactgtgaatttgttcactgtgtatgctcaatctggcaagggaaaacatcaataattaataaaaaactaattaataattaattaataaaaaagagaaccaatttctcaaagttcatacaatgtttttcctttaaagggaaattttaaaggcataattcaattggaataatatattttttctgaataactgcatatttttcacttttttatgataaacagtatgttgtgtgtattttacaacaataaaaatacattcatacaaaacagtaatgttcatttcgaacacatacaaaatagtatacattaaaattgttgtgtatgaagtgagaggggggtacatggggaaaaggcataagtgtgaaaaaaatgaatgaaatattttttactttttaatgccttttcaatctttgaccataagtgtaacttacctatgtcagctgttgacaaataatcactgtaaaatcgaagtaatctttatggagttttttccctaacagtttctaaaatgtgagaaaaataattttgagtcatatgtttggcatgtaaggacaaaattatgaaggttatctaccacattctttaagataagacatacttttactaccatgagcactggatcacctgtttcaactatgtaatcaagacactcagtagtcaagcagctgtgcatagttttatgccctctaattcatgaagtatgctactttcataaaactactgatatgtctttgtttttgcaaaattaggctcacctcccttcttgtataaataatgtgttataaaataatgttggatgtttaacaggcacacagaagtgctttcagctttgaaaagattctggccaaatttggtcttcaaattttctcttaactggctggaagatggccagatattgaataataatagataccccaaagaagatgagcataaatctatatcatagttgctatgttgtaatttaaaatttatgatgttttgaagtactatttagtagtttattagatattcaaattaatattaccactaaaatcactgcactgtatagaagtaaatctgttactgttgccataaatcttttaatttagtctgcaaaatcttacaatgtacaactgggaacatttttattgagtgaataaatgtaagtatataattaatgttaattctttaaaaatacatatgccaatattgaaattggtacagagtactttattccattctgattaattctcaaaatatctccatgctgtaagcttgcaattacacagttacttcatttcacggaagaaaaaaaagaccctcaggaaactggccagcttaataagtttgctggtatataaattctaactgttttaaaattatacatgggcctgttttacttcctatttagatgttgttcattttagtgaagaaagattggtgttcaaaattagccagtgtttcagatgatcctatcaaaaacctttgcatacaatgttgattgttttctgaaaatatttgagtagtcagttaacttacaaagattagatattgcatagtaggtctgatgagtccattgtgtgattaacatcattgtatattaaggagcaagaagttcatatatagaatcttgctttaaaccttccagctttccttttatcaacacaagctggttactaaaagactgtgtagaggaaaaatgagacattcttaagtaaattttttccctcaatgaaaacatgggccattagtattaagataacaaaaatgactactacaacaaaaattaaatgtgtgagtggtttctgtgtgcctggcactgtgttaaacactttatatacattatttaatttaatcttcacagggctcttattaggtgggcagacttatgctcatttgcagatgggggagatttggctcacagaattaagtaacttgctctaggttacatagctagtaactgtcaaagttgggatgtgaatgcaagtaggtttaactccaaagcacagctttagtatcatcacatgtatcactatactgtcactggtgttattaaaacatcgcatattactttgtatcaagcagtgggataatttgcatctgaagaaatacaaataactgaagttttcttctctgtaatatgacctaatgaatacttggcattatcttcagcttattaaataaaaacttactccaagtttccttgtacaaaatatatccatctgtcttcccctgagaaggcgtagcaaccttcagtttattttgcttacacattgctaagatgctacaaaatttaacttggttgtattttaaacacattcctgacatttattaaaactatttatacttctgttctttagggtctggaaaattgttatagaatgcataataataattatccagacactacatatattatatattaaattgtatatatacagtttaatttcagataatctcagataacttagtcatatttaggaatgcctaaagataatttccttccctaaagccactaaatccaaatacaaagcaacacaaaaacaaataaaagaaacagcagagagtttgttttaacaagcatgtctgaaggatggtgaaaaagaaacagtttactggcaaataggttctttcttttgtccatgtccttagtttatttttaatccttttaggactgcgctccacaaaaagtaagaggcaaaagaaagggaataaaaatgatgaattaatccaaagatagtatatctggaattctattttaaggatttttttggggtgtgattctgggtaaatcatatctctgtttctcaatatttttctgaaaaccagacatgcattatttgtgacctgattaactttaggttctttcagtgtcttaagaatatcttagaaggtttgtattctgaaagttgcagtggctctttccagcaattagaatactatttattgcaatatttactgagcatatattacgtattatgtactgtgtatgcacagatacacaatgcaagcacccaccattgaaaaaattcagcctatgtgtggataccaacaccaaagagtcaatttcagtagaatatagtaagtactgtgaaaaaggtatgttcagggagttagaggactctagtggaggccagctaacagaacctgggagagaaagggcaatactctcaaaaaacatattttaaccacatctcaaagagcaggtgggagtgaatcaggctagagaagagggtaggaaatggggaagggagtcagaagaaagggtatctcttcctggaaaatagtacatgaagaaaaagctgagttgtgtgtcagtaggtttgtatgggaattagtgtttcaggagtaccaagttcaagataggaagtaggaagagataagactgcagggaagtctcatatcttggaaagttgttttagggaatatgaagctttacccataggctataaggagccattgaagaatagtagaagcactaactaatcaaaaacagtcatttacattattcacaaaaatgacctggatagttaatatcaattaataactcaaatattactttgttaaaaatttaacctttcttaccaaatcctcttaccagaactacccacaaagcaatgaaattaactcgtgacaatgaatatccattgctttgttccacccagtctttgatacagggatttataaatggaccagattgtcaattgcagaagagaaaagggagaaaagtaggctagaaaattcaccaaagagttatcagtcttagcttatcacaccaatagcattattttgtataaatattaatacacattatatatagcataggagtagattgagttgataagaaagtgagagggagcacgaggacaaggaaataatactgtatcatatattatggaacctgggtgttaatcctttttcttccaataattaactgaatgaccttgggcaaatagttgactctcctaggcctcagtttttgtttttgtatttgttttataaatataaattgaagagaggtaggccagatttcttgaatagattacagttgttaaatgttaccaatagtgctaagcaactgagagagagagtgggtggtaaggtgagagaaggaaagataagagagagggagaaaaaagagagagaaaaagagagagagagaaaattagttatctattgttgcataacaagttacctaaaatttaccagcttaaaacagtatttattatcttgcagtttcagagggtcaggaatttgggagtagcttagctgagtgggttggtcttagggactcttacgaggttgcaatcaaactgtcagctagggctgaagtcttcttatgtcttgactggggctgaaggatctatataaagcattctcacattgttgttggcaggcctctgtttctatcaggctgttggccggcaacttcctctttgctatgtgggcctctcgacaggcttcctgagtgtccttataacatggcaactggcctccttcagactgagcaatgagaggggtaggagagagagagagagagggagggagaaagagagagagaaagggaggcagagagagagagaatctttaagatggaaattgcagtgtgacgtaccatcatttctgccttattttattggtcacacagactaaccctagtaaaatagtaaaacgtggggggagggaactacccaagggtgtgaatagtgaatactaagtgttagggatcattggggccaaaccacggactaactaccatgcatggtttttgcatctgaagaatttttagtcaagttgaaattctaagtacacataaaattaagttaaagcaacaatagaagagaaacagagcaataagtttgtggaataagcttgtttctgaacaagcctgagaagtagatagctttccttattggaactgctaatctgggttagggtctcctcaggaggaacgtggctctcttctcttactgcagacagagggaggaaaccttataccatgtgttaataccccacttcgtagcattgagaaagaaactggatgatttgcttgcttaaaatcacactaatggttgtatgaaacaaagacaactccactctggaattacaggtctggaaggaagccatgagatcatagagtccagagattttgacatgaagtttgcagatagccctcagggaaactggaaaggaaaaaatatgcacaaatattggggacaggattcaaagcgtttatcacattatcaaaagtatctgtgtttccaataaaagtttaagaagcactgatctagtctattatgcttattttatttgatgagggaactgagtcacgaaaagataacttttcaaaatgacatcacgaattagtggcagtggtggtttggactggaattgaagtcttctggtttttagttcagcatacttttagttaaacccactgtgtaaacaatatgcattattactgtggtttgtaacaccaaaagcttagctgatttccttctgtttatacactcttacaatttggatcatttccccttttgttctcccaccaaatgtcaaaaagttgatatatttcttataagtaaaagagtcatcatagaggggtagaatattgctccaaagtatttatagtgaaaagccaatgtttatatatataggaaaaagagatcagcaaattgattatagttggccatctataatataaaaccaaatacttaattgaaactgaaattgaaactacttaatgtcctatttacataaaattatctaaaatgaacatattgttgtacagtcatacagctaaaataaaattaaccaaattaatgcattaatatttattaaacagatgggagaataaaaacttctctttattgggtattaactatttgtcaggcacagtgcttggtgctttacatgatttctctcatctaattccattttataaatgaggaaaatgaggctcagtttgacagtcagagactggtttggttctagtaaacaacagagtcaggacctgaactcagggctctacagaaatgaaaagccaatgctctttccacccattgagttgttttgttatataacattctgaagttgattactgaggtattattaaacattctaatattttaacattttaagttttctatcaagatgatactggttataagttggtttagatggaaaaaactgtaacaagaaaactcaacctgcttactgcttagagattcattctttttggcttaatgttttatctttcaaagtgtaaattaccaccaaaacataacacttaaatacttatgaatagcttacaactttaaaatgaatgagtaaataagataatttcctgaatgtgggatttgattgggtagaacacagagaacatgagattaccttaaaaggagaagagaatacagaagtggaagagactgcagaaggaggtcagaggcctcaccaaacaatactgccaatgttgcctgggtgcccacaacttagattttcaaattaaacactcaattcatacttatttagcatcaatttaagtctgcagtgttataggctcattaggggatacaatgattagaaagcataacatatgtcttggattcagcccctaagaatccaattttagaaataaaactaatatcaacacaagatgaagtaaaataaaaataaaattagagagacattaaatgctaaatcatatggtattggccacagttccaacaggagctccagaggactgaagtagaccaggaaagtagaccaggaagcattacagacaaagtgggacacaaagattagttaggatttccatatatagagagaaaaggagagtgcatttcatgacatggtataattttcttctgattcaccacagcagtacttctcaggggctccacatcatttcatatgttcagcctctcaaataacaatgataatgattataatactattttattttattcataattcttattctttattacacattttcataattattattcttaatagcagtattgtgtaaagtttttaaagaaaatgtattatctcattgaattcctatcagtcacatgactaattgcatacagtgtttctcagtggtcagtaggaggagggagcaaccttctcattgtacttatgcatttatttttatcattttgtgtagtgctcaagtattataattatttgtatatgtctgtctggctagagctccttgagggcggggaacttttctttttcatctttttatcaaaagatccattatagtgtccagcacattaggaaataatgtgttcaagtaattgaattaagtaagaagcaataaaaacttcagtgaataaaggtattgtaaggcttctctcagctcttcattaagaaactctatcatttggctcttttttttcttttaccttattttctactgtttgctaatggaaagattctattctagccagccaatctattcactatttttcctagactataaacatccatactttttcactctgcatgacaatattgactagaatttttcttctcagtatctacccattcttcagggcccagattaagtctcaactctccacgaagctccccttggccatttcagtccacccctgcacactgctgagtaccttgtgagagtaaaatgtgagaactgtaaaacagtatacaaacataaggcattactgttatgattttctccttagattactgtattctcctagactttagaaccaggagttggaagtattataggtctttccatctattatattacctcttttccaattcccttgtcactctctcccctttccttatccctcactcccatctcagcattagaatagtgctttgcatagagtagttactcactaattacatgaatgcagtgtcttttattgttgcctgccattataaagctgcaggtaaaggaaatctactagcatggttatttaaacatttgacagaaaaagctcagttctaatttgttactatttacactagacacttcaaatacccaaccactggcttttcttctttttaattccgtttgtgcttccacacgacacctatatacctactaagtcactacaattcaccaaatatgtgctgctcacaccactaatgattaggttgattaggaaaaagagactggaagtgggagagtcaaaggctgttggaaatcatgtgaaggcagaaatagtttctatctcgaactctgctgtattgcatctcacaaaactagcacaattcctggcacatattaagtgtttgaaaatatgtagccaatgaatgtttgaatatatgggattagttataagtagggtgaccatatttggtggtctgctgaagctccttgtactggtccatgagagccaattgttaaattttcaaaaattttgttaacttattaaatacagccattattaaacatttaattacataaacttagaatgaaataaattacattaaaagaaaagtaataaatactcaaaactctttactactgaatttctttactattatatatgtttttgaggttatttctaatgtatttatatgatggaaatactagataatggtatgcgtctgtatatttcttcccaactctgttcagtgatgttttgttggtggcttggacccaactatgataagagcacctacaccacataaattggccaatgctacaaatcagggcttgattcactattttgttgatggtctacatttaagcgaatgatacaaaaatgttaataatgtagattaaacttaaggtttagtgtctataactgtttcattgtgaatagaacaaaaatgagaaaatagttttctagtatctctaaaaactatgatctaattcagcaaagaagtcactcatatcattgagaagtgagtgaagttccaatatacatcttcattcatttaccttcttcttacttattaacataaatgaaaacatcaacaaatattattgtcagaactatagttgttcctctattacaaccatggtttggcttcagagaaaaacagaaatagtgaaagcattttgtgagtattatattttattatttatatgcttgtgtgctatgcttcctttatatcagtagaatttgtaatgaactatgtgtgcatatatatgtacactttttttccctgagagtcagttgttaaacatttacatcatgcttctacatataatctatcatccaaactggaacacttttgagagtaaaagattgtgctgtaaataaacacatcagaatagcaggtgtaaactaacattgtgctgggcaaacaaggatgcaaggtcacctttcttataaggatcttacggcagtgttggaagcaatgctggggtaggcagtggcattgctgggatagcagaaaactcatcaatgagaaccatatgtactatttaatttttcattatagtatccattctccctcataaggatttatgattgctctcaagacaatgaaaaaacggagaatggaaggccacaatccagctatttagcccagtgtttcttctttttaacattttaacatttcagtaaaacatgctactatgaaaagatttgaaaatgcacggaaccaaagttggtttaaacagtaacagattatgttttatagtatgaaaaagtaaaaaagaatatagatgatcacatatttgcctttaaaaacttttttaggataaaaagtaagtagacaaagaaataacattgaaattatctgcttcaaaacatcaatagattgtagtacgtgggtctaattacattcagttaaaacgttatgtgtgtgagagaacataaggtttatctcaagctgaaataacttggtatctaatgaagcctaatgaagcagatctaagttgaatcaggaaccttcttagcctaatattctgctgctgactgcagaccaaggaccctttgtgcatatgttccggggtctgtctcaaaggctagaaataaattgcaaatatctccagctttttaaatactctgcatgaatctatcattcaagaatcaatttaagccatcttgaatcaatgtttttgtgatatactttgagctaaaaaaataaatttacaacctaatgcataaagtttagcctctctttttttgtttttatcacatctcagaatactggtaattagaagctttgtgtgtaaacttaaataaaatactttagaacaaatattcatgtattcatattcattctgattcatattcatatattcatatatgaattcatattcatttggttaaagtcctaattattatatagatttcagacatatcctcaataatccttttctttccagactaaaatttcataatttaaaatggttggtgttttttcaacttttattttagattcagggagtacatgtgtaggtttgttacttgggtatattgtgtgatgctaaagtttggggtatgtatgatcccattacccaggtactgagcatagtacccaatagttaagttttcaacccttgcctacatctctacctcctgctagtagttcccagtttgtattgttgccatttttaagtccatgagtattcaatgtttagctcttacttataagtgaaaacatgcagtatttggttttctgttcctgtggcaaacttatttttatcatgctaaattttcctctctagacatttttcccacttgaaatgtaagttttctattgttttttctttagaacatttttatctaaaacaaacagaccttttgcttaagctgttttatattttgttaattttctcctagtttggttcagataaatgtctagatcacggacatactaattaccctgctctgatcactatacactgtatatatgaaaacatcactgtgtacaccataaatatgtacaattattatgtcaattgaaagaaaaaaataaaatatagaaaagtatatgatccatcaagttcagatgataatagctgtccagtttttaaaaactgcaggtatctgtttaaagtcctgctcatgttagccaagaaataatagtaaaagagtgtatttgaaactctcttatcaccagattccaattatcagataatttcaaactaaaatttagtatgatcatttgaaattagatagaaagtttactagacaaacatatctatactatcattaataacttcttgttaaaaatgcccaagtatcagacttccccatctacattataattttatataaattcatgaattttttccttactggaatagacatatttacaatgttagttttcttgtacattaaaactatggtgtatttctaaataacaatgttttattaaataattcactaccttttaagtaaagatgaagtaattagtgtattataattgggagtaggctgacaacaattttcattgaggaaggcttcactcactgataaatatgggaacacttttttctttttaagttaagagccactcatcttagaaaatcttaactgaatgttacatggaatcaaagggcaattagatctagttcattaagatttaaattagtgcagttcaattcagtactcatagagcaccttcgatgtacaggtgacattgtgtaataatggatacaaagataaacaatgtgacttttacccttaatgtactgccataggaaataatttggtaagttacgatagttgctagtaagtttcatatgaacaaaggagtgataaggagactgaaagagaatatttctgggtgcacctaaggaggtaaagaactgggaaaggaaaatttcctggtaaaggtgcatttgcttgaaggaaggattggttggaggatttcatagagggtaaagagcttttttaaagaagagaacaaaatgtgaaaaaaaggtgcagatgcattaggacaacagtgaggaatggggatctctgtcctgtctagctggagaatatgatgcaaagaaagtggtaacacagacctagtgaacagataaaatgcttcaaaacatattttaacttcatattataaaaagagaagatagcacaaaacaaggataaatgggagagacagaattaaaggaaggatgttaggaagtaaatggagaaagatacaagcagggggagaagtgaggaaggagtgctcactaaagagaaggaaaagcaatacacagatatatcaagaaatcaggagagataaaaggcagagaaatactccagaagttctgaagtttctagagattttgacaggtataaccagaacactcactggaatttgggggtgcgggaactcatcctgaataaatggactgtgattctactaacattaccctaaacactgaataaaatcatgttaaaggtcaaatatgcaagcctgtggtttcctacactgatataaggctttcaaaaagtatttcttgtaataataatttaggtggacaaagtgttattatataatccaccaggcccattgtaaataatcttgcactatattgttatttcttttgatacttgtaagagcttgagaatattaactaagaaactctgtaacatggctggcaaaatactctcttatcactttgaactttacttagaggtaaatacattttgagcttctgtgaggttaagaagaagtaagcaaagatcacagagctagttagtgatagagtcagatttggaacatatgtttctagatacccagatgtgcattacaagagtcaaatatggcagctagtatagaaatcatgctagaataagagattctcaatcttaatgtgatttaattactaagtcttggtagcatatgcgttgatgtattgtttgtcaggtttaaaatacatgttcaccatcagtggtgtatttgcttggggtgaattttctggtaaatttatgcaaattgatagatttcaaagctatctccttcattactgaagaagatgatttgggtaaaacatgcaatcaattcatggataattgttaatacttgagaaaatttttatgtggaatgactttgtcctcattactgcttgctccaaactaattcaactaactggtcaccaacatgatggagaaaacatgaaaacataaaatccaagattcacagaacgagaatgaattgaataaacaataggtttgacttttgtttttcatgccaattaatataaggtagaggtagaatcctcaggctcgtgtcctttaaagatctagcttttacttctgcaaccagagaagaacttcatcattcaaaagctgctccagatatcttttgatttgagagtttgaaattattttaatgtccgagagcatatacagatttataatcagtaaataacaaacttatcagaacttcaaaagacagaaatatgaagcaacatattatgctcctatttacataacatatttgagggccagatgaatgagggttatctcaggatatctatcataaattactagaactttcttttcaaccttctccctaacatttcactattgttgtccccccaactcttctgttttttctacatctccttccaaatttgtcttctttcctgttaccttttctccctcttttcttttccttattcttttttctcttcccttctctcctttctttccatttaactcttttaattccttttctccatttctttgctttaactaaccacaatatagaactgatgtgtatattaattgttcattaaagtgactgggtaaattccttgtgcttaaatttaaaaagcaattttaaaagagtatatttattgttttaaaaaactcctaacataagttaatcaaaattcacagaaaaatgattaaaaataaatatactagattacaatagttatatttctggttattctcttcactttttttcagtgatttccaaatattctttgatgagcatatactattttttgatgaacatccacatatgtacatatatatatatataataaactatgttgcttttaatacatgtggctgtcaatttcctctcagtcacactctgataagataaggaaggctcccccaaatacccagtagtctaagcaacccaagacagataactggcaaaacttttcttgaagctctccaagaatgaaccctctacaattttctttagcagtcgattccaatattatattaccctaacaactggatactttctcatatctagggaaattactcctgcttcagtttaagcccctttcctcatgctcttttttttgcatatgaataatatggatatgccactaaaaaaaacactttcataggagaaataacattcttttctgtctgcactcatccccttgataagtaatttttggctatttcaaatgctggtctggcttacagataggaattcaaacagagacttgaatgataccttcagtctgtagagaactgctcactctagcactatctcagactgcattactaagtctaagtttttcttgttacctaatttccacctgcataggctcatattgggctcctagtatttattgctagttatttttatatggaataaagcaatcatgaaatcaatctaaaataagaccacaaatcagtaaatgttttttacttctatacctacaaattgtcctctataggacagtgattttagtatataaagacagttatatttctatttaatcttatcttctctaggctaagcaatgtaaattcactcaaccattacacttaaacatgatttctcagattttcaccacccaccagtcctctaagaataccacctaaaataggatacccagaatgcaatgctccaaattgcacagggtggggccagaatcagcaagattactgcctccttggcaaccttatacttctattaaggcagccaaggttgccttcccattaatatagtttaaggcaaatatgccatactgtcggctcatcttaagcttgtccaggtccctttcagatgaattgctgccaagttaggtctctttcgcttctatacttgtgcaattgctttttgtatttacagtgccttgcttttctctttcttaaattttgttagcttcatcccaatatcatagtcaattataaagatacatgtaaacgagatcagatatccataaagattacttaactttagagatactgtcatcctgtgaattctaatgttaaaatttctgagttggaaaacaggtttttagaaatgtatggagggaacactccacagacatatgcaaagaaaatgtcatgctcaatcacaaactagactgtgatgcgccattcatacaaatgtggttgcatgagcccgtaaggaatggatcagcaatgcatgtgccaaagttgtataaatccataagactgagaagaaacaaattaaaacggagttgtggaataaacatgccttcttacagggaaattcactataaagaaatttgcaataatggaattagaatggcagaagagtgaatttagtttctatatcaagactcaagtgacagaagaataacaattgaacaactgatgaagtgtgttcatttccctcctcatcatcttttagcagtttcctgtcaatacaagataactctttcttccaaatcttggaatttttattgtgttcctgactgtctagagttcatttctctggcctatgtcactgattatgttgctaaagatattttttttcccttatactgacccttcaaaaccatcctgaatgccattttttaagcccctcctcttagccagctacaccattagagagccattttataaactgacattattaatggttaatagctcaatgtgtaaactttctcagaaatatttactctttagttatgtgcccctgaaaatatgatgcttaatgtagagcaactagtttccagtggtacaattcaagggctgcagccagcaagagtctggataagaaagacatttcagagaacaaaaacttccttatgcctcttgattcccacatcacaggttttcaattacattcttgatctttaaatccagtttaacaaaactaataacactgcgtttgttatgatagttcatttaaaaataaacctcatctgttttactgtaaaatctgttacaggcaattggatagcttaggttttttgtctgaagctgcccagttattcttttccacatgtgggctgaacctatttgggaaaaaaactaaactagagatatagttagtatagctacagctaatcaactcctttgaatgctccttcccccaaaaatatatttccctggtcagtgccatctgtatgtgtgtgagtggggaaatatatgtctaaaaactggtttttttttaaatgacagtttaattcaatcaaaattttaagtcagatataatcccatgacctagaaaaagtatatcaaaaaccaatttcctttagggtttatatgtatttgtttccaaaatattaactaagaatatggatacttacatataaaataaataatacggtcatttaaaattttaaccaattagagcttgccaatttctacagaaagtgtgacaactacatatattgcatatcatagaggctaaggttttgtgagagaagaaattataaaaactaaaaaagttttattaggcacaaaattagtatcataatgataaagtattttttcttctgtaaagtgttgaatagtatatatttttaagcaacattcaaaattacagagaagtctatgcattgctgacagacatatatgtatatatgtttgcttaaatctatatgtatatatagattataacatcaacaatgagattaaattctgaaatctcaactttactaaaattttagtatttatatttttttctaaatcttcttagaattcctcttcaattcacctttaaatgtactgactacacattcattgaccttgataatttcagtaaacatgaagtgaaacacagcacaagccaaactgaactctaatttttatgtacgtctcaaatcatgaaacatgtcttctaaatttgaagcctttattggggattaatactcctaaattttatttagaatcacttgttaagtaagttttaaaagtaatacttatatagcaatcaagagcggtcaagtaaatcttttacctaggaggaaaaaactaagacccactttgtaatctcttaggaattattttacatgcggttcttccagtaagtccaggatccaggatgctctcagaatttgagagactgtgtttaataactagtgaaaaaatgctatttgagaaactttctctcaatatgatatcttatatcactacttgacatagattcaaaatttgattcaataccaaccagattttttttttttgagatagagtcttgctctgttgcccaggctggagtgcaatggcatggtcttggctcactgcagcctctgccttctaggttcaagcaattctcctgcctcagcttcctgagtatctggcactacaggtgcatgctaccatgcccagctaatttttgtatttttagtacaaatattactggactggggtttcactgtgttggccaggatggtctcgaactcctgacctcaagttatctgcctgccttggcttcccactgttctgggattacaggtgtgagccactgcacccggccccaaccagaattttaaatgccagttaccttactatttcatatttgtgaaaattaaaatgaacccttgttaacatctatttctatacttgctatgggaaaaaatgtttggtaaacaaattaataagtaaaaagctgccagagaaactggatgttattttctggttcttcataaaaagatctatgcagattttttaatgcagttacaagttattattgtttatttaacttaagcaactaaagaaagctcttttggatgcagtctttaggaaatataatgaagataccttagtttgggttcaaatctgagatttgagagaaatcctattatttctgggcaaatgagtcagtctctctgaatcttggtttctttattgggtgactgagatagtatctaatctatgtgcttacaagattattaaaataatgaatactgtatatgtgaatcacagcacagggtgcaggataatataagcactcagcaaacgttagctgttatatgccttgcttactatggtataaacaaaaagatgataaaactaaatttctttgaatattttacatatttcaaagtcaggaatttatcactttaaatttttatcactttaaaaggttttccttccatagggcccaaattcacaaaattactctagttaaaaattgtactgctaatataataatcacttttctcctttctcttaccactgtggaaatgtaatttttataaataatcttaggtaatcatcctaaaatattgcattgaggtcaacaaaaagtggtagtagcatgtttggttcccattttatattctctgtaataacaactgtatttttctttttttaaaatttgaatatgttctgtttaatctaatacgtcatttcaacacataatcagtataaaaatatatacatattttcattattattattttttattttaagatgggatttcaccatgttacccaggctggtctcaaatgcctgagctcaagccatttgctcacctccgcctcccaaagtgttgagattacaggcatgcgccaccgtgcctggcccagtataaaaatattaatgagatattttacattctttctttttgtacaggtccttcaaaatccaatgcatgtttttcctttacaacacaccttaattccaactattcacattgcaagggttcagtagccacatgtggcacatggctcttatgcaggacagttcagtgtagaccatgtaaccgtcagggaccatgtgttactctgctcatgacaaccatatttttctgctcatacattccgaggtaattgtatctagactcatgacttcaattatgacccacgtgctgtttaatctgaaatctgaaatttcatgtctcttccttttcttgagctcttgttacatgtatctaatggtcactagatagctctcctgatgacctccaggaaattcaatttcagcacgttcccaattgaattcaggatcttccccctcaatcctgctcttaccttatacattttacataagagttctgatattactcagttgaccaaagtggaagccttgcattcctccatctcttctagctcccatttttaatcaccaagtcctactattctatcacttgaaatgtgatagaacattttaatattctcttaaactgaatcctcaaatctcctaggaagtttatatggctggggaggcagtgtggtgtaatagaaaagatgtgtcagacaggcgtaggtttgaaactctgctttacctctaattaatgtacaacatagatggggcatacttttataaaagaaatacagagtgaatgatttattgaaggttatatagttagcattttatcatcagaaatacagactaaataaattgcactggaatccctgaaatataccatggatttccagaagtttcatagggggcagggcacttgttaggtctctcttgtgcattttcttctcttttccccctttccagtttaattccagaaacacatcatttataaagtaaaggaaaaaacactaatatcatcctaggtaaaaatcctggtaataataagagccaatatttattgagtgcctgctctgtttatagaaaatatttacctatcagcatatcctcaagtaaattcagttctgctgtggaactccctactaatgagaaaacattggttccacttaacttatctgtactttaagactagaagaggtctccaagatctagatattccccataattatactctttatttattttattttttatattatttttttgagacgaagtctcgctctgtcacacaggctggagtgcagtggagcgatctcagctcactgcaacctctgcctcccgaattcaagcgattctcctgcctcagcctctcaagtagctgggattataggcgcgtgccaccatgccccactaaatttttgtatttttagtagacacagggtttcactgtgttagccaggatggtctcgatctcctgacctcgtgatccgctcgcctcggcctcccaaagtgctgggattacaggtgtgagccactggacccagccataatatattcttaaagcactctctgcaggccttcagtctcaccatgttccattagccaattccagggattttagtgaggtgggatggaaaacaggtaccttgcccctaaacagcagtatgatttaaagtgtagttgggggatcacctgtattaggatcacctactttacttgttttaaagcatattctctaggcctcaaccctcacctattgagtcaaaatctctgctgttaattggcgtctcaggtgatttgtatgcatgcaatgtgacaggcacctcaagtctggtgatattcctgttcacctgtgtgtcaggcattctgctaggtggtgaatacacagtgttaacaaagcggccatggtatccctaatgtatagcgcttatatttgttatgaattcatctagcatgaaaatcaaggtcaatctgtatttatacacagctttcattttaagaatatctacttcatgatgaatactgtgtgcagaaaaatgcataaaaccccagcatttttcaaacaaattgtatgttttcttaagtaataaaattgtagtaaggcaatgttaaaaataatgggcatgataccatacgggtgctcaattgcactactctgaaaaagataagacaaatactctttactgaatttctgggtaggtccatcgtcagttataaaaaagtttttggatttagataaaagtctttaaagaaatatttttaacaatttttaatctaatgtcctatatttctaaacagacatatttttaaatggcagcacttaaataagtgattttggtgttttaaacatcaaatgtatgctattttcttgcttaaagtggagaaaacaaaacgtgctccactttgggtatggtcaatagaagaaatttttcagtttgtctcaagtagcttatcttatcactattgggtattattgaaccatggcttttttcttttttttctttttgtacccagaaatatgctcctcttaatttttcactctagagctccaaatgtgttggaaattactacagaatgggaactatgttgtttaggggagtatcagaaacactctagaagagctttctattgacataaataagaactagctcaacatgctgttacatgctttaatgtgaccgcatattggtgccacttctgccattcactaacttataagacattctaaaatgttaaaagtaagtctagactctgtattataattttgttaaacacatttgattgagatttttttcagtttttttccagatatgctatatttcagaattaattctttagaatttcattttttaccctatttccctctgagacttgaattattaccccagttcccaaaatgtgtttgatgatcataatagaatgctttgtgaaagaagtacaaagtgcagagttctatttagaagttgaaagaaataatggaaagggaaagcagctggacagtgtcttatatgacaagtcatttctgccaattaaaatttcttgacagggttaaggaaggttaatgtaaaatgtaatgctatgtgggtaacatacttgaagtaaaatttctcaaccattatatttccatttattcaataaattcagcatttctactatatgcaagcattcaactggatatatataaaaataagactattcaagaattactttttttcctttgcctttctcttctcaaggaataaatgtttgagaaggagagataactaacatagtaactacaaaataaggcaggataagtgttctttctaaaaagagtcagagatactttattttgtgaatttctgaaaagaaaaaaggggaaaggatcagggaaggaacttgagtctcactttgaaagatgaacagggtattgacaggtgatgggaagtcacaaataaacaaaagatacagagttgtgagaatcagtggcagtccaactttgttgatgaaaaataagaccagaaaaagacaggcaactgtttttactgtgttaagtgcattacaattcaatccaatttaatttttaaaaagataccttcatattatagagaagggaacttagaattgaaaaagttagtcactttgctcaaaatcacagagctagtgagtggatgaatctagatttaaagccatgtctcaaagccagtatcatttttactactacaccaccatgcctgtcaaaataggaagactccataatttacagcaagacgtttgggtttcatttcatgaacagtagagaactactaaaacttttaacagtgttttttctttgggaaagcaggaagcagtttattggattcattggaatcaggagaaagtaggcaaagagagaagagttcgtttaatactataatattccaaatgcggtaacaacggtgttagtaatagaaatggaaaaaaatcaaatcagcgtgtaaactaccctgtaggtggaatccatagaaagtggtaattagatatgggttatgagagataacttttttaaaaagcattcaaatttcaaagctgaatggtttggaaaattatgatgccattaactaaaacaggaaaatcaagaggactgaacttttcagtaaaatataaatacttgagtcactttttcttaaaaatctataacattttataagtaactacattatcaaattccttagagaacagaaacttttctacttccatttctcaagaggaaagaaaacttgagtacagacttgaaaaatgagtctataaaatgagtatgatcttagagcagaatctttgaagtggtcccaggtcccagtgacaatagatttccaatgtctattacttcagtatttagaaaatagatgacaagttttgaggctttatttagtatatttaaaattaaaagaattgattaatacattatattagagaataggaatttttatagtcatcagttaaatggtatacttttggaaagcgttcataatgatataaaaaacaattaaatgaatctaatcatttttgtgctaattttagcacaagttaaacatttaattaatgttagaaaaattaagcctttactgatgttatttatctttcgttaggcatcactttcttgattgataatattttttccccaaaagcacaatattcactttatagcaagattgttgttggggagatcaaatgacataaaacatgtaaaaattctctgaaaacttagtgaaaggtgctgaggtagggcttcagcttgataagatggacaagtgaaggtatttataatcactaacataaattattgatatgagtaggatcttagagcaggaattttgaagtggtcctcaagtaccaatgacaatagattttgaatgtatatttattcatttatactgaattaatatactctggagaaaaagaacccccccacgtgccaaatagtacatttaaatagtcataatccacaaataagctattacttggctttgagtcatctttaaaggtcacttaaactcataaacatgcacgtccagcatagttaacttgtgtttctaattaattctcatttaaaggttttggttttatttggattatttttcatccaagattttcctgttccctctttaccaatttaagattcaacacacttttgcattttaagataatactcactagaagaaactctttaagaacaggatgactaaaaattgctttttaccattgccaagctcttgtctttatagaaatcagagggaactttatgttcccatattttctgactttcatacaaatgggaatctaatacttcagaaaacaaaactcaaaatcaacttcataataatgtttcctaaaagcaataggattagttacagttgtggatatttctgaagttcctaaaatcctgtcttttagaaatttattctataaattcaatttataaacaaaaaataagtcttgcagatgaattcaaagtatttcccccctgcaccagtattttgtctattttttctagactgaccaacatctactactctatttagtaattattttttacgagactagttgataaaaatgaccactgcttataaaaatattgatctgctatccagaacaataaagcaattcgtttgattgtccttcatttctattaaaaaacacacaaaatctactgtcatataactaatactcaactaatatatcttccttctctagtgatataaatacaaacattactgaatatcttctgagtttcccagaaagtttcaaaatgctttgaatctttgtccaggagaaagagtgtgcgtgtatgtttctcacaccacattgtaattgatgtgcagatgtcagctgtcctggccagaggaggagagatttgtacatttgactactttcaaacatggaggagtaggctcccaataggttctctgcattaggtgctttctaggggagcagcacaccatgtgatgcctacaacaaattcaaaaactctcttagaatcagaacacctgtaattagtatgtttattccatgaattttctgaacctcctagtccatgtgttgtacatttttgcagtgctgttttctttcttttcttttttttgagatataagagtgaaaagagattttttaaatgaacctgcatttcagcattgtgttaagtgcttttcttttcccatcctctatctttatcttaattattttaaagtcctcttgttttatctcttcaatattttgcaaatattgcttttatgtaaatttatagagtttgaggaataattaaaactagtatttctatagttctctacactattattttatgctttcaaaaatgactgtacacattttcaggggccaaaaccaggctatagttcatgacataagctgtgcttgagacttgtagctggtggtgtgctggagatggctcatcccggctcctgtgtgcatctctttccaactccacattcatctcttcccaataccatgttggtatcttgacatgggcataaaactggccatggtggaggtatttacacaatgtaaatgggcaaatgccacacattagagacatttcttttcttctggagagtctgttcttaaatatttttatccacccacacactgtctgtagacgaaatttccacagctatcactttcttcccttgacaccacacctcaccactgcctagtttgtctctaccaacaacaaactttatgtttttgttagcactgtgacaacctgtgcaaggaatgtcaagccagagcatcaggtatcatggaagaggcaagccccaagagaggaagaaaagtgatactatttttcctagtacctgccaaagttacttctgaagccttaaaaaaaaagtccaaaaaactcagtgcccctagaagtaggtaagctgcacaattacttacatagtacataagtactgatccacccacagataacaatatgttgagacaaacatatagccatgcttatggaaggtgaagtttgattttagtggaatgacatataatttacttaagtgttttagttgtgtagtgggtgtccatatatgatctctgattccactgcaaagtctgaatgcatgtgctcaaattagctcaaattctaaatctgtggtaccaggattctttttgaaggactatgtttttactacttatattttgacatttcttcacagttcaggcgatcattaccaaatattcgaggtgggagtactggccaatcccaaaaatgttctagcaacagccaagtcagaaaacaaatattttaacccacacacattgtattcattatagtctgaaaaaaataggactcttgataccagtcatgtatataataattaaacaatctaaaacccctctggcacttataaaaactgtgcagcttctttgttttggcaatatgattttctgtccttagcagagacatattagagggcaaagctttgtgtgtgaggcagatatcaaagaagaacattgtttgtttgattatgttttgttttgtctttttcagaatgcatttggtttgtttttaatttttctttcttaaaggaatactgtccaagccaaattccactatgtcaaagctcagtgttgatagctggcatccatgtagaccataaagaatgagtgatattcatcttgtggggccagccttcccctgaaaatactacccttcatcccacctctgccatttttcttagtctatttccttctagtatgtttctccctgacttaaatatctcttccatcctgatgaacttcttcttcctatctgttgaagtcctcctcgactagactagtgacagatcttttctcttccttactactttgccacttagagtcttccttgtcatttgggctaattgcaggtctcattatctcaaaaggcaattagttcctcaaagatagagagctaacaatttattttttgtattccctgtaaaaatccatgcacaatgttagatactgagtaggtatacagtcaataactctgcttcattttatgcagatttgaaaaacattaaatacatattccttggccatcatccaaactataaaaagaggagtggcttatctgacatcatgtctatttttcaatgcagactttagctaatctgagaaactgcatatttcatgctctatacttctcctacttactgctagatgtcttgtctatctctttgaaagagccacgtacttctgtttaatttaggcatatgaagttaatccctgcaaatactggctagaataagttgtacactatgtattcagatagtgcaggtacaatatgtacattctcaaagcatcaaaaagaataagagcaatccttatttttttgaggaaaaatttttatactccattaaaacttaaagagataccatgtgaaattcaagttgaattttcttatgctaattatggtactgatttaatttcaaattaaacaactgcaagctctctatctacatatggttactagggtaacctcatttatctaatacacatagctttaagactgattattgcccaggggcagtggctctgtaatcctagcactttgggaggccgaagcaggcagattacttgaggtaaggagttcgagaccagcctggccaacatggcaaaatcccatctctactaaaaatacaaaaattagtcagaaattgcttgaacctggcaggtggcggttgcagtgagctgagatcgtgccactgtactccagcctgggtgacagagtgagactccatctcaaaaaaaaaattgtatttaaaggcagtatgagagcatggtgaaaggagaaatgtgtgaggatctgggatgacttaggaggatctgggatgaaaaaaagattgattattgcttttttgtactttaatcatatatgagtacactgaaagtggtctcattatttaaaatatcttgtagaaaataatttctaaacatgtattttgcaagataaatagtaagctcctaacatatatttactaaatttagaaattttcggatgatatttcttaatcacaatgctttttccccttgtactcactagagagctggccttagtccagaagtatttttagtccagtctcataattctcttttccagcatgggcaaatataatttctaacataatttgttaaaaagtctctactgattctattttaactttgtatctttcattcattgtgcatgatccactttcgttggcacagaactggaaagtatagagtagggaggtaagggtaggctacagtaactcttaccaagaagaggaaagctaactcactgttgctcacagattctatgactgctcttccttcctctttctctcattcaatttattttacttccaattaagttaaaatacaactttgaaagataagatatgatatatcagattatgaaagcagcttagactagtgaagactttggcatgtatagaaaggatgactgtattctgaaagattattgataaattataaacgatattacattcaaaataaataaatacattttattctctaggtcctaaggcactttatacattcaattttggcagaatggaactgtgtcatgataaatatagcattattggattctctaaatatcaacaatactttgaggtctttaaagagtttgtgtcttaaatcactcaaaatagattcaggatctatatgaaccatttatggaaatataacctgtttgaagaaacaagttcactctctcccaatcctgacgattcttgccctggagtaggcctccatcagctcctgcttagatcagtactacaatctcttcactggtcttgcctcttgccaatttatctcccacactgctgctagaagtatttttctaaacttttcagtggcttaccatcctctacagaataaaaattcaaattcggccaggcacagtggctcacacctgtaatcccagcactctgggaggctgaggtgggtggatcacctgaaatcaggggttcaagaccagcctggccaacatagtgaaaccccacttctactaaaaatacaaaaattacctgggtgtggtgatgggcgcctgtaatcccagctacttgggaggccgcaggagaatcactggaacccggaaggcagaggtttcagtgagctgagattgtgccactgcactccagcctaggcgacacagtgagattccgtctcaaaaaaaaaaaaaaaatatccaaactcaactagctgcataagttcttaatggtctagccctgcctatatttcttatttcttttcctggaagttcgctgtgtataagttgcaagcacaccaagttaacccccaaatgccacagtgttttatgcttctgtgcctttctcacacagttccttctgtctgattttctgtttcactactatgctgctacaaagtacttataatgtttatggaatagattctgaggaaaggcaaggcagcttctgtaaggggaaaattgtaagtatttgctaacgctcttataagcacagaaatatcgttttttagactacttcaaactgatttgatgtggctcaacaaacaaggtttttgtttgttttttgtttgtttgctttagagttactatttttatcctaggataaagctgatctttttcattggcggaggtgagacactttttaaaacctggctttgaataagttgtgatttttttttccatccccaaacacctgctgtatggacaataattctattagtttcattggctaactactgtgataagcctcatgaaggatgggttaggcaggggatggattttctaaacgagggtgtagggagggtaggtaatcagaatctccacagagtatgtgtagatttaaaaagcggtgattctgacactttatttcccgaaggatattttttgcccaacaatttctgcccccacctctagtctatcatgttgagaatcactggttcttaaaagagaaacagaaaaggaattagtttgaattaatattttaaataaaaatgtgttaacagtgagattcctctaaaatgatccaacttagttgacatttttataaatgatctaaaagtatgtacgtgtagtgaaaattctaagtttgtaggttgggctaacatctctaaattcatgaactaagctaatgatgataaaatgctggaagacagaacatttatatataggtaggcaaaaaactggcagatgacttttaatgtattgaattttgtaataaaatttaaattatacaagataaaagtcactgaataatgattttcttgcaaaaatgacaccaataaatcatttcagatgttcccataaaaatgttatcttaatgtgcagtggtcccaaatgaccaataaagtaatggacactatcaggaagaatgtaagacacaaaacagaacacatagtatctccgtgtaaacagtgtggtgcatctacatctggaagacagatgccattctccttgcttagcgttaataaaaactatacagtacaatggaagcatcctgcaattagaatgaataaatgaataacgtaagacatacatgacatacctaaaaaacattttggctatcatctagaataataaatgtttattaaggtgataataaacaccttaactagtttctaattaagaaactataatgttataaatgtctagttaagaaactataatggactgtattcaatgtatataaaatcataatatggataagaacagaggcttggataactcatgaaatattagaagtagaatgtccttcttaattttatttttattttattttttgagatggagtctcgcactgttgctcaggctagagtgcagtaacacgatctcaactcactgcaacctctgcctcctaggttaaagcgattctcctgcctcagcctcccaagtaggtgggattacaggcacctgccaccatgtctggcttttctttttcttttttttttttttggtagagatgggtttcaccatgttggccaggctgctcgaactcctgagctcaagtgatctgcccacctcggcctcccaaagtgctgggattacaggcgtgagccaccatgcccggcctacttcttaaagtgttaatgtgttaggagcaagatagataaatagatatgctatcttacagagtacatagaaaacatatgtaagttgttacccataatatgagtgttgcatgttgaaaatataaatagattcaagagagatttagccaaaaccaaaaaagagagacctataattgattgaaaaaccagagatatttggggttctctcaacttttttgagttggcatcataaaatacaatctgagataaagtattatttaaattaaccaaggaattttgtgcttatttaattaaactccaaaatgtaatgaaaattagaaggaaatttagcaaatacttttgttattcaatctaaccttagtttttcgacatttagtatgattagaaaacttgttaattctttaatcttggaataataacaatcatatgccaacttataatttgacacactacttaatatggtgtttttgtcatttattgagggtgtgtcaaatacaaatccctgtaccaagtactgggggttagctgaagcataagatagtctcttcaaatagtctacaacctagatttaaaaacaggcaaaatttataaataacaagagaacaatagaggtgggtgctaattaatagtacagcagtatgttcttaaagtaaaatagatgacaacagattaggaaactactaatcactatggagaaactggaatttcaatttgggtactcaggtaggtggaagctgttaaaatactaattatcaagcttcacctcagacctgttggatcagactttctgaggaacgggaactggaaacctgaaaatcttttagagttcatcttgtgattccatgcaatcagtccatgaggcaatatttgggaagtacttgagtagagcattctatgtaattccaggaactggtaggcagagcaggtagagactgacattttgcatgggagaggaagacaattagtaaatctgtttgaagtcaaaggatcttctaagttgtagaagaaaaatgggagaaaattatgtaggctggagtcagattttggagagctttggatagtaaataaaagaggtttttgtttgcttttgtttttaatagagtataccactgaaacttttgaagcagaagagtaacctttataacatatatcttatgaatacataaagggttaaagtcagaagggctggaggcaaaggtctagctaagaaactataataatagttgaggcacaagaaaatgaaggcctggactaatgtgatggcaatggaaacagaagagaacggctggatatacattggtaatatagagaggaaacataattgtttctggtaagagcttgggggtctttaaccctttttaaattttttaattatctttttaagtaaactcagatgtttttatttctgcctctttttcctttcactttcatttctgtgaaaaaatattaactactccacataagaattccttgtttagactgctagcaaagagcatatgctttaaaagtgctaagaaagccaatgaccaaaatgactttaaatcgtgctttaatttttccatgctgatgaccagcatgatttgaaaccaaaatgtttagaattatcttatgcctgggtagcagaacatttagacacaagttaaagagggagggaagaaagattacattatatatctactggatggtaagtttcacggagtatattagtatttaaaataaagggagaaagtggatgtgtagtttatcatctaagctgctgtctctgaattagataaagtgtagcataacatgctttgtgactcctagaggtagctatgaacaaaacgttaatgaaagtttctataacttctttttctgaccattttcccccttcaatttcactcttagtgcccttgtgatcactttcttctagccccatcaaattctgctctcagagaaggtatagtcacttatacacagtataaatttatgcataggtgttaactcctccctggtacatttgtattttgaaacttacctctcatcctatgtaatgaaaatctggtttcctgctgaagatattttagactttaggaaaatccagaaaatggaagagattttctagatggtgggaagagattgcttcaactatttccatttcatataaaaatctgatactttctcacatgttctgggactataatatccacacctattctgataattttggagccatttttaaaaaaacacagtgttgtatttagcagatgtaaatagtctacattgtcagacaaataattctttctgtataaaagtttagaatctttagtgattagagagtaaacaaagagtatttcctcctgtctgattcagggaatatatcttctctggcccaaaggagaaaggtgggtcccttgcattcctgagaggccataaatgataaggaaaacgatcagtaaattggtatagaaatataagtctgtgcaatacagttcaatgatgttcccatgacattcttcagtaatatgctactggataaatatcacactgtatattgcacaaccgaatagtttgcttcaaattctgatatagttctaacgctgctgaaacaagctgctgcaacttaaattctttcaaaagaaagtattgctataattgtaccacatgctgatgtactttctaaagattttctaatgttttattttcttaataaatccctgaatgaatgacataattatttttggttaaccagacatgtcatttaaatggtttttgacatcattataaaatatatatgggattaataagaagtatgtttgatttattccctaataatgaggatgatgtggaatcagttctcttgttgcaggacatttcagttatacttgataccagcaattatgcaatcatgtggaactattttgaatttcatgctaatttgaggggaattatactttctgggtttcagtaataatttatctacttgtgtttctttcttgcaggcttcaattagttttctaatttcttttagtgtattccaaggttctgacttaaatctgttatttaacagctacagggcatgctttcttagggtaaagtgatccaacgacaagattagtattatcaaccatatgtatcattgtgtttttttacaatagtggacttcagggttcatgggaaaagagaaaaacctggaagcaggttctgtatccagcctgctggaggtcactacctccacagagtcctttgtgttgccccttcaaagtgaaagtcaataaagaaatgtggagaaagtgaactcaattctttcctaactcaaacattgaatcattccctccaggcagcaaagccaacatgtgcacagcatatccagttaatggtcctatcccaatactagcactgacaaaagaggtttgtcttccgtgttaagcagtcactctgcttaactgatggaacaagtttatttcaacttcagtgctcataatttgggctttttctatttcactgtcacttttgaaaaagtcaattttgaataacatgcatacattactaaaggtcatttgcttatgtttcaggttgacaccttaaaaaaatacagctacatgttttatgtatatgtatatatcttacatgattttgacttggttcatgatggaggtaacttatacaagttgtttacaagaaaataaatgactcataaaacatctgtaaaataaatgtaagactgaatgaaataaatgtaaaatggtacttgagtcatttattttcttataagacatttgtctataacagttgatataaaattatattactctgttttcaaacatattttcttttagagaaacatttcttggttagagataattataccacttatcgaatactgtctatacagaaaactgctgtttattccagggatactcttaaaattaaattaaatttaattctatttctacttgaaggatatggagcattacaattatatttaattttaatacattatatgtgatttataagcactatctttacttcattctgaaatctcagaccaacaaatcacttggcttttcatggcacaatttttactccctttcttagagtcagaacaagaaaaatttatttctgtagtcaaggccaaaacagtggcttatgaattaaattattaggtgttgcttcaataaagtattgaattgaaataattcaataaagtatttacttaaattccttgattttactataaggcagacaaaaagtagccaaggaacttcatttgcaagaactaattagcagttgtcagagaatgaaataatcttcattatcaagacactggttacaactaagttatgcctttaaaagtgattgataatagcagtaatgagattgagaagctactggctgaaacatattgtcattatctttcaattttttacgactctaagaagtcataatgataagcaaactcaaaatgagaaatggtgataaagagaatggagaaaatgtaaatccacatcaaaccaaagaattctcaccttcacagtacaattaagagtttaatgattccatcttttcattagaggatggcattaaatagaaatggtagctatgctttaacatatttcttaattctctggtaaaatttaagccctgcatacaaccataatcaaaatgggacattctaatgttgctccatcttttgaagaccacggtattatgatcaaagcgtggaaaatgatggaattctaaaatgttactgtagattgtaaattaaagaggaagacagggatagaaaaaccacatgtgagaatactttaagtggcaccttataattctttaacactgggaacactgagtacatattaaatatttttaaaattaaaacactatcattatcactatattttaaaaagtcagatatgaaattttttggtgctgagcaaatttcttttttattaccaataagcaattctgttgatcctacatatctagtacagctacaatttcactgtggatctagatcacaaagtgattttcttatgccaaatttaggacaagtatatacaaaaccactatcacttcaaacttaatatcttcataaaaactccaacacattatcactcccacctagtaaaaatagcatccccttaacttttatgataccttaattctcaaaatgacctgtgtttgaaatgatatttgacttctctaacttcttttgctttagcctcaacatccattgggcctggaagttgaaaaaatgggcatagcaagaggaatgtgtaaatgtgatagaaataatttggatcattgctgttaagtataaatgagtatttgtgatctatcatatttgctgaagtttgacattaaggtggtacattccagtattatgtatcactttctagaagatcaatgaagtagaaatgcagtgacaagggtgtcatctagaaagaatgaaaagaaatacatccaagaactcaaacagcttgctgggagaaattccaggatgtaaggacaccaagggaactactgcagcccacctggaacatatttgttgtgtttgttccacatcttgtgcctgagatggttaccaattcatgtataatataaactgtttttcttgagtagatgtgaaagtgaaaagtcttgttgatactcttttctatgctacagcttattagaaaagataagtacttttaaagggagtagaaaaactaattcagaaaggaagccaagaagaaaaattctaaagaggctagggaatccaaaccatcattaagaatatggcaaatgtgaggccggatacagtgactcgtgcctgtaatcccagcactttgggaggccgaggtgggtggatcacctaggtcaggagttcgagactagcctggctaacatggcaaaacccctcctctactaaaaatacaaaaattagctggtgtggtggcacaacctgtaattacagctactcaggaggctgaaggaggagaattgcttgaacctgagaggcggaggttgtagtgcacctagatggcgccactgcactatagcctgagctacagagtgagactctatctcaaaataataataataataataataataataataataataataataataatatggcaaatgtaatgaatttatatacagaagaaagatgacagatatgtagagtactgaacatagttaagtaatcaatgacttgttttattcaaaaatggaaagttatgattttctaatcaagaatggcgaatctggtctttttgagagtgacaacagcatctcatgctttatgtaacaataatgagcatccagaaaagctagctgacattaggtaatttcttggctaggaagcagctgaacacaggtttgacagtttgctgagtggggagctgtggtcttcctgacacgtgtatcaagatctaaagggcagccagaaaagacgtatcaagctaactaaatgctgacacatgcaggaataaatgacagcaccggaagaaacttggaatccctcgtgacagtgaagttctggataagaaagtgaaagacatgacagcacaggtgttgttttcattttttcttctagttttatctcatgactttagaagtgaaaaaaaaaaaaaagctgtgaaagtaaacacctggccattaacaacagtgttgaaaataagacttgtctttctggctgttagcttagaataactgaaaaaataggctcctggagttttatgtacattttatgaagaacgcatttgaagtaaagtgaaattggggtgcattagttaagattcagtttggcttaaaaaattgtttatttctccatgcaataaacatctggaggagtgacaactctgctccacaaaaacatctggaagtttccaagtccatttagctcaccgttccataatctctttgttctcataacccaaggtagaatccaaattccagcaggaaggtggaataaagtgattaaaagtgagcataaagggcttctgctgggtaccttttatggaagacttttggaagttgccataggacacttcagttaaatcgcatcagctaaaacttggtcacatggccacattaagctgcaaaaaagactgggaaatggaaagtttattttgtgcagtcagctaaaaattctattgctatggaaaaaggagagaataaaagttgggaacaattaaaagtctttgctcagaaagttggggagaaaaatgcgtacatatgattgaaggaatgaacatcacaatgaatgacattatactgtcataagcttgaagacttaaggggcaaagatatgacaagaagagaatagaaagcttattatgcctcataagaaaagggctagaatcaaaacgtgtaacttcaaatgggtagaaaaaaagcacagatgtaatgataaatagtagatggaaaagttacatgacattacagatgaagacatttcccaaatttgctaatgacaaataagagaaaggagtatctaattttttgggtaccatacattttaatatactcatgtatcagttatttgtgatttattccatgccaaattataaacagaattaaagtggctgaattaaaactcaccatttcttaagcaattgtatgtggaccactcatgtttccaaaggtacttgggggattaatttaactaaaggcatactgtaatcttttttcaactgaatattttttaaaaacatttttgtattttttcaatttagaaaagaatggtttgagtgcctccacaaacatatcaaatatgaatgccaggaatttagaaagatgagacagatttactcacagtttagttaactcatccttttgtcatttaatgaagtcatgatgatgttcactattatataaataagttcattcattgtcatatgctgctaaatttataaccttaacaaaccattggttaacaagagaaagtataaagaacattgagttaaatataagttattagaagcataaaataactccaaaattcgcttttattttttaaattgatgtatatttgacaatttacagttaacttttagataattttcttcagatcactacagtcctagtgccaagaatgggtctggcaataaacactcagtaaatacttgttaaataacttgtatgttacagaaaatattgtgacaatcatattggagttggtctcacgttttggaggggtataatgactctctaccccagcaatattttatttatggagcactatttacaaatagaagaataaaactatttctcttatttcaacatttggaaaccaaagaaattgtaaaaataagtgagctaatttttttaaagcatagaaagaattttaatgattagattccaaaactagattttgtcatctttgatgttataacatttatatttcaacatatatttatttaactcacttttaattctacacatgctgtatgaggtcattttaaaatgtattttttcaaaaatcatgaggtttttaaaaacataattaatgtaaagaaaatgaggaacattcatcatttgttgcaggggaacagttgacatttgcctttatatataatacatatttaaacaaactttataatataaccttgaaaaatatactaacctaaaacaaaatgtatttttgataggcgaactttttattatattcaaactctaaaataatgacaggatttaaaatatttttaaggagatggtgagattgtattactgtaaaatacatttatggtctatatcaaggaaaataatgaacactattctgtcttaggctatctatatcagcccagttcttgctgagatacttatttttagtaaataatgtagctggtaaagagtctggaattcataccgtatgagaaagggccaaagaaactaaggataatgggaagcatgatcaatgtcttcacctctttcaagggctgttatgtggaaatggtattgatttattctgcatagcttcagaggatatattcacgtataattggtaacacaatcagagctacttgtaaatgtaatgaaccacctgaaaactggtaacctacaataaattaatgagattatatagctgacagacaggtaaatcaatgggacaaaacagtcaataaaaggtaaaagagaggcatcagtaaaaaaaggaatagaatgtttaataaataatgttgaaaatactagatagctatttcaaggaataaaatatcagttttcggcaggagcccccaacccctgggctggggaccggtactggtccatggcctgttaggaactaggcggcagagcaggagatgagctgcgggtgagcaagcattccacctcctgtcagattagctgtggcattagaatctcataggagcgtgaaccctattgtgaactgcatatgccagggatctaggttgcgtgctccgtacgaaaatctcactaatgcctgacgatttgaagtggaacagtttcatcctgaacctccccccggctcccgtcccctgactgttggtttagagtatcatctcacaccataccccagaattaattccagatgaatttaagataatttgaatttatatttaaaattcaaactataaaagatagaataaactatatttcagacaatggtatggaaaacatacttttaagcatagatacaatataataaattatcacaaaagatctatagaattggttacacaaaaattgatcagtttgattaattttttcaccctgcactccggtagtgtatgattagtgaaacatgagaattaggaatagaacaaggagtgtgaagtgagccaaacagtgcataaaataaagtgttactgaaagaactcttggatttggcaattaggagtttattcatgagtttgaagagagaacgccaataaagagattagaagttaggatgcaaaagttaaattgaagaaaaatgagcagattctggctacgtgttcaagaaagttggtgctagtgaaaaggaaccagggtagtcctttgaaaagatttcagagttaagggcagggacattttattcatttgacctataggcacagagatgggagcctgtgaaaatttcaaaggcttgcaaatgtatttaaactttaatattaagatagtgacagtaaaatttgaaaataaaatatacagattagcagatatttaacaaataaaatattatgctaactttattatttattaaatttattaattttttcataacatctaaaaacaatttgatattttttttactttgtaacaattcccaagaatgtacacaatttgcagaaaatttacagctggggcgggcacggtggcttatacttgtaatcccaaccctttgggaggctgaggcaggtgaatcacctgaggtcaggagtttgagaccagcctggccaacatggcaaaaccgggtctctactaaaattacaaaaattaggcggtcgtggtggcgcatgcctgtaattgcagctacaagggaggctgaggaacaagaattgcttgatcctgggaggttcaagacccttgacaatttggccctaactctttttccaccctctcactattttgttacacttcctattccagacatacagctctagtttcaatcttctgaacatgacttttgaatctttgcttccatggccttgcacatagtacttttatctctcaattagcatgtttccatcttttctacctatgtcaactctattcatccatcaagatctaattcaagctctatctattcctcaaatcctccgttgaccacttgaccacttctttcttctgaattcctatttattttgctgttttgtttttttgtttttggtttttttttttttgcatttggcatatactgccaggtatcacttattttattttttctgtggaaaaagaaaatactaactgaatttttgtatatatttattaatatccagataggatatcataattaaagtaatcagatcaagtttctaaaatattactggctcttgttttccattcccaaacacctgagagatactgtacacttaacaagtgaaacagtggtctgtatatccagtatttgtatcctacaatttccaaagtgtgtttttattatgaccttactcctctttactgtccatatttcacaaaaagaagttatccattgggtaagaagatcttaatccattaccaaagacatttttaatagtaattaataaatcacatatgttctatatattttggacataaataaataatgtaaaatgtcggtacaaatagtttctctacactcaatgatattatattattaaagtcagctgcatttaaaaattagtagactttgtattttagaacacttttagatttacaaaaaaaattgagcagataggccaggcgtggtggctcacgcctgtaatcccagcactttgggaggctgaggtgggcagatcacaaggtcaggagattgagaccatcctggctaacacggtgaaacctcgtctctactaaaaatacaaaaaaattagccgggcgtggtggcgggtgcctgtagtcccagctactcgggaggctgaggcagggaaatggtgcaaacctgggaggcggagcttgcagtgagcggagatcccgccactgcactccagcctgggcgacaaagcgagactctgtctcgaaaaaaaaaaaaaaattgagcagataatagagttcccataaacaatctccatttccccccacagttcctccattataaatatcttgcactaatgtggcacatttattacaacagatgagccaatatttatttatgccatcagtttatactaaggtccacgttttgctttgtatagttctatgagttctgacaaatgtatatcatgtatccactattacagtattacgcagaatagtttcactgatttaaaaatcccctgtgattcagcttttcatcctttttctgctctcctcaaggcccttgccaccactgatactactgtctctaaagttttgcctttgccagaatgtcatatggctggaatcatacagtatgtggctttttcagactggtttctttcacttagcaatatgtacttaaggttccccttgtctttttgtggcttcacagctcaatacctttttattgctaaataatattccagtgtatacgtgtaccatagtttgtttatccatttacctattggatatgtgggttgcgtctggtttttgatgatacgaataaagcttctataaatagtcatgttcaggtttttgtgtggacatagttttcaattcaattgggcaaaaacctgggggcatgactgctggattatatagtaagagtatgtttagtttttaagaaactgccaaactgtcttcccatgtgactgcaccattttgcattcccactagtaatgaaagagttttggttgctttgcatccttgccagcatacagcactgttagttttttggagtttagtcacgctaatagttgtacagaggtatctcattgttgttttaatttgcaattcctttttaaataatttcaacttttattttagattcagggggtacatgtgcaggtctgttacctgggtatattgtgtgatactgaggtttgaggtatgattgctcccatcacccaggtactgagcgtagtacctaatggtttttcaacccttccctcatctactccccgccagtagtccccagtgtcagttgttgccatctttatgtccctaagtacccagtgtttagctcccacttataagggaaaacatgcagtatttagttttctgttcatgtgttaatttgcttaggataatggcctccggctgcatccatgttgcaattctttaatgatctatgatattgagcatcttttcatatgcttatttgccctttgtgtatctttagtgaggtgtccagattttgcccactttttaactaggttttttttttcttattgttgtgttttcagtgttttttgtatatgttggatatattgatatattttttgcatatatgtatatgtcggtgtattttagtgatgtaaaatgaatggaatctatagccttaaacataataaaaatatataatagttaagatttcccactcaacaatccaggcttgacagaaaatcataaaatgtatttaaatttaaatgtttttttctttgttgatactagttcttagttttaacatgccaaagagggtatatttgatcaaggacaagattaaatgttctgattggctaaccatcaaaccactgcctccactttttttccaacttgaaaataatatttagttatcatgctagcacagccatattaatatataccccttcaaaactttaaatataaagctttaaatgtttcaggaaaaagaaatattaatgatgctgagattggtgggcatggattctgtgtagtgagacactaaaaagtaatttttcaaataggaaagttaaagcactttaaaatcacaaagctattggtaattaaaaaaagaattagtatcaatttctgaaatacaagattagagggacacctaaaattatgaaagattttagagaatttttttaaaaagtaattgcaatttagatcaaagtttcccatttttcattccaagtgtgatacaggtttaaataataaacagacaaaaaggtttagataaattcatgaattattgaaccagaggataaaaaatagggaagctatttagggcatagtctctagtgtgtaagggtgacatcctaaataataaatttgtgctattattgacaatattgctgacaaggctaaatggtcaatgtgcttgacatattgcctggtttttcatgttctattgcatgagctgattctctctctcttttatttatatttttgaactctaccattatgctatcatggacattatgtcaacaatttgatgcatctatgtaatatgctttaaatctttggaaataaatttactgggtactacttaatgtgaacaaacttctcttaagcacaaatggaaatccacaaagaaagacagcctcttctatttgttttatgtgaggcaacggatacactgtagacaaaaagaccaagtataattaacttatattggtaactaacttaatatctgcatattacatatttttctattatgttttctgagcaacttcgtggcttctgatttggagggtaggatttcatagttaatacctctgtttttttttttttttttttttttttttttgtgaaatggagtctagctcttgttgtccaggctggagtgcaatggtgaaatctcggctcactgcaacctccgcctcccaggttcaaatgattctcctgactcagactaccgagtaactgggattacagacacccaccatcatgcctggctaatttttgtatttttagtagagatggggtttcaccatatttgccaggctggtcttgaactcctgacctcaggtgatccacccgcgttggcctcccaaagtgctgggattacaggcgtgagccactgcgctccgcccatagttaacacttctataaatatttgtgcatattgaaaggaacatcactccccacactgcaagtgaacaaaagagtgataatgttaatttctttattcttgagcttttcttgaataaaagagggttgtaggacatggaacaaaatagactagaaaatagggttgataagctactgattctgccaacactgcttaatgctcttcccaagcaattgtcttttagatatgttgatttcccagtgttaatggtattttttaaatatgtcaagcaattaagaatataagtctattctcatctcagttaaacgtagaatctttacaaagaatttttggtatccttaaccctaatatgtggagggataagattaaaaatgttcatcaccttatttttatttatttatttatctattattttgagacagagcctcactccacccacactggagtgctgtggtgtgacctcggctcattgcaacctctgcctcccaagttcaagtgattcccctgcctcagcctctcaagtagctagaattataggaatgcaccaccatgcccaactaattttttttttttttttttttttggtgagacggagtctcactctgttgcctaggctagagggcagtggcgccattttggctcactgcagcctccgccttctgggttcatgcaattctcctgcttcagcctcctgagtagctgggattacaggcacccgccaccacacccggataattttttgtatttttagtagaaacggggtttcgccatgttggccaggttagtattgaattcctgacctcaagtgttccgcctgactcggcctcccaaagtgctgggattacaggtgtgagctaccacatccagccatcccctttgtaaagtgcagtaaagaaacagtgggcaatagacaggcaggggatagaggaaaatgttttgggagaggggcaatatgaacttattgtcatgactggaccaaaaagggaagatgtctgcctatcataattaataataactctatcagtcaacatttatgttttacaattgttctgtaaaagaaaagccagcaaacattacagattccagtccctaataactgatcatgaaagacactctaaacttgtgcatcagcattctctttttatctaaaagaaaatatattaaataaagggaggaatggcaggagtaaagagacttgaaggaaaagaaaatattgacttcttaatgatattttacaatgctaagatctttagaaaccaactattccatatgtcttttaaatattaggttggtgcaaaggtaattacagtttttgtcataaaagtaatggcaaaagccacaattacttttgcaccaacctaactgatacatttattccattttggaggtattgcaaatatgttgaatcaatgaatttcttcagtatttttcattttattagtacaaatttaacctaatagtattcttctgcatgttatttccctttgtgcttcctttactgcaatgaagttgtagttaccaaatagagtgctctaaaagggcaaggcttgtctgtgaattaagcctagcatagaattggctctcagtgaagatgtgttgaacgttacatgaatgcatcaacatcataatccttcatgtgcttgtaagcaattattaaaattttctctagcctattcaggcctgtgttcttcaaaattctgcaaaatatatggacgtgtttgctgtttctattaggttttaacttctggtgtcagaaaccagggctgtttttcttaatttgtgtcctaaaaccacagtagggttgtatgcattgtgataatgcttaataaatatataaaagattaatatccattcatttgcattttcttaataaaacccaatttctagatgagtagctgtgaaactctcaactggacgagctctgactagtgttaagtatagtatattgggaaaagggcttctatatgcaacatatatgtgaggcaaatgacaaatattagctgggctacattaaatcccaatgacatgaatagaaattttattatccaggtagcaaaaatgaagtaaaaaaaataaataagagaatgaagtgaaggtatggggcaaaacaattagttttttctttaagtcaatattttagaaaatagtttttgaaggcccaatcacacagataattgacactttgacttttctttgcactgtgttagacataggtaaaagaatgtctcaggactgtaccttcatgtagaaaatgtaattaatagcaaattgcataaaagtacattaaaattttaattattacatcattttaataaatatcttgagattttactttatttagtgtgtcattaaaacacaggatttaaggaagatatatataataaaggaaaatagtaagttaccattcttgtgtaaacacattttgtaaatactatttcaacaaagatttaaaagttaattacaaaggtataaagttatgaagtattatataaacaggattcataattttgttttaaatggtcttttaatgtatcaaaatactatcagtttaaaacaatcttttttttaaggcagtaggctctgtttaccatcatttacacttgctttaattagaattttcttcactttcagtatattcaagagctattctgttggcaataatttttaagataaagtttatccaaatagaaaagtaattatataatgattaagagccagaatgtctgggttcaaattccagttctgctacttatcaggtataagaatttgggcaaatttcttagtttctctgtgcttcagtttcctgatctgtaaaactgggataacaagactacctgtctcaatctgtggttatgagtaaatgagttaatacataagagcaatgcaataatccttggcatgtggtatgagttcaataaacattagctattattattatagtaaattagaaatttaattctagagaataaaaagctgaactcaaatatgtaactatttatttgatacagacacattttctacaaaataaaaaaccatcggtttgcacttcccttatataatgactatcttggtgtttgtgtgtatctgttgtgggtcaggggtcttgggctgagtaaataatcacattaaaaattttaaaaacttccgattaaaacagaaataagaacaaatggccattcgtggatcatttgcaaaactgaacgaatatttgacatgtctttctgtgattccttgcagatatcatggaaatcaggacagtggcagttggaattgtggcaatcaaaggggtggaaagtgaattctatcttgcaatgaacaaggaaggaaaactctatgcaaaggtattgataattgatagcttaggcttaatttttaaaactcatttttgtcaaaatatctcacctttctgaaaagtaaaaatggaattaatttatctccaactgtataatttaatgattttattaaaacactttatactcaaacgttaagaaaaaatgttttctgtgtgactttggacaaatggcttgttctttggattttggtttcttcatctgtaaaatgagttgaattaactgacctctaaggatccttccagctctaaaattccatgtgcattttagatatttaaaatccaaaatttccatttgccagtattaaagctctttttgttaaagttcacccaatttgcacattgctgacatgaaaattcttgggaaaaaatcttgaaatgtttagttcattcatcaacatcaatctcacaatcatgggcattgaaatgtaattattcacattgtccccacttcactacaatgcaaaatatgtaacagttcatcccaccataataaaatataattggctttcctttgtattcccacagctaggcataatgatacaggtttaattgaatgaacaaatggttgcatggatgaacaaacaaattaaccttttatcttccattaccattgaagacaatgtagaagtaaataaagttgtgaaacaagtctctcacctgagggaggcagaggttctgctaattataccaaatttccagtggttaaagaatgagtgatgtgggaataagtaatatgaggcctgttacttagggggaaataggtcctaatttaaagaatagttgacatgaacttccaaaaagctacacatatttcataactagctgtgtattatgtggtgtttttatttcaaatttaagatacctttttatgcaaatatactacataagtatagctaataaaccacattaggcctgctcaatctgagggttaaaaaaagttgtgtatgtttcaattctaccaaatattacctgcttactcttcgtttaattgagcctctctaaaaatcatttggataatgtctgtttgtttgtttgttttaacagaaagaatgcaatgaagattgtaacttcaaagaactaattctggaaaaccattacaacacatatgcatcagctaaatggacacacaacggaggggaaatgtttgttgccttaaatcaaaaggggattcctgtaagaggaaaaaaaacgaagaaagaacaaaaaacagcccactttcttcctatggcaataacttaattgcatatggtatataaagaaccagttccagcagggagatttctttaagtggactgttttctttcttctcaaaattttctttccttttattttttagtaatcaagaaaggctggaaaactactgaaaaactgatcaagctggacttgtgcatttatgtttgttttaagacactgcattaaagaaagatttgaaaagtatacacaaaaatcagatttagtaactaaaggttgtaaaaaattgtaaaactggttgtacaatcatgatgttagtaacagtaatttttttcttaaattaatttacccttaagagtatgttagatttgattatctgataatgattatttaaatattcctatctgcttataaaatggctgctataataataataatacagatgttgttatataaggtatatcagacctacaggcttctggcaggatttgtcagataatcaagccacactaactatggaaaatgagcagcattttaaatgctttctagtgaaaaattataatctacttaaactctaatcagaaaaaaaattctcaaaaaaactattatgaaagtcaataaaatagataatttaacaaaagtacaggattagaacatgcttatacctataaataagaacaaaatttctaatgctgctcaagtggaaagggtattgctaaaaggatgtttccaaaaatcttgtatataagatagcaacagtgattgatgataatactgtacttcatcttacttgccacaaaataacattttataaatcctcaaagtaaaattgagaaatctttaagtttttttcaagtaacataatctatctttgtataattcatatttgggaatatggcttttaataatgttcttcccacaaataatcatgcttttttcctatggttacagcattaaactctattttaagttgtttttgaactttattgttttgttatttaagtttatgttatttataaaaaaaaaaccttaataagctgtatctgtttcatatgcttttaattttaaaggaataacaaaactgtctggctcaacggcaagtttccctcccttttctgactgacactaagtctagcacacagcacttgggccagcaaatcctggaaggcagacaaaaataagagcctgaagcaatgcttacaatagatgtctcacacagaacaatacaaatatgtaaaaaatctttcaccacatattcttgccaattaattggatcatataagtaaaatcattacaaatataagtatttacaggattttaaagttagaatatatttgaatgcatgggtagaaaatatcatattttaaaactatgtatatttaaatttagtaattttctaatctctagaaatctctgctgttcaaaaggtggcagcactgaaagttgttttcctgttagatggcaagagcacaatgcccaaaatagaagatgcagttaagaataaggggccctgaatgtcatgaaggcttgaggtcagcctacagataacaggattattacaaggatgaatttccacttcaaaagtctttcattggcagatcttggtagcactttatatgttcaccaatgggaggtcaatatttatctaatttaaaaggtatgctaaccactgtggttttaatttcaaaatatttgtcattcaagtccctttacataaatagtatttggtaatacatttatagatgagagttatatgaaaaggctaggtcaacaaaaacaatagattcatttaattttcctgtggttgacctatacgaccaggatgtagaaaactagaaagaactgcccttcctcagatatactcttgggagagagcatgaatggtattctgaactatcacctgattcaaggactttgctagctaggttttgaggtcaggcttcagtaactgtagtcttgtgagcatattgagggcagaggaggacttagtttttcatatgtgtttccttagtgcctagcagactatctgttcataatcagttttcagtgtgaattcactgaatgtttatagacaaaagaaaatacacactaaaactaatcttcattttaaaagggtaaaacatgactatacagaaatttaaatagaaatagtgtatatacatataaaatacaagctatgttaggaccaaatgctctttgtctatggagttatacttccatcaaattacatagcaatgctgaattaggcaaaaccaacatttagtggtaaatccattcctggtagtataagtcacctaaaaaagacttctagaaatatgtactttaattatttgtttttctcctatttttaaatttattatgcaaattttagaaaataaaatttgctctagttacacacctttagaattctagaatattaaaactgtaaggggcctccatccctcttactcatttgtagtctaggaaattgagattttgatacacctaaggtcacgcagctgggtagatatacagctgtcacaagagtctagatcagttagcacatgctttctactcttcgattattagtattattagctaatggtctttggcatgtttttgttttttatttctgttgagatatagcctttacatttgtacacaaatgtgactatgtcttggcaatgcacttcatacacaatgactaatctatactgtgatgatttgactcaaaaggagaaaagaaattatgtagttttcaattctgattcctattcaccttttgtttatgaatggaaagctttgtgcaaaatatacatataagcagagtaagccttttaaaaatgttctttgaaagataaaattaaatacatgagtttctaacaattaga

SEQ ID NO: 36803 - DNA, 12567 bp, Homo sapiens
tgtgtgtgtgtgtgtgtgagcgcgcgcgcgcgcgcgcgtgtgtactcgtgcgtgtgcctgtgtgtgcctgggagtgacctcacagctgccggaacataaagactcacaggtccgcctcccaggctcaaagctggctctgcaggggacatgagaggcacaccgaagacccacctcctggccttctccctcctctgcctcctctcaaaggtaaggaggcccgggccctggaatgcactgctgactatttgggtgtggagggggtggggatgtaaaatcgcagccaaggacccccttggcagaattcctccagggccccacattgggcacagtctggcccccatgcctaagcagggcttctctccctggaactcagagctgcctccggccagccctgctgtgtgacctcagatatgtgtcttgccttctctgggcctcagcatcttcccaggtgaagggtatacagtttgtgaggcctctgtgaagaccattcatgatcattcatcaaacttaccaggcaaattgaagaggactttaatgtatcctcattatgaatgggggcactcaagacatgacatgcttggcctaactctgagccagcatttggatggatgcctagctgattggaaggttcattctgcaagggcatcaatgctgttggactcttaggcagtgagtgacccgcccgccctagctagaggggaacaggagacacctctgtggagtaatggccttatccctgaatgctgcatgggacattcaccaaagagcctgtgggacatctaccttgtctaacatgcacaacaatcccataaggaattttcagttaagtgaggctcagaaagggtaagcaacttgcaaccccagttttcagtcaagtgaggctcagaaagggtaagcaacttgcccaaagccacacagcaaagaaaggtcagagcaatagaggagagccatggtggagcccagaatgacatggatgtagggggagaagcactccagtctgtgcctccccaagcccaaactggaccaaggccacagctgctaagccttgtcatcccctcggcaaatgctgagttcccagagccatggaatcggccccaccacaagccacgatctcactgtattttcacgctcctttgaggagcacgggcaggagcttctctccctcaggctccaagtcttcgtgcctgggaagcctgagaaccacgctggcatcctgtcctgctgtttgttcttccaaaggggatgggtagggcatgatgccagtgtgggtggcttgggtagttggaataggggacttggggctctaggagggagaaggggcccaggattatacgagaacaaagtaaagctgtcctagacttgccattagggtgagacttacgggaccattcttccctggtcccaggaagcagggactgcacagaaacacagggacttagtcaccacaacatggaaagccacagcaaccctcagagggagaactgtaagtcttccaggctggccgttggctccggggctcctggctgtggaccggggcaggaggcagacacctggacacaagcaaaatcacattgatcaaggactggccagaacctcatttaatctccatcatcactcagaaacaggttgtctctactccagtttacagaggagaaaactgagcttcacctccaccttccaaagccgtttgtccacatgttcagtcacgtagcaagtcactggcagaacttgaatctcaactcttgcccaaaaaactccatgcccagtactcctgccccagatatcatgagccttgccccccaccaccagatatcacagcaaggccctggggaaactgaggcacaatgggacaacttgagtttgggccttggatgtcaacttgaacttggatgtcaatcctgattctgtctcttactggctgtgttactacacggtttgagctccagttttctcatctttaaaatgggcataatgatggcacctcacattggaggggtaaatgagacaacagcacttggcacatgacatacatatggtatcacatgagataattgtacactagaatagttgatatcattaatagcctctcctgggtatcggggcctacagagtcctgccccctgacaagcatggccagtagaggggtccacagtgggagccaaggtgcacagctgctggtctatttcctggcactcctgttttcaggtgggagggacctgagagtcatttctgacagtcctccctccattgcccacaagccaagggagctgaacctctgacttagaagggaacccaaaagcctagaccgtttctatgtgaatcacctgtggatttatgaaaatgcagattcgggctgggcgtggtggctcatgcctgtaatcccagcactttgggaggccgaggtgggtggatcatgaggtcaggagtttgagaccagcctggccagcatggtgaaaccccgtctctactaaaaatacaaaaaattagctgggcatggtggcatgcacctgtaatcctagctacttgggaggctgaggcctcccaagaattgcttgaacctgggaggcgaaggttgcagtgagtcgagatcgtgccactgcactccagcctaggtgacagagcaagactccatctcaaaaaagaaaaaaaaaaaaaagaaagaaaaagaaaagaaaatgcagattcggatttattatataaaaattcagcttcggatttatagaggggctccagatgctgcctctctgacaagctcctagatgacgctgctgctgctagttcagaccacaccttgaggggcgaggctaggccatcgtctctagaatctgaacagcctgcagcgatgggatccactcccttgtgaggcagccagacacctagctccgtgtgtccatctgctactcagtgctgtctcagtgggggctgtgatcgcctcctactttgtggcccccaccagaggctggtcagccagtttgcaatggctcctagtggccggcgtgggagttgccgggaactgaaagcaggtttgcaggattgtgggtagtgggggcactgggcggggcagagggtgaggcagagcaaaggggtcattgcctgctttggggctgcacaggagatatgaggtcattaattccatcattataaactgcaagcctccattcctctagatgaaaccctcatcccctaaggatcctactaaactcaaacttggccccccaaagatggggccactggaagcatcttgaattatacttccttcttggtccccaccttcaaatgggcagacagggagctcacggcacctgctgtatgctttggttgtttctctgatgtgggtggcgagggtcaggcaggccacatgggctgataccctgatcctgtctctggggagtgggtccctggcttacggacacagtctacccccatcccgtgtccctgagtcctcacttgggaagcaggaccggggacgctcccagccctgaatcgaacacactgacgtgtgctaagttcctgtccctctctggagctcagtttccccatccgtacctggcagggggaggaggttagactggggcagaggtgctgaaaacctagctgagcttcagaagccactggacagcttattaaaaataaagattccaggtccctgactctgggacttctgattttgtaagccccagagtgggttgggggtctgtattttcccaagtctcctggctgatgtgatgtacctccagagctgggacacatgctgaatggatcgaaaggccaaaaacatccatgatatggttcaatttattcagtcctaagataagtatccgtatgctggaaaatgtaccagaccctaccattttcatccttgacttgttgcttttgcctttctgtaagctcccagagggctggggctgagccctctgccaccattaacaacaaggatcatcaaagctaagtgcagtgagcgcctactgcatgccaggccctgtgctgagggtttgctgtgcagcatttcatgtactcctcagagcaatcctctgagttagatactttgaggaaactgaggctcagaatgcttaagtaacttcctcaaggtcactcagctaataaggggcagaattagaactggaagtctagccaggtgcagtggctcatgcctataatcccagcactttgggaggccgaggcgggcggattgcctgagctcaggatttcaagaccagcctgggtaacatggtgaaaccccatctctattaaaaatacaaaaattgccaggcatggtggtgggcgcctgtagtcccagctactcgggaggctgaggcacgagagtcgcttgaacccaggaggtggaggttgaagtgaggctgggatcgcgccactgcactccagcctgggcaacagagccagactctgactccaaaaataaaaataaaaaataaagaactggaactctagtccagagtccttgcccataactacatgccatactgcctcttagggcatgttgtgggactactggcctttgaggccaggtctgcatggctctgaggctaaggtgtggacaccacactacccagcctggcagagaagtggctggttgtgagggtctcactgcccacctcgaaagcccgtggctgagtgaggtctctgtctcttcaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctctgtaagcaggtttgcaggactgagtgggggcgggtgtgagcgggaggtcaaggccgtggtgtcctggatcaaagtgcagccctcctctctctacctccttgggtgctcacttcaggtatcccatccattccagctgaacttggtgtcccaaagcccactccccactccctcctctcccttcttggcctctgcttaaaccatctcactaccccaataacctttccccatccctacctgtccaaatcattgccaactttcaaagccaagttcaaacagcttctcccctgagaagcccccccagattcttcaaaccagatgccaccactcccttctcaggatccttacaacactttggggaaaataaaagtgcaaccttttagggcataatatgtgtccagaactgtgctaagcacttactacacaagtcacatcatcctcacaataaccctatgatgggaagtactttcagacctattttatgaatgaggaaacaggttcaccagcattaagggacatgcttcatgtcacacggcacgggaccagatccaacgggctctaaggaacagtttattctgtcttctcccatagtgggggccctcggagcactgctgggatcctgggtttgccatgtattcagcagtcacccgagcatgtgacattcctcaccactcttctaggccttggtattctctgatgcttcggggcagggctttgcaagctggctccagtgactgggtgccagagaattagttgttgtgggagggctgtcctgtgcatggtaagacttctagcagcatccccgaactccacccactgtatgccagcagcactccccatcccccaagtcatgacagtctgtcttcagacagtgccaaatttccccagggggcaaaatctccagttgggaaccatcactttagagaaatgcaaagaggcaagagattgttcttcttttttcttttttaataataagccttgtagaacaatttgcctctttcatctatgtgcatgtcacacttttataaaaataagaacgaaagagagagagagagaagctcatgaatcattgataatgaattcatctgtaggaaaagccttgttaaaaaacaacaggccaggcacagtgactcatgcctataatcctatcagtttgggagactgaggcgggacgaccacttgagcccaggagttctagtccagccttggcaacatagtaagatcctctctctatcaaaaaaaaaaaaaaaaaattagccgggtgtggtggcacatgcctgtggtcccagctacttgagaggctgaggtgagaggctcgcttgagcctgggtgtttgaggctgcagtgagccatggttgcgccactacattccagcccgggcaacagaccaaaccctatctccaaaaaaaaaaaaaaaaaaaaaaaaaagtaataactccatgtgaaatgctttatttacaagtactgtaaggataaggagggtgattcgttacactgactgagggatgattgcttatgaaaatgtatctgaagaacaattgagataagtaacacttcgcttacaaagctgttatttacatttgctgtgacacgtgtaaacagcacccacagagtttattttacacttgcacagcccttaccacgtgtaagacactgagggtttcacaaatataaactcatttaatctcacaaccacatgaggtaggtacccttctcttataaatggaaaaaaggggtacagagaggctaagcaacttgcccaaggtcacacagctcataagcggcagagctgagatttgaactcagggagctggctccacaagctccattgctcaactgcctgacatgcagcagttgattagtacataggctgtgattgttaataactgtattaagggatttttcttattccatcttaattcagacttcaaacacctgcaggccaaaggcgtacttgggtccctggtccttcctgcaacttcccaccttggtctgtcaacatgatgggtgctcaacagtgtttaatgatttaaactgaatttagaggccgggaactggtgaaccccaaagagtccagctaagacatcacaaaggctcagtctagggctttgcagggaacatactgccaaaaacctctcccatcacttactcgttgaacgctcttctctaagggccaactctgagctgtgagatgtgctgcagattcaccatcgtgataacagcgcatccaatgccgggatcctgatcttccgccccccagaacggcctccccagtctgttgagagcacctccatccttctcatggctcagactcaagacctgggagtcgttctagaggtctctctatctctctctcttttttttttttttttttttgagatggagtctcactctttcacccaggctggtgtgcagtggcaggatctcagctcactgtaaccccatctcttgcgttcaagcgattctcacgcctcagcctcccaagtagctgggattacagacacataccaccatgcctcgctaatttttgtattttagtatttcagtagagacggggtttcaccatgttggccaggctggtctggaactcctgacctcaagtgatccacccgcctcggcctccctaagtgctgggattataggtatgagccaccacagccggtctagacatctctcttttctcacctcccacataccacccaccagcaaattcatcgtgtatttccagcatccgacactcccatcccttctggtctgagccccgtcatcattggcctggattttgcagtagccccataatcatctccctccttctgtcgttgcccctggtctattcacaacacagcagtcagagagctcctgggaagtcataagccagatcacctccctcctctgccccaagccttctggtggcttcccatctcagaggaaaagccaaagtccccacagtggcctacaaggccccaacaggatcctgttcatgcttcctctctgacctcctctcctcctgctctctgctccagccacattggccccttgctgttccttaaataccccaggcacactcgtgcctcagggcctttgcactggctgttccctctaccagcattatttctcagcaaggccttccctgctggaggattagatgagctaggggacttacagcattttgccccaagcctggcacatagcagatgctacgtggaagcataaccctctcctgtttattgagcatctgctatgtgccaggcttggggcaaaatgctgtaagtcccctagctcatctaatcccccagcagccctgtgagccgggtaccaaggctcagagaggcaaaataacttgccccaggccccacaagtgggagccagagttggaacctaagtatgtgtggttttggttctgaaacccctgtgtgtgtacagacctactggaaggttttctcagaagatctgggagaacttgtttgctaatgagtcctttccccagacgtagctcagtggccacccaggtctcacacacacgctgtttcccgtctgcacttcctgagcagctcacacgcttcaccagcgctcttacttcattctgtcttggagatgatgccctcacacccgtccccctttcccaagcccatgagtccctcaaggcaggaactgtcctctttctgtctgggagcacagtggttggcacacaggcgggaaacagtaaatatctctggaatgataaggagtagggctattttatcagggtctctcatgtgccaaggcttatgccagctattcactgaaggggcattcctacagtactgtgtgtcgcacctaggctctgagcccaccggagggtgcagagacgcacactggccgccccagccctcaaggagttcatgtccagtggaggaagtggcaataacacccatatcttgagggcttcattgaaagagtgttccctgagcacctaggccatgcctagcactgtgtgctagagggtacggacatgtcatcccatggaacctgaagttacgattactgagctcatcattgctgtagttcaggccactcagagaagttaagtaacttactcaaagacacacagccagcaagttaagccctgacctgacagtgatgacagcacaagtggacaacgactttgttgcatgaaatctcagcgtgtatagaatacttaaactttattaatatatagtaactatactaatgataataacagagtagctaggacctatggaaggtctcttttatgttgtgatcattacgcctatcattccgagtagtctctaccaccctggaaaataagtaccattatatcccagcttgcaaatgtggaaactgaggcaagaagaagtgaaatcacttggcccaggttcacagctaagaaagggcagagtttggggggtcaatccaggcctgtcttcttgcaatccctgtgccgggatccagggtgccccagcaggctggtggagggctggggagaggtgcatatcctgggctggagccctgggcagggcccagctactgtgaggcagctgcctcaggcagcgggatctgggcagctctgcagagaaggctgtgccgctttgcgggtcaccgatgggggtgcggtttttcctccgcagtggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggtgagcgcagcggtggtccaggtcagggcaggactgcctgggggcgccaagggccacctagggggtggggtggggggcggcttcctgggtaccaggacccagggacacatcagaagctgggaggggcggaggctgaggagggagataagaaagaggagtggagggccgggcgctgtggttcacccttgtaatcccagtacgttgggaggccaagacgggcggatcacctgaggttaggaattcgaaaccagcctggctgacataggaaaaccccgtctctactaaaaattcaaaaattagcctagcatggtggcgggcatctgtagtcccagctacttgggaggctgaggcaggagaatcgcttgaacccgggaggcagaggttgcagtgagcccagatcacaccactgcactccagcctggccgacaagcacgaaacttcatctcaaaaagaggaaaaaagaaagaggagtggagggtcaccaggcctccctctttaaaaccaataaacaaaaagccactgcctttgagatgtgtaatttaaaaccataaataattaaaaataaaaactgggtgacagagccgggagaggaaaggtgggttagggtatgtgaaccaaattctcacatttcagagatataatagagctaagctcttagaatatataatattatcgtatttataatatattgatacatattaatatatttagtaatttattattatttgggcttactaaaaaaggaactcaaaactgaacgaggcaaagtggctgctctggaatgtgggccgggggtgggctagagatggagaaaagacagttacctcccaccgtcccactataaatcttcaattttagagatttttgttgttgctgtgttgctttttgaaaattatcacatgaatgtgactttctaaaaaaggcaactgaaaagaggaggattgatttcataaatgctgctgccacccacaagaggtagtcacgtgttatgggtcaggtgcacggcatctgcaacagccccgccatcccctttttgctgtgtgactctgagaaagttgcttaacttctctgtgtctcagtttctccagctgtaaaatggggacaataagagcatccacttcatagcgttgtgagaactacttgagtttgttcaagttaagcagctgtagcagtgcctggcacatggtactatatcagaggtagccgttattatccctgtgatggaatatgatatatccatttaaatacataggaaaacaccagtgagttcaccttatggataaaagcaggataagaaggtgtatttccaactcgatctcaactaagtgtgtccctatgcacgtatacaggtatatctacacatacacatgcatacacagcacacacatgtgggtagaaatcagggtttctcaacgtcagcactagtgacaattggggcaagtaattatttgttgggggggttttcctgtgcactgcagggtgcttagcagcattcctgacttctactcactagataccagtagcatccccccagttgtgatcaccaaaactgtctccagatattgccaaacctttcctgggaggcaaaattaccctagttgaggacttctagtgtaagactagaaggaaggacaccaaaatactcacagagggagacttggagcagagaaaaagctagaccatggtgaacctgccatcttgttcctggcacaagaatcctggaatctttagcatccttgccactgggccaaagcaccactccacacaggctgggcaccccctgcctgtaaaatgctgtttatccaaagagacgagaaaaccatggttcactgagggaccatcgtgaccaacacactctggttgccaaataactaatatttatggaaatcttacaagtaccaggtactgtgctaggcacttcatgcccattattttattcaatgccatccactgttaagaaatttacataacaagaaactgagatgcagagaggctgagccatttgaccaagattgccgtggccgctggcaggtgggttgattgagctgctgagccctggctgctcagtgctaactcttgttctttcccccctaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtg

SEQ ID NO: 36804 - DNA, 83465 bp, Homo sapiens
cgggcctcgagccgaggcagcagtgggaacgactcatcctttttccagccctggggcgtggctggggtcggggtcggggtcggggccggtgggggccccgcccccgtctcctggcctgcccccttcatgggccgcgatgatggcggccctgtacccgagcacggacctctcgggcgcctcctcctcctccctgccttcctctccatcctcttcctcgccgaacgaggtgatggcgctgaaggatgtgcgggaggtgaaggaggagaatacgctgaatgagaagcttttcttgctggcgtgcgacaagggtgagagttaggcccctttctcctctggacgcccctgtcctccagacctttagtcctctcccccgcctcaacttatatcggggcattccctctgtctcaggcgccgagtgtcttcccgcctcgcctgctgcctcaggcggtcttctcctcaccgcctctgccctgtgagtgtggagctggcgggagagtggagctggggctgcgccctcggagcgctgcaccgtcgggggtggctctggccttggggtccggggtttaggtagcgccttgggagccccgaccccagcgttttagcgccgcccttgctactgaccgcatgaatgacctggtcttctctctggctcgcagttcattccttccgggagtcgagaggctagtttccgacactccagtcggaaaattccgtcaccttaccttaggatgcctcgtatggagggttctcatcacctggtttttgtttttcttaaaaacaaaaccagaccctctattatttagcttcacctgaccagtgctttagccagtgactgttgactggcattaataacggaatatcctaggtggagatacatgaagtaaggacgggacggaagaaattctgccttagttgccaaaactttctctggatttacggaacgcctttgattgttagtgctttttattggagagaaagatttattgctcccagatctttctttgggagataaagatagtgaaaaataattacaggaattacaaggcaaaaatatgtggaatatatttagcgcgttatcctttttttagtctagaagttaatcatttttatggccatattaaggccatgtcacgcaatcatcctttgtagtgatgtatataacaaaagggataggaaattgattgccctaagactgcttttgtttcctacatggaaacactaaaatttttctttttccaaatttatatggctgtacacttaggaaaactctgttagaaacatgcaaacttctggaacaaacccaaagggcagtttacactatgaaaagactaactacacaggatttttgtttgtttgtttgtatgtgtgaatgtgtaattaataaatgacagccttcctaacctctcctcctgcttttgaaataggattttatttacatgattttttgaaaacaattgacatataaacaaagtccacctatgtctgtggttgagccatttttatgttcttatgtaatagtattaaataatattatgaaagcaatattaataatattgttaaagtacaccatggacacaactttgagcagtctttgagatgtaaagaaacagaatatacatctacaacgtcacaaaaatagggtctgtggattatgtaaaattatttagtattgctggagtgggttgcctgagttctcttccctcaaaagttctgagagaggaaggggagaagattgtgttgtactaaaatgagtaagtgctggctccatgtattccagctcactgtgcaatggttattttaaagcaaacagaaagtatgtcaagaaaggaaatttgatattcctgtcaaactgaggacagaaaaatatcagtggaatatggttgagcaagtatttgtgcattgtgtatatttaggattattgcatgacatatctcaaacaaaagagagttttaatttatgatagttgtatagcctatttagtagtaccaggtgaaataccttgatattctttgtcagttttttattttataacataattgagatgagagacttggctttgggggggtagggtggaaattaaatatgcatattttccccatatataaattagaaatttttaaaacaagtgagctaaaatgggaattttctgtttcaggtatgtctaaacaacttcttgagttagatttggaaaaatagcataattcttacgcatacttatggggtacatttacatttaaaaagtaactttgagttataggaatattcttttgattacgtgtttgtattcgctaatattgttagactttttaaaatgttacctaaaccagtctaaaagtgaacaatttcctgaagtagctatgacttccaccattacactggagccttcctcagaccaaatgttaaacattcactaaagcagctattggggtcgagtgttcatgcttttcatagaggatttcatttaaaccccacaaccccatgagccagatctgttgttgtcctcaatttgtagatgaggaaaatgaggcttagcaaaattttaaaattactttgcccaaggttacattggttagataatagtagaactggcatttatcttgagcctgcactcctaaccactacgttatatagatctggttgtaggtgaatgagtgaacatcatttgtgtcagaaaagacacatccatatttggacttactagttgaaattacattttctttgtatggatgctttataaaccttgatttctgtgtattacatttgttcaatgaagggtaaaaagcaagcatggtacttcagtagcaccagagtaaatcaactctagagtatctatggtgttctagagtgtctcattcttttcatgtagcattcttgttgtacatatgcaaaatgttcataacatattcttcttaggaaaaattgaggaattcctaaagcaaaaattgtggagatgagatggatatgtgtatgttagtggatgggtggccctttgaaagatgtgtacagattaaagagtacaataaatgtaggaaagagaaaagaaaaagatttatagtttgtgatagctggcttttatgtaagtaagttcggtagatttaggcaactgctgatctaggtagtggccacttagtaatggctgttagtgatcttcatagtgggtgaggatcatctcagaggtaacattgaatcctttctttgtaaaggaaaaccttaattgaaagttactgtgccagcaatatataaagtgaagtctaggacccccagataaaattctcagaaagtatactcatgttctttctagagatagaaagctatataaattcagaggtaaaacttaattgaaacaagagctgactataaatatgttgttttatgaaaaattaagtagtgattcttacagccatggctttgtcctctctcattgagaattagtgtcataatgagcctcttttatttgtaggcacctatggtgtccctcaggtctgttaacaggagaaagggtaaataagtttatttagaaaacacctaaactaagtgtagttcatgttaattttcctctaaaaaaaaaaaacttgttgagtagatggtagcttttagtatatatttgtaaatataaacctgcataaactgtttgatttgctgatgatcattaatcagttcatgtggaggaaagaaagtatgaaatgattcagtccctgccaactctccatggagagtattttcaggaaatctgatgtgcggtaaatgagttagaagccccttcttgaaatttcagcatggggttagggggagggatggagagagcaggttttcacctttatcagtgggctcagcctagtctcagtgtcctgtgtcacctttgtggtaagatttgctgtgttgtaaggaaaaatgttttgatgactgtatttctttttttttttttttgagatggagtttctcttgttgcacaggctggagtgcagtgcaacctccgcctcccgggttccagcgattctccggcctcagcctcagcctcctgagtggctgggattacaggtgcccaccaccacgcccggctaatttttttgtatttttagtagagacagggtttcaccatgttggccaggctggtctcaaactcccgacctcgagtgatccacccgcctcggcttcccaaagtgctgggattataggcgtgggccaccgtgcctggcctgatgactgactttctccataagctttgtgtacctttgggctaaggatgctttaaaaatgtgcaacaactccagagagaagccagagtcagaagaaaaaagtgcagcatttctgagagaagtaatattaagctgctgttttttaaacaccttatttatatataatgggcctttaaaatttttttacttatttgagaagagattttgaagtctggtattagagaggatggtggtgggaagaaacaaaaaatgcagagtactgagtattggtgtgaagtgttatgttgacaatggggcacctaatgtaaggaggtatgtgctgtgaggaaaaaactttgcagaaatgagaggtaaagagggtattgtaggcagcattctataaacacttcacaaatcatcatagacatagcatttatgtactttatataggaaagcttttcaaataaccaaagttttacaatgtaatagttgaaaaacattgccatggcgaacggttcagggatactttaacaacagcaacgaaagactcaaattgcgaaaatcttagtggataatttatctctaacagactagtaattcagcagctagctgcctggtagttctatgatactggtaattctttatagtgatcacgcaactttgctgctctttttctgtaagtcacaatcaaactatacttatcaagctgttaattgtgttaaggcactgtgaaagtgctttatcaagaaagtactgagtacatccctatcctttaggagaatattctttaatggagatgctctcttgtgctctagcgaggagaagtaaggaaacaaaagtatgtttgtattaaatatatctgtctgaagggaagaagcaagtgctcaatttaacttaaatggcctatatgtgatttggagaatgggatattacgtgtacagggtcagtcttttatctgggcagttaaaaaaaatgtaacccaagccagactcctagctataccttgtatatagacttggaggaagagtgtgaaaagattaaattttattatataggtattatcgtaacctaataattcctcttctaccttgctgccagtgctctaaatatcttcttcattgctaactcttccaaatttaatgatactgagaaatttaagatttaagatcaatagttgaataggtaatgaggatttcaaaagttatcactaagatgtgattaactaatgacttttaggagcctagatgaatgataaggactaaaagaattccagcactgtatcaatatagtcatgagactcagtagatttctttggatgccaaagctttgttatgtataaagtgggggtgactggcactgttattaatagcttctgttaatttttaaacatatgtttttctagattaacatattggccagtaatatatttttctagttttataaatatgtataattcaaatgtatatgagattaaatttaagcaacacaataaatcctttctgagactgtgttgcaacaacctgatataaactaagttttaaacaacttacagcagcattgtgaatgggatctcatgtcatttatcagactctaactacaaaataaacattgcttttgactatttttctaatagagttaagaatatgctgtttataatttttatcaactgatttactatgaaaaaatcagcattaccttctgtgctatagtgtaattttttcaggcagcagtgtgaatctttgctcttttgccaaatgatattcattattattaatggtcctcattaagattcataagcaactaagaaattatggtaataattgtctttttacaaaaatgttcaaagtgttataaacagtttagcctaccatgttttttagtatctttaattttgaaggtttcatttacaataatatggttataaatacattggggtctgtaatacgagttttgcacatttgataaagctacattttaaatcattttcactgtaaaaagtctgcatgggttttttttttttttcctttttaaaatttggttcaagctaatttgaagtttgatgtcagttaacatttttatcagtattgtcatttatatttccagatccagcaactgaacttgatcatgtctttttattttttcacatcatcattctttttcctcttaataaaactttctgttttaagcatcattggtaatatttcagttagaatgttgcaattgccacactcaggtttgttacagaaacttggtttgaaaagctttacaaattttttgacattaaattctctcacacttcacaactaacttcaaatttggttaatataaaattaaactgaacaacattgatactctctttgccataaaatcaaacgagatgctaatgaggaagaggtggaatcacctgttcttaatcagtattgtaacatttctccattgtatttctcaagggtttattacagttggccagagtaaatttgttgctaaggatctatgggatcactctggtattttgtatactagttcattttttttaaattgctggttaggactcactaaattgattttatgactgttaatgggttgcaacctgcagtttggaaaacattggtttggaatgatcattggctgagccgcagagaggcacaagatgaattcagaatgttaacaaggtctaactaagtcctatagggctttgtaggccacagtagaaatttggcctttattttaagtgtgatagaaaaatcacaaagtttgtaagcttgatatgttttgattttttttttttttttttttttttttttgagaccgagtctcgctctgtcgcccaggctagagtgcagtggcgtgatctcggttcactgcaagctccgcctcccacgttcacgccattctcctgcctcagcctcccaagtagctgggactacaggtgccccccaccatgcccggctaattttttgtatttttagtagaggcggggtttcactgtgttagccaagatggtctccatctcctgacctcatgatccgcctgcctcagcctcccaaagtgctgggattacaggcatgagccaccgcgcccggcttgtgttttgaatttttaaccgataactctagctgtggagtgcagagtggattgaaggggtggggctagagcaggagtgagcaaactatgggccacagaccatatctgcctgttctgtgaggtcttggagctaaaactggttttttacattttatatttcaaatggttaaaaaaaatttcgtaacacatgaaaagtctataaaattcaaatttcagtgtccataaacaaaattttcttagaacacatccactatcatttgtttacatatggtctgtggctgcttttgtgttgaaagggcagagttgagtagctgtgactgagagtgcatggcccacaaagcttaaaatatttactctctaaccctttttcagaaaactttgttgacccctgtgctacagtataaagtattagtaagtaatataagttgcaatagggaaaagagtaaacaaggaagggggtgagtgtgggctcagtggagtcagggaagtgaaaaattacaaaatacggggcttggggagttggtccatgtgaatcccacctgagtttgctaaaggcacttaaggagttaggctcctaccctccctggaggctgagagataggggccctgtcttcaggtgttggctggaacaaaagtaaatttttatgtcagctttgagttttctcgggcaggcattttaagaggggctagggtcatcctagggatccggccttcagctgttagaaacacttaagtgttttgttcaagtttatatgggccaaggtggaggccttgtggagaagggctcagaaaagcctgactagagtttggttaaggagagaatcttggtcagcagctgtgttagttaagaggctattgcagagtccaggaggaagatcatgggggtttggactgtgggtagcagtatacatggagacaagtagatgattatgggagatattttagagagggggctaagaagacgtgctgttgaattggtatactccctgtggaattgattgaaaatggtttctttttccttgactgaaaaagactaccatctagccaaaaaagtaaacagattatgttgcacttccttctatgtgttatattttaaaagacaaaagatgtaactcttgaaagcaacttcgttataaaatgaatggcatttatatatttgtctgtcatacacaggcattttgaattgtaatccttgttctataactagctacttgctgtctattttaagttttctgacctctttttacatatatactcatcctaaaaattaagagtgttctggtctttttttttttttgacatagtgcattgttttaaatgaattgcaaatataaacttctctgaaatgcttagcaaccactctaggtttcctgtaggttctgtgactataatgtgatttttcatttgcatgactgtgttagctgtagcagggtggaaccttttatttttagggatgaaaattatttatttggttttgatttttagggattttctttctttcttgtatagctccttgactacaatagaaataatctttaaaaccttagggctgggcacggtggcttatgactgtaatctcagcactttgggaggccaaggcgggcagatcacttgaggtcaggagttcgagaccaggctagccaacatggtgaaaccacatctctactaaaaatacaaaaattagccgggcgtggtggcagctgcctgtaatcccagctactcaggaggctgaggcaggagaatcgcttgaacccaggaggcagaggttgcagtgagccaaatggtgccattgtactcctccagcctgggtgacagagtgagtctctgtcttaaaaacaaaacaaaaactttaaagctggaatatatgatatttgtaatgtactttcctttttaacagcaatctaaacttttaaacatgtagcagttatttttgtctatttgctatacctgaaatttataaaatgtcataaggatttatttgtgtagctcttcctacgtttctgtctctagcaatatggttgattagataatctgaaaacctttcttcttcaaatcacctagaaattatagctaaaatataatgaacatccagttaaatgaacagctgagctttcaagaaagtaggggaaacaaccaagatacaaaagtgaagaaaaaactgaaaaacaggagtttgtgagctgacactatggctgctccatgggtggggataagagttactgttctgggcattgcagggatttgagtcttaatgcccatatgagaacaggttacaaggcctggagactgtacaaagtgaggagttggattcaacatctaagcataaaaccaggattcttaaaggactgtaccttcagcaaagaggtagatgaggagaaaaaccaatctaccagcacatggagacttcaaagaagcttgtttgtgttattgtgggctctgaataaggctaaaaataagactcctttaagaatacataaccatggtcctgcctcttgttgtcttggggttcaaattaatactactttcagataattaaactgtcatacagcgactacaaaataattatgtttaaaatgatgagaaagttaaaataaggaaatgaaaacataagaaaataagagagttggaaagaaatctggtaaaacttatgcaaataaaaaatacagtcattaaatttttaagaaatcagtgaatgggttaaaggaggaatgtgaatggaagctaaaggagaaataagtgagtggaagaaatatgtgaagaaattacccagaatgcaggaaagagagaggaaaaaaagaaaaaacaggaaatcttgagagacacagatgttgaaatgggaaggtctaacttaatgtctaatggaagttgacaagagaaaaagcaatatggagatgaagcaatatttgaagagagaatggctgaaaatactgaagaattaatgaagggtagaagtccttagatttagaaagcctaggccagatgtggtggctcatgcctataatcccagcacttttggaggccgaggcgagaggattgcttgaggccaggaatttgagacaagcctgggcaacatagcgagacctcatctctataaaaaataaaaataaaaaaaaaaattgaaagcctaatgagtcctaagcagaataaataaaaaattacttttcacctggacacatcacgataacaaagtatagcagaatttttatgtgtagcattctactactaagatgttgaaatagagtcacctgaaataagattttaaatgtcactttccagtaatagcgataaattttcactggtctatctttggtcactattggttcaacttgtgacttagagtatcactttgtgaagtgtctgtctgataaggttttcccagggagcatttgtgtctaactattaactactagtactatggggaaaatatttctttttgtgactagttttcttcttgagggacctaaggaaatacattgtcaagaaaactatcacccagcttccttcaaaagaagttgtatgtgtgaggcagggagtttaaggccatagattaaaaatagtagcaaatttacttgaaattttaataaataaaatatgttacctgtctttcttactcacttatttagcccagtttcagtattttctttttctgtatcatgaaatcatttctttttctattttctatgctgattgttctttccctgtttatttatagacttctaatgagcaactgtatttgcacatcacgtaaaatgacttatttatctattgtttaacaagtcaaatgaaacaaaacaagcaaaacccaccttggctttttttctctatttaattagcatttctcttgatttattccccatattcctgtaccatctggtcagcagacaaatacagtggggccttgctgaaaataattactgctgtaattgttgtcatttcctcacatgggacaactgttttgttgtgggctacagtcacacagaaggcaatttgcctgctcctaacaggtcaggcactaatcctagtcctgccttaagagttttgtgaactgaatgttccctggccatttaatctaatcagcttcattaatgagatggtgtgtgtgtgtgtgtgttgggagggtgggaagtagggaagaggattttcagacatctttccctttactatacatatccttgaatatatatgtatttatactgcttttccaaagtgttttctcctgtaaaacctctttataatatcctctgcttattactagatctcatttttaactctatgttatgtaagtaaatatctatgtatatttgaggtataaaacttaattctttaagctttttccatctaatttttctagtgtccagtctgtgcctttgggcatcctttattaaattgctttaaatatcttccaaaagtttctcctcttatgatcattcagttattaattttaaactaataatttttattttattctgtacatttaaaaattttctactttttatgtctgctgctgatgtacgtattattttattaaggtataaattttcatcaaggaaatgttcacattctctgtgtacattttcttatacaaaaatgagtttaggcttttaatcttttaattcaacaagctaagtttttctttacagtcatccttacttgatatgtcacggatattaaattatgtttgtatattgttatttaggtgactattatatggttaaaaagattttggaggaaaacagttcaggtgacttgaacataaattgcgtagatgtgcttgggagaaatgctgttaccataactattgaaaacgaaaacttggatatactgcagcttcttttggactacggttgtcaggtacaaggctagataatttaatccagttaacttctaagtgctgttagatatgccatgctttcttcccttcttgttttctttcttctttttcctcctcttcttcctttctttttctttctttgtctctcttactctccttctgtctttcatcttttatttggttttgaggcactaaaagttttaaaaacaaaccaaaaaaaactttttgaaaagtataatattttgaattgatttatctttttcctcccaaatgtcattttccccacatgacttattaaagatgactttgttttcattacctatgttaacactatttatattatatatctaaaatagtacaaatactctggaagtgtcagaggaatagttttttttctggcccatattagttacagacacatcaacaaaatgttcctgcctcaaaacagttttcagtttgactttggttttattaaattttatttttttgtttgaaacttaatgtttgtttttatctaaagatgaatgatttttatccatctataaaaggtagaccttcctacttcatatcagtttgggtagaaaaacaggcatgtgtgtaagtcttgaatgaattcagtctagagattctgaagggaatttgataatattttcctttcctttttggtttgcttatgatgggacttggcacattaattctacctctttttttttttttcttaatgaggcacattttttttgagtgacatcaggagacattcacagcagattttctgaatataagtagggtaattctatgtacattgctattttatatatatatatgtatgtatgtatgtatgtatgtataaaacaacatgtggtactatctccatgtacatgtttggagtaaaaaaaaaagaattgcttacccagcaacttcagctatccagaccacaattgagaagcagaaagtaagtaaaaaatacctctgagcagccagtggtttgctgccatgaagtttacagattaaatttatgaactttagttataggagtcctccatcagggtctattttttctcattttagtttccattttaacataattaatttctaatccatagagaatctgagggacaatggaaggggcatgagagctgcagtggaataaaatgaggagtggtacctccgacactgtttaacagaggtcaacagcattacacatgtgatctctgagggagctgtatgttaggatgataattaaggcttataacaatggtgcagagtcagtaaggaagagttaaattatattcagtacctattgttttagaagaaagactgtatatatgtgtgtttgtgtatgtgcgtttgtgtgtttataagacacaaaagcagaagacttccatcaaaatagtttaaattttaaaattaaacacttaaaggcataagcttcagttacctagaaaataagggtagaaaaaaattcatacgctgattctggataaaagaattactatggtattataattttgtctttttacacatggttatatacatgtaatggttttgcagtatacatggtgctttcatatacttgatcacattcagacatcacagtcaacctatatagatgttacattttatagattagaaaactgaggctcatagactttaatgaatttctcaaagttctaaaattagtaaggacaagacaaagatttaaatataatcttctgattgcaaatctcatgctctttctagttcactgtgttctgtccaggttacctgtgtcttattttatcagtccacaaatgtccagggcctttggttgggtatgattgtggaaatgaataagtaaaacatgggttctgtgtgataggatctttaagacaaattggacaattaaagtatgtatgaattacaagtaaattaagtaatacaaaggtatatttggtaagtgttgagtggtaataatatttgaccattttatattgctttgcatttataagagctttcatgtatcttgtgctatatcagtggttctcaaccaaatgattttgtcaccataaggggacatttggcaatgtctgaagatactttggtttcacaattggagggcagtttactactgttatctagtgggtagaggctcctacaatacccaagacagtccccacaacaaaaaattatttggcccaaaatttcagtagtgctgctattgagaaaccctgttttatgtttaaacttttgtggtttgatatacattatttagaaatatagaataggttggggctatcaagaaagatttcattggaaaagtatcagttgactcagccttgaaatattaataattgctaacatttatataataactactctctgccaggaaccttaaatatgttcacttacttaatcctcacaatatagggatttgaatttaatcttcaaattaaattcagggatgagttagatattattttattattattattttttgagatggagtttcgctcttgttgcccaggctggagtgcaatggcgtgatctcggctcactgcaacctctgcctcctgggttcaagcgattctcctgcctcagcctcccaagtagctgggattattataggcatgcaccatcacgcccggctaattttgtatttttagtagagatggggtttctccatgttggtcaggctggtctcgaactcctgacctcaggtgatccacctgccttggcctcccaaagtgctgagattacaggtgtgagccactgtgcccagcctagatattattattgtccccattttatagaggaggaaacaggtaaaaaaggttaagtaacttgcccaaagtcattctgtgaatggcagacctggaatttgaacttaggttctggctccagaatctatggtcttacctattatgctaatctactctcaaacatgtaaagacaggtagggaacaggagatgtggagaaggatataaacagagccatgtgcaatgtatatttttgagacactgaattgatttagcatttttgaacaaaacagttgggttggggagtagtaggaattaggaaaaataattaaaacaaaatggatacaaagggccttgaatgccagaataaggaatttgggttttatataatagttaggggatatcattacatgattttcgagaaaggatgtgatgtgtccagtggtattttagaaagatgtatctagtggctgaatttagtatagactgggaaatggaaagtgggaaaggctatagcctatgtcaatagtttttgtagtaatctacatatgaagaggttgaggcttgaactggaacagtgctgtaagaaaaacagtggctatgagaagaagggggaaaaggcagatatgagtccatggcctatatggttccgtggtctgttaggaactgggctgcacagcaggaggtaagcagcaggtgagcgatcattactgcctgagctctgcctcctgtcaggtcagcgatggtattagatcctcataggagtacgaaccctattgtgaactgcacatgcaagggatctaggttgcatgctccttatgagaatctaaccaatgcctgatgatctgaggtggaacagtttcatccgaaactatctccctacctgctctatgaaaccagtccctggtgccaaaaaggttggagaccgctgtgaggaattgacaaatcttagtgaatattttgatttggagtgggaaattgaaaaggagtccaggatgatttggaaatcttaaacgtgggtgactaagagaaggaagaaaggaaaacattaagttcagaagctaagtaaagcttggggcaagggaatgtgaattctggttttatccttgttgatttggcagctatcaggcagtcctcatcagacaaacacagatgaacattatatttctagggagagatcaggctaaagagatacagtaagctgtcagggccatgggaatgcccatcaccattgtgagagtaggtgaaatcatggagaagagcaaagggctggtgcagattcattcttaaggaaacatctacatttaataaagagcattacatggaaagagtttcattaaagaccaaatgaattgttgaagatatcagaggcagttaggataatgcaacattgtgaaagccaaaagaatagtttttaacatattggcttagaaattaagaaaaattagaaggtagaaaaagtaattggacttggaaactggcatcagtagaattggagaaatgatacactttgatttgcaaagtttgacacaatgaaaggaagaagaaaacgagtggtaagagaaagatggaattaagtcaagttagcaaagagctagtaagcaagttagcaaagagtgatgaaggatttaaagttctgggaggtgggagattagactggtatttctgcaaatgaaggaccagggttctaaagattggagagcatcaaatagaatactaaggtggaaaatgtagctttggaaaggaaatacgtaacttttttactctgagcttaaaggaaagagtatgggaattgttgaaaagataaattctaaggtaggaaggaagataatgatctcataaatatgtaataagtatatattgaagagcttttaataaagaatcgtcaaatatctgagaaattggaaagcaaaactagtgaggattttttgtataactatgtatttttaaaataatttaaaacatttatttctctcataactgccattgatttatcaaataacataccatttgtgcagaataagtaaatggtaactccttatttacaagaaattttaatgtaaatgaatatttttatagctgaagcttatccttttaagcattgaaagatttaatgtaaatctttattccttactaagtaatgtatctgaatataatttaactttaccatccttagttggaataattgagaatgtaattattttactttgcttcatatggtctgaaactattaacatgtttgtccttacattaagtggctttagactgttgtgcattgatagtgattttgctgtactggtatttaatcttttcagtagtcaacttttagtaattctttcttcctttccctctacgctgttggttttaatcttgctattcttttattcagtaaagatctgaaggatacttgggaaagccagatattcatcatttatggacaattctaaatcagaatgcttgggtctgtttcttttgggaaataatacccatggagtttctttgtgacagctcaatatgttgctgtttttaaatccatggctatttttcagattgttgaagttccctggtgtttgactttgaaagtaatgacattactatagttagctttattggttaaaattaaaaatcataggctgggcgcagtggctcacgcctgtaatcccagcactttgagaggccgaggtgggtggatctcttgaggttgggagttagagaccagcccagccaacagggtgaaaccctgtctttactaaaaatacaaaaattagccgggtatggtggcatgcacctgtagtcccagctactcgggaggctgaggcaggagaatcccttgaacctgggaggcggaggttgcagtgagccaagattgtgccactgcactccagcctgggtgacagagcaagactctgtctcaaaaaaaaaaaaaattaaaaatcataaatgaaatatttaatagtaatggatatagcattctttttgttcatttccttcaactgattaaatatgctaaaatctgaagagaaatgtttgcaaagcagagtaataatgctaggactttaaagcataggccacagctcaatgaaccctgaaagttttaagagatagtgcaatgggttaaatttcccatctgggtgggaagtttttctgtgggaaaacataggtgattcctaagggttgagtgaggactccaacccttttttttgaggtgcatagtcctatttttagatattcaggtaaagtctgccacttttagttctattttttacatccagataaagtgaatataaactttactcttttcagctacaaagaatattaaagatcgatatagttttgtttccaagagcaagaacattgatttaaatagttattaatgattatagcagttaaaatgtacagattgaaaataattagggcattttcttagattaaatcattatttatccccatgttttccttcttcctttatatttttccctaaaaatccaaaaacctgatgttatagttgccagtaggactataggctttgttacagagttgaaaagtccccatttcctcagagtctccttactttttcctctttcggatcttcacagtgagctatagactgggagcagaatgataaagtcacttctccctccagtctccatgaactttggtagcctaactatttgtggcttatacttgataaaattgctcataaatgtcaaatttgtagcattttagtcagccatgtgttttaaaaatgagaacagaaggctctcacctttagatattctccctatattcctgtttgcattgatgataatcattttcattagactgaaaaaaatcctttacctgtagtaatagttcttgacagtttcttttatagatttggattgttaagattcttttggtccacagttcaagagtaaggatcttgaaaaaaaattttcaactttaaatcctgcatggatcagcactgttactctaataatcccttcaatgagacattcattattttaccaactcatgcattgaaaccaggacagaaacgtgtgtattgtggtacacagaagtactcctaaggcaagcaaatgtactatttgtacagtcaaaatttttgaaaaattttgtattactgtatataatacagtttaaatttttaaaaagttttatttatgaattagtaaaaagaagtagtttacctttttatcttccattttcatttttaactttttttttttttgaagtctgcagatgcacttttggtggcaatcgactctgaagtagtgggagctgttgatatactacttaatcatcgaccaaaacgatcatcaagaccaactatagtagttagtactcttaaatatttattaatttggatttttaaaccaaaatagatctcttgccccattgccattttttccttccctcaaatttattttgttttttcaaaaaatagatattttttctcactctgtaaaatattaaaagtggacacttgcaggaataattagtatttctttcaggaaaactttttaaatttagttgatatttccataattttgtcactgtggaccagtatttaccatttgaaatattctgcaggtaatgttgaaaatatagattagtttgcagatagataagaattaaatgtaaacaatgaaaccaacaaactggaagaaaatgtaggtgaatgtttaactgatcgtgagtagaaagactttatgtgcataaaagcaatggacagaaatcacagtggcacagtttttgctgttaaaaaagttaaatttttggaatccagacatcagacaaaatttagaaagcagatgaataactggcaaaagatatttgcagcatatatcataaattaataatcttaatattggacaaattggtgaaaaacatattagaaaaggacatagaaatagcagaaaatacaaaatgttaaatcttaatgataatcaaatacagtaagatactaattttaaacttaccaaatttacttattaaagttgaaaatttaaaaaaaatcattgatagcaagggagtattacagtctcatgctactagtgaggcaggtattttggaaagtgttttggcaggatctgtcataagaaaggtgttcatatgctttaacttagtgctttctcctctgggaacttatcaaggaaatggtcagaaatgtggacaaaaatgttggttgtgatcttatttgtagtaatttttaaaagcccatgtgacataatctaaacattccaaaatagaagataggaaatataaatgattacatatatgtacaatggaatattatgcagtcattaaaacagtacttttaaaagaatagttaggaacatggaaaaatataacgtagtaagtggaatacttactatggttaaaatacttaccacggttaaaaatatgcgtagaaaagggactgtgtggaaatgcaacaaaatgttacctaacaatcatcatctctcattgactaaccaaattatggatttttttgtactctttttatttttctttattgcttttgtaattaggaggatagtcactactaaataaatgctaattttattgttttttaatcaaattttaaacatgataacattcattattggtgacgataccgtgaaacaagcagtttaaataactgctggcaatataggctggctataagcagaagaaaaatactgttttaagagagaattataaattggttgttgactctctgccatgtttgagaaatgtgagaggctctgctaaattgcatactttgttatatagtaactgaaaaatcttactcattcagactattacaaaagtgtgactttctccagaggatagtaccatctagtttaagtggtggtaagaaatcaacaggaataaggaacaaaaggctaagaatatagtccctatccaaagcatcagaaatatctaaaataccattcaattttctgccacttatcttgcagttattattatattttggcacacctgtcccatcttctagccttttagtccatttcctttcctgggggaagggtggggtgtagtgtgcttgagtactggaaccattgactggttttattcatcaccattatcactaacgattaaatcttagtgttggcagccctcacctacttagtaaaataacctttgggaggccgaggcgggtggaacatctgaggttgggagttcaagactagcctgaccaatatggagaaaccccatctctactaaaaatagaaaaattagccgggcgtggtgccgtgcacctgtcatcccagttacttgggaggctgaggcaggagaattgcttgagccttggaggtggaggttgcagtgagctgagatcgagccgctgcactccagcctgggcgacagagcaaaactcttctaaaacaaaaaagaaaaagaaaagaacactttctactctgtctctaacaaataaagattattcagcctttatttaaatacactcaatgacagcaagatcataccttcttttattttattttatttttttgagacttagtttcgctcttgttttgttgtccaggctgcagtgcaatggcgtgatctcaggtcactgcaacctccacttcccgggttcaagtgattctcctgcttcagcctccggagtaactgggattacaggcacgtcccaccatgcccagctaattttgtatttttaatagagatggggtttcaccatgttggccagtctggtctggaactcttgacctaaggtgatctacccttctcggcctcccaaagtgctgggattacaggcccagccaagatcatatcttgatagcccttttacttctagagaggcaatattaaatatttttatatattttaaataactgagggaatataaactggctataagcagaagaaaaatattgtttcttttagcgtttcagtaatggtaatattcttttagcatttcaatgaattcattctgtattcttggcttgccagattgtctttttggcaattgactttcaaatttaggttttttatttaatagtatacagattatattatgaacaatggaattatgaactttaatcttatgcatatctagtgatgtttttcatacagttaagtatgtttcataagaaacatgaggaccacttttctcttaagggattaaatatattttattcttctttataaccagtaatgcaatgataagatggaaaagggctagttttaggtttctctgtaattttaaataaagtcattaatttgaagtcctcaataaataaataagtatataaacaaattagtcataaaagaggaggaaaatcagataagtatatcagaaaatattaaaacttaccagtgatcaaaggaaattaaattacaatttcatgatagtatttttcactataaattgggagtgatcatgcctaagacgggtgagtaaaactttagtgtgaaatgggtacctccttatattattggtaatataaactattaaaaggactttaacaatatgtttcaagagcttcaaaactgttcatggccgggaggcggagctttcagtgagccgagatagtgccactgcactccagcctgggcgaaagagcgagactccaccaaaaaaaaaaaaactggtcatggcctttagacccataattctgctgctgggcttttatgttaatgagataatcctaaatttgcaaaacactcttttcataaagacgtttatggtaaattagcaaaataaaatacttgaacacagaatctatgaacttccttaaattgcatataaaattatgtgcatgaattatttttttctgaagattctgggctatgtaaagatcctgctttatggattattaaaagggtccctgatcttggagatattaatgaccactgtttaatcattggtccttagaatacctactgtttatgccaaagatgtccttaaaaggggggtgtagtagaaaaaggattaaaatgaaatactgtactggaaaatgttccttgggtagtaggaatatgggtatttttaaaattctttctgattttctacattttcagatattttataataagtatatacactacttttataatattgcaaaaaaaaagtaagtattagaaaatacgatagttataaaatagtcaacctttttatttaagcctggttctttaattactaatggtattttcctcatttcatgctcttaccacacccatggactcctgtagtggaaggagctccagctctagagtaatacaaacctggattctgatcagcacccagccaccctgtttgtggctcaggcacattaacttctctgagcctcagtttcttcgtggggattataatgcttggttttgcaggctactgtggcaattaaatgagatgataaatgtaaagtgcctaacagttccagaactcattaaatactagcattattgttaattttttggcgtttatagtaggaagtagtatatgtaatgattgaaaatgtgtagaaaattatacaaaatgaagagtgcttcctattgcccttttcaagtagctgcattgctgtcaatgtgataaggtttgccatagaggtgaaattcttagtttttctcacatgttaatattctccctattttttagcatttttatttttctaatatatttttctaacattcttctttatttttgtcaggcatgattctataatcttgtgaaaattaaacacttttccctaagatatttctctagatattctcacttctttgttggaaaaaacagacctctagttaaatgaatgttacctattgaagattttgtctgttatgattacattgcatttattaattagagttaagttttgaggtttcaaagaaaaatttagtccaagcaaaatgtttaacatattccttaaataattcttaagttctttgtgccttcctattttttcatttcattcttcagataaatatattttttgaagtcacaaataataactttggacatttatataaatatttttcagaaactaatggaacgaattcagaatcctgagtattcaacaactatggatgttgcacctgtcattttagctgctcatcgtaacaactatgaaattcttacaatgctcttaaaacaggatgtatctctacccaagccccatgcagttggctgtgaatgcacattgtgttctgcaaaaaacaaaaaggatagcctccggcattccaggttagaacattaaacttttgataaatagatgtgtgatatatatcaacaatgttgatttttaaaattggtattctttctatgcagcttttaagaaatgtgatgctggggtgacttatgaaagccaaacttgtagctcctttgttttatataatgcattctgcatttttaagaagtgttcaccaaatgctgaataattgcaaaaatccttcaaattatgaatgaagttatctcatactcctgctggcaggggcactatttgctttttagaggcagagtttattaatccaagagaagttccaagtcgtggaaggagtggagataccacctcctatctcatttataaagaaatcaaaactattttctgtctaactaagtattgaccttttatgcctctatcttcccctctcacacaatgttcaagtctttttctctttcttattgatcatctcttcctgtttcttcaattaaaaatgttaagaacaactgaggattgattgaccaagaaaataccctgtcacaggttgagcaagatcacacgtgggcatgctgtataagatacatggtgctggactagatttgagaatctgattttcagcagaaacatttatacatacagtcatgtgctacatgacattttggttcaaaaacagttcacatatatgacatcggtcctgtaagattaaaatggagctgaaaaattcttatcgcctactgatgtcattgctgtggtcacatcatagtgcaacgcattactcacgtttgtggtgatgctggtgtaaacaaaccctactgtgctgccagtcatttaaaaaaagtagagcacatataattttatacagtacataatacttgataataatgactgttactggtttatatatttactatacttttatcattatgttagtgtgtattccttctacttataaaaaaatagttaactaaaacagcctcaggcagttccttcaggaaatattccaaaagaaggcattgtattcatagatgacagctccatgcatgttattacccctgaagaccttccattgggacaggatatggaggtggaagacagtgatattgatcatcctaggcttaaactaatgtgtatgtttgtgtcttaatttttaataaaatagtctaaaaagaaaaaagttaataaaaaattttacaaagaacaaagctggaggcatcacgctacctgacttcaaactatactacaaggctacaataaccaaaatggcatggtaatgttaccaaaacagatatatagaccaatggaacagaacagaggcctcagaaataatgccacacatctacaaccatctgatctttgacaaacctgacaaaagcaagcaacggggaaaggattccctatttaataaatatgttgggaaaactggctagccatatgcagaaaactgaaactggaccccttccttacaccttatacaaaaattaactcaagatggattaaagacttaaacgtaagacttaaaaccgtgaaaaccctagaagaaaacctaggcaataccattcaggacataggcatgggcaaagacttcatgactaaaacaccaaaagcaatggcagcgaaagccaaaattgacaaatgggatctaattaaactaaagagcttctgcacagcaaaagaaactatcatcagagtgaacaggcaaactacagaatgggagaaaatttttgctatctatccatctgacaaagggctaatatccagaatctacaaggaacttaaatttatgagaaaaaaacaaccccatcaaaaagtgggtgaagcatatgaacagacacttgtcaaaagaagacatttattcggccaacaaacatatgaaaaaaagctcataatcactggtcattagagaaatccaaatcaaaaccacagtgagataccatctcatgccagttagaatggtgatcattaaaaagtcaggaaacagcagattctggagaggatgtggagaaatagaaatgcttttacactgttggtgggagtgcaaattagttcaaccattgtggaagacagtgtggtgattcctcaagaatctagaaccagaaataccatttgacccaacaatcccattactggatatatacccaaaggattataaatcattttactataaagacacatgcacacgtatgtttattgcagcgctattcacaatagcacagagtaggaaccaacccaaatgcccaccaatgatagactggataaagaaaatgtggcaagaatacaccatggaatactatgcagccataaaaaaggatgagttcatgtcctttgcagggacatggatgaaactggaaaccgtcattctcagcaaactaacacaggaatgaaaaaccaaacactgcatgtctcactcataagtgggagttgaacaatgagaacaaaccaccatggcacgtgtatacctatgtaacaaacctgccattctgcacatgtatcccagaacttaaaagtaaaatttttaaaaattaacaatagtaaaaagcttatagaataaagatatgaagaaataatattttgtacagctgtatgtgtttgtgttttaagctgttactccaaaatggtaaaaaagttaaaatttaaagtttacaaaataaaaaaattactgtgagctaggtttaatttagtattaaagaaactttaaaaatatacatttagggtagcctaagtgtatagttattataaagcctgtagtagtacagtaatgttctaggccttcacattcacttaccacccactcactacctcacccagggcaacttccaattctgcaagccactgatggtaaatgccctgtacaggtataccattttttaatattttatgctgtatttttactgtaccttttctatgtttagatatgcaaatatttactattgtgttacagttacctacggtatttagcatagtaacatgctatacagttttgtagcctaggagcagtaggctataccatatagcctaggtatttaatgggctatgtcaactaggtttgtgtaaattcagttaatgatgttcgcaaaacgatgaagttgtctaacaacacatttctcagaatatattcctgttacacaatgcatgactgtgtgtgtgtatgtaaatggtaattaaatatagttgaaatagtatcaaatataatacctactgtggagaatatcatctggaagtcccaggcagcctggtgacaaactatttttaggttaaggattgttaaacagtatatgaaatagactttaaggctgtaaaccatccaccctcactctttcctcaccttaagaacaaacctttgatggatttgagatagtgacagatctctaatttgggaaagtctcctgggaatcaatctgatgtttatttgcagaggtttacctggaaattttttctattttcaagtctattttacaaagagatctgtgtttctctttgataagatctggttgatagcgatggctacatcacttaactttttagttttaaaatgactagtttataaaatgacaagcagaaattatctttaaggctttttccagttttaaaatcctttattagtattaagtgaaggggtggcctgcccctccacacctgtgggtatttctagttgggtgggatgagagacggagaaaagaaataagacacagagacaaagtataaagaaacaacaatgggtccaggggactggcactcagcacaccaaggacctgcaccggcaccggcctctgagttccctcagtttttattgattattattttcattatttcagcaaaaaggaatgtagtaggagagcagggtgataataaggagaaggtcaacaaaatacatgtgagcaaaagaatctatatcatgattaagttcaagggaaagtactatgcctggacgtgcacgtaggccagatttatgtttctctccacccaaacatctcagtggagtaaagaataacaaggcaatattactgcaaacatgtctcccctcccgccacagggcagcttttctcctatctcagagttgaacaaatgtacaatcgggttttacaccgagacattcagttcccaggggcaagcaggagacagtggccttcctccatctcaactgcaagaggctttcctcttttactaatccacctcagcacagaccctttacgggtgtagggctgggggacagtcaggtctttctcatcccacgaggccatatttcagactatcacatggggagaaaccttggacaataccctgctttcaagggcagaggtccctgcagctttccacagtgcattgtgcccctggtttattgagactagagaatggcaatgacctttaccaagtacactgcttgtaaatattttgttaacaaggcacgtactgcacagccctaggtcccttaaacgttgattttatacaacacatgtttttgtgagctccaagttgagtcaaagtggctgggtcagagtggctggggcaaagctacaaattaacaacatctcagcaaagcaattgtttaaagtacaggtctttttcaaaatggagtctcttacgtctttcctttctgcatagacacagtgacagtctgatctctctttcttttccctacaattaagtgtgaatatttttcaaattatatgcttgttaaataagtgtgtagttgaagcagcggggtcttacaggttgaagctagagaaaacactttacctggcttggtttgaggttgggggacaaacttgtttgaaggcttttaggggagctatgacttgacatagatcttttagtatgagtaagagttaaaaattgaaaggtattttaggcagaaagtacagcatgtgatttgtttatttggaaactgcaaatggtttggaacattaacagtagagtttgagagagtttgttaatgatctttgagaaaacatttgtacgaaatggcaaggacccctgacttaagtcatttctgggaattgctaagtagaactgcagaagaaaaggaggttaacaaaattagtaaaaagagaccgggcgcggtggctcacgcctgtaatcctagcactttggaggccgaggcaggccgatcacctgaggtcaagagttcgagaccagcctggccaacttggtgaaacctcgtctctactaacagtacaaaaattagctgggcgtggtggcatgcacctgtagtcccagctactcaggaggctgaggcaggagaatcgcttgaacctgggaggtggaggtcacagtgagctgagactctgcctcaaaaaaaaaaaaaaaaaaaacttagagaaatagcaaggtttctcagaatttgaagagccaatatactggcagtaagaaagtgagatggctggacatggtggctcacgcctataatcctagcattttgggaggccaaggcgggtgaatcacttgagtccaggaattccagaccatcctgggccatatggctagaccttgtctttacaaaaatagccagatgaggtgacttgtacctgtggtcccagctatgcaggaggctgaggtgggaggattacctgtgcccaggaggttgaggctacagtaagctgtgattgcaccaccacactctaccctagcctaagtgacagagcgagactccgtctcaaaaaaaaaaaaaaaaaaaaaaaagagagagacaattgttttttaaattttagagatggtgtagtttcagggtaatatttcctaatgggccagggaagggtagtaaaccattgtagtttagaaaaacattttcagtaatataatagctgtgatttggttttagtctcaatatttgatgtattttgaaacttcaaataactttaaagaaggagtctttatttattatctattagtggaagacaaaaatttaaaaaaacttgagaaacaccggaattgggaaagatagcaaagaaatggattgccagttaaatttaatttgcataaagtataataaaaaaaatgacgagttaatgtaatggatgcagcacaccaacatggcacatgtatacatatgtaacaaacctgcacattgtgcacatgtaccctaaaacttaaaagtataataaaaaaataaaaataaaaaacaaaaatttaatttgcagaagagctttgtttaacttgcatagtgttttttataattttgaatttgaatgccagtaagccctatgtacactcagctttattcatattattaccaacatcacccctgaaggcaaatgaatttgtaaaacttggctcagtatctaccaagagagtaggatgttggctggggtcatgttaggaatatggaattcttctggcatagtggcaggaaaatggcttgggagagagactgcttagtgccacagtcctcaatgaatatacaagagtgacacggaagtaggaaatgacagtgatgatgatgagggagtattggaataactgaatggtatgaatctccaaaaagggtgattttgatatgagaatgaatgaataatatagcctgtaagattcaggtattgtgacattatgcttccatattgccagaatctttaaagggaagtattgttcaatcccaattttcaatcccaatttttcttttcatttctagagctaaccactgttactagtttggtattctacacgtgttccttaatggttaacattaccattggttagaaatgttgagtcttgctgggcgcagtggctcatgcctgtaatgccagcactttgggaggctgaggcaggtggatcacctgaggtcaggagttcgagaccagcctggccaacatggtgaaaacccatctctactacaaatacaaaaatattagccgggtgtggtggcaggcacctgtaatcccagctacttgggaggctgaggcaggagaatcacttaaacctgggaggcagaggttgcggtgagtcaagattgcaccattgcactccagcctgggtgacaagagcaaaactccatctaaaaaagaaagaaagaaatgtggctcttcgctacagtgttagattggaaactagtctcatcaatggcttagttacatgttagaaatcccttctcccaatttctgcctatacagaattccattcatgtttcctttcctttttttattgtttgcctgccttactaatcttgcctcatttactccagttctttttatagttgcccacatatttaggttgaaccatatgaaattagtgttttaaaagtactttggacatagggaattacatatttccatattcttatattggtgtgggtgaaaccaaaaccccagaaagttacacagatcataatcaccttactccatagggcctcaaaaaaggctttttttacagtgtggaaatggatgatttacagtatgtttaaagtgtgtaactattaccataatctaatattctaacatttctatcattggaaaaagttctctcttgcctgttcattcatggtcaatccttgtttccatccccagctccatgcaaccaccagtttttctatttttgtagtcttttctttactagaaatttcatataaatggaatcataaaatatcttgacttatgtctctggctttcttttacttaccataatatttttgaggtccatccatattgtttcatatgtcagtaattcattttaaaaattgttgagcagtattccattgtatggttatagtaccaccttttatttatctgttcactagctgctcaacatttgagttgtttccagtttttggcagtgaacattcacttacaagtctttgtgcggacatgtttttatttttgttgggtagacacctaggaatggaatttctgggtgtgttaactttttaagtagttgtcaaactgttctccaaagtggttggaaacagtttaacatttttactggtaaggtatgatggttcttttttttttttttttgagacagagtctcgctctgttgcccatgctggagtgcagtggcgcgatttcagctcactgcaagctccgcctcccgggttcacgccattctgctacctcagcctcccgagtagctggaactacaggcgcccaccaccacgcccggctaattttttgtatttttagtagagacggggtttcaccgtgttagccaggatggtctcgatctcctgacctcgtgatccgcctgcctcggcctcccaaagtgctgggactacaggcatgagccactgcaccaggccctggtatgatggttctaattctgccacatacttactgaaacttgatattgctggtcttttttcttagtcattttagcaggagtgtagtggtttcttactgtggttttaaaaatttttttatttcttgttgaggtaaaatatatgtctataatttaccatctttgccatttttaagtgtacagttcagtggtaataaatacatgaatattattttctttccccttcatacatcccattctttcctggcctctggtagccaccagtctactctctatcttcatgagatctactgttttagctaccaaatacatgtgaaagttgtctttctgtgcttggcttatatcacttagcataatggcctcaggttccatccatgttgctgcaaattacaggatttcattcttttcaatggctgaataatattccgttatgtatataaaccatgtttttaaaatccattcatccattgatgggtacttaggttgagtccatatcttgactattgtgtacaatgctgcaataaacatgggaatgcagatgtttcttggctatattgatttcctttcttttggatatatatatatatgtatctaatagtggaattgctggatcatatggtagttcttttttttaaaaaaaaattatgtttaaaataatcccaaaggattataaatcattctataaagacacatgcacacatgtttattgcggcactattcacaatagcaaagactaggacccaacccaaatgcccaccagtgatagactggataaagaaaatgtggcacatatataccctggaatactaggcatgtagacatgaattcatgtcctttgtggggacatggatgaagctggaaaccatcattctcagcaaactaacacaggaacagaaaaccaaacaccacatgttctcactcataagtgggagttgaacaataagaacacatggacacaggggaacatcacacaccggggcctcttgggggatggggggcaaggggagggatagcattagggcaaatacctaatgcatgcggggcttaaaacctagatgacaggttgattggtgcagcaaaccaccatggcacatgtatacctatgtaacaaatctgcacgttctgcacatgtagcccagaacttaaagtataataattaaaaaaaaatttttttgtgggtacatagtacatatatgtatttattgggtacatgggatattttgatactggcatgcaatagtgtaatactcaggtcatggaaaatggggtatccatcccctcaagcatttatcctttgtgttgcaaacaatccaattatactcttttataatgtacaataataaatgtacaattaaattatggactatagtcaccttattgtgctatcaaacactaggtcttattctttctatttttttttgtactcattaaccatccccaccttctcctaacacccccaccaccctcatatggtagttctatttttagttttttgaagaacctccatactgttctctggtagttctatttttagttttttgaagaacctccatactgttctccatagtggctataattatttacatttccagcaacagtgtgtgagagttcccctttgtccacatctttgcttgcatttgttattgtgtgccattctgatacaaactattttaactggagtgcgatgatactgcattgtgattttgatttgcatttctctggtgatttgtgatgttgaacattttttcatatacttgttggtcatttgtatgttttcttttaagaaatatccattcagatcttttgcccattgtaaaatcagattatttatttttggttttttgcttttgagttgtttgagctccttacatattctggttattaatctcttgtcagatggatagtttgcaaatatagtctcccattctatgagttggctcttttgtttgttttgtggaagtgttttagcttactgtaatctcaattgtctatttttgctttggttgtctgtactttttttttcttttttttcaattatactttaagttctagggtacatgtgcatgtcgtgcaggtttgttacataggtatacatgtgccatgttggtgtgctgcaccggttaacttgtcatttacattaggtatatctctaatgctatccctcccccctcccccaccccacaataggccctggtgtgtgatgttccccaccttgtgtccaagtgttctcattgttcaattcccaccaatgagtgagaacatgcagtgtttggttttctgtccttgcgatagtttgctcagaatgatggtttccagcttcatccatgtccctacaaaggacatgaactcatccttttttatggctgcatagtattccatggtgtatatgtgccacattttttttatccagtctattattgatggacatctgggttggttccaagtctttgctattgtgaataatgccacaataaacataagtgtgcatgtgtctttatagcagcatgttttataatcctttgggtatatacccagtaatgggatggctgggtcaaatggtatttctagttctagatccttgagaaatcaccacactgtctttcacaatggttgaactagtttacagtcccaccaacagtgtaaaagtattcctgtttctctacatcctctccagcatctgttgtttcctgactttttaatgatcgccattctaactggtgtgagatggtatcttactgtggttttgatttgcatttctctgatgaccagtcatgatgagcattttttcatgtgtctgttgggtgcataaatgtcttcttttgagaagtgtctgttcatatcctttgcccactttttgatggggttgattttttcttgtaaatttgtttaagttctttgtagattctggatattagccctttgtcagatgggtagattgtaaaaattttctcccattctgtaggttgccttttcacttttcccattctgtaggttgtagtttcttttgctgtgcagaagctctttagtttaattagatcccatttgtcaattttggcttttgttgccgttgcttttggtgttttagtcatgaagtccctgcccatgcctatgtcctgaatggtattgcctaggttttcttctagggtttttatggttttaggtctaacatttaagtctttaaatccatcttgaattaatttttgtataaggtgtaaggaagggagtcttgctctgttgcccaggctggagtgcagtggcgcgatctcggctcactgcaagctccgcctcctgggttcatgccattctcctgccccagcctccacgcccggctaatttttttgtatttttttagtggagatggggtttcgctgtgttagccaggatggtctcgatctcctgacctcatgatccacccacctcggcctcccaaagtgttgggattacaggcgtgagccactgtgcccggccttgtctgtgcttttgaggccttacacacaaaaaaaaattggcccagaccagtgtcctgaagagtttccccaatgtttaatttgaggttgtatatttaagtttttaatcagttttgatttaatttttgtgtattgtgagagattggggtctagtttcatttcattcttccacatagttaatccagctttcccagcagcatttattaaaaagactatcctttccccaaaatatgttctcggcacctttgtcaaagatgagttggtcataaatgcatggacttatatgtgggtctgtattatgttccattggtctatgtgtctatatttatgccagtaccatgctgtttgggttactatagctgtgtagtgtattttgaagtcaggtaatgtgatgcttccagctttgttctttttgcttaggattactttgctatttggagtcttttgtggtttcatataaagtttagtattattttttctatttctctgaagaatgtcgttggtattttgataaggattgcatggaatctcaaaattgctttgggtagtgttgtcattttaacaacattaattcttccagtacgtgagcatggaatacctttccattttttggtgacctcttctatttttttcatcagagttttatggtcttccttgcctagatctttcacttctttggttagattgattcctagtttgttttgttttgttttgttttttgtaaccattgtaaatgggattgcttttttgatttctttttcagattgttctttgacatatataaatgttattgacatttgtatgttgatttttgtatcctgcaactttactgaattttttttaccacttctaatagttttttggtggagtatttagggtttttttgatgtaagatcatgtcatctgagaacaaggctaatatgacttcttcctttccaatttggatactctttatctctttgtcttgcttaattgctgtggccaggacttccaatattatgttgaataatagtgggaaagtgggcatcatcatcttgttccagtctttagaggaaaggccttcaatttttccctgttggcttttattattttgaagtatgtccctcctatacctgttttgatgagggtttttttggttgttgttgttgttataaagggatgttgaattttattgaatgcttttctggcatccattgaaataatcatatggtttttgttcttgattctgttaatgtcatgtatcatgtctattgatacatatatgttgaatcattcttgcatctctgggatgaatcccacttgatcatgacaagtgatctttttaatgtgttgttgaattcagtttgctggatttttgcatctatgttcatattatatcaatatatcaaagtgtattggcctgtagttttctttttttgttggttccttgtatggttttggtatcagggtaatgctggcctctttggatgagtttggaagcattccctccttttcagtatttttgaagagtttgagtaaggttggtattagttttcttgaaatgtttggtagtatacagcagtgaatccatcaggtcttgggcacttctttgatgggaaactttttattatggctttgatcttgttacttatgattggtttgttgaggttttctatttcttcatggctcaatcatggtaggttgtctgtgtccaggaatctaaccattttttctaggtttttcaattagttttgcatatagtagtttataatattatttaatgattctttgtatttctaaggtttcagttatatctcctttttcatttcttatttttttatttggatctctctttcttagtctagctaaggtttgttgattttgtttatcttttcaaaaaatcagtttttcatttcattgatcttctgtggtttttgtttttggttttttgagacagagtctcactctgtcacccagtctggagtacagtggcgtgatcacagctcaccgcagccttgacctcctatgctcaagtgatcctcccacctcagcccttcaagtagctgggactataggcacgtgccaccacatctgactaattattgcattttttgtagagatggggtttcaccatgttgcccaggctggtcttgaactcctggactcaagtgatctgcctgccttggcctcccaaagtgctaggattacaggtatgagccaccgtgcctggcctcttctgtatttttttaaattccaatttcatttatttctgcttcgatctttatttctcttcttctgctaattttcggtttggtttattcttgatttttttttttttttttttttgacggagtctcgctttgtcacccaggctggagtgcaatggcgtgatctcggccactgcaacctccacctcccgggttgaagcaattctcccacctcagcctcccgagtagctgggactacaggtgtctgccaccatgcctggctaatttttgtatttttagtagaaatggggtttcaccatgttggccagactgctctcaaactcctgacctcaagtgatcctcctatcgtggcctcccaaagtgctgggattacaggcatgagccaccgtgcccagcctattcttgattttctagttcttcaaggtgcatcattagattatttgaactctttctacttttctaatatgggaatttattgctataaccttccctctcagtactacttttgctctgtctcatagattttggtatgttatattcccatgttcatttgtttcaataaatttttaaattttcttcttaatttcttcattgacccattggtgattgaagagtatgttacttaatttccatgtgtctgtgtattttccaaattccttttattattgatttctagttttattccatatggtcagaaaagatacttgtgatttgtatttttctgaatttgtttagacttgttttgtagcctaagatatggtctgttctggaaaatgtttcatgtgctggtgaaaagaatgtatattctgtagcaatagggtgaaatgttctataaatgtcagttaggcctattagatctagtgcgtagtttaattttactctttctttgttgattttctgtctagatgatttgtctattactagagtggcatgttaaagtcccctactattattgtattgtagtttatctatgaacctaacactggagccttcatgtatataaagcaagcattaactttatatacttgggggctccagtgttgggttcatagatattcataattgttatatcttcttgctgaattgccacctttatcattatatagtgaccctctttgtctttttttagtctttgatttgtagtctattttatctgatataagaatagatactcctgatcttttttagttttcagttacgtggaatatctttcagtctcagtctatgtgtatctttataagtgaaatggattccttgaaggcagcatatagttgggtcttatttctttatccattaagccacactatgcttcttaattggacaattgagaccatttacattcagtgtgattgtaaataagtatggacttactgcaaccattttattgcttgttttctccttgttttgagaattctcttttcctttttttgtttcttattgtcttcctttgtagttaagtgattatctctggtagtatattttaatttattgatgtttatttttagtgaatatattataggtttcatactatcattaccatgattcttgcaaaaaacatcttataaatataacaaattattgcagtccagcctgggcaatagagcgagactccgtctcaaaaaaaagaaatatatatatatatatatatatatacacatacatacatacatatatatatatatataacaaattattttaaagagatgacacttattttagatcacagacaaaagaatggaaacaaaggcaaaaaaaaattctacactttagcttcttctcccaacattttcacttttagttgtcaactgatatatttttatattacctatttcattttcacttttagttgtcaactgatatatttttatattacctatttcttaacaggttgctatagttattattgtttttgataaacttgtcttggaggcttcacactagagatatgaatggattgtacaccacagatacagtaatagattattctgtgtttgtctgtatacttaattttaccaatggtttttataccttgaacattttttctttgcacactggtattttgtattttcttccagattgaagaactccatttagcattttttgcaaggtggatctggtagtgatgaattgtctcagctttcatttgtctgggaaagactttatctctacttcttatttaaataacaattttttctggatacaaaacacttggatggcagggcttttttttccctttgggcactttgaaaatgccattccactcccttctgcctgcatggtttcattgagaagtctgtttccagatgaattggggcttctttatatgttatttgcttcttttctgtagctgattttagggtattctctttgtcattgacctttgtgagtttgattattatatgtcttgtatagattgaatctgtttggtggtctaagaccttcctgtacgtggatatttatatctttctcaagttttggaaagttttctgttgttatttctttgaataagttatttatcccttgttcttgctctgctccctcttaaacacaggaattcttacatttggtcttttgaggtactcttttatatcttataggcagtctttgttcctttttgttcttttgtcttttttctccgctgaatgtgtattttcaaacagctgatcttcaagcagaatttctatacatcaacattgttcaagctgagggccaaatcaagaatgcagtcccatttacaatagctgcaaaaagaataaaatatgtaagaatacagctaactcaggaggtaaaaaaaaatctctacaatgagaactacaaaacattactgaagaaaatcagagacaatacaaacaaatggagaaacagtccatgctcatggataggaagaattaatagtgttaaaatggccatactacccaaagcaatttacagattcaatgctattctcgtcaaactaccaacatcatttttcacagacttagaaaaaactattttaaaattcatatggaaccaaaaaaggactgaaaagttaaagcaatcttaagcaaaaagaacaaagtcagagtcatcacattacctgacttcaaactataccacaaggctactgtaaccaaaacaacatggtacaacacaaaaacagacatatagaccgatggaacagaatagagaatccagaaataaagctgcacccccaccatgtgatctttgacaaagtaaacaaaaataagcaatgaggaaaaaggcttcctgttcaataaatagtcttagaataactggctatccagatgcagaagaatgaaactggacccctacctatcaccatataaaaaaattaactcaaggtggattaaagtcctcaaaagtaatttcaacaaaaacaaaaattgacaagtgggacctaattaaactgaagagcttctacacaacaaaagaaactataaagggaataaacagatgatctatagaatgagagaaaatatctgcaaagtatgcatctgacaaagacctaatatccacaacctataaagaacttaaataaccccattaaaaagtgggcaaaggacatgaacacttttcaaaagaagacatacatgtggccaacaagcatatgaaaaaaaggctcaatatcactgatcattagggaaatgcaaatcaaatctacaatgagatgccatctcataccagtcagaatgtctattaagaagtaaaaaaaaaaacagatgctggcaaggttatggagaaaaaggaacgcttatgtgtctatatttacatcaatataactctgtactgattactatcgctttatagtaagttttaaaatcaattactatgtgatggttaatactgaatgtcaactcgattggattgaagggtacaaagtattgatcctgggtgtgtctgtgagggtgttgccaaaggagattaacatttgagtcagtggactgggaaaggcagacccacccttaatctgggtgggcacaatctaataagctgccagtgtggctagaatataagcaggcagaaaaatgtgaaaagagactggcctagcctcccagcctacatcttttttttttttttctttttttttgagatggagtctcactgtgtcacccagactggagtgtagtgttgcgatctcagctcactgcaacttccacatcctgggttcaagccatcttcctgcctcatcctcctgggtagataggactacaggcatgtaccaccatgcctggctaatttttgtatttttagtatggccaggctggtctcaaactcctgatctcaggtgattcacccacctcggcctcccaaagtgctgggattacaggtgtgagctaccatgcctggccccagcctacattttcccccatgctggatgccctcaaacactggactccaagttcttcagtttcggaactcagactagctctccttgctcctcagcctgcagacggcctattgagggaccttgtgatcatgtgaggtaatacttaataaactctcctttatatatatctattccattagttctgtccctctagagaactctaatacacacagtaagtcctccattttaaaatctttttcttgaaaatttcatatattgtatgtcctttaaatttccaaataaagtttgaaatcagttgtcaatttttacaaaaacatctgcttagatttttgagagagattgtgttgaatcatttaggcagaaatgccatcttaaaaatattgaattatccaaccattgaacatggtatatctctccatttaataggtttcatttaatttctctcagcaatattttgtaatccccagtgtacaggtcttgtgcttctttatttttactgtttattcctaagtattttatactttttgatactattgtacatgaattattttcttaaattttattttcactgttcatagctaactttaaaagttcaaagctaacttaaaaagatgtttagatctttcccatttttaaattagttgctttcttatggttgagtttttaaaatatttaaatagtcctttgtccagtatgtcttttgcaaatattttctcccagtctgtggtttgccttctcattcttatgatccacagagtattttaaaacttgctgttttactttcacatatcagggagtttcctagatttcctttttttggtgatttctactttaattctgttgtggttagagattatactttatttttaatgatatctttgttaagatatctttatatataaatatattatatataaataaattatatatctttatatatcatatcatttatatatcataagtgtacatttcagctcttaggatattcacaaagttgtgcatcacttcaaaaagaaaccctatattcattagcagtcactctcccagctggtggcaactactaaatctactttctgtccctacggatgtacctgttctggatatttcatatgaatgacatcttttgcttaatggatatctgcatatctttattagatatatgtctgttcaaattgttttcttagtttttaattggttatctgatttttttattgatgaattgtgtgtgtatgttttttttttaacttttctgatggtatcctttgaagaataaaagtttaaaattttgatggagtccatttgatcttcttttttcttcttttggtcatttgcatattggtgtcatagctaagaagccattgcttaatttggagaatgtgctttgtatgattttatgcctttttaatgtattaagagggtccatggctcagcatagggtctaaaatggaaatgttctatgtactcttgaaataatatacattctgctgttttagggaaatgttctataaatttcagtttggtcatattgtttcatagtgttgtttaaatattacatatcgctactggttttctatcaatttctggcaagagagtattaagatttctaacaattgctccattatctttttctgtgtcagtttttgctttgtatattttcaggctctgttgttaggtgcatatacatttataattgctatgtattccttctgctattagtttatccattctacctctctcatggttactgattacatggcactttttccaaccctttattttcaatatgcttgtttttcttaatttaaatagtcttttttggacagtgtactattggatcttgctttttatctactttgacagtttttgccttttgattgaagtgtttagttcactcacatgtaatgtaatttttggtatgacagatttatgttttttattttgccatttgctttctgtatttctcatgtctctttgttgttgttcctctgttcctcctttgctgttttctttgtgttaaaaaagtatacctttctatttcctctgtgttttttaactatttaagaattttttcttttagagataatagtatttatctttagtgtattacaatctatttcaagttgatatcgacttaaaacgtaacaactttgctttcccattttctttgtgctattattttcacatatattacatctaaatatgttataaacacaataatgcagtattataattattcctttaaataatcttacattcttagaaatgcaagaaaaaatattcatatatagtcttttatatttatccacataattactatttctgtgcctcttcattttttcttgtggattccagttaccgtttcctttcagctttagcattctcagtatggcaagtctactatctgaaaattctgttagtatttatctgggaaaatttttatttcaccttcactttttgaactttaatgagatagaattcacataccatataattcacccatttaaaatatataatttgttggtttttcatatatctataggtatgtaaatgatcaccacagtcaattttaaaacatttttatcaccttataaagaaccctcataccctttgctcttttttgtcactgttttaaggtagaaagtcatgttactgatttgagatctttcttctttctatttttaaaacatttttatttttgaaatggggtctttcagtgttgcgcaggctggtcttgaactactggcctcaagcagtcttcccacctcagcctccaaaagcattgggattatagccatgagccactgtgcctggcctcttctttcttaatataggtatttatatctataaattttcctctaagcactgctttagctgaaccccataatttgttatatgttgcgtcttcattttctttcatctcagttttttattttccttctgatttattaaacccatcaattatttaagagtgtgttgttaatttccacatatttgtgggttttttaaataactttcttgttattgatttctaatttattccattgtggttggagaacatacttcgtgttatttctgtccttttaaatttattgactttttttcccttatggcatagcatatggtctaatctggagaatgttttatgtagacttgagaagagtatataatctgcctttgtttgatagagtgttctgtagatgtctgttacgtctagttcatttataatgttgtttaagtcttctatttccttgttgatcttttgcctcattgttctctccattattgaaggtaggatattaaagtcttcaactgttgttgttcattatctgtttctccatttctgtctgttttttcttcatgtattttggtgctctgttgttagttgtatatatatttatagatgttgtatgttccttttttttttttttttttttttgagacagagtctcactctgtcacccaggctggaatgcagtggtgcaatcttggctactgtaacctctgcctcctgggttcaagtgattcttttgcctcagcctcctgagttactgggactacaggcatgcaccaccacgtctggctaatttttgtctttttagtagagatggggtttcactatgttggccaggctggtcttgaactcctgacctcaagtaatccgcccgcctcagcctcccaaattgctaggaatacaggcgtgagccgctgtgcccagccatatacatgttatatcttcctgatggattgaccctgttattcttagaaggtattcctctttagtaactttttaaagtctgatattaccatagccactaaaattttcctgttgttgctgtttgcagtatacatctttttccagcttttaattttaatctatttgtgtccttcaatctaaagtctgtcttctgtagacaacatataattgaatttttaaaaaatctagtctgacagctgctgccttttgattggattaagctgttcacatttaatgttattgatagttggatttatgccttccattttacttgttgttttctgtgtctgctttttgtttcttatgtgtttcatgtcttttttgtttctctgtttcttcattagtgctgtcttttgcattgagtatattttctaatatgatttataagactgtttgcattgttagaatacctgaggctacatagtttataaagaaaagaggtttatttggcttattgttctgcaggttgtacaagaaacatagtgccagcatctgcttctgttaaggaccttaggaagcctccaatcatggcagaaggctaagggagagcaaagatgtcacatagtaagggaaaaagagcaagagagagagaaggtggtgccaggttctttttaaaaatcagatattgtgggaatgaatacagcaagaactcacttattactgcaaggatggcaccaagctgatcatgagggatccacctccatgacccaaacatctccaacaaggccccacctccaacattgaggatcaaatttcaacatgaggtttggagggaacaaattccaaactatatcatgtagcatttttattaattattttttcactgaattttttgagttctttttttgactggtttctctaggacttgtcatatatattgtaacttgtcaaagtcagtgtcagattttttgtttgtttgtttggtagagatggggttttgccacgttgcccaggctggtctcgaactcctggactcaagcagtccccccgccagccttccaaagtgctaggattacaggcgtgagccactgtgcccagcagcttgagatttataccagcttaatgccaataacatatgaaaatgttactcctatacatctgtatttcctttctcgtaatgatatttttgttatacatattctatctattaatattactaacccaagaaaatattgttataattattactttaccatctctaggcatttccttaactcattacaactttggccccacctacctactatatgctgttattggaaaatatttacaccaaatgtaaatagaaatatattacatttctatgttataggccaaacattactttctattctataaatattattctatataattgctttttaaatcacttgctttcagcctgatgaacttgcttttatatttattgtaaggcagttctggtagcaatatattttgtgagtttttgtttatctagtgaagtttttatttttcctttatttttgaacattcactttgctggatttaggatttatgattaacaatttttaaatttctttgagtactttgagtatgttctctcactgccttctggcatctgtttctactgagaagtcagctgttaatattatttgggttcccttgtaagtgacctgatatttttctcttgttgcttccgagattttgtctttgactttcagcatttttactatgatgtttctgtttgtgggtctctttgcatttatcctacttggagtttttttagcttcctggatgtgttggttgtttttcaagaaatttgggaagttgttagctattatttctttgaatatttttcttttcctttttcttttcttcttacagtacttccattatgagtatgttggtatgcttaatggtgttccgcatctctcttaggctctgttcatttttcttaattatttcttctctttgttcttcagcttgcataatctgtattgatatatcttcaagtttgctaattctttcttctgccatttcacagctactgttgagccctgtattagttttctggggctcccataatgaggtaccacaaagtagcttaaaaaacaaattttgtggctgggcgccgtggctcactcttgtaatcccagcacttcaagaggctaaggcgggtgaatcacctgagatcaggagttcaagaccagcctggctaatatggtgaaactaaaaatacaaaaaaattagccaggcatggtggcgcacacctgtagtcccagctactcaagaggctgaggcaggagaatcgcttgaacccaggaggcggaggctgcagtgagctgagatcgtgccactgtactccagcctgggtgacagagtgagactccatctcaaaaaaaaacccaaattttgttttgttttgttttacagtttgggaacctagaagtcagaaatgaagatattggcaaggttgacttcttatgagggtcgtgaaggaaggatctgttctaggcctctctcctttgttgtagttggccatcttcatgttcacatgacattctccctgtttgcgtgcctgtctccacatttccctcttttataaagacactagtcatattagatttagacctaccttgaggttttcattgtaccttaatttcctttttaaagactccatctccaaataaagttatattttgatgtactggtagacagaacttcagcatatgaaatttggagggatacaattcaacccatagcaagcctctctagtgaatttctaatttcagtcattgtactttttaattccataatttccattatagtctttttttttgagatggagtctcgctgtgttgcccatgctggagtgcagtagcgcaatctcagctcactgcaaccttcacctcctgggttcaagcaattctcctgccccaggaaaaaaaatctgtgtgcagaataaccagatgtcagatttaagagaaaaagatttcaaactagccattataaatatgctcacagtactaaaaggacagcatgattgcggaagtaaagcagggtaagaggacaatgtcatgtcaaatagagaatatccataaagggagaaataatgaaaaggaatacaggccggatgcagtggcttatgcctgtatcccagcatcctgacatctggtcactctgcaggcagtttttttttttttttcctttagggggtatgggtcatacttttcccatttctttgcatgtcccttaattttttggttggaaactgggcattctagataatatggtagcaaactctgtgtgctagtccccacccaccctctttcctggggcttgttattgttatttatttgtttagttttttagtaatggattggattattttaatgaagtctatccccgcccccctctcccccatagtggtaaacctctaatgttgctcctcagggaggcaccttttccttgaacatctagtatttgtttgtttgaaaactggacagttttgtatgtattatagcaactctgcatacttttttcctgttttgttgttttttatattttttacattacttgcctagcctacagaatttgtctccttgtgttgtacatttattgatgtctgtgctttgtttgtgttttagtctcattttcattgtttaggtttgattcctaaggactctttttagtgtctacatatgtcagccaaagatttgggctgaggttctgctaatgcaccttcagcccataaagtttgtactatctgctaatcaatctgtgggttagttggggaatgcatttgaagttgtgggcatttattaatttttccttggtcttttctttttaccaactctctgatgttccccacacatatgtaattttctagtcagccaggaatttgtggagaacttatgtgaatccatttatggctttcttatttccaagctctccctgttaagtttctggttggtccactgcttgcctcaacttggtttgcaacctcagtcttgcaaaactgcaagttttctctatccatgtccaccaagtccattactttcagccagtagagctataggcttttgcctctcattgaattgattttggcaccctggcatgaaactacaagtataccagctacaggatggcaaaactacaaacctcattgactgaactgggggcaggggtgatggaggcagttctaggcaaggctattcctgcctgaagcactggcagtttttcaacaatcaacaattctcaataaacagtttccagtggcctgaaatggttggtctttttggataattttgttcagttttatgtattttttttttgtggaggggaattactgacctcttcatactgttattattttaatggtgttttgagtaccaaaattgatagatcttatgaaagaagtggcttcattattcgtcagattatatcaaatgctttccacacaatggtgcttcattataagtctaatacaaatggttaccaatcttttcattccaccattattggaagttactcttgctgtgcattttgtgattaatccttactatatcttgagacatgataaagtaggttaatacaaaagcctatttttgaaacagtgtgataaaattaattaatgtagacattgttggaaatggataagttgcacaattacatattatttttttctcagttttttgacagtgtagtataggtaaatatgtcttcagaaatccttaatatacttattaattaactagatcataactgaatttcataaatattgttttcttaaaaatgcattatatgggattacttttgtatctaagtaagacattaaacctataagctaaataaggactatatcaataaacttgtttaaatgaagatttggaatttccgtatagaaaaattcattacaacaaagtagaaagataaacaacaaactggattaaaagtatttaagtcgcctgtaatcccagcactttgggaggccgaggtgggtggatcacttgagcctaggagttcaagaccagcctgggcaatatggcaaaaccccgtctttactaaaaatacaaaaattagccaggtgtggtggcacgcacctgtaatcccagctacttaggaggctgaggcaggagcattgcttgaacccaggaggcggaggctgcagtgagcaaaagttgcgctgctgcactccagcctggttaactgaatgagagtgtctcaaaaaaaaaaagtatttgaatcacttttgattggacagtaggctaatttctttgatatgtagaaatcttacaaattgactaaaagcaggataaataatcattacaaaaaatgggccaaagaatatgaacaggcaagttacagaggaagaagtataaatgaatattaaacatgaaaagatgctcaggcatctaaagaaattcattttaaaccacctataaaatcctattttctgttagattgaaatagtaatacccagtattaatgaagctgatggagaaaatgagctctccttgttattattgctttggaaacatctatcagaatttaaaatacaaatgccatattccctagaaattgaaagtacacaaaagatatgcaaactgaagaatattcattgctgcattttttatagcagaaaaaaattagaagccacctaaatgttcattaatggagagcttatagacctccgtccagttgtatgagatgaatctgtatatggtaacacagaaagagattcatgatatgttacactttttaaaaagcaagctgttcctttattatgtctgattatgttcgtgtgtgagtagaaaatatcagggaggacatgcacaattctctgtaaaatgacgagttttgaggattgcagttgggaggtgatgggaggacatggatgagggagtatcatgtttccaaattgcttaccttatgttttataataagcatgtatttaaatttatattaaaagaaaaatataatatctactaaatttgtaaattaagaattatattaataaatgaactatagcaaatttttctggtttgttttctatttaggtatggaaatttgaatattaatttatagatggcaaagggagtgcttttttacattacagactgtgcataagtaaatgatttcactcttaagatttgaaacatctttcaaactcataacctgaatgaatgaaaaatgtattatatatattgagcatattaaaatatttttatggtctgggcgcggtggctcacgcctgtaatcccagcactttgggaggccgaggtggctggatcacaaggtcaggagatcgagacgatcctggccaacatggtgaaaccccgtctctactaaaaatacaaaaattagccaggcgtggtggcacatgcctgtaatcccagctacttgggaggctgaggcaggagaatcacttgaaccagggagtcggaggttgcggtgagccgagatcgtgccattgcactccggtctggtgacagagtgagactccatctcaaaaaaaaaagaaaaaaaaagtatttttattactgagagagaaagaaaagatttattagtcatcaaatccacatcatattaaaaatttatgttattagcatattttatttaaaattatgttgggttcaaaccaggcacagtggctcacacctgtaatcccagcactttgggaggccaagatgggaggataacttgaggccaggagcttaagactagctgggccacatagcatgaccctgtctctataaaaattttaaaaattagcctggtgtagtggcatgcacctgtaatcacaaggctgaagtgggaggatcccttggcccaggtgttcgagactaaggcaagctgtgatcactccactgcactctggcctgggtgacagagcgagaccctgtcttttaagttaaaaaaaagttggtccagaaatatgaatttaattaaactggattaaacaaaaatctttatattataccaaaggcattttgaatctatgaaaagagacagtaaaaaaattttctaaaaagcaatagatagcaaggtttttcaatatttatatctcaaaatatttgttttaagtctttttatggaggttatcttgtaataaatatatctgtagtttttcttttaattttataatattttaagtatacatttatgaaaattatagattaaaatacgaattatatgtgtataagtttattttacattatggaatccaattttatcacaggtttcgtcttgatatatatcgatgtttggccagtccagctctaataatgttaacagaggaggatccaattctgagagcatttgaacttagtgctgatttaaaagaactaagtcttgtggaggtggaattcaggtgggaatgaatgcaaattatataatgtattttgttttaaatcttcaacctcagtttcttcattacccaaattataatttgtatatatttacatttgatccaagaacactacaccttgttgccacttacttggcaacagacccctgctctccctcaaaggaacagaccctggtgctacttaagtcattccttccccatctgccctctgccaccctataaacacctttaatctcttccccacttttcaacctaaccaaaggcattgtagagcagtatgaaatacagtaggattatagcctaaagcaggagcaaatttattcatagttgctctctctctcacacatatctcctcattctctgactctataatcatccttgagtaatgatccttcagatctttcaaaagcatatggaatgctttctgtatgtcaaggacattccacacacagacatagtcccttttcactatttgctcagattttctggtaagagaaataatatatgtaatacatgtaaacataaaaataaaatacaactaattaagagggatgaacacccagtctgagttctcttctgaaatgaagattaaatgtaattttggcacttggcataccaaagaagcactcctattattttcctttaggggggtaagttgaaaaaaaaaaagactttgtaatagcagcctatgaaactactaatttaaatattgtttttaaaaaaatccttagaaaactacttttattaatagtagagttgagagaaagcgttgagattttcctttatggaaaagtatccctgttgccctctaaagaaggaggaattgattacgattttttactagcccctgttgcaaggtttctactggggatctataactattcctaccttttctttcctatacggctgctattagagccccatgtcttgtgtgacactctttcagtgacttgacaaaattgggaaagttcaaatttctacttcctggaagggcagtaagaaacttggagttttctttagctttaacagcagtacttaatgtgttcttcatagacctgagttccagaaactgaaaaaagacctgtttatattttcaagtttggaactactgtcttgtaacttggataatttaaattttgtttaaacttgatatgacatgaagtatgtactttactttgatgaacacacaaaacatggttcaaatgtaacttgttgctacttttaactttattagcacatgaggctgttaaattattctgtttaaatatgaaaaacttcctattgtaacctcataatttgagtctgagttatataaaataaaacttactcaactcctttcaaacaggatttgaagaaactgctatgattatataatcataaaataataaagttagatttggaagcgatcatagaaacccatttacttcaatccagtgttttatagacaggggaggagatttataaaggctagatttttactaatagcagcatctaattaggaatagagttaaaactaaaagtaggagcaaagttataactagaatatatgactccttgcttctggttttctatatttccatctaaactatacagccacttatttgtcttcagtaatctattagaaatgaattagattaataagatgtataaatttcacctttgaatctcgtagtccatcaaatgtttatccaaagatggaatatttttgtaataatatatacttctgataaacattccagtctgcagttagattcctaaatcaagaagcagggagtgccgcatttgttaaataaatccaattacttattttcaggagttttgactacatagaatgtataaagaatgatgagagaaattaaggcaaagaagtttttattcttaagttatgatttttatatagccagttcctggaaagccccattatatagaaagactaaccagtgggaaatcttcctgtttccccttcctttcagtttgggaaaaaactgaataaaaacattattttctgaagcccaacctcaagactatgactcataattatttatttctgacttcattcttaagttatgattaagcttagacataaagttaatgtaattgatttttttttttttttttttttggagacccaggctggagggcagtggcaccattttggctcactgcaacctcccctcctgggttcaagcaattctccctgcctcagcctcctgagtagctgggattacaggcacctgccaccatgcctgactaatttttgtattttttagtagagacagggttttgccatgttggccaggctggtcttgaactcctgacctcaggtgatcacccgccttggcctcccaaagtgctggcattacaggcctgagccaccgcacccagccgtaattgatattttttaaaagaattatatactaaaacttcttcatttctcacaaattagtttaggcctgcctttaataagcagttcaaacccaagattcaaggaatagggattctgaaagagaggtttttgttaggcgcattttaatatctttctttctaatttgaatttcactcaaatgagcactttaaatatgaatcaaaatgctattttaatattagaagtaacataaacatattgtagatgactattgaaaaagctctagttaaaaattttatgataatgattggatagcattaagatattatgtctattgttaaggtgagtaatataaaaggaagttttagccaagcttacagagaataagggaaaatgagttaagcgaagaactggttgacaaatattattagaatttttaggaataacatcagtatatataaatgaacactgtgctcatctaagattattagtatgaacacagggaacataattgtgttatggttttccccaaagctgtggaaaattcgtgcatcactagtttcctttgattatccacagaaaatgacttcagattttgtgtaacactgtcagaattaaaatgttgctgagtaaaaacgtttttagtgaatatagcttaattagaagatggaaacgacgtttctgataatagaatgctgcattttataggaatgattatgaggaactagcccggcaatgtaaaatgtttgctaaggatttacttgcacaagcccggaattctcgtgaattggaagttattctaaaccatacgtctagtgacgagcctcttgacaaacggggattattagaagaaagaatgaatttaagtcgtctaaaacttgctatcaaatataaccagaaagaggtatgaggctttctgtaatatatttaaattattttctctacagtagtctagtggctcagggcaaaggctttggagtaactcatctgggttaagatcctagttctgcttcctaaaaattgtgtgtcttgggatagttattgaatctgtttgagcttttgttttaataattaattaagaatatatactaaaagggtttagcacagtaagtattagcattaagcaagtatgcaataaatggtagtttttattatttttagtaatattgattataattataacatggatgttgatttaatgtttttgctaaatagttgctacacaggtaagatcctttgtagtaggtacaaactttatagtgaagtttccatcttgtgttttgtctgtcacaggttggttttcattgatctggttataaatagccccttctatagtaatagtgatttctatttaaaaataaagtatcagatactatatttcctgattcctcttatttataattcattgtgaaactcaaaagtggagaggtacatgatatgataactaagttgaatctgacttttctggcatcatccctttctattaagagatatgcccatttctactccccatgcatacatatacatatgatccaggaacttgaatcaggaaaatatgcattttaaatttcatttttgagataattaactaaacagtgatattcatatgtagataataataatatctaattgatagtatgggatgttgataaatggtatttattaggtattacttctaagactattttcattgttaacatagatgtttaaataaaacttgcttatcaaatttatattattacaaaaatagggcctgaaatatataatgatagaaggccagatacaggacctttggtgctaagggcagaattttttcttaccttggttaaaaatttgagcctcacaaagttattaggaaattgatggaggaattgatggaggatgtttattggttaatatatttgcttctgtgttccacaacctaaaagggacatgaagtcctagaaaatgatagaataaggggattacatggtataaaatcaattaaagtgatttaaaaaaagaacctcaaagaaaggcgtaaagaactaaaattatcctgtttaggaaaaaaaatcttaagaggtaattttctaatgatagctatatccctgaaggactcacagagtggagtccaaatggaaccaaatgtaccattctaaagaagatgaaagaaaagacaagaagtagtagtaatatttgttagttgaaaggaagatattttgcgattttaaagatgaatgaaaatgtaaagtagtttttaaaactagatttctaaatacgatcagtggggaagatattttctcaaatagttggtaagctttgtttaggttatcaatcttgaatagcaaactactctgaaacttagtggcataaaacacttcatagttattttataataatttcataatcattttattatgctcttggattcttaggtcaggaattaggaaagggcatggcaatcatgatttttctctgcttctccgtgtctgggaactcatctggagataaatgacagggctataatcagctgggggcttctccactcacatgtctggtgtctgagcagcagctgaggcctcaggaacagggtgctcagatgggtgagtccacagaaggtggggctcctgagaactcacaacaggaaccaaggagaggcatggccatcacaatgggcagactttgaggatgtggtctgagaagcctctgcgggctggctggggtacatacatgtgacctctgtgtgcagcctgggcttcctcacagcatggtggcttcagagtggctttttacatggtagttcatggctccaagagcaggtgttccagtgagcaaggtggaagatgcgtagccttttaggacctaccttcagaagtcacatagcatcacctctgttagaatctactagttaaatcaatcacaagcctgttgaattgaagagtaggaaattttgacttcctccttccccacctcttgatgatgggaagaaagcgtgtccatctttcactgcagacttagaacatttctagttaaactttttattccaaatacatagttaacattactgcaaattaaattgtcattgtatagagggatagcaaggacagtaatcagtcctgagattgctttgatatttggaggaaaggtgacactactaaatttgagatttactaaacctggtcattggtgagaggaaaagctgtttctctcccaggcatttcaccttgagggacaaattaagatttcccaagaacattggaatctgagcagaagagtaaagaatgaagtattgccaaaaataagtatttgcatataacatacacacatcttcccatatactttaaagtatctttcaattacttataacacctaatacagtgcctacacatcatttcattcatgtggattcaacatagtacttgctgtgaagaatattcaagttttgcttatttggaactttgtgaattttttcttccaaatattgttgatccatggttggtttaatccacagatgtaggacacagagatacagagggccaactctacagtatactagaaattttcttgaaagcacaataaacaacaaaactctgtccaattctttttttcactacagtgttaattctacaaattatattctgttttgggataaatcattttaaaacagaaggttgaccaaatattattgtggattacctgaataatgtcattttataataatttcaaacctgatcacatgagtatatatagaattatcaggacccttaagttatacttcacaacatgagcattatattggaaaaatattgcctatgaaatttgtcaactaagaagatttgtaaactttggtaaattagtttctgtacctgaactaaaatttttctcatatttgggaatatttttcctttcttctcacatgaaattcagttttaatcaggcttaagagtgtctttaataccttttaagaaatccgcagtgctttcttggagcaagaataggtctaatatttagctttttattgtttttgctatcttgacttcttggcttctggtaactaaaatcaatagtttctctagactgaagatgtccaacattagttagtggtatctttttctatggattgtgcatgataactttgaaatttcataaatattattatgagtttttatatattaaacatgaaaaaatggctaagtaagctaataataatagttaatacttatagagtgcatgctatgaaccaggcgctattctgagggctttacctttaatcttcacaactttattagtagatactattattattcccattttacagatggggaagttgaggcttagagaaatttaaaaacttgttaaaggtcatttaccaagtagcagagcccagatttgaatctaggtaatctggctccatagtctatcctcttaacctctacatgcttttattgttagaaaaagggaaaaaacaaaactatgttgaatgtatagaattgatttttaaactcttattcagtaaactttgaatatcaaccaatcagtatttaaaggtttccttttactttttttctttttaatgtgtgtgtatgtccttttcagtttgtctcccagtctaactgccagcagttcctgaacactgtttggtttggacagatgtcgggttaccgacgcaagcccacctgtaagaagataatgactgttttgacagtaggcatcttttggccagttttgtcactttgttatttgatagctcccaaatctcagtttggcagaatcattcacacaccttttatgaaatttatcattcatggagcatcatatttcacatttctgctgttgcttaatctatactctcttgtctacaatgaggataagaaaaacacaatggggccagcccttgaaagaatagactatcttcttattctgtggattattggtaagtatcaagttagtttgaaaggttttgtctttatttagcccactgattctttcttgattgatggcattgtgaatattgggttcaatttgcaattttacactgttcacaccacaagaatttgaacacttccatgatcactgaagacttaactaacatgtctgtaaagataaatgttcctgaacttgatgataaggaagcatctctcttatttaatatttcttaaatacatggaattttaaaattatttattctcagactctatggttattcatgattgtaaaacagaaaatcagctttaacacatgaatgcttttttggtgtaagaatatgaagttttcttaggtattttgaaacaatctattttatactgttgtgcatttttaaagttaactattctatttcatttataacattagttttccttttaagaacctatgagctttttggtttttgttttgttttgttttgttttgtttgagacagagtctcgctctgtcgcccaggctggagtgcaatggcacagtcttggcttactgcaacctccgcctcccgggttcaaacgattctcctgccttagcctcccagtagctgggattacaggtgcgtgccaccacacctggctaatttttgtatttttagtagagatggggtttcacttcattggccaggctggtctcgaactcctgacttcgtaatcctcctgcctcagcctcccaaagtgctgggattataggcctgagccaccgtgcccggcctagaacctatgaacttttgcagatatatcttgctttatctctattttggaaacattgtttaaatttagatttaaaggagtccctggtgactcattccataaatcatttctttgtagagatagccagatctctttagaaatgatagttttttaaaaagtataagacattttattcctgaaaattatttttataagtattacactgtataataaatgtcttaaatcatcttctacaatttttactcgtcttgccttctgtgtgtcggggtgcgtgtggagagttgaggtagaatcacattatctgtttatggtattttaaagatattttctttatttccctctgtatcttctaccttgtttttaacctcagcacttcccatctgtccgtctactatttgctatagagtaaaagggtaataaaatttagtcttatctatggcacaaagtactgagtgtatttatcttttgattactacattcctgattgtttcaattatttagtactttcataagttatttcacaatgttcaattttagctctttagctatacaaatactttttatattttagaatgtttatttgaaaatcagttaatttcaggtaactagattgtaattagagttttgcttttaacagtatttaatctatgatgcattaatgtttaaaattaggtagataaaataatacacatctaaactctaggttaaagagaattaaataattccttcttgttaatatttttatttcctgtagttttgctcttatctaaaatttaatcttttaatttaggaaataatttaaactttaccatatatggttttatattggactgtgggactctttcaatgtgaaatatgtttgtattgctagttgagtagttaaaaaattcctggaagaattttacacattagtttgaagagaatcgctaaggagcactttccctatattcatttaaactatttctgattgttatatattccttagtcttaaacagatgaaattttataacatttatctataacctattgtttagtagtaagaaagaatattttctgtgttttgttagatttagtttaccccagtctgtataagaatcaaattaaagtttatatgtcttagcaatgagtaaaaactcaccgaactaaaatagtcataccactctttgaatagcataaatattactgctgtccccgattttcataataatggtaaaactatagctcttcccttttatatgatgctgttttcaatgatattacacgtatatatacatgggtacccccttacacacataatatgattaattttctaaccatattctacctcactagaagaatgcatgtgcattaagccagtaaaattcctggaagtatcttcctttcctcagcacagcttctgctttgaaacagtttgatctgaataagccttgccaaggaagtcttcttaagccttttatgtaattaggtcactctgggctttttttcagtatatagatccaaaccggctctaagtgagcatggaggaatattttgcttgcttgcctaaataaagtcattgcttggttcaacttactatttcaagcaatgaacacagtgactttttaactcatcatgaccaatttttgtatatttgttttgtttgctttcattagcttttcagaaaaaagtaaggttaggttataaaaagcaaggtaggtaaaaagagaataatttgttgaggaatgcacagaatattaatggtatccttttacttaatttttgctattaaacataatagaatggctattatagaaatgtattttttaaatgtcatgtacctactttgtctaagcacaggcaaaagcagatatggcccatacactcgtgaagcttatgatctaataaaagccaaataaaaccatcaaaaacttgacttgagaatcatatggaaaaatgaaaactcaaaaatggattaagtgctattggttaaagatcatagtgttaggagagtaagcatattataggggcatttgccctagtcagggaggttgggaaagacacgttgaggaagtaataagtgagctaagatctaaaagataaatagatgtcaactgagagaactgggagaggaagctactctaggctgagataaaagcacattcagaagctcagtggcaagagagagaatggtacaaagaagggtctgagtaaaggctaacatttctggagcagggagaaccaggagagcttgattcaagatgaagctacagaaacatattgtaccagaccatgcatggccttgtaggtcaggttaagtaattttgactttatattaagaacaaggggaaaccattgcctacctgaagtaggcaagtgacatgatcagttttgcctttcgaaaagatcattctatctacagggtggaggatgagctgggaggatagtgctgtggcaggagtagatggagggagaccaatatcgatgctgttgcactaatccagatgagagctgatggcaccttggacttagggtgattgtgatagagaaagagagaagggaacagacttcagagatatttataatgtaaggccagtaggacatcgaaatacatagtatatgagaggtgaaggaaagggagattattaagcaatattggtcttttggaagagtactaggcttggggatttgtgtgttgaggggtagatcctgagtacagtttcggatatgttgagtttgaaaagcctttgagatattttttaaatatcccttttagggatgtcaagcagacagttggtctggagcttgagttagaaaggtatgcatatctgaaaataggtggtatatgaaactataggcataggtgagacacaaggagaaagataaattgagaaaaagagaggacctaagatcaagcccttgagaaatcccaagatggctgggattgctgccttctaatgttattattaacattaattctaaaaaaaatagaccctaaaatatagaatgttggttatgtagtgtttgtattgcttggattagtttcaacttactatgttctttgtgatccagcttggaaacatgcaatacatcaagtgtattagcttcatttttgtgggggtattgcagaggagctgggaaactaaccaattggtcttcactgtactttcatgtctgtcttttttgatcaacagttttctccaattcatgttgtaagtttttgttaagagtttcttttaggtaaaatattgcatttcacagaaataaacacatttctgtaaacatctttcttagtttgatgttttaaatattaacaggagtgtatctaaagtttaaatataagggtttttgtttgaagatgtttcataaataaggattcgcacacatcaggatctagaattagacaataattttgagtcttcaagaaagtatggtcatggaggatttgtttaatatgtttctgctccacagctctgagtggtaggtgaaggttgaacatgagaaatatcagaaagctttcatccctactccttccccaaataaaacagtatttgagttaataaaatgttacctgctagactatttcattttacatttttagacagttttcatctattcattttgagtaaaaacatactaaggtggaattgttaaaaatgtttttcctgtcaaatctgcaaatgttttaaacactttttttctgtataaaatatgggtactgcataattaagatgttttgaacagagatcttcaagaatgtttcttgtgtttcccaggggaattattttgcctactgataagccagagaatgattctgattggcctaatttgatctccacccatgtgtgatgctacagcactctattcttttgttactctgtagtctccccgaaaatgacttaatgaaggaatgtaccataaaatgatcctgaattatgttactgaagtctggtacccataaaaatatatagttatagaggagcttctggccaaaaaacggaaagtttttctgtttgtttgctttggtttttatttttgtatatttattcatttggcaatattttttagcaccttgtttgtatcaggtacttttcaggacatttggaaacatcggtaaataaaacaaagattcttacccttgaagagcttacccaaagtgggggaaagataatcaattaataatagacctaataagtaaattatattcagtgttagaaaagagataagtaatacaaaagaaaggtaaaagcagagttaggagaattgggagtgggggacaattttaaagttgcaaagagtttgcaattttaaatagggtagtcaggaagggtgatgagcaaagacatgaaaaagtgaggtagttagtcaaatggatctctgggtgaggagggtccagccagaaggaagagccagtataaaggccctaaaggcaggagtcatgtgttcaaagaacagcaaggaagcaaggaggccagcgcgactagaatagtacaaggaaagattagtaggagatgaggtcagagaggataggtaatttggagacttgcaggccattgtaaagactggttttgattctgagtaaaatgggatttaagggagggtgcagtgcccactatgcacaatgagcagcagtggttttgcatttttttgacatttgcactcacagaacaaaacaggctgaaacctggtactaggtttacttaaatttgtagaagtaaaagatttgaacttaaatatataaacttgagagcctttgccatgtagatgatatttaaagccattagattgggtgagatcattaaagtagtaagtataggtagagaaaagaaaaggatcagggactgagccccttgtgcgggggtgtgtacgtgtgtgcgtgcacatccatgtgtgtatccgtgtgtgtctccgtgtatgtttgtatccctgtgtatgcatccatgtgcatgcatccgtgtgtgtgtgtttgtgcccatgtgtgtttggcattaatttatttggtttcttacgtttgttccacatccaaagatgaaacttaaggttattttcttcaagtcgtatgaaagttaaggttattttctttcagattttaagaacttttcactaaaatgtttttggttttgtttttttttcttttgaataaggcccaaggattatttatttaatattttgagtcttaaagtattatttagtttatttattgaattaagaaagtgttatctgatttttttcttccttttctcagggatgatttggtcagacattaaaagactctggtatgaagggttggaagactttttagaagaatctcgtaatcaactcagttttgtcatgaattctctttatttggcaacctttgccctcaaagtggttgctcacaacaaggtgactatttactatgtcaattgaaggcacaaattaagtttattttggaaatagctaagatatttagctatgtaactcagagttacattgagccagatcagtgtctggtgtgttttcattttaagcctatctgtgtgcacatagtttcctatttttccagtagtttacaggtgttacttacctttacatgatggttatttattatataacagggaccatagttcacatttggtatactttatctctttttatctacactgggattctttgagactgaagtccttatttccttattcccattttgcaagtaagaaaaatgaagcctaaaaatattaaacaacttgtccgaaaccacacaataggaaaccaagactggatttaaatcctgccctgtctaggcattttctttctactagatgccaattccttatatctgacctaggttcttttagcttattaacctgtatatacttaaaatgagaacaaagtaacttaaaatgattagtgttagatatctttatatctgccagaaaaagagtttccattccattccatttcataatgaatgaaattggttatgtaatattttacacatttcaaatcatgattaacagctttaaaagtgatgtaaatgttattatttttctaataactatatatttttatttagaatttgacaaaaatctacccttatagataacttacaattttactttcatcagaatttaagctcccccaagcccagaaagggtaacaaattgtgtgttaactatctttgtttaaaccctgagtttagaattcttctggggtgtcacattcaaggaactaaaatatataatattctctgttttttattagttcttagattattgaaaaggcaagctcattattttacataattttactttattaaaaaattctgtttaattgatcagtagtatggaatatgttaggtacgttcagtgtctagagtgtgaaattactaagaaaatgaaaattggtcatatatagataaatggtttgataaagggattgagagacattgctttttcagattgatctctttcgttctataagtggagtacccatataattttttatccaaatcaggacattttgagagtgaaagggggcactattaataattatgccaggacaactggtacagcatcttaaactatcccaggcaatggggacaattgaccactgtgtctaggtacaataatgccctcttttttattttgtatttaaaaggggggaaaaaaactctgaattccaagtcaaagcagtaggttaatgtaatatgatagggaattaattgacagcacatgtacttaacgtttgtgttgtggaatttaagaaaactagccaacatttcattaataaaaagcttaatgatcatttaaaaaattatttaattttctaaaatttaagagtttctggaaaaacctcttcatatagagtgataatgcctcacatacataataatattttatttcattaaaatattatttctatttttaaaaaaccctataaaacataagtggagatcccctataagaagacaaaattaaaatggctttctttcaacagtcagaatatttgcttttattttcctaaattgagagagcttatttacctttggctttttcttcctaaccttagtttcatgattttgctgatcggaaggattgggatgcattccatcctacactggtggcagaagggctttttgcatttgcaaatgttctaagttatcttcgtctcttttttatgtatacaaccagctctatcttgggtccattacaggtaaataattaaaatttcttaaagaacattttttagatgtcattattgttacatctttctccttgtccagtggaatactgttctctcatgatattaaagctaaactttgctcttgagaataagtagcaattagaaggacacagcatgtttatctactttgcttctggctcagtgataatcctttgctttcaggtattccaagttaattatgctgtggtccattagcctcctccccccacttcatagacatagatatgtttaaaatataattacacttcagacagtagagtaacataaaaatctgctttttatcaaaatgaatctcacatttaaagttttaaatattttaggttataagtataaaggaggacctgtgcaaacaaaaataatcatatttgatgatttttgaataagctggatttaaaagaatacttacactttcgtttaataaatattaaatgtaataagttggaaagtagcatacttagagctaaaaaatttacagaggctatgtagttcagctttatattttataatactttatagttaaagaaattgagcttttgagatgggatttgatttgtccaaagtagtatgattattatgtatgagagttcaagactaaattctcagtctctttgcaccaaagaaaagactcataattggttgcatttaccccacagaatttagtaactggttttcagaaggtggggtcaactctgctagctctatgtaatactatagcttattatttctgaaaatctgaacaatattcatttttccttaagtcaaaatttactaacaatttagattgtctcatatttttaaaggtgatattttaaataaaaggcataattaccttctccaaacagggatatgaaaataaaatatataggaaaaacctgatttgattaggcttgtgctgtcatccagcaacagtgtttcctgaagtgtggctctcttaaccaagtcctgtgagatgctctgaattaagtaagtttgggacacactgtatactgtatacctcttgggaattgacagtgcatgttatcacattaaagcctctgagaaaaaaatttgtttaaccttgttcaaatcatcattacctaaagtcatttaacctcatacctgtttttcatgaaatatgtgcaagtctctgtatttttccaaaacacagtaagccatagaaacactggcttaaactatctgtccttttgatttatttttgccactaatatcatctacgaatgctttaatcaagagtctacagtgtttttacatgcacattgatttttttttaactgaaaatggacgacagaactaggtttctatactggaaatttctttatggactcctataaagggttaaaaaggagaaagtataatattttttaggaatgaagagtcaatttctgacttctgtttccagccaacatggagtaataaggattggatttacccttctatctaaagcaatcaaaaaggaaaaaagaacaaaatatatgaaacaacagcttataagaaactagatatcaggcagtaaacaacagtgatctctaagaaacaagaaacaaagatcactccagcttactgctttgtgagaatttttaggctattgtgcagagtgggtcagtgcagtcagagcctggcagaattctggatttagcagcacagaaagaaaattctggagatctgcagttgtctcccttgagtattcagcagagtactgattagcatatgcatgtgaggacactacctcgggcagggaaagaaccatctcatccgacgggattagaagaatactcagaagggtcttgcctcaatagttatctcaagcctacacactgctctagtttcaacgaacaaatattaaaagcaagatgtgaaaggattaaattttttccaagtaacttaaatgtgttcattaaaacctatccaaaagcaacacagatgttagagttatcagataaggactcttcagcagttattattattgtgttccatatgtacaaaaagtttaaagtttagtagagacatggaagatgtaaaaaaaagaaaaaaacaccaaattaaactttcagagatgaaattttcactgtgacctgaaacatgcactggatgtgattaatgacaggttagaccttgtagaaaaacacattagtaaactcgaataggtaacaatagaaactattcaaaataaaatggagaagaaagaatttttaaaaatgaaaagagtatctgtgaactttgggacaacttcaggtggcctaatattaatactaatgtaattggaatccctgaaaaaaggagagaccaaaaaaattttttaagaaataatagcagacattttccaaatttgaagaaaactataaacccacatccaagaagttcaataaacctgcaaacacaagaaacatgaggaaaatcacaccaagggacatcatattcagtgtatcactgctgaaaatcagtgataaaaaaaatcttcaaagcaaacagagaatagcaggtcatcatatacagaaaaagaaaggtaaggatgacagtagatttcttgtcagaaacagtgcaagcaaggaggcagtggagtgacatttgtaaagcactgaaagaaaaaaaaaacaactgtcaacctggagttctctacctagcaaaatatcattcaaaaatgaaggtaaaatgtagacttccagacacacaaaagctaaaagaatacatcactggacaccagcactacaaggaacgttaatagaagtccttcaggtggaaggactacagtaacataggggaatatggatctaaacagaagaatgaacaaaatacaaatatacccaaagggaatgtaactacaaagctaaatagacaggcatttttttgttgtttcttttgcttttatgaaggatgccagctaatccacttcagcagatacaagaaacatgattgggcataaatcagtaatgctttatattttaaagaaaaaacgacatgaagatagaatctgtacataattgtggtaataatagtaataacagcagacatttattgggcccttactatgtgccagatactgttctaaagtctttattcacatttattacctcatttaatcctcacaaccattctaagaggcagactcttttatttccattttacagaggaagaatctgaggcatagagacattaagtaacttgcgcaaggtcacatggttggtaagtagcagaactgggattccgcctaggtggtttggctccagagccagtgatcttaatcactatactaaatcgccccccaggttgtataatactacagaataatatgattccctcattaactcttactgtataacttctgtgggcaggctttaataatttacagttttttaaaaagttattcaagtcacatgtttcaaatgaattaaacagccttttacactgacagttggataatttagacagaaagaacaacccatggccacacagcactctacccttttttccttatttccttatttccttttttccttacctggtcccagggtagggccctctctcaggtcccacatgcttcctgtctttattcttgtagcttagtacaaaagatgtgattattatcagttcctcctgctccaagactctgctgcgtgggtccctgattcttacccatctgtagcacatactattggaaaaatggctcccatagacttactcaaaaaaggttgccacaaacaacacagtatctgtggagcaccacaaagttaagtgtaataaaacgaggtatgcttgtattttgagggcagttactggtactaagtagtgagagggttctaactgaatctggcatttaaagtgtagagtggagtggattgaggaggatagaagagaaagaggcaaggccttcagagaaagcaacctttcaaggagttttactcctgctgtccaagggactgtcaaatccaaaatctatccaaagagaaacctaaggtttattatgattgtcatatttgataggacccagacataaagtcgagtggacctgtttgcccttcctctttttttcttccccttcgcactgtaaaacatcaccaccttttcttcagtgctatgataagaagtccttacaaaagcaacaagtctcccacttcagcttctgtttttgacctcatgctttcaggcctcacatctagagaaactaagtggaaaaaaggttgttttttttttttttggaggggaataaattatttggcaattttctcaaatattaatcccttttcttccctaaagttcctccccttcctacttcatttaggataggaggtgcgtttctttcccagaggttgaaatgtttcctagggaaatctgccgtatcatgtgattctaaaacagtttaaaggcaccacatacactgattaggtttctctgaggaggagccccaaagcagaaatctctggcaaggattagttctggaggggtggtgatgagcaaatcagaccaaaggaggggagctcttgagggtctatgcatgcattcctaggcctcaacatttatggtacttgaaagagcttgtatctaactgtcttgcttttctgtttggtctaattattagaattactaatattacaaatgaatgaacatccccttgggttctgacaggttggttcaaaatcttgctccatcacttactgtttagtgtctgtgagcctcagtttctttatccgttattgtgaggattaaatgggtcagtgtatgtaagatgcataccacagtacttgacacatggtgggctttacgtaaatgtttaggtccattttttccattccttttatagttagttaactatggcagacctgaaaaataatataagaaaacttggaaagcttagtacttgaaacatgagtgtgtattttatttctagtgaattatttggttttactggataattatcagatttaatttagtagcctgtataatataagtggcatgttggtgctgcttctaacgagtaaagagctgtttcaggtgttttgcattttggtgtatattagagttagagaaaccgaggagtcatgtagtccagaggttcaaactggtggggctgcagaatcacctggggagcatgttcaacctagattctcaagtcctaccctcagagatactgattaaattgattgggttaaagctggaaaatgacatgcagatgagtctgatgcagcatttgactatatcccttgtatagatcaggaaactaaggcccagctcacacagtgttagaaccaggacttggtgttaattaactaagttaattaagaaactaagaaagtggtaaagaattattcaacattttaattaatgcactgggctctggagcttactaagacatggtgcctgctcttaaagactgctagaggagacaaacataacataaatactagtatgaagtcaaaaatactgttttagcaataacaaacaaagttactttggaagcatgactgaggaagtagccggagagagtcaggaaggctccttagaggaggtggcatttgatctgagccttgaaaggatgagaagcctgcctggcaaaggacaaagggaaagtaacacgcagaagcgtggagtcctaaagcatggtgtgcttagagaagacagcatatcctttatagttggaccgtggattggagttggggagatgaggctaaaaaagacaggctgggctggacactgaaggtctctgtgccaggaattttaatatcacatgtgcaaaggaggtttttgagcctgggtgacttgtttagatagaacttttggacagataattatggctttattctggagggagatttggaaagacagtgactagaagttgtgattattattgctttcttttgttagcaacttgtgtaatttaatgagcctaatgatagcaacctttcccttatcagagatttaggttgtttttgttgttctgcatagtactctgtgtatgaggctttttgcctctgttatttctaagggtaagtctccaaaaatagtattaacagatcaaaagatatgatccacctaacacctcagtatttttatttttttacaataaagtgtgttaattttctgcaatacaagcagtataaaaatagtttcactacattaatagcatttggtgctgttttaaagttatgctaatttagtagtttgctttaatttccctttttctgattagcaagaaggattttttcctctgtgtgtactagtattaactctatgtaaattttagtattaatattttaattacctttctcttttcatttcacaagttttcatatttctcaagttaaaccgccaagtactttttaaaaagtaaatgtttgagaaagcattattacttttacaaatacataaaccttataatctctcagtctaaaataaatttactgtttttaatatttgcctttcacatgaatatttcattagtgtcttcaagccagtgttttcctcagtggtatccactgttctacttttacttcttcttgtattaagaaccaataccatgctattaaacaagtcaggccgggcatggtggaacacacttctaattgcagcactttgggaggctaaggcgggaggatagcttgaggccaggagttcaagaccagcctgggcaacatagcaagaccttgtctacaaaaaaataaataaaaattagccaggcatggtgggatgtgcctagtttctcatgaggcttgagtggggaggactgctgaagcctaggaggttaaggctacagtgagtcatgattgtaccaccatactccagcctgggaaacagagtgaaactctgtctcttaaaaatttctttttaaatttaaaatttaagcaagtcatgaagtttgtggtgttctcattcagaattgcttaccttgatattgaactcgattacatttatttaaaacttaggttaaattaaagctactttgactacatgttttaaaattaaaatgatatcatacatggtcactattggaaaacctgatttacctgtaagcttacagtgtccagactttcctcaaggtgatcttttctgtagttatcaaaagcagttactgtattcttactgtcataagggattgagttctgtactgagatggtatagctttattctaagcaatcacaatctgaatggatgcttttctttctcaaggtgatccaataaagctgtcattgattaagaggaaaatgcatttcttctccttcttacatattttgagttttctgattctaagtgtcccctgcttcttgtgtcagaattttgtaagggggccaagtgagggcagcataggccttgaaaagtaccacatggtctagtcaaaagcacaagtcaggcatattggacctctccactatggcagagtctgggttactagcttgtggcgtgcctaagaatttaaactcacctattctgcttaagtagctggtccactttagtgggctggaagcatctggccagttgcctgtggctaccattttgtatcactgaaagcgggatgtgctatgctggccgacttgggccaattaggaattttatttaaagcttgatgtaattaattatataaatttgacctgttaaatttgaggaagggttgtttcaaaacactcaattttgtacattaaaaataatgaggccaggcacggtggctcacacctgtaatcccaacactttgggaagctgaggtgggcagatcacttgaggccaggaatctgagaccattttggacaacatagtgaaacccgatctctactaaaaatacaaaaaattagctgggcatggtggtgggcatctgtaatcccagctacttgggaggctaaggcaggagaatcacttgaacttgggaggcggaggtttgtagtaagctgagatcacaccactgcattccagcctgggagatagagactgtcttaaaaagaaagaaaaaaaaaaaaaagtctccctactatacccttagatatatgcccttccatagataaacatggttaacaatttcttatgtaaacttccagaaacttcctatgcatattaaagcatatctatattaaaatatgtatcttgtctatcctttaacaaaatagaaatgggggccgttctacatatacatactgttttataccctgctttttggatttactgtcttacagccatctttgtatgctagcacatgtagatgttcttcattctttttaaaaacaatgttgagtaatgttacagctcttttagaatttgtctagcaggctttccggttcttgcgggaaagtcccccccaaaaaatattaaaaaataaaaaataaaaacaatattgaggattttctaaaatttttttgctacctctaacaatgttgcaatgtaaatccttgtatatacatgcatctttgtgtacttcctatctattggttaaatttctagggatagaattgctgggtcaaaaaagtactatcacattattccccaaatttgcatgccaatttaaaaaccaagaatttatgaaaagtacctaatctctaaattttgaagaatgaaattaggattaaagcttccatatgcactatacatgtctaaactacaaaagatactcactactaatactggacaccctcatttggcttgcacacataatattttcttaaaatggacccaaagggaaagaaaatctatcacttcagcaaaagaaattagggcagtcccataggaggaaatgctgattttaggaattggtttagaattggtttcaaaaatcaggtgaaatactttgcctcataatgattttatgtttgtaaaatttaagaagccatgtaaatataagcatttatttctctttaagtttgagcagggtattttccttttatcccttgcaaattaggccttttcttaaatctccatatctctgcctctatctccataacaacaatgtcctctgaaaccctgatccaggttctaggaacgtgccatctaacactgatagtgttggtatgattagaatgactttttgttaggcagctggattttcgatgtttttaaaatgatctgtctcaaccagatgcaatagaaggggtggcctgtggattatgtgtttgtcttcttccttttgttgctgggtcatttatatttaatattttgtttttctgataatcttaatgaacacctgtgtaatatattccacagatttcaatgggacagatgttacaagattttggaaaatttcttgggatgtttcttcttgttttgttttctttcacaattggactgacacaactgtatgataaaggatatacttcaaaggagcagaaggactgtgtaggcatcttctgtgaacagcaaagcaatgataccttccattcgtgagtatcttttaaatgttttagtaaatatatttgtcttttttttttttaccatcttctatatgaattagtatctatagaaatggaacttcacattttaagaaattccttagtaatgttcataaactttaataaatacttatttttcatgaatcactatagtcatctttacatacagcatcttaaatagtgggtccaagttattaccttgtcttccctactgcagtctatcttaacagaggaattcttggcattttgtgtgttcttagcattttgagcaattctttgtcattcctatgtattgcaagatgttcagcatctctgtccttcaggtattaaatgtcagtagcaactctcagtcattgttacagccaaaaacgctcacagcttcaacactttttaagaggtcattagaattgagaatcattagaacttcatgaacatttttttctctaatgtatcataaggatttgaataacctgttttgaggtaaacaaaattcctcccgtcatttttaaataaaacaatggagaagagttgtggaaggacacatttgtcatgttcttattatgtgtcaactattctttagttattttgtgtgtcatcttatgtaaagaataagattaatgagtatgtgtcagtgtaccacttactatataccagccaatgttctaagtgctgagcaaatgaagtattagtaaacaaaactaccctgatgaagcttacattctagggaggtgatacaggcaataaaaagaggagtaaaatattcagtatgttacacagtggtcagggctacaaagacaaataaagcatgagcaaaagagtgtctgtgtgtcagagttcagttttaactaaggagctagggagtgccccagaagagatgacattcatgtgaggatctaaagctggtaaaggagcaagccacgaagaacatttctgggggaagagcatttacagagagagagaacggcaaaggcaagtgtccagaggtaggagcatgactggtatgttcaagaaaaagccaggcagccagtgtggatggaatgtgttgaatcagagggggagttgtaggaaatgaagtcagaaaggtaatggggatcatgtaggacttttttgcccttgtaaggattttgagttattgagattgagagttatttgaaggttttgagcagaggtgtgacaaaatccaattagatattagcaaatcatataggctgccttgttgagaacagacagaaatgaagtcagaagggtaatggggatcatgtaggacttttttgcccttgtaaggattttgagttgttgagattgagagtcatttgaaggttttgagcagaggtgtgacaaaatctaattagatgttaacaaatcatataggctgccttgttgagaacagaaagaaaggcagcaaggggttaaacagttacaaataatttatcttccttagggtctctttgtttaaatttaaagtaaggcatatcagtactgtggaagtcaacatcatttttaaataaggaacttttcatggattatcaatgttttatttaaataattttgatataaacaaatgattcatttttgctaatttctttaattgccttttaaacagaaatgcaattgtctttacaggttcattggcacctgctttgctttgttctggtatattttctccttagcgcatgtggcaatctttgtcacaagatttagctatggagaagaactgcagtcctttgtgggagctgtcattgttggtacatacaatgtcgtggttgtgattgtgcttaccaaactgctggtggcaatgcttcataaaagctttcagttgatagcagtaagttcattcttttaaaaactttatattctcctcagaccatactaagtgcatacaatagataagatagccaaagattataagattataagaattgaaaaatagtatttttaaattaaatatagatttttaaaatgtaagtaatgtataataattgcaaatgttgaacaaaatttttctgcaaggtgtggaaacatcccccatatttgtgtgtgtattaatattctagtttgctttttaatttgccttttatatagaatcatgaagacaaagaatggaagtttgctcgagcaaaattatggcttagctactttgatgacaaatgtacgttacctccacctttcaacatcattccctcaccaaagactatctgctatatgattagtagcctcagtaagtggatttgctctcatacatcaaaaggcaaggtcaaacggcaaaacagtttaaaggtaagaaattagaagcttgaatggcaacataaaagttttaacaattcctaatctcagatatttcttaaagcgtaagtatgcaggttccctaagggctgtgactgtctgactttttttcactgctatataccctaatgtacggcatcgcatccaacataaagtaaggattcaataaatactattgagagtgagagggctgggtgcggtggctcacgcttgtaatcccagcactttgggaggctgaggcaagcacatcatcacttgaggtcaggagtttgagaccagcctggtgaaaccccatctctactaaaaacacaaaaactagctgagtgtggtggcacatgcctgtagtcccagctactcaggaggctgaggcaggagaattgcttgaacccaggaggtggaggttgcagtgagccaggatcatgctactgcactccagcttgggtgacagagcgagactccacctcagaacaaacaaacaaacaaatatatatatacacacacacacacacacacacacacacacacacacacacatataattattaagaatgggagatagtactgagatttttttttttacttttcagattcctccaatatataaaatttcatctcatagttttaaaacatgggaaatattcaaaatacccattctgtcactgtagctaaagaatgactactagaatcagctcatatttttctggttcttcttgaaagttattcaatacatcaataattcaatatatgttactataaaccaggggttgggacattttttctgtaaaggtccagatagtaaatactttacacttttcaggctgagacaaaatcagagatattgtaagcagtgatacagtaagagagaaaacaaattttcacaaaacttttattgataaaagtcaaaatataacaataacagtaataactttttaaatataggtctactagtgaaaagaatggagttccttttgggaggggataaaatttcacttaactagagtttaaaattagtgttattatcaattgatgataaatgttcatctgtaaaatctattcttagctcacaggctgtaaagtcaggatatggaccatatttggcttgtgggttgtagtttgccaatccctgctataaactaaggattcctaagactaatttttttcaatcaagataagcataaaattaaattcattaaacaaatatgcaggctatatttgttttaaacaagtgttgaatattataccatgtagtagaaaaactatagtctaataaagcatttaaagatgtgtttgtgtctgtgaatatatttttgaactctacctcatttaaatatcgtttctgcatatccttagtatcatattgttgttttgaaggaatggaggaatttgaaacagaagagagatgaaaactatcaaaaagtgatgtgctgcctagtgcatcgttacttgacttccatgagacagaagatgcaaagtacagatcaggcaactgtggaaaatctaaacgaactgcgccaagatctgtcaaaattccgaaatgaaataagggatttacttggctttcggacttctaaatatgctatgttttatccaagaaattaaccattttctaaatcatggagcgaataattttcaataacagatccaaaagactatattgcataacttgcaatgaaattaatgagatatatattgaaataaagaattatgtaaaagccattctttaaaatatttatagcataaatatatgttatgtaaagtgtgtatatagaattagttttttaaaccttctgttagtggctttttgcagaagcaaaacagattaagtagatagattttgttagcatgctgcttggttttcttacttagtgctttaaaatgtttttttttatgtttaagaggggcagttataaatggacacattgcccagaatgttttgtaaaatgaagaccagcaaatgtaggctgatctccttcacaggatacacttgaaatatagaagttatgttttaaatatctctgttttaggagttcacatatagttcagcatttattgtttaggagtataattttattttatctaaaataatagtctattttttcttttgtattttgttataatcttaagcaacaaagaaaaaaccctaatatttgaatctatttatgtctttcaatttaaattcacttcagtttttgttattgtaatatatttacttttacatggttataatcactttatatttttaatgtttttttcacttaatattttatatatacatttccatgtattgatgtagttagtccacatttaaatttttatagaattatatagtttttgaaaaatacagtcagtagatgttttattttttagctattcagttatgtttataagtttgcatagctacttctcgacatttggtttgttttaatttttttgtatcataatagtcctatttttttttcaagttggagtgaatgtttttagttttaagatagataggagacacttttttatcacatgtagtcacaacctgttttgtttttgtaaaacataggaagtctctttaatgcaatgatttgttttatatttggactaaggttcttgagcttatctcccaaggtactttccataatttaacacagcttctataaaagtgacttcatgcttacttgtggatcattcttgctgcttaagatgaaaagcattggttttttaaaattagagaataaaatatgtatttaaatttttggtgtgttcacataaagggatgtagctaaaatgttttcataggctattatatattctcgcagcatttccagttaagaggatattaggtatataattctcttcttaaccgaatgtcagatggtcttacgccacagggtgcaggtaacccttggtctgtaagcaccaccgatccagggatcattgtctaaataggttactattgtttgtttcatcttgcttttgcatttttattttttaatttccaaattttaagtgttccctctttggggcaaattcttataaaaatgtttattgtaaagttatatattttgtctacgatgggattatgcacttcccaattgggattttacatctggatttttagtcattctaaaaaacacctaattattaaaacatttatagagtgcctactgtatgcatgagttgagttgcttctgaggtacattttgaatgacagcatattgtaagaaaaaaaaaggtgaataaaatttgacattagattataaa

SEQ ID NO: 36805 - DNA, 404994 bp, Homo sapiens
gagctggagcagccgccaccgccgccgccgagggagccccgggacggcagcccctgggcgcagggtgcgctgttctcggagtccgacccagggcgactcacgcccactggtgcgacccggacagcctgggactgacccgccggcccaggcgaggctgcagccagagggctgggaagggatcgcgctcgcggcatccagaggcggccaggcggaggcgagggagcaggttagagggacaaagagctttgcagacgtccccggcgtcctgcgagcgccagcggccgggacgaggcggccgggagcccgggaagagcccgtggatgttctgcgcgcggcctgggagccgccgccgccgccgcctcagcgagaggaggaatgcaccggccgcgccgccgcgggacgcgcccgccgctcctggcgctgctggccgcgctgctgctggccgcacgcggggctgctgcccaaggtaagaggcgcccgccggcccccgcccgcccagaccccctgacccgtggccacccttccgccgtccagccgggcgcgggacacgcaggaagcgccgcgctggctccggggcgcgtccggccacccgccacggggctcgccggcgccgccaggccagggtttgccccggagccccgccaggccagggtttgccccggagccccgcggcgggccggggcgcgcccagggactcgttcctcggtgcgcagcagcgattgtcagcgctgacaggaagcgtggaggggtttgagggtcctgggggtgatcggggcacttctgtgcagggcgtccccccttgtctccctggacctctagcgcgccccagccggtgttcaggcaagtctatcctgcccccaagttgcgagccggcccggaaggcgcggtccaggagggagtttggattttcagtggtgctcgccagagcccaggcggctcgcggatcgacgcaaacaaaagccctgtcctcctggggctccggcggcctcgcatcgccaccgcccccggccctccggccctcccgagagtcatcatagaggccaaaacttgtgcgccgctgcagccgctgccactttgtgcaaaatgtgctgtcagaggcggcctgcggctccaaagtgctttgggtgtgcacgcgcgcgcgcgcgcgtgtgtgtgtgcgtgttacaaacaagagggggaaaagccatctaatgcatatttgattttggtaatctctaaagacaatcgcaacagttagagaaagacttcaccgcaagccggagcgtcttagttcgctgcgggaagctggggtccttgctgcgtctgagccggtacacaatgagagggaagagcccggctgagcctgtggagacaaccgattcattctttggaggttggagggggaaagttgattaaagtctccggggtctcgggcctcacttttaacatgcatcccttgagggggtgaggagcctttggattctgccctcccccactcccagccctaaacctgagcggataaatagatctctgctcttttatcatgcatctttcatttttaagttagcactgtgtttaggaaaagaaaaagttctgcgctacttagcagttgagaggaaaaagatgtattcactacatagactacgaatgcagaattagtttttactaaaagttagctgactttcttggtagaaaacacactctggaaggaagttgtgtgaaattttgatttcttagagatggtttttggaagctagagtagcattttctgaggatgatttctgaaacggatcctataatgtggtcgtgctaatctgaaagctcctgggggtaaatagagctcctaattgtaattaagatgtgcatcagcagggagtgcaccttcctgatgaaaaatcctaatgaaatgtaaacagcttggtcacatagatgttttgcttggtgatgccaaacatctggccttgcgccacaacacctgggtgaaaagtaaaaatgggccatgctgcctaagtaatgtaaacatccttctcaagttgggttgcccagcaaattgaggtggagataagcagggtgattttaactaaggtgggactcctggcttggggctttggttaattcagttatttcccctgtggactcctttactttgtacttcacctttcaacaatagttgcttttagatcatagccccttgtgggggtgggggtcacttacctttaaatacatgtccctgcattgattttgctcactgtaaacacccttcttatcagcagccaccccaattctgtctcctttaactgtttacagccttttagagttgtttaaaaaaggtattgcctattccattgtagcaggaggagccacagacaaaactcctcagacacccagtgagcaattcctgtcccttttaagggctcacaactctaagggggtccacgtgagagggtcatgatgggtacatgactgggggctgcatgcactggtaatcagaacgaaacagaacaggatagggatttttacactgtctttccatacaatgtctggaatctatagataacataaccagttatgtcaggggtcgatctttaagtaccaggcttaggtcaggcaggcccaggcctggtttcgggtctggttccttggtttcaggtctggttcctaggtgccgggctacctgcctttaatttcgcttctctttccttttctgagtataaaacaatataaaacaatatgagagggtctgtctctcttctctcaccatactctttagtaatgagctcaaatctgttattattgtcttatttgttgttttataaatccctttccattttgtgaatgtttgatcttttctctggggtcaagacttctggtagaactcacgtttactttctcctcttggactcaagattcctaaggtagcccagccagtggctcaggaaatcagcttaagcggagatatgtttcatgtatttatttaaaaagatacaaaacatttctcccatcatttttctattttgttagccaggagaagaaaacctttaaatttattttttctggtctgtccattgttgatttctcatctaccccctccctatgcaaagctcaacttctttaggaacctgaagcttaccttataactgcacccaagcccagggctttaggaacctacctggcctttctcaaaatcttatagattctgtggtttggctgctgggagccagagggaggtggcttgctactgtgtttgctatcattttgtaaaccttccgttgccatttaaataggtatttgtctgtacttttagaatagaagtgtcttgaaggcaataagactgtgagcttttctggtgaaaacactgagagcccaagtccactagtcccaactttattagagatgcctgaaaatcctccctggctggctagggggagccgaaccaaggtgggatgggcaaagggtgtggtcaaattgtctccttcagttttggaaatatttaatttccaatatagattcagtatacatggtaggctgttttgcttctctgatgcctgggataatctgcctgatatttagtgaggggtcagctttgccctatagcaccctttctcttctgtatcttgagcataggcccccagttagacttttggaaagtttctgaaagtgtcacttgctctgaaattagtatcaggtttggctggtggtttgatggtgaacatctaccccatttcaaatatttctgaaaattttacacagcatcctatggagaatggaacactttgtaagctatatgtactttgatgtaaatgtatatgtacagatagcatatgtatatacacacatatatagtaagtggtccatagatatttgttgaatgaatggagaataactttttcggttgtatgcaaaattctgatatatgctttgcttagtaaaaatgcaacatggcatattttcaaggatttttccttttcttgtcccatcttctagtatgaaagaagtgtagtgtagcagaacttgacagtaaagctaaatggttacaagcacaggctttggcatttaacagacctggatttgaatcttttctctgttgtatagtgggtgtgtcagttttcctgagcctttcaagagtgttatgagattgaagtgaggtcatgcatgtaaagtactggagaacagcacccagccaagaggtgagtgcgtgaaattaatttggggtacatgaaattaaggatatgtgaacttccagaaataatatacacaattttatatgcatttttacggttctgtatttatagctatagctataatcttattttccaagaaaagtgtcaacctctgaacgataggaactgctgacttggagtgtttgatgcctgaggcaatgggttgtcttcctggggaggctgaaaggagttgagtgttggtggctagttctaggccttatcccaggttaacacactccatggaggccccacttctcacctcccagtttcccttccaccaggcaggctgttaattgggcctgagagaagctgaagaatggtgccaagtccttgtgacctcaagtaagaaaatatgtctctgaatccaagcattctgagatgcaatttgtacagtttatttaacaaacacttatctaatccttacaatgggccaatcactcttctaagccttttgcaagtattaactcactgaatcctcacaacaaccctataagggagatagcataattagctcattttactgatgggtaaacttaggcacagagaggttaagttactttctttaggttacactgctaaaaagtggcattactgggcttacaagccctaacagttcatgctcttaccttagtggctgtcctagacattctttccttgtttaattcttacaatttatattcttttaatgtatggaacaaaggtggtatttcccaaggttttccaacagcagcaaagggaagcttgcttagctgtaatctagaggttataagaaattattggagacagccaatttcaatttcccttcgagtgctggagttccctaagacggtcttgctgaaactcagagatagactggaagcaccttgttggatggcctggatctctggttctggaagaattacatttttgtaatgagcttcaactttgatgtggtttgagaagtgtgctcgccagttttttccaactatcaataagctatattttgatgaagtgactttgtatttgcatcttggtggacaactgtggttgtaggctgagaaggcggggatttattagagtgctgtctagtgggacagctggcttgccagctcaaggtcccagtgaggaccagaccctggcaaatccagctccagctgagaaacactcacgtcttcaaggcctctttctcaaacagaagggccttagcctggcttcacccattccctggggtgtgacgggagagactgttcggtagaaactggaagagaaaggagagtctgagaaagttctctggagttgaagggggaggggatgggggcaactcttcgaaaatccttaactaaatgcagctgcttgttacacggagactgacttgcatgccaggaatatctaaaaagctaacgaatacaaaataaaaataaacagcagtaaaaaggctctctctttgttgcagtaagctcagttggggttttcagtttgtttaggaatgggataattgtggcatccactttattttggtaaggcagtgaaacgtggattaatgttatgtgattgggatgctaccaccatctgaactttttccttcatcccctgcccccagccacaccccccagaacacccaggcatggacatccataggacctgagtctcaaacagttgcccctgagtgaattacattggaagagggcagataatttaatgggataatcttggcagggccagcaaatttcacacctcatctctcactaatagaaaggcagcagaaggctacaacatcctcagatgaaaaggttgtataaaaaggctctgcttaacagtaactgtctgtccataaataaggttttgtacagtcttgatccaaaagctgttatgaaatactgataagccaagcctcataatgtttggcctccttacatttccttttcctgcttctctccatagaaccatagatttttttttttttaagagagagagggggactaaaaaaaagatcaacagtccaaactttatttttttcaagtatttctatacaggatggacttcctttgatagctgcttaaagaggtggcgtggagtaatggaaatagaatgggatttgagcctgatagggaatgggggtttgaattggggctttgttgccttcttgggcaaagttacctaaacttttgagcctctgttttcttatctgtaaaatgggaataacaataatatgtggcttactggggggttttgtgagaataaaaggatgttatgaacttatagcgcctaacacagcaccatggacttagtgaacgtgaagtatgttagccaccatcattatcaagggcttactgaagaaatttgaaaatctggcttcaaaacgatggtcctgctgcaaggtagcaaccaaggctcagagaatagcaagttttacaaggttttaggactccagagtgttttgttttatagggagcatgcagatgctctagatctgagcagtacccaggccagtgctggggacctggatggaagggattccacagtgcagttttgcaatgccttaaaacaaaggcttttttcagaacagcaagctctttggggaagagcaacccctcccaggtgcttagtgtaattccagaatcctacaatggggaatgttacatttcagggacctccacttgtaatctgaccgtttttagctccaatatccaaataatcttgctgagcacaacttgaaagagaaggataatggccggaggaaaggatcctgaggtgctctgtttgccatttaaattttctgagtagaagaaaaaaagttcatgttacccaaagagagaagagtaatgaagcgtgtgggaagcaggaggggtgataaagaggacttctaaagacaaagcagaggttgggtttgatattttatttttcaacagtgaagcttgtcactcagtgtatttcaactaacatttattatatatttatcacatgaaagatacagtattcgtgtccaggaataaagtattaactttgccctcaaggagagaggagaaaaattctcacttttttgagcacctgctatatgccaggtatcatttttttaaagctattaaatttatgcttctcagcactccttggagtttggacttctgatcctattttacagataagaaaatcgaggctcaggaaggtaagtatctcagccaaattcgtacaatgattaagttgggatttgggatttgaatctaggtattttgactctcagatgtatgctctttttgttatccttaaagtgtgattggggagacaccaatgagcagatgtggtaccacaggcaactatctctcccacaagtgaattataggaaagagttgtggaaaaaatgctgtgggaacatggggaagaatacattaattctcaggggattagagggtcagaggaagaacatgagtgcctccttcataggcttattgtgaagagtcaatgaaataattcatggaacacactcagactgtgcatagtgagcgctcagtgagtgttctgctatagttatgtagccagtgagaggcctgatcaggatttatctgcctctaaaacccatgtactcttgctcccctgtgcactttttaaacagacatgtgattgttggaagagtaagtaactgtgcagtcaccaaatgaaagggaagacaccaatacagttgctctggtatattcaccacctgccctaatcctggcttttaggactggactgctttgggtatgggaggggatttggatagatgtggggttggaaagaatcaagatgtctcatcatgaactatagcgctcctagaactctggccaggatttaccacctgccctcattcattcattgatcatacattttctatgcacttacagtgaaccaaatattctgatagtctcactggagatgtaaagatgaataaggttagatcattgccttggagggtttttcaaatgacagatttatggcagagattgctagctgatcaccaaatatgtttccatctcttccggtcatatgactagacaacatttctcagctttctcacagttaagtgaagccatgtgactaaatactagccaattaaatgaaattggaggtaatttttgtcgcttgtaggcttgacccataaaaaactccccaggcagaatcggtatgatccttcttcggtggcttgacaaccttagaagtcatgtgttgaaagtgtcacaacgtggaaagagcctgagactctcccttaatcactgtgtggtggaagccacacttgtttaggttttatgtgaaccaaaaacaagtgtccattgttaaggctgagattttgaggttttttttttttgtttttttttttgttacagctgctaatgttaccttaactaacatgaggttgtaaatcagtgtgtggtgagatcaatttagtgggttaggaccagcatttttagatagaataaaataggaaacctggtttgtgtctgaccacttcatgcagacctggggctccatccagtaaattaaaccccttcccaaataatttatggcacacatagggtgcctctagcactgtagagaatctagaagaatgaagggtggcctttacccttggggagtttaccttttaggggcagtaaaataggcactttatacagccagtgagtacagagttggcaattatatatgcagaatccctagaagggtgggtctttcgggaggaagtgtgatatgatgtgagccttgaaggaaggattgagagggtgcgggattgaaggatgggagatgggaagaggagttggacatttcactgctggaaaagggctggagttccacagcagcctgcagctgctctgggggtctccatggactcgctgagactatcctgagttcttaaaccaggccttcactgtggaatgaagctgatctccaggggatgggagagtgaagaaaagaaagacagcgttgaatgaagcctgttgtgtttttagcatatgaagggtggaggaggagagagaaggaagcagtttcactgggagcctgaagacttgtctttcttcccaaagggtgtcccagggagttaaaaatgttgtgcatttcagggctgcttgtcaaaggtatatgatggtgtcttattgtctctaatgcagccattttctcttatagtgcaggctacttaattctattccccctcttgtctgcttgatgaaaagaataatagtatactaataattaacacactgagcatactgtgggccaagtactattctaagttctttaagcgatttaacttgcatagtcttcaggacgaccctatgaggtaagccagagttctaggagcattattgttcactattaggcatcttgattctctccagctccacacctgtgtgaatcctccaccatgcccaaagcagaatccaggctaaaagccaggataagggcagatgggagaaaatacaagacgaactgtcttggtgtcttcccttctatttggtaactacacaactacttactcttccaacgaccacatgtctgttgaaaaggtgcacagcagagcaagagtatatgggctttagaagcagattaatcctgaccaggtctttcaccggctgctgaacactccttgaacactcacaatgcatgtggcagggtgctcagtgtgttccacgatatccccattttccagataaggaaactgaggcacagagaagtaagtaacctgcccaagaccacacagagagttaaatgggaaaactaggatttgaacctgcatatcctaaggcctgagttttgttcctaatcattattatgccaaactgcattgcagttttttttttcaactctgtctgatgattaaaattctctgtaagatcccagccaaatagctgagtcaaaataattataattaaatcctccatttgtatagggctttgcagcttacaaaatcattttatgtacagtattacctttaattttccaaaaaatacagttaaataggatttatttctctcttccttttaaaagtaggcaggtgagtttggcagctcacacaaggtcactctgtagctgtcagggcctgtctaaaacccagccccttggacttagggcccattgaactttctgctctaaagactacttttgtttggaatttgtgcctctaatatactgatatatgactattttcactactgtttcaccaaaaggtgaatttgcctgattttcacttgtttcatccacaaaatcttcaaatagctgttgtctttagaaacagttgaaaggcatttgtagatgggacctggctctgggatttctgtaacctgggaaaatttacttgcaaaaagacagagaagttacttaaaaacaggattttcctaagtggttggtgattgtggcagggagaggagccaggaagagaaggactttggcatcagatggactaggctcactactgctctgccaggtcagcaaactacgtaacctctgagactggctttcctcacgtgtaaaatgggagccataatggtgcctaccatgacagagggggaaggaccatgggtagtgtttggcacagtgcctgggccatagttggttgttggtgtgtgatcgaagctacatctctcaattgaatggagagcagcaattcttcctttaagatttttcacaggatgggatggggcaaaattgctagttctcagcgccttgttaggcatgattttataatacagttatctctgacacggactttcttagcacctggaaatcttaggttataattatattgtttctcaagggcagggactttcttatgctctgtgaaggttaaacatcataaggtaaaaatagaacatgctgcctgaaatcctagataccctggaaaggctcttatctgttcttcatgggaaactgacaccatttccggatgggtttagacaatgtacatgaaagcaacttattctactttttctccataagagagattatagccttgcttctaggatttcactccaactggggtgtttcaaagtttttacataattttcacaccccctggagagtattggctgtttttcttttttctgcctgaacttccattgtggtgatggactgtattagcctttcatatgcctaccttaaagaggtaatgcttaacccagtcatgactgttttatctcctcccttcagagaactgttgtgtgttgtatggggattttcagtcccaagatattgcctgttggagaccagtggtgtgtagaccactgaaaacaagcagcaactatatatatatatattttatttatttatttatttatttatttatttaattttttttttgagacggagtctcactctgtggcccaagctggagtgcagtggcacgatctcagctcactgcaacttctgcctcctgggttttttaagtgattctgctggctcagcctcccgagcagcttggattacaggcgcctgccaccacgcccggctaatttttgtatttttagtagagacagggtttcaccatgttggccaggctggtcttgaactcctgacctcaagtgatctgccccgctcagcttcccaaagtgctgggattacaggcgtaagccaccgcgcccggcctacgcagcaacaattttcgatgatgttcttaatccaccagtgatttaaacctctttttctctgtgcggctcatagcgctttgcccactcacatctggtgtccctaagtcaaagcattgaaaactttgcctgtgaccaggtagtcttcagtgggttagagtctgctgtcagggcctcccaggggacacgtgataactaatgtcctttttccccactgaggaaggggggagctgaactgagcatgtccagtctgtgctacccagctcatccctaagttgctgcctaggactgtgctccgggcctctgcaaggaggagttagtaaaggtgcagagaaagtccaggacttaacactgattagtcttcctccccagaaagaaagcacctggcacagggaataaagcatttccccccttacgctggctacaacttgattttttttttttttttttttttttttttttttttgagacagagtctcgctctgtcgcccaggctggagtgcagtggcacaatctctgctcactgcaagctccgcctcccgggttcacgccattctcctgcctcagcctcctcagtagctgggactacaggcacccgccaccacggccagctaattttttgtatttttaatagagacggggtttcaccgtgttagccaggatggtctcgatctcctgaccccgtgatcctcccgcctcggcctcccagagtgctgggattacaggcgtgagccaccgcgcctggcctttttttttttttttttttttaaggagcaattgtcagatttgatggttgtgttggggttaaaactatgtagataaggtggtcaaaaccttttagaaataatcctcccacatctttcctgagggcttaggtttagaaagtttcttagccatcccaggatgtgggtgaaagtggcttcccccagactcatcaaatacacagagcaattgatctgagtgctggtggatgggagggaaggaaaggaggggcccaagaggcgcagctccacctgcccgagggagacgtcctgtgtaaactaacaagaagtcactggtgcttcggtttggttaaatactgatttagcaactgaaagggatgcaggagaaatatggcaatatcctctccagtaagaagtttactgtttttgttagggaggcaagactgatacaccccaaacggtatgggaataatgaattgatccaaatgtcagtggcctgcccttggtttagggccctttgcctatcttgaagcctccaggaatttctaccctcacaccggcctacctccctggcatatccagctcagactctttcctcttttcatttcttcttgctgaattcttgttcttcaaactgtattgcatccacatccaggaaggcaccctggcctgtttcagcctgtcagtccttcttttgtcgtctcaccttccaccagtattctcacataggccgtctaaatcacacctgcttatgctgatttagcccaacacctttgcaataattgtcactgtcaagtattaagcattgactgtggacccagcacctggcaaggcattttgtattttgtagtggaatcatattattttctccctgtagaactattgcctttctttccttccttccttccttccttccttccttccttccttccttcctgccttcctgccttcctgacttcctttctttccttccttctcttttttttttttttcttttttgatggagtttcactcttgttgcccaagctggagtgcaatggtgcgatctcagctcactacaacctccgcctcccaggttcaagcaattctccagcctcagcctcctgagtagctggaattacaggcacctgccaccatgcttgcctaatttttgtatatttagtagagacgggttttgccatgttggccaggctggtctcaaaatcctggcctcaagtgatccacccaccttggcctcctaaaatgttgggattacaggcataagccactgcacccggcctatcgccctgatttcaatccctcatctgtcactccctcattctgggaaatgccccttcatcagtttcaaaaggaactaatcatagtctttccttgggatttaggggcagcccttctgggatggggaagctgagagatgcccttggtcatgtctgagcccaggaaagaagctggtgtgtaggagagaatgacttcatatccagagcaggcactcctgagaggcagaagaggtctgacagcctgccaatctcttttccacctccctggggtttccttatctgagccagtagacgctgctttcatgaggttattgtgttcctacaatgcacacagcctcacctcactaatcctcataacaaaatgaagtgggtgttatcctttttttaaagctaagaggaagcagtttgattgctttttctgatgagaacatttatatccattaaaagcaaattcagaaatgtataatgaaaacaaatttcacccattatcctaccattcagagataacttctgattgtgtttatacacgtggatttataaaaggaggttatgcttttattcccaaaagaaaactgaggctcagagatgttaagtaactcctctagggtcaaaaccagtgcaaatcactaaaacgtgttgactgtctgttaaattcaatgtaattaagtgccacagggagttacaggcagtaggttttgtggatcaagaaggaaagaggccggcattgattggaattactgggagggttttctgaaggaggtggggcttgacagagtgatctaatatatatattatatgttatatatatatatatattttaaggcttgttttattttaatggctgatctatataatcacagaagccagtatgtacagacaaagtggaagtttttatttccttgtctcttcctccttggacaaggtcttgatgatttcctccttcttgacctggaggcactctttatggcgcttgcatgcttccttggtcttagacctctgggcctcaacctggttagccaggagcttcatgcgagccttatctgccttcagcttgtggatgtgttccatgagaatcgcttgtttttgaacacgttccccttaaccttcaggtacaggctgtgatacatgaggtgatcaatcttcttagatatgcggtatcttctgagcagccagcacagaatcctcattctcctcatccacgtgaccttctctggcatccgggcattggttgtaccctttcgcttacctatgcccatgtgcctgcccttccggtaggccaaggtgttttcctggcatcgagcctgggaatggacagtcattggcttgcggatcatcagcccatctttgatcagcttccagatctgctgacaggagttggcattggagatttcattggtttcattggggtccaaccagaccttcttcttgccacaggggaggaccctagaggcaagcctcttctgaagcctgagcatactcatggctgtgaccatagcagtgaaaggtgagtgatctaatattgacttgattcctcccattaagtggcctctgagtgggcaaagccagtgaatggggacacctgagcactgcctgctgtcgggactgggcactgcctaagacaatgattacttttgagcttttctgaagtgaaaataagtcaatgtgaacatggcaaagagggacagaggaagagacttatggtatctagaaggaagttggcaggtaacagggtgccaggaaattaagacctaaagaaatagagtggaggagaaggagggtgggggcacaacagtggattgtggttttgcatttgaatcaggaggaggaaaaaaacacccatccttcctctccttttttttttttttttttttttgtctttaaacaggcactgtcactctcttttgggattacttatttatatgtttgtctctccctctgcactgtgagatctgggtgaggaggaatggtgtttaattttcatgcatatcttcagtgttcagcacattaagcctggcacaaatcaaagagacactcattaaatatttttcaaagcaaggatccactgacatgactttcaggcaggccctcccaagctgtctacaaccccctctgtggtctcatagggcacctatgcacatattggcttttcatgggctgttccctcccacagaagcacctttcccccacccatcagctacagtccttctgtcttggctcagatgtcacatccctgactcaacaggtgagattagatttccactcacatgctctcctagcactttgtgttcttaaataaccttcattataatttgtcattgaatatttatttgtgtaatgactattttttgggatcttctctatcactgggttggatgctccttacagtagggtctggttctggatctcctgagcctgggccagttgaatggattctgcttttacttttactaagcattgttcttccttcctagaggccgagataactccagcttaccttggtgtgactatctaggaatttaaaaacgcgtcttcgaacaactgaaaatctccaggctatctcttccaacagttgaggaatccagccctgtaaaaagtcaatcaggctaaatgacacctgctgtgagttctgtttgcaggagagcaatgggcagctccagagctgggctgttttcccaacatggagtctgtgataactgggttttgctgctataaattagggtcaccctgctcttaattggcaaccaattcagattctcccttacaatcctcctctttctcctttttcgtgtggactgtgtttgagagaaggtgtggaaaatcctggcactgtgctacagggacggtgcacctgcaagctgggaatagaggtggtgaatgctggctgccggccctcagcacctttttctccctccctgttgctctgcccttccctgtcttttctcaggaattttgaaagaggtctcattactagggaaatatcccctggggagctcttcctctctcttctttctctcaatgagtagaggggaaagtgttctcagttttgaacctgcaagccatctggatgcaaagatggccagaaatgcccccttgtctctggatttcctacagcaactctgccttagcctcccagtaccatctgcttcaggctgggacatctttccttcatgcaggagaaaggggagcttaataaaattttgctggggtttcttggggcctgaggcagtagtggggaggagagaagcctgggctgttttatttcttgcacctgctatgagtcaggagtggtccttggtcagcaggcacatggaggcctgctgggtgccaggcattgggcaggtgttggggctacaggattatctgctaggacctcaaagtctggccttgtgggcagcgtgaaaacaatgatggtgacacagtgagagtctgggcacaggtcctggaaggtgtggagagggagcagccaatgcaggctcctgttagagtgctggagacagaatcaggaaaggtgactcaggggagtcacctttttttcactggaaaaaaatatgtctgggaggcactaaaacaagagcccattatgtgttttaaaatgatattagtaataatgtaggggtttatttggacaaatgagttcacaaaattgtgctgcctgtaatgttgattcttgactgagggataaaactcacttcccaggcccctttctgtaagccagttcccaccatccccttgaacctcagctgctccaccagagtcaaagcaactcagaaggaggctgagacccccatgcctcattgctaatcgatgggcatggtggatgggcatgagggtggggttcaggaccttacctagcatctgtcttcccagaatgttgctctgccctttctggggataagaggtcttagtttctttatctctataatgggaattataatccattccctgaagattatggaagattataggaggtaaaggctataaagtcaccttgtaaacctaaaatcctatctgagatcgaggatttagatggcaagtaccattttgtcttcatttcttggtgaagaaggatccatgaggcctcctttattcactcaacagatatttacgtggcaggcatcattcttgatactgagggtaaagctgtgaacaaaacaaagaccctggtcatggaggagtcaggaaatacagaaatatacatgacagcaggtaacaggaagggccaagaagaatgagcagggtaaagagcttgtaaaggaggtggggtgggtgctgtcgcatggggcagtctggcaggcctctaggtttaggggatttgagcagagagacctgtgtgaagggaaagggtgacccctgagactgtctgagggaggagcagtgagtgcagaggcattcaaagcaaatgccttgaaatgggagtgttatcagtttacagtacaaccagcaattgcttctactaccactggtaatatttatagagtctatactgtgtgccaggcagtattcaggtgccgcgacaaccctattcggtaggtcctatttttatccttcccccatgtcacagatgaggcattcttagaacaaaccaagcatccagataatacgaagagggagcagttctcatttacatggggagtgtataagtcacagccctgcacagagggaacagtgtatggtttggaaagaaaaaaaatctcagtttgggcctggcctgctactcatctgctgctagggcaagatgtttcacctctctgggcttctgtttcctgatttataaaatgggctaataaaatctcagaggattattatgtatattaagtgagagatccaagtgaaagaatgtttcaaactgcagggcaccatgagaatatcactttattcttcttcttattacgccaattctcattccttgcctcttgcaaagagagagaatgagagaaaaatggaaacttgcaacttacttaacttccttggttctttccctgaaaacttattttctactaatgtctgtgggagtgaattaactagagtatccagttgaattaagtattttgctgaaagatgaagggactgtgagataaagttggtgccgaggattctcacatttctaaaggaatcacttgaggtgctaggactcccagtccactcttccacaataccagacaacctgtaatcctcagacccagaatcttatgacagctttctctgatttcacattgtgtagattagctacccaaaaaagtaagtggcctcaaatagtgctgccctttaaaattattctatgcatttgtcccagagtcttgtgggatgaatggctaaatcctactggattaggcgagatgggtattattatctggggctacagaatggaaaaactcaggtgaaggaagttatcccaaacttcataattgatggtgagcctggatactcattctcaaatctggtgaggcatcgttggcttctaccatgatggcgatggtaagctcatttgtcaatcaaatgatcgattggcagtagggtgatgacagttaataataatctattatatatttcaaaatagctagaagagaataattagaatgttcctagcataacattatggctatcccagttaccctgatttgatctttacgcattctatgaatgtaccaaaatatcacatgtgctctgaaaatatgtacatctattatgtgtcaataaaaaaagttaaccaaatgatcgatgaacacctactatgtgccaggcacagtgctgggtgctggcaatgcagtggtgaatgagacagggacctgggtgcttgctctagggaatgcccttaggagaagctcagggtatgtttttttatttggaatgcttgctgattcccctcccaggacctccagaaagaagtggtggttgcttcagcggtcacttggtgatgactggcaggtatatacctgtgtagctggcacatctggtgcctgtgatcagagccgagccatccagtctgagctttgtttttcccagtgcagcagtggtttcctgcagtaagctccatcttggttgtgctgccctccccgctggggttgggataacagcctcctggggactgtggctaatctcaggagaagcagagaccccagggaaagactcctgtctccgttgtgtgcacctaggattagatagaactgccgctaatgcagttaggtaaaggcaagggccctggttgctggggaaccaggaagcacagggtgagcttcccatctgctctcagtgaaggacgtcctcactgtcaccgcttcctagggccaaaggggcctctgacaaagctaatgtgaccaaagtcaaaatatgggctccgagagtcagccaaacccattcaactaactgtgatcttaggcaaacctcaaagcttcggtttccccatctgtaaaaattggggtactaatcatatctacctcattaccttttggtgagggcaaaaatcagacaatgctgacggtcactggcatgtcctgagtgtgcatggtgagtcgtccatcaacaagagctcagatgaccatgttccaggtgaggaacccgaggcccaccctggccttgatcagaaataaccaccctgaattcctcagtgcctgagtctggcatcgaaactggcttccccggcctccagcactaggccacgaaggaaccagcttctttctctcactggtggtggcctgctgtgccctgctggctgggtccagagagacagaatgaggaggagctcaggacctgttatcagaggccagagggcggctctccagctagactgctagcaggaccgcagtgatggaatcacctgaaggtcttcttcaatttcctcatctgtaaaatgcagtggcttgactgccccttccagccctaaatttgttttaggaagcccactggaggaagcagcgagcaagaagggagcagcggagggaacatatcaatatgatgtaagaataatagctcccattttgtaagtcctgactgtatgcccgggactgtgctgggatacacagggtccagaacattatccattttctaggggctcacgcactcatgaaactggtgatagtggtggggtgcagtcgtttggggtgggtggagagacataataaccggaggaattagaatttgttttggtacatgccttaagagagatctgcacagtgacttgtggaccccagacgaggctgcctgtgtgtgcagagcctcgaatgccatgcagtgaagggaggttggaaccctgcatccagggaagcggactttgtggttgggagggcaggttcaggaaggttctggtgggagggttggcagccaggctggtgctccagagggctgatggattacattcttcgagttagaaatcatcagaagccccgctgagagggctcttgtggctttggagctatgccggaggttccctcttgcaaggggaaaaattggctgtgcctttaagtgttatcctcctgtcctcttggtttcctagtgtggcaagattcaaatccaaagtatttgcattgaatttgttaatttcaaccagtggtagaatagaataagaagtctaaacagccattttttcttcccttggagggtatgttttctgaccttttaaggaaaatcctgtcgaaaccttgaaaacttgtgactctaggtgctggatctgacactgggtcagggacatattgtggacctgccgtgtgcttgggcctgagctgagcaagctcatggagtaagctctcttgaactcttaagatcgtgaaaatacagttccaagccacagaagccctttggagtgattctgaatggtgggagggcagagaggctttgaatgctgtttgaacacttagactgctaagtactactcttcaaacacttcacgtgccttagatggtctagtgcaaaggatatgcaggaacataaaatatcttgccgctactggaatagccttatcttctgcctcaatattgatttagaacaatagcttgttttgaactttctccccataaattaaattttaatttagaaaatgccattaggggaaacttagtatgtaagtacagaaggttttggagatgggggtggctgctcagaagggagtctttagagatgacaaaggtaaaagcattactctaatcagaacatttcattaaaacccccatcagactaatctgtcgacacatagtattttgagtatcttttgttggcaacattctgtgctggaaactgggagagagagagtttagctcttgtcctgtatgtatgtgcatatttatatgtgtgtagtattgtcttatatgggaaaggacgatgggatttttttttttcagaaacatttttcccttctacaaaggatgacatcagggcatagcagaaagagctctggactgaaagtcaataaacttgagtttatctcctagccctacctctaactagctgtgtggccccacacaaaacacttgccttctctgatcctcaggttctcatctgcaaagcaataaggttggaccaagccctgtgtagtggcagtgtcaacatcacctgggagcttgttagaaatgcagagtctcaggctcctctccagaactactggatcagaagctgcattttaacatgatcccaggtgatttatatgcaaattaaagaaccatggctttaaagaaccattcctgctctagtaatgtattattttgtgtttttttccaaatgcatattaaaatatagttacgaagaatttatccaagactgcatcaaacattctacataaaatgggtgtatcatctcttaccctttaaaagtttgtactttgtgagaaaaaaggtttaaaggcagaaacaggcacaagcagtcgtacattcagttccagtgctagatatacatatttcttccttttgcctcctttgtgttttgggccttgacagtgtggtaagggcagcggtggagagaggagaggaggagttgcagagtcgaggtgactgaaggtggaaatggcaatgcaccgagccctgagctggcaggtggtccagagagcagcgggccccagcccagctcctcagtatcattgcaagggttttgagaatccaacatcatcggtgatgagaaaaatgtttcacatttttcaagcatatatgaaagtgctttgatgaattgaataacaattcatagtgattttttgatgttctatattttttctaattaattgattctagatgttaaacctattagatgggaagaggactctagttcatttttgcattaaaagggttctttcttacttgaagctggtgggaactattggaagagggcgtaataattaataatgatgacaataactaacacatgccgagaactttctaggtgccaggcactgtgccttgcaaaaaaggactttgggcatctgttaattaatttatggataaggaaaccaaggctcagagtggtgaagtgacttgctcccagtcatcctatgagtaattggtggatccaggctagaaacccagtgtcctggctgtggggccagctttttttctgctgtgcccgattttgtggtttgtctctctggtgctctggagtagcatgtgtgggaaggctgaacggagagtcatgaattttcccgagttcctcctctgggaatcacagactatcagagtccggaggactttcaaaagcatgcaggccacaaactccatttacaggtgaacacatccagcccagcaagggaagggaacttgctcaaggtcaaacaattagtagggtttatttgttctggtcttcctctacctgaaattcagctctatttgaacaagtgaaacaagcccttctatgaaagcaaatgaacacggttttgaatattgtatctcaggttgctgtgagggctatatatatctttaaaaaggattcagcatagccactggtagttgataaacactcaaatgatgtttgttatggttatcatttttactaagcttcacatattaaatttagggacacctttgttgttgttgttttaaagcaggactgattgtagtcttgtctttttttttttttttccatgttctctatcttcaggataacctttgagaggacagacgaccaaattccttttcactaaatactgcaccacataatcattggaagccatatactggcaagggagaaagttgcccttttgagaggctgcattcttcatcttatgagcccatgccatgccagccagctctcattgagctgagaagctatctttttggcagtaggtctcctgatcatgaagatttgaatggaacagacattttctgagactcagtcaggcatttttccactctgcatacaattgttaccaatctagagaagtaggaactggtttagaatcagagccagcttcataggtatgcaacctgtgcaactgcgcagaccatccacattggagccccctggttgatttgacgctctgcagggaaattggaattcttgatattattttcaataagacgccccacttttttattttgcactgggcccatcaacttaagtaggtactcttggttagaataatctagaacaggaccaagagcctgtgaggaacaagtcagtgggggttgcagtttttgggggaggaggaggaggccacagacctgactccttgtgatgggtcctagtattatacatgggcttgagccaggcagcatgcagtccgctgccatagagaggaggtaagcagggtggtttgttgtcttgtccacccatcactttgccttgtaagtatagacaagacactaactgctctgcatgtctcctttgtatccccagccctgatcacacatagtacccagcacatagtaatcacttaacacattgtggctatttactttattgctgctctaaagtagtccagagatgaaccattattccaggggctttacatgtattatctctagtttttctgacagcctttcaaggtagacatgatcgtcccttctttacagatgaggcaactgagactcagaaacgttaagcaaaagtatctctggttcatctctggactactttgaaaaaatagatgaagtgttgtgtgagatgcattataaactttcctatttttggtgtcagcaccatactttatatcttggctattcaggggcttaacgtcaatttccctgctagtaacctctttcttttattgattcaacagctggattaacttccccagcatcatcatttattagccacgtaatcttaaatacttttgcttaatgtttctgagtctcatttgcctcatctgtaaagaagagatgatcatgtctaccttaaaaggctgctaggaaaactagagataatacatgtaaagcccctggaataatagtgactggcacgtagtaggtgttcaagtcacttttcttattataaagttgacatacaaacagctttcattgtgtcatttcccttcctcaaaaatatcttcaatggctccccattgccatggccatggtggatcaaagctcatcatgatctagccatagcctacattgtctgacttctctcaccagtgtttaaaaacttctccaatgctagctgtgtcttgttccccaggccactggaacctccttggcgacagaattccatgttatcacttgagtgcctaggagcatgcctgtcatagtgtctgtatggctggttgctaatcacagtgtatttcaggaatattgtgcaattctgcttttttcccatttgtttatagctcttagttccttcaaattggaaatggattatggttttgcatttgactcaggaagaggaaaaaaaacacccatttttcctctcctgtttttttttttgtttttaaacagctagtgtcactcttttgggattatttgtttatatgtttgtctctgtctctggactgtgaggtctgggtgaggaggaatggtgtttaattctcatgtatatcttcagtgttcagcacattgagcctggcacaaatcaaagagacactcattaaatatttgtcaaactgatgaatattggaaagctcaagtttttatggcagacgagggagacagtgggagctgcctttttattggaaaaacattgtttattagatctgtatggatcatttagaaaatatgcagttggttatcttttatggtcaaagaagaaaatcagtataaaatgcttaattaaaagcaggagctaacatttcccctagtaacgaaggcaggcttgtgaatattttcctttccttagctcaggagatgggcaggcagccaggctcaaagatggggatgcttcatagacagatgagaaggtttgacttaggaggactgagtcccagggttaccctgggtccatttttgctttaatgtttctccgcatggatgttgaaaatgtgaatgaagagtgttaattccttaagatattctgatgacaatgtcaacccctttaaggtgattttgctgttacctataaaattatcacttgtttgtgaattgattataatggcatattttcaggagtatgttttgtacttttaatttgagattaaaagccctaagaagtgtgggtctttttcttattcttcttggtgctcctgtgcctgacacagagcaggcccttaaaagatgtgatacctggagttcttattcacttggcctcagcagagttggccctttcctgggtgtaggaaactgctgaggactaggagctggggaggcagaaaaggcaatgatgttctgaatgtttctgccactggaaggaaatcaggccctctgagacagacaatgattggatgtgctgcaggacaggaggtctgagtactggcagcatccacattacctgggagcttgctggaaatgcagaatctcagatgtgctccagacttactgaatcagacactgcagttcatcaagatcctcaggtaattcatctgcacattaacatctgagatgtgctgctctgatgagaaaaatctgggaacttcctcaaccttgagactcgatagtctggattttcgtaattctaggatgtagcatggtgaagtttgactgaccttgaatcccagagctgccactgtggggatattaattaacctttttaatctcagatgtttttcatctataaaaagtatatgttgggtattttgctaggttttttttttttggtgaggattaaatgaaataatataatgctcttggcatatagtaggaacttaataaatattacttattgctgattttgttattttatctgagccctggtgtagatggtttatttatttattatgataggagaaaattgctgtattattatgattacaatgttgtaattttgcattagttttatgtcatttatatgatttaatgagtattcttaaagaattaaaaagcatttgcatgcttttgacctcttgttttaacctgtttttgaatcttctactcataacatggacgtattatgtggctgtatttatgggtatcatgtttttggtcttttttttgagacagagtctcgctctgtcacccaggctggagagcagtggcatgatctcggcttactgcaacttctgtctcctgggtttaaacaattctcctgcctcagcctcctgagtagcttggattacaggcacccaccaccacacctggataatttttgtatttttagtaaagacggggtttcaccatgttggccaggctggtcttgaactcctgaccccaagtgatccgcccgcctcagcctcccaaagtgttgggattacagatgtgagccactgtgcctggccgggtatcatgtattttttaaacaccactgaatcacttatatttcattttggagatttcttcctcccatttattctgataataatgattaagtagcctttttatccagcactcattagacagttaatgaaaaaggttagttaaaatagggagtgaggaaatagtgaagaaatgaaattaactattttatctcactttaactgcctagctgtacattcatttaatcatgtagcttttcctttgagctgggtctgatgtttggagggtgctgtcttctttcacaaccacacctaacctgtaatacattttctgtggtatccagctttgttttctctaaagtggatagaagctgaaagacacaagtaaagcactgtaaatggggaattcttttagatacgtataatgcccccccatgtgtttatccttgtcttagagttaacacagtggtaattatttggttgggggaggggaggaggttatttttatttcactttccaaagaattgggcttaattttcacagaagcaacaactcgtcttatactcttgttttattaatttaaattctgtaaagtacacaatttccaaaaaattatatagctgaaactgtataacaagctttgggatcaaaccctactgaatcttgtcagaatagaactcaagaggtgggaatagtgcatggcttgtccaggagcatccacggagcatccttggacactaggtggggtgctctatagagggaatggagagccctgcccgatctagtgagttagttatgtggaggttggttaaaaaaacttctatatttgtttatttgcatgctactttacagttcttgaagtactttcaaattgattttctcatttaatttttacaatgctcatgaaataagcaaggcaagaatttagaggtgggaaaatggaggttcatagaagttgaattgtgtgactatgaataagtaatttccttgaaggtgcgttggaagcagagttcagatttttcagtcttaagccagatctctaccctctcttctcgattgcctcttttcttgctgttttgaaagcagtgatgagactttgattttatttagatatttataattttcttatagcattatgttaccatcatagggcatatcagtaatagtaacatactacatatgtcaatgttagacatttaatcacctctagcaacctacaagcaaataaagagacaaaactcctctggaccagcactgtccaataaaattataatttgagccacatatgtagtttgaaattttcctttgggcacattacaaaacaaaaaagaaacaaataaaattaattgtatattttctttaacccagtaaatccaaaatatcatcatttcaacatgcaatctttataaaaattcttcttgtgatattttgcactcttctttttgtactaagtctttcaaatcaggtgtgtaaattgctttacagcacagcttatctcagactagccatatttcaggtgctcacttgccacatatgttgaacaacacacctctgaactttaagaagaatattgtaacaaatgcaggcatgtgaacacttggagatacaagcctctaatactttggggccatttaatttcgagacaaatagttttacagatttcggtggctcctaataatgactccaaatcattaaaaataagattaaattatctacattgtatttaagagggccgagtatggtatgaaatatgtatttagaaaactctccatcaaatttttttttttttttgagatggactctcgctctgtcgcccaggctggagtgcagtggcgcaatatcggctcactgcaacctctgcctgctgggttcaagcaattctcctgcctcagtctcctgagtagctgggactacaaggcgtgtgccaccatgcccgcctaattcttaatatttttagtagagatggggtttcaccatgctggcgaggctggtcttaaactcctgacctcgtgatctacccgccttggcctcccaaaatgtggggattacaggcgtgagccaccgcgcccggcccaaaaatatttttaaaaaaggtttgacatataacccagccattgtactcctggacatttgtcccagagaaatgaaaacttatgtccacataaaagcctttacaggattgttcatggcagccttgcttgtaatagccaaaatctagaaacaaaccaaatgcccttcagtgggtgaatggttaaacaaactgtgctacatccataccgtggaatactacttcacaataaaaataaatgaactgtcgatgcactcaacaacttggatgggtccaaagggaattgtgctgagtgaacaaagactcagcaaaactcagtgaaaataatgttttactgggtaaaaaattatgagacattaaaaaaagtacccttttgagattatgctgagtaatctctaaaggttatatttatagaacattcccaaaataacaaaattgaagaaatagagaacagattaatggttgccagggttagggactcaggaggggggcgtcctgggagggggatggctgtggctgtgaaggaggatcatgaggcaactctgtggtggtggaacagtcctgtattgtaattgtaatggtggttacatgaacctatatgtgataaaattgcacagaacgcacacactcacacacaaacacacatgagtgcatgtcaaactggtccaatctgagtaaggcctatggatgtaccaatgctgatttcctgatttttctattgtattagtgttatagaagatgttaccagagggcaaaactggatgacgggtatgtgagacctctctgtgctatttttgtaacttcctctcaatctatacttatttcaaattaaataaaagcctggtgcttgaatagatgttctattatttgtaaagcctccttcctagaactctacagtgaagaaccccagtgaagatgtatgaatgaggatgagcgtggacatctgttcagggacccttttaattttattttatttttaccgttctttatttatttttaattatactttaagttctgggatacaagtgcagaacgtgtaggtttgttacataggtatacatgtgcagggctgctttttctacaagcttggggctgggcttatctcagtgcagaggggaatggttgtggcctagctgcaatctctcccctaaataagaagggaccccattcttgttccagtttcttgttaaggtcactgcagcagaggatgccatctctaggctcctgaatcagaatgtcccctgaggtgccattgggctgtttgaccccaccttgggaatgctagagcctgagatcttgtcacttgctcttcacattttcatattaatgtgtcactggctttcagcagttgcctctcagtaatgcatttagtccctggtgagtatttcatagccagatgaactttaatccctgaatgcgctgaaagggagggttccttttcctcttttgaagattctgctcccctgtaagaaaagtgcatgatttaattagtggatgaaagaaaagggcccaaatggagccaaaaaagagtcagcagcattgccacccacctgcagacacacaataggataaaagcagcacctgatcagggaggggaaggaacgaggagggagagggacaggcttggccgtgggtgtagcccggagttgggaagcccgtggcccaggatcaggtcagccactggctcagtgtgaccttggagctcagcctctgtgggatttgttttctcatccttttaaaatggagatggtagtatagatccttcctacctccagaaacatgtagacagcagaaagaagatgggggcaaatctatgaaagtataaaatgcactataaaaaagtataatgcagtttataaatgattgctcctaatgcatcaactggagtgaaactagccagagtgtaagagaggaaagaggggaagatgcagaactctgttcttgtatcttttttaaaaagcacaaaaaggtgatgtcttggtaaagagtagaagtttgacatgttttgtcgtgataagaatagaattactgtggtgactgtccatttatccacttgggatccgagcattccaaagtataagatgcttcattacaggccgggtacagtggctcatgcctgtaagcccagccactttggaaggtggaagcaggaggatcttttaaggacaggagttcatgaccagcctgggcaacatagcaagatcctgtctctataaaatatatttaaaaaattagcctggtgcagtggaatgcacctgtagtcccaaatactaggaaggctgaggtgggaagactgcttgagcccaggagttcaaggctgcagcccaatatgattgcatgactgcactcaaggctgggcaacaaagcgagacgctgtctcaaaaaataaataaaaatgctccttggctgtataagacatattttattgcccttttggagatttataatgagcacattaaagttttggaaaaatcctgcaacaaagaaatccgttttactttgtttagttcagtaactccttagtttattatccatggacccctctcctgtgccctgtgacttcctcctaacttgttacatagcctggtcaagtgcgctggaacaagggtactgctctgcagaattctgaactgagttcctggggttttgttgttagcttgtttgtgactgtcagactatttttttttttttttttttgagatggagtctcgctctgtcgcccaggctggagtgcagtggcacaatcccagcccactgcaagctccacctcccaggttcacgccactctcctgccacagcctcctgagtagctgggactacaggtgcccgccaccacgccctgctaattgtttgtatttttagtagagacggagtttcactgcgttagccaggatggtctcgatctcctgaccttgtgatccgcccgccctggcctcccaaagtgctgggattacaggcgtgagccaccgcgcctggcccagactatttaatttttgtaaataatttagtgttttgtttttgtttttgttttggcctcaaggaaactcaaggaaaatttgtacctcatggttagtttccattttagaatactgtgacctttgtatctttgtattgtttttcaagttttctttccttgtcttgacagattcacaggccctgacttaaaaattcttgttactgtattgcttgttgtatcataagccatttcagaatctgcctggattgagatgggctatgaatataattaagaaacaaaaacaaactaataaaattacaataacaactcttttttgagggcctgtcatttttcaggcatggtactgggttctttgcataaatgatttcttccttaatgtgatcaaggtgttcctcagttttgtcctaggaggttttagatctcacggttctaatttagtttctcagagtcttacaactgggagggacttttgagagcatctgaccctaagaaataacctccagggagatgaaagtctaaaccagccaggacagatggtcttctgagactctccatggcaacctgcagctaatctctgcccttctgccacttctgggaaaattgctttacggaaatgctgttttaactgggagcatgaaatcactaatgatgggcaaggtgggggtggctggtttgtgtttgggaaattaaggttcagtgcctgtctctctggggggagcagctgctgtgagccaggattacctaggacagtttctgtctgatgagagaaggggacaatgccttcctccactcaggtgggtgaaggaggactctcacatgtgctgagtttgtgctagcatcagtcttttcattgccctgccttcacataccccagcatctcatctaagatgtgtcctgctgacatgagccaagtaatgtcattcttcctcatccagagccatttctggctgtcccaggctttagagcgatttccctcacttggcataggtctttgcaatattttgttatatcatctttccatgtgtaagccccatcttgtctccttgtgtagactgggcactcctgaaggcagggatgatgccctacgcatggttgtttctcaagttactgttcagtaccaggtgcatattggtcctggggtggggatatttattgttgctgctggttggcatcagtatttggtaaatagagtggagggatctgtgctggtctctggagatacaaagatgcgtggacacttttcagttcatagtaataactgagtttcttgaggggagggactgaaatttattcatgtctctccaacactgtacctggcatattgaactgtggcagaggctgctacttgttcttcccaatattattattattagtggtagttgtagtaatagtattaatagtagttttccctctccttctctctttcttcctcttcctccaactcctactctccttctctttcttcctcttcttcctcctcctccaatagtaataggaactttacctgggcacgtttgccagctttccttgcagctgaatatggtcatgtgaggttctggtgaaagagacataaacagaggtgataattgtaacttccaacttgtgctttaaaaggaaagcagtgggccatctcctttttctccttctgttgggctggagcacagctctatctttgaccatatgaataaaggtcacacttttgggatggcagagcaacaaagtggaaggagcctgggtcctcatccttgctgagctgttgccatgaccctagactgaataactgaactgtttttatttgtaaagtaacatttacatgagagacaaatatacttctatcttgtttaaacttttctacctttgggtacaaaaggcacttattatagctgcctagtctgtattctgatcaattcaggaggtattgataaatgtctgttaaatggatgaatgaatttctgccttcccttattattgagcagctttaatagtggtcagcgcatacatttaaattgagaaaggaggtttcccaggtgactttcaccgtatttcattggccagaaatgtgtcatgtgggtctctctggctgcaaggaggctgtggatgtgagttttattttccagtcactgtagatgaagaaggcagaaaaggggtaggaaaaaggaggaatgagtgaaccaatctatagtacctatcagcagtcacatataagaaaattagttttcatttatgtttttttttttttaaagaatataagccacctaatttgagtattgccaagaagagatgtacttcttatcctagttgaaccagattttgggaagacaagatgttttcaaaagagtagataattatcagcgtggaccttggggctagatgtagtcatcttgtcacacaacttgattcatggccatttggaactgtctacaatgggatggatgttgatgctgaggccacctggtgcttcagtgtcttaaatgctttctttggggccacagccaattccaggcaaggcatggcaatcccatagtttgtaggtgatatggaaaaggtagtgtcagggcagtcagaaaccctcagcaaatacttaagtacttctgtgcaccagcaatgctaggtaccagggaatcccataaatgatctctctgccatcaagagggagatgaagagataaactgatgagtcccccacagggtaatgaatgccatatagaatgtctgtgaagagtattgggaacaaagcgggagaacaagacagaaagtttccctggaagagcaataggaggtacctggagcctctatatttaatttctaaagagattctaaaacagtgggtctgaaatatatagtctgcttccaaattgggtttaaattagcatcttgtgtatcatatatacattgtacttgttactctggggaatggagagtttcaaagaagtctagagttgaagcattgtccttttctctgtctaggggagacgcttaagcaaacgtgaatgtacttccaatgtggcatctaagcagagagaccatggaaaggccaagttttaagaattgagtgtttctcctttcgattaaagaaagaaagttgctcatgaatatatgtcacttcaggcaaggggcatgggatcctgaaaatatctgtgtcagaaaatctttgcaaacaaaaatcctcttccacacctttccaaagtcaagaatacgttggacatttaacattttaggttttggattttcttaaagcaaggcacacaagaagatcaaagaaggtgcattgacatgttggcaaagaagaagcatgaaattcaattctgtggaactcattttaccagagaaatttcataaaacaaagtaaacttatcagtggtttaagttgccaacccttggattccaatgcaacaagcaggatggatgcaggcagcttgcccaggttcaatggagtttaaaggccaggtgtttgtgtaggggaaggaaaaacattgtcctgctcaggaaaaatgtattcaaataagaaacgagaaacccattttgagaatttagtgcatatgttcattttacaggtgtgttgggaaattatcggcaaatgaatggatttggtcacaaagcctttgggttgatttgggggaggaatgttgcttcttgggaaacagccagaggaggcaaaagatatttttgggaacattctaaggcattctctttcctcttttttgttgatggcttccaagttgtctagccctgaatctcttatgtgcattggggaattacatagcggtagaaggcacgcatcatttctttacttaactatgtgtccagaaccattgttgagttctggagatgaacagacacacttcagcctttaatgaactgctaggcaggagggggaaacacacatgtaatctaaataatgtaatgtaatgccataagtggtgtaaaggcttgtggttttggagaagaggaacagatgaactgtccagaggacattagagaagccttcacagaaaagattatatttgagctggatactgaaggatcttgaaggtgattgccaggaagaagggaggaaagggcagaccagatggaggtatccacgtatgcaaaggcatggaggtgtgaaacatgatgcctctaggggatgtctcatttagctggaacacgggttttgggaggcccatggaggctattttgggaaataatactggattgcaaatggcctgatatgcttgctagtctacaaatctaaacttaatcttttaagaagtaaataacttctctgtaggaaagtaactacaaacggtaaagaaagacatgcttgtcaaaaaggccagaactcctgaatgtggaccccaggaactcacatgtactatctggtctcccccaggttctgcaaggacatcaaagacctgaattttgcctagaaactgaccctaagagagacaggaagtagtgagaggatacagacccaaccgactgtagaaaactgtgggattgaggttaatatataatttgctttaacttgggtgaatgtggaataaggagagtggcaaaatgttaagttcatactcatctgtttataattgtgtgctctgagcaccctttcctttaaagtgggctgcacacacagagaaagaaacatttttcacacagtttggaccagtgcctgaaaagctcagactcggagcgtccaggagctgagatgcctgtgctggacagcccctgattggagaggagttaatgatcagtgcccctaaaattgtcacataggcagctgattatgagaaattggtccagctgtttaggttacttttgagatcaaaattttgtgttttgtcaggggagtgagttgtcacaaaccccatgtggccaaggagagactactagcctgcccttgtgccaaaatgttgcaagcttctgtgggcagctgattttagtagaccttatagggaaacccctcactccatcttttttttcccctccttcctacactgagatgtagcaggaaggaccctggcctttgggactggaggtgtggttagctggaagtaagtaaggttctgctagttccctggtgaacatagaatggtacttctttctgtctcctcatctgtgaggtaaaaacattcagagactcagtgtttcttatgacattgataagctaaggttccactcccctttctggcctgttttgagttttccctgtatactcagtgagtgcatatgatttagaaaggtctgggtggctcaggcagtgggtgtgagaagagctgcctcactttgggctctatgtccttaggtccaggttgggatcaagtccaataagctaaagaaggctttcgggaaataaaaccagaggtgttttttttttttttttttgagacagagtctcgccctgtctcccaggctgcagtgcaatggtgtgatctcagctcactgcaaccgccacctcccgggttcaagcaattctcctgcctcagcctctccagtagttgggattataggtgtgtgccgccacgcctggctaattttttgtatctttagtagagacaggatttcaccacgttggccaggctggtctcgaactcctgacctagtgatctgtccgcctcagcttcccaaagtgctggagttcgctaaccaaggcctgcaggccaaatttggcctgaggcctgtttttataaataaagttttgttggaacacattcacccacatgcatttacatatcatctgtgattgcttccatgctaccatgtcagagttgagtggttgtaacagagaccatgtgggctgcaaaggtgaaaatatttactagctagccctttacagaagaattttgctaactaacctgtcctagatcataaactctaggagggctggggacattgaaggtagtcagtaagttttgactgaatgaatgaatgaatgaatggatgaatgaatgaatggtcaggaaattggaatttgttggatatgtaatttgacagcagacttttaatgacacacttcaggttccattttccctttaaataaaataagaacagtgctacctatgaaacaggcagtacttaggaggattatttcccataatataactttgggtgtttaaaatgctattaaaaatataactaccatctatgaagctttgtatgtgttgagcactttattaagagctttatttttattacctcttttagtcctcaccgccacccactgtgagggaggaattattgatcctagtttatagatgacagagctgagtccagagaggctgagttacttgctgaggtcacagagctggtaaggcattgagcacagggtccaactccagggtgtctggttctaaaggcttcccatcatgccccattgcttctgagtgctgttaggtgcttcccaccacttttttaaataaaagagacagatatcaattttggagaggggtcttcaagatagaaacaaatggcaaaaaaaaaaaaagttggttatcaaatcttttaaaccatttatgtgatttagaaaactgtgaagttactcatcattagaagtgcactttaaaaaattctcttccttaaggttcagctcagtgtgcttcatggaaaaaactaaatgggggagcatgttttctttgggaaaaacaaaataggtaagttttagggatttgtagaattttcatttgtttagcaatggtgtacgtagtggtaatacacattcaaatgctgccttctcccagaaaccttctgccaattccgcacatcacttggaactgggtacctagcacatagcagacattcaataaatattgattgaatgaatgaattagtaccttctagcatttcacacatattgccttccagtatacttggttttatgtgaatgtgtgcccttacctattatagcataagcactagaagagcactggtaccctgcccacttctttgtaccccttatggtacctacctagcacagggctggaactgagtagatgctcaatgaacatttgtggaattatgctgtggcccccaaattattttgtggcccctaaagctttgcagctgagtgaatggcccattgaaaactagcacgatgatcagatggacttctctctgtctaagggcattgattgagacccacatttatattgagggtggaaatgtccaacaaagacaaagaaaagcatatttattgctttagatagaagtcatatttgtttctttcactctggaagatatagtcacataaggtcatgagctattttttcttcctacttaattgctagtctgtgggttggtgaaagctcacatgcttagcttttcagtgaaactttcacagtccatgtggctctgactcagaattttttcccctatctgcttcttctgttgccaattcattgtttatctcctttgtgttttacatctgacctattattttgcatgctgttttggattactgaggtagcaacatccaaatagtttctgtgtacattttagcttttgggagtcaggcagctgctctggggcctgtttgagtcaggtcagggtcagaaatgcccttctgcttttgtttccgtggaagaagttggcctggaactctctctgggcaccttctgcgccctctggcaaccagaaaagcaaagtcgttcatcaaaatctcagactggagcaactccttaaaacagcttccacagttcttgcacatactcctttcttgatttgttgcatatcatttcaggcacctcttttaatgcagctattcaggctgcctaaggcagtggtccccaacctttttagcaccagggaccagttttgtggaagatagttcttccaccgatggggtgggggtggtggtttggagatgattcaagcacattacatttattgtgcactttatttctgttattattatattgtaatatataatgaaataattatataactcacaataatgtagaatcagtgggagccctgagcttgttttcctgcaactagatggtcccatctgggggtgatgggagacagtgccagatcatcaggcattagactctcataaggagcacgcaacttagatacctcgcatatgcagttcacaacagggttcgctcctatgagaatctaatgccaccactgatctgacaggaggtggagctcaggcggtaatgcaagtgagggggagcagctgtaaatacagatgaagcttcgctcacttgcccacagctctcctcctgctgtgcagccaggttcctaacaggccatggaccagtaggagaccctggcctaagggaccaggacagtggccagtgcttttcatagcctcttagtacttctggtggagtgtctctattcccctcaattccctcctattccgctaggagtttgaatctgctttgcccagttctgtcctgccagcctttttcctttcactgaattgccttcactttttgcctattagctttgatctctttggaaaaaagggcactggggtattattactgcctctgtttgtttttgcaaatgcactatgatttgtggttggtcttttggctagcctgaggctacctgaccctccctcaacagccctagttcccccaggtcattctatagttttgcccatttctttaattaatgttggtgagagtctccgagcaatgaagactttttggatatggagagaagcagaaccagagggataccagtaattatgctaatctgagagcattaagtcttcaaatatacatttttggataagcaattctgttgtttttgaagtttggttgtctttttgtttctgggtggtggactataattttgtattaaggaaagaatgcctgcccttatatatccaggactggattttttttttctttttcttttcttttcttttctttttcttttttttttttttttgagtactcatgaaaggaaaccataagaatgtttgggtctaataatatacttgcttgtgtatgaagataaaaccaataataacattaataccacccttcagtggtgaaatgctttaacctttcaaaacaactccttttatgaacttactctatcagttggcaaggtgatttcagggctatctcctgtggtgatgatggatctgtgggagcttttctaattgtgtgggtgaatttgagagaccccatcccagtggttcttgttcaggggtgagtatggaatcatgtggggaaccgccatgaattacacatacccaggtcctgcccaggacctactgacacagtcctggggtgggggacctgcccacttggaaaacttcctgggacttcctcagctggaccctctggggattggggaaatgcattgcagtcacctgcctggggtagtaggggctgccacatctgtgactaggacccaaggagagtgatgatgacccttcttggaatcatgcagaacacacagtgacagtcccttttggaagctggccacaggctgcactttattcattattttaacagcaaccaaacatttgctgtgtgcccactggtggccgctagacagtcttcccaccctttagctcatgtagtcatttaaaccagttccatcactagagaaatgtgttactagccccttgaaggagagtgggccttcaactggattcaggagttgtggtctgaggagagtgattgatatggtttggctctgtgtccccacccaaatctcatgtagtagctcccataactcccacgtgttgtgggagagacccagtgggagataattgaatcataggagcaggtctttcccatgctgttctcatgacagtgagtaagtctcatgaaacgtgatggttttaaaaatgggagtttccctgcacaagctctttctctctttgcctgctgccatccatgtaagatgtgacttgctcctctttgccttctgccataattgtgaggcctccccagccatttggcattgtaagtccattaaacctctttttcttcccagtctcgggtgtgtctttatcagcagcatgaaaatggactaatagagtgatttaatgagtttcaccagcatgggtttctttagcctcggtttctttgtctgcagtatatgggctaatggtacacaccttgaggttgttgagggagaagagacgggctcaagtgctgcctttgtcttaccaaccttgtgaagcctccttgagcagccatgtcttcatttgtaagatgagaataagagcacctgttttatgggctttttgtaaggattgcgtgtgctcatgtaagaaaaaccccttgcaccctgcatagtaccttgcagagcaaatggtggtgataatgacaatagaaggagctctctttattgagtgcttactgtgtgccaggcactgtgctgggcactggactacaacagaggggaaagataggcatcgttcctgacctcactgcgcttaacaaagagaaagctctaagagaaagttttcaaagcattacccttctctgtatatttaagaggaaagctttaatgttataggatgccttctaaatatgtattttataacacagtgggtagaatgtggaatgtgtcttctgggagggaactggagttttgcatttcctgcctgcttgtgcttttgaatttgtggctgtaatgctgccctgcctgaggtttcagcagttaatatttcccagggcagcatgatgtcaacgccccgtggtctcttatctacaagaagggtatagccggggcagagggagagaaaggactattttcaaagcctctcttgaagactttgttgagctttaacttaaaattttcctcatctccttcctcaaacgtttgtgcttgatgtgcataaaccatgccagtgttttggaagattcaagtttgaccaccataaattggttcatatttccagcagggcagttatttaatttcctgttggaagtctacaaaatgttggcactgtttgctctttggcagaagaccaaaactcagtacagtatcattagcatgctctggtacatagattaaagcacgattgtctttaataagaggccatccctgtttaggatggggctttgggggctgcaagggtgcagggaagcacaacgagctttctaatcaaaatcaaagtgcagttactgggactcactcgagaagggttaaagggagggcagaattccgatttcttgtctcaatttcatttgtttgggttattttgctctagactctgggagagttttggaggccagggctggctggtttgtgggataccctggtttaagcctcgtgcttcttctgcattcctccctcttggcagtacggctcatgggagaagcccacctctgaagcccatagagaaatgcagagtgtctctacggaacccactgtagtaactgaaatgttataatggtgggcatttacagaggctctgttatcagtgaggcactttacatatgcatattcagcctttacagtaaccctgtgagatacgtattattattgctgttttgaggatgagaatactgagatgcaaaaagattaaagtatctgtagccagtgagtatctgagctggggttagaacccagttctgttccttggaaagattcttactcttctcatataccctaataagggcctggggaaggaaaggatctgagttttcaaaaaagcttgaaaatttgcctaacatgaatcttgggaaattatttctaggggcttcttaccagattagctctgtttttctttcgcagaggcccttcagtgttggctctttggtagaatgagcatagaaatgtatttttttcctacaaatattgtatcatgaaaaatgtcagacagattgaaaagttgaacaccacctacattctactattgctgttttattctatttactttatcacttgtttctccatctaacctctaagatctatttatatttgttagaacatcttttctctctgcccttctgttcctttgattgatggcaatggcctgatgggaagtaattcacaaaaccagagggaaagtacagtgcttagaacaatcttttttttaggaaaaagagaaaattgttcttatgtttaggtagagcccaaaatgggcatttttcccctcccctaggtctgttgtttaaaggatctgacagaaataattataatgaggctgatggtgaatacataaggtataacctattattactgtcttctatgcaccaggcatgatgctgactgcttagtaaccttatctcattgatcatttcaacattcctaatttacagatgagcaaacagcctagagaggttgatttctgagctgggatttgagactggtgtgtagagactatggtgtgatttctctgcatttcaaattatgcttccctatatttttgttccagggtctcagtgggaggccctagaaggttactactaataaggaaaaattgctaaagccctggaaattgaaggctaccagaaccttgtaaagattctctgggactagacctcattcctctgaggatccttgtcagacagtttccagggggtggggagatgttctgctctccccagagtgtcatagaaagtttctgtggctttcggaatttctcatgactgattcacatcttcttctccagcttagaagaaaatccaaacacttacctttggtttatcagttggttaatgttgttttcttttcatggtaggatcatctatggcctccttagacctatacaagtgacatcttttcttcctggggaagaagatggtttctgcaggcactgacttatgagggcaggtgcataccttttgtaagggatgaaacttgaaaaagaatgggtgctttttgatgtgtttatgcttgaacctgcttccttgttgagtgtgatcttgagcaagtcacataagcttcttaaactcttggcatccctgcagcagttattattgtgagggagatggaaaaaaggtatggatagagttctttccattagaaaatgtaatattcctcaggagcccatgaagaggatgctgctgaaaactgaggacatggcatagataggaattgctagagaaaggcagtagagagaagaaaaatacctgttggttgaaatagttgattggaggaataaaaattgcctggaacttaaagtttccttcgaataccagcactgtccatcagtagctgtataaattagcctctttggtcattaagtttcatcataaagtgggattattaatacctacatcatagtcttattgtaaggataaagtttacataatgtatgtaaatctcctaacagtagttcatagtacttggcgataaaagatatctcttagaagtaggaaatggggaaactgaggtacaccttgaaacctgagtaggatttggatgcgtaaaatggtccagttctgaaagtattttacaaatatcaccatggaacactatgcaggcatcaagaagcatggttgaaacccaaaactcttctttcttttaataaggcaaaggtggttaactttttgagccaaaagttccaaattgttcagtaaaatgtcattgataagatatcaaaatatcagatatcattttggttgaagctcaagttggcaagaaccaagggtggaattgctaagctgggtgacacatttgaagccattgtaatgttttagtgatctccacagggcacgtcattggtggctctccctgtccccctgcaagccctgcaatctggctgcattttctacacacttgtttggttgtttcatgaaatctacccccctgtactgctgcaggccacaaagaacagtgttcagtaaggtggattttggaaactgaagttgtgattgcactgtagaaggctttcattgtttgttttgttttgcttttagtttatggaggactgttgggagattaggagaaggaaaatgccccagtagaactgaaatcctagtctagcacctgaaaagagtgaattttgccttcttttttttctctgctaccttgcagtcatttctgctatatgcagattcaggtttgatgtgaattttgagtttagctggaattagttctttcatggccttggggaagatgtggataaaagaatgaacatactaagggttgacagtaaaattcaaaggtcaggtaaggttctgtatgcatcctctgcctggagtggttgtgtagtgatagtgttaggactttataagtctttttctcacatcatccttataacaagccttagagataagtattgtttttattgctattgtgcagatggagaaacagatgaggaatggagaagttcaataacctgtgtgaggtggtacagctaggaagtggcagagatgggacttgaattcaaatctctgacatgtaagcccttccagcaattgtggtggaatatgctatctctgttacaggcttctcttgtaacaagctgtgcttgttaatgctctataaggagcctctgggagcaaggaaaagggaaagattttttgtgttcactttgcatccacacagccctttttattctcaagattatgctggggggaggaagcactagaactaccgtgaattaagtgttcacattgtacctagattaaagcaaggtgctctgcataattctcacatttaaccatgctgtccttatccttatttcattgatgagcttcagaaagtcaggttccttgaccccagtttcacccacagaggaagttctgatggtgaaatttgaacacagaatgagtccaccaccttgccttcctcttcggttttcaatgacttctccctgacagtcctgcgatggcatttgtggttttaatttcaaagacccttacaattgttgatggttgatagcatttggtatccattggaaactgccaacacttttcactgctgcatttggaagaaaatcatagtgagttgatgtgttagtgattcaggacttctgggaaactgagagcacccgtgtgtacttatttggagtcaatactttatgaacaactttggcccaaaaggagaaaaatctgtcttctgaaattgagtgcaggtctcttagtggcttacctcagcagggagccagttattacataagctgaataccaggtccgtgggtttccctaacctgaaaaagaagcagcgtttgcagttatgaggaaaacagaaagacccatttctctgtggcatgatactgaacaggcagcttcagccgtgaggatattttggccggaggaaaatgtagcttaagaaaagtcccagctggttcaagtgacttaagcccagctattcatgaaatattatctgacagctcccccttctcctcaagtggctggggagtgagtcacaattgccccagaaacctgtgttctcatatgggattttggtattccaggtttgctctactttgcacactggacagcttcatgaaaagccatatttggtgcagacattttcttgtgatgataaaagcatttagtaaatgtactgggaagcttgccgtgatgaatccttttgttaagaaattaaccaacattaattttgaatgtaggactgtcccacgtgcccagcactgtgcttgctgatgtgggggttcagagattatgagacatgtgaaacactagaatggaatctccatgaaggcagcgatttgcctattttgttttctgatgaaactgtggtatatgtaacagtgtctggcacatagtggatgcgaaatagatatttgttgaacaagtgagtatgtctctgcccataacagcttacaacctagtttgcttgcattaattaatcaactaattattaattaatgaatgattttattcctttattctacttatatgagcatccagaagtcctcaattttattaggatatctttaattctttttattatttaaaaaggtaaacatgtgatgtgtttgttgtagaaaatgagaaaagagcaaagatgtaaaaagaaaaataattgagacaataattattttaatttaagcttatatcattagaaactttttccatgtaaatacctgattttaaaaaatgagtttaattctcttgcaagttgattttataacttgctttcctcccacttatcagtgttattgtgaacagctttccatatcaaaatacactgttctcaaatcatcaatttttaatcacacaatttagcattgtgtgtgattgcatcatagttttcttaatccctattgttgaattgttgggcattactcctctctctgtttcattagtataaacaatgctatgattatctgttaatttttgtgcatatccatgattattttcttggcaataaccctttgaagtggaattattgagtcaaaggtaaaagtcttttgatctacacaatcattgtggctaccataaaggttacagaaatgtattcccctctctgtgttctgtggaaataaagtggtttttttgtttacacataactgatgccatgtattgtcatttaaaaaaaaaacaactttctgggttaaaaaagggaatattattgttatttaagttaatatacttttgattactggtgatgttaaaaatcttttaaaatattttttgtcatttgtatttcttcttttgcaagttactggtttatatccattttcttactcagagactcgaggacagatcttctttccttggtccctcccaatccatgatgggacttgctatggaatttgtccacagttagccccagtaaatgttgaatcctcccatccacccactcattcatctacccactcacccatccatccatcgatttatatgttgattcattcaatgagtatggaggacctaatagatacaaggtttataatttaagatagcgctttgaaagtttttttgatattgctgctaactacagacattacttttttttttttttttttttttgagatagggtctcactctgccatccaggctggattgcagtggtgctatcatagctcgttgtaacctcagacttctgggcccaagtgatcttcctgcctcagcttcctgagtatctgggactaggagtccgtgccaccacacccagctaattgttttattttttgtggagataagggggtcttgctatgttgcacaggctggtcctgaactcctggcttcaaggaattctctcacctcagcctcccaaagtgttggaattacaggcatgagcccccacacccagtcaaaatcttaaacttttttttttttttgagacgaagtctcgatctgtcgcccagggtgcaatcccggcttactgcaacctctgcctcccgggttcaagccattctcctgtctcagcctctctagtagctgagattacaggcatgagccaccactcctggttcatttttgtatttttagtagagatggggtttcaccatgttggccaggctggtcttgaactcctgacctcaggtgatccacccacctcggcctcccaaagtattggaattacaggcgtgagctaccgtgcccagccccaaatcttaccttttaagaaaagacatattaatatgaattaatacaatgagcaactaatccaaaaagttttttttctcctaatgagttttcctttgggtaatggaactgatcttgtcttttctgtgcacccagcagggttgggtagacagaaatcaacaaatgttttctgtaaaagtctggatagtaaagatttcaggctttgcaggccatatagactctgttgcaactattccactctgctctaaaagcaggaaagcagccatagataatttgtaaacaaatgagcatggctttgttccaatgaaaatttatatatagaaataaaatttaaatttcatacagctttcatttgtcacaaaatattatttgtctttttttttcccccagtcacttaaaaatttaaaaaccattcttaagtttgtaggccatacaaaaatagacagtgagctggatttggcctggggtttgcagtttgctgatccctggggtagggtctcagaagcatgctttgaggctttgaggagctaatctggttttgcaaatttgctacaaacaaccccacaatggatgattcataaatgaataatagaattgagtttagctgaggcttggatatgtatcctacctcttaatgactggcaatacataattcttagtgtgttagcaatattttaagcttctaaaaatacttttattatatatttactcataaaaattttacagttatgagcaaagaaaaaacgctttcctatcctttgtcaatattttgatgtgtcttttttcagtcttcatgtatatatagggcttacgtatgtataatgtctttctttacaaacactgttgaatcctgctttatttctcttaataatatatggtaaatatttgtcagtgttgttgaatattcaaatataaactgaaaccacaataaaataccactacatacccacagaatggctatgattaaaaaaacaactaacaataccaagcattggtaaggatgtagagaaactgaaatcctcatccatttctggtaggaatctaaaatggtgcagccactttggacaacaatttggcagtttctttaaaaattaaacttagcatatgacccaggagctccagtcctaggtatttatccaaaagaaatgaaaacacatgcccacacaacgataggtatgcagatattcaaagcagcattatttataatagccaaaaattagaaacaacctaaatgttcatcaactggtgaatggataaacaaaatgtggtatatctatacaatagaatactatttagtaattaaaaggagcaaaataaagagaggctaccacatggataaacctcaaaaacattatgctaagtgaaagaagttaagcacaaaagaccacatattgtgtgattgcatgtacattacatttctagaaaaggcaaaaaactagagacagaaagcagatcagtgtttgcctcaggcaaggtgggaatggttagcgtcacttctaggagcagcagaacttttggggatgacggaaatgttttaaaagtcgaatgtggtgattgcacgactgtatatatttactaaaattattgaactgtacactaaatgggtgaatgttatgtgaattatacctaaatataactggtaaaaatattctttgaaagctgaatttttaatagtgtcatattattccatcatgtgaatgttttatttctttatcctggatgacttgggagaaatattcagtgtttatttccttttacgccaaaatccatattcagtaggttcaatttgagccattggacttaaacaagaatgattcagaggaatgaatcccaatccagttgtcaagaaacctagcgtggtctcaatcctgcctccagctgggtggacctcagttccctcatctataagatctaggacagaaataaatacaaggaaatactgggttccagggaatagaggattagaaatagaaaacatagtagtggcagtaatgaataagactgatttccctaaaagtaggaggccaggcactgattatttttatttttattttttagcttttaagttcaggggtacatgcacaggtttgttacctaggtaaacttgtgtcatgggggtttgttgtacagattatttcatcacctgggtattaagcctaggactcattagttatttttcccgatgctctccttcctcccaccctccaccttcctatatgccctagtgtgttgttcccctctatgtgtttatgtgttcacatcatttagctcccacttacaagtgaggacatgttatatttggttttctattcctgagttagttggctaaggataatggcctccagctccatccatgtacttgcaaaggacatgatctcattcttttttagggctgcatagtattccatggtgtatacataccacattttctttatctagtctatcattgatgggtatttgtgttgattccatgtctttgctattgtggatagtgttgcaatgaatatatgcatgcctgtgtctttataatagaatgatttctattcctttgggtacatacccagtagtgggattgctggattgaatggtatttccatttttaggtctttgaggagtcaccacactgtgattcacaatggttgaactaatttacactcccaccaatggtacattgtggagaaaaaggaatgctttctccacaacctcacaatggtacattgtggagaaaaagcattcctttttctccacaacctcaccagcatcagttattttttgactttttagtaatagccattctgactggtgtgagatggtatctcactgtggttttgacttgcatttttctaatgatcagtgatgttgaactttttttcacacatttattggccacatgatagactggataaaaaaaatttggtacgtatacaccatggaacactgtgcagccataacaaggaatgagatcatgtcctttgcagggacatggatggtgctggaagccgttatcctttttttcataatggttgctggctgcatgtatgtcttttgagaagtgtctgttcatggcctttgtccactttttaatggggttgttgtttttttcttgtaaatttaagtttcttatagatgctggatattagacctttgctgggtgcatagtttgtgaaaattttctcccattctgtaggtagtctgtttactctgtcgtagtttcttttgctgcagagaagctctttagtttaattagaccccatttgtcaatttttgctttgttgcaattgcttttggtgcctttgtcatgaaacctttgcctacaggtgctgtttatttacacccctgtcccaacctcaccccactccctttcttttgctggtgggaagtcagtaagaactgtgggtggggttctgaggtaatcaatacaaagaagaaggtaagaaattggaggggactcaggggagatggcaatgctgacaaggggttggatggaatttgttctgtaaactggaagcattctgcttggcctcaacacttgccaaggcgttgatgacacacaatttggatgatttaatcaccaggaaactatctaggtttcttgttctgaagtatgagaggacagcctattaaaggaagaccgaggctggatattgccatgaaaatagtaagttttcacgtttggcttccgaggggagagctggtgccctactcactgcagggaaatttaaactgggtgaaactgaactggtttccaattgcttgtgttctccatttccagccaagttccaggttttcctagagtacagccaggagcatctgcacctagagaacacagaataaaattgtggaaaccaaacttgtaaatgtttttctcattagcttcaggctcccagccaccaataaactgtaggctttaaaaaatcctgtattattttgcaagttaagagaatgtgcatattccccttatttatatgttcaggattttcttaaaatgttacacatcaagcatttatctgctaagccaccccaaaaggtaacagcattctagtttttgtacaaaagagaaaaaaaattccacttaataaacttgcagtaacttgagcctgttggtggtcttggaggaaacccaaatccaggtttggttgatactgtgtaatgtgaatgcaattagtagcggtttttctaaagtagaaagagatgtagaaaaataatgcatagcaaatttaggtcagagctgggaagcttataaatccttatttttgttttcattactttaagtaatagggcttttgtctttattatgtaatttccctagcaataatatgttttaaaacatttttctgttaatttcatacatttgatcagaaagccacagttcataaacccctgtgatgtggcagctgtcactgtttatatatagaggatgacttcttgttcatccctgggaggccaacacaaaaattactgatgggggcaactttcactacctgttttttcatttagtagaaggtttgcaaagcagttttcagttgatcaacatcctcctgataggctaaggagtgaactgacctttacatgcatggtttatttcagagcatgttatttgattccagcatatttaaacctaagcaactagattgtaaggtctgtaaaaacagaatttgtctttctggttttttactctattcccctggcacatagtaggtgttcaggaaatattagctactattctcctctccaagatgcagctgttcctctccagctgtcctgtccttgctgctcctccttgaacttgccaggctactcctgcttcagcactttggagaccacagaccagcagggatcactccctctcctcttctgggtctttgttcagattataccatctcagtgaggccctaactatctccttcctttctttctttatttttccatcatatcatcgccatctgataaactgatatattgatgtactgatatattgacttatttatttgggaatgtgagctccaccaggacaggtgtttctgtctgatttggttattgctgtatacctagtgcctagaacatagttgctataatttacttggatgttccgccacgtactggctgtgtggtaatagctaatgcatttgctcccttggatcctttgtttgattccccatttgtttcatatggcatatgtgggtcagatgagatgttgcacatgaaagctcttttatgctatgtgttatgcaaatgtattcacttatttattcatttaatcaaccagatgcagttcctgccttcacagagcttaataattggacaaataagtaatttcaccaaagtgggaatgcgggtgatagggatagtgtgatagggaatgtgcagcgtgctatgggagcaccgtcacgagggattcctaattcagatgtggggacaggaccctggaaggcttccaggaggaaggaacatagaagctgagatctggggatggaatgggcattcaacaggcgaagggagtgtgatgtaattgatggcatggagagtattgcaggtaggaggaataatgtacagagtctggaagtgcagaaccatagagtactggtggaactgaaagtaattcaatctttctggaatatccagtgtggggacagataagtggatagggatgtggctcgtgatatagtctggggacagatcaaggagcgctttgcaggccatgctggggagcttggacttgatcctaaggacagtgtggagccatggaagtcttccaagaaaggagtgacttggtctgactttcattttcaacagtcattttatggagtaagacagcttatttcctcgccaaggaacttgaacacaagctcccaggaagggaggttgtgaaaacagtgaaagggccttccagaaagtaaatccttaagctccatgaaattagcttaaattctgtttgaatctgactggtgaatatcatagcaatgaggccaaaaaaaaaaaccttcataaaaacttaattatctttgaggccgtagctcatacttgagggaagggacatgggtaacgctagagacatatatgtttgcattaacttttacgccactgtggggcagacaattaaagcaggagtggaggagtcagagcagttttgaatctgcttttaagtcccagagagtgtcacagtacctcctacccagcactggttgccaaagtaaaagaaagtggtaacaatagggcataaggtggtggagaagaggctgggtagaccttggccatattcttgctttgcaccttacactgctataaagaactacccgagactgggtaatttataaacacaaaagaggtttaattgactcagacttctgcatggctggggggtctcaggaaacttaaaatcatggcagaaggtgaaggggaagcgaggcatgtcttacatggcagaggaggagagagagagtgctaagagagaagtgccacttttaaaccatcagatcttgttggtttaaaacaaccactatcgtgagaacagcatgggggaaagcacccccatgatccaatcacctcccaccaggtccctcccttgacatgtggggattacaatttgggatgagatttgggtggggacacagaaccaaaccatatcattttactcctggcccctttcaaagctcatgtctttttcacatttaaaagctaatcgtgccttcccaacagtcccccaaagtcttaactcattccagcattaacccaaaagtccaagtccaaagtctcatctgagacaaggcaagttctttccacctatgagcctgtaaaatcacaagcaagttaattacttccaagatacaatggggatacaggaatttggtaaatgttcccattccgaataggagaaattggtcaaaacaaaggggctgcaggccctgcaccaagtccaaaacgcagcagggcagccattaaatcttaaagctccaaaataatctcctttgactctatgtctcacatccagggcatgctgatgcaagaggtgggctcccaaggccttgggaagctctgcccctatggctctgcaggatacagcacccctgacacacagctgctttcatgggctggcattgagtgcctgcaccttttccaggtgcacagtgcaagctaccagtggatctaccattctgggatctagaggctggtggccctcttctctcagctctactaggcagtttcccagtggggactctgtgtgggggctccaactccattttccccctctgcctgccctagtagaggttctccatgaggactccactcctgcagcagacgtcttcctggacatccagacatttccatagatcctctgaaatctaggcaaaggcttctgaagctcaacttttgtcttatgtgcactcgcaggcccaacaccaggtggaagctgccaaggcttggggctcccaccctctgaagcaatgcctgagctgtactttggccccttttagccatggctggaactggagtggctgagactcaaggtgccatgtcctgaggctgcacagaacagggagtgcaggagggacccctggcccacaaaaccagttttcccttctaggcctctgggcctgtgatgggaggggctgccatgaagatctctgaattgccctggagacattttccccattgtcttggctatcaacattcagcttctctttatttatgcaaatttctgcagctggtagcttgaatttctccccagaaaatagatttttcttttctacaacatggtcaggctacaggtgttctaaacttttctactctgcttcccttttaaacataaatcccaatttcagaccatctgtctgtgaatgtctatgactgtatgctttcagaaaaagccaggtcacatcttgaatgctttgctgcttggaaatttcttctgccagatatccaaaccatctctctcaagtttaaggttacacagatctctagagcaggggcaaaatgccaccggtctctttgctaaagcataggaagagtgacctttgctccagttcataataagttcctcatttccacctgagaccacctcagactggacctcattgtccatatcacaatgagcattttggtaaaaatcattaaacaagtctctaggaagttccaaactttcccacatcttcctgtcttcttctgagcccttcaaatttttttattctctgcccgttacccagttcctaaatcacttccacattttcagatatctctatagcaatgccccacttctatcaggaccaattttctgtgttagtctgttttcacactgttataaagaactgcctgagactgggtaatgtataagcaaaagaggtttaattgactcacagttctgcatgggtggggaggcctcaggaaacttacaattatggtggaaggtgaaggagaagcagtctcctcccttgacatgtggggattacaattcgagatgagatttgggtggggacacagagccaaaccgtatcaaccagtgatgtggctttgggaatcacttaacttccctgaacctctgtttccttttctggaacatggaattagtactactgatttttcagtgttgctaggattcaatgagataaagcacagtcagtgctgctataacagttgttttgaaaacacacacattttttcaaagctgattgatgtattcagaaaaatttgagaataatgcaaattttatgtttacttacatagtcagttttatccacgaaaagtactaggtggactcagaagacggcactcagctaaagtgagatgcatggcaatatacaaacacacacacctgaaacatctaccagctcctcagttcaccaggtgtgttgagttacactcgagttacactcatccacatctgccattacaactttctgtccattttctgataaccagccccccacccaccacttcacaataacccataagctgtaacccttacaatgcccatttccacaagaaagtagtagtgtgttccaatcttgttttcccataaactctgctgtttttactgcacaattttgcatagtgtggtgatttctcagaactcatatgttgtgttatagcagaactgactctgtctaacacaattcctggcagacagcagacactcagtaacaggtagctgttttattattaatattaatccacttaagtacaattgtgggttggggcagggatccctagttacaatgtttagctgctttgattagtagtgttaagtgaaatggactgcctgagtggaagggttttggtgcttttatcttttctaagtgtgtgctggtcagaccacccttggggtattaacagtgacaaaccaggtatgtccagaaaagagcaagccagaaaaggagaagacatgagaatgatctttaaatagttagagggccatcttggaagaaggattgctttgttttgtgggtcttcagggtgacaaggggaagctcccagggcccagggttctggctagctcggggacgagcctcagaatagtccctgggggtgatgtgttctccaagctctgattggctgctctgggaggggagaggacagagaagagtcaagcacgggtttggaggttctatctataaagttccttttcatttttttttttccttcaaggtagtgtgcaaagacagattctgctgatcagagtaaatttcagacagaaacaacccaaacttttccagcagtatttggacttctgcttgcctgcttgcgtttttttttcttttgggtgatctaagagaatagttagcacatgtgcatatttacgcactggttttttttctagttatgcccttgaatgttgcaaatataaagactatgctttacaaatatttatggcttctggcatgcttaggaatagtgaaattacatcaatgctttccgtctcgagggcttttttttgacttttcttcttcttcttttttttttttttttgtttgtttgtttccaactcagggaaaaagctcagttagttactgacctggcattgctttctctctaacatcctgtgtagcttttgtcctctccatctaagcaggctgttaagctcttgtagtaagaaagatgttaccctgggcttagaccctctcggtggagctgagatggagaagcctccggaagcatggggcatttgagctgagggatggcaggatctgcttcagatatttaaagtgggttactctgagcctgcaaactagagagtctagtgtggtgtctctagaagaattacttttgtacccttagatgaattaaaaagtaattatactgagtgttttatcttgcctgtatacggatgtataagattccaggtttctagttgatgttactgttaaaaacagaagatgttcaaacatatttgattttattaaattagttttccctgtagtcataggaggggtactgctgtttacatgctgaatcttagcaaaactataaaatagcatttttaaaaaatggcagctcttctgttctgatgctttgacaattaatgttatctctttttgtttctatgatgagcacatgggacttaggcttactcttaaaatggatttttccaaaaccaagagttattacatttcttcctctgagacaaagtattcaggcctcctcctcttctagcactcagtctggaaaatgtggttagtctttccatgtgggagctcttgtgctttgtgcattggttccaagatggcaagtggactactgttccaagatctgggcccaaggcatgtcgttgggctcgcctgaacttgtatataatgaccagaaggaattggtctgcactgccattaccgccagccactacctgatcaattctgcttgggaaatggctctaatcaacattcttctagacctgctgttcatggctgcaggtggcaggctcatggatcaataattggctggggcggttggccccactggtcaacctcactccttgagccctatttacctgttgctgcctcctccatcctcccctaaagtcacacagcttcaaataaggtggtcccatctattttggtgctttcccttctttcttaacctcccataatggaaaaagcacaggttccagaagcctggttttaaatctcagctctgttatttatcagctttgtgattttgggcaagtgacttaatctctctgagcccttgctcactcattttaaaatgatgtcactcatccctttcagagctgttaagaaaacatcatgcaaaccatctggtacagtgccagacacagagaaagccttctggaactggaatccacacacaccttaccaattactttttgagtaggtcaattgccagcatgtctccagagcaaaaagattagatgatcctcctttctttttgtgccaggttctgcccaggcccaggggctgcagagatgagtaagaggaagtccctacctataaaggcactcccagttttgctaaaatccatttttccaacaaacgtattttgatacctactgtgtgcaaaatttatgtgcctttggggaggatactgagatgattcagtcactcatttattcatcggtcatcagtcgtgtgccagatactgttagaagcactatgggtagaaacaacaggcaagacattgtccttccttttgagaagctcatagtgcagtaaaatatactaaagtatgggagaagtagatagaaagagaatatgatctcattgttaaaaggcacttgtgttgttggacaatatagggtgcacacagtaatgtggatttcatttttgcaagtattcagatcttgatagagcttcattgagacaaccgtctccttttagaggaaatggagcttgggagtggttaatacgtcacacatttaggttaaagtaaagctgacactagccccacagaaactttaatttgtgtagtgactaaagtgaaaacactctctttcttcttgattctattgtctcccagcagagattttataatttgaaaacattgttccttaggtagccccaagaggtagattttcagatttgctgcttgctttttgtaaactattgcattccttcctcccaatagccccactggggtcaggaccattttgaacttaaagaacttgctcaaagttacacaacttgacatacaaagtcaggatttgaatccaggtttgcctgattccagagtccaagccctaagcctcaacaccatagtccgtccatgattcacactcattgtagtgtctgatggcttttgagactttgtagaaaaaagcacatcttaaatcatttttaggacctgtttatctgaaccagtggaaaaactaaatttacgaaccataaatagtgtctatagatgtggaatgccaagtgagttaggatatattaataaataggaacaaaaagttatgaccaaaagttgtgttttcctatacccagtttcttaagatttcataattagcaggggggaattctgagttgatgagtataaaaaggcctctgcaggtagcccaagagacgatactaaagtccagaggttataaacagaaagaggaacagacactgtagatttttctctactccatgacttcttcttgcagaaattctgcacttggcactaatcagacctaaaattaatttcttaaaatcaccaatgccttatttaaagaggttaacattctgcatgtagctgctccactgccaaacaaaaacacccctggttcttttgtgaccactaatgcaattgactttccatctttttaagaatgccccctcctatccctccatctttgtctcccaattaatttatgtttattttgtaaaaagcttgtgggcctgttgagttgatattgctaaaggctgacaaccacatagaggtacctcttatagcgatgaagtgtgtgtgcgtgtttgaattatctgttaaccagcatcaagacatcggttccctgtcttggatgaatggcaggggaggctgagcttaacttggccaaagcagcagggggctaatagaatgtttctgttccccataaagaaaggtagtcaagcgtctgtactttccactgaactccagtttctatcctgctttgaaaattctgcttaccctttcagtgagagccacatgacaagtgttcagtatgtcagatttgttttcattttattactacgtatgaatttgacctccacagtagggctgcattcatttcccaaagctcttccaataattgtattcttttaaaaaatatgcatactattattctttttcagattgtgttatggctggtgttttgaaagtggttaaaggatgactggttgcatgtggagtaatgtgtacatgatgcacatttccagatggaaacagccctcaaagttccctatgtagtttgtgtacctattctactcatttcattagactgaactcagtactttctggccagtagagcaggtttttttctttgacaaaattaaatttggataaccttttctgaaaagcaatttcagtgtgtcatattgacatttatattgataattaattgtttgtggctgtcaaaagaaagtgtgtatctttgcttgaggccaggagttccagaccagcttggccaacatagtgagacgttgtttctacaaacaatacaacaattagctggacacggtggcgtgttcctgtagtcccagctacttgggaggctggagtaggaggatcagttgagcccaggaggttgaggctgcagtgaaccgtgattgtgccactgcactttagcctgggtgacagaaacgagattccgtctcttaaaaaataagtatgtatgtaattgtgtatgagctaagttactcttcctgtcacatttgtatggtagctacagtcaggcactgcataatcatctttcagtcagcgttagaactgcatataaatggtggtccaatagggttataatggagctgaaaaactcctagagaggctgtagttattgtaatgttgtagtacagtgtattactcatgtgtttgtggtgatgctggtgtaaacaaacctgccctgccagtcctgtaaaactatggcacctccagttatatgcagtatacctaattgtataatgataatagtaagtatatttgtgataatagtaagtatacttgataatagtaataaacaactatgttagtggtctacgtatttactatactttttattattattattttagagtgtactgcttttgcttctaaaataaaacattatctgtaaaacagcctcctgaaggacctgaaggcaggtccttcaggaggtatttcagaagaaggcattgttatcatagcagatgacagctccatgcctgttattgccccttgaagagcttccaggggacaagatgtggaggtggaagacagtgatattgatgatcctgaccctgtgtaggcctaggctaatgtgtgtgtttgtgtcttaatttttaacttaaaaatgtttaaatagaaaaaagcttatggaataaggatataaagaaaatatttttgtacagctatacaatgtgtttatgttttaagctaagcattattacaaaagagtccagagttaaaaaaataaaaagtttataaaataaaaaagttacagtaagctgtccaatttctattgaagaaagaaaatactttataaatctagtgtagcctaggggtacagtgtttataaagcctacagtagtgtatagtaatgtcctaggctttcactttcactcacactgattcacccagaacaacttctaattcctgcaagctccattcatgataagtgctctctacaggtgtaacatttttaatcttttatactgtatttttactgcatcttttatatgtttaggtatgtttagctatacagataccattgtgtgacagtcgcctacagtattcagtatggtaacatgctgtacaagtttgtagcctaggagcaataggccatatcataaagcctaggtgtgtagtaggctataccatctaagtttgtgtaagtacgctctgtgatgttcacatgacaacaagcatatcaactaagaatgcttttctcagaacatatctgttgttaagtgacgcatggctgtaattcatgcattaattggttacttgtaccctctgtttagggcttcaaaagtcagatctgtccatctaagatgcttttaagtaacatttaccttaaagaaatagatggttgattggtttaaagaaagagacagctgaattggacggggaagccagattttgaccatatttctaagaggagctgttctgtaatgttttggtaaaagaatgtctgtctccatatcatctatctatctatctatctatctatctatctatctatctatctatctatctatctaatttggcatctatttatccattaatctgtctgtaatacaaatattccaaacatttaaaaagtataagaaggctctgtagtgcaatggatagcacattgaactttttttttgtttttatattggcttattgcaattaaaaaaggtgcaaataatatatgtaccaaagaaaattcagaaaataaagaaacactgagaaagtgaaagactagggctcatattataaacacacaaaaaatcacttttaatattttgggtacatttccttgcaggcttttttgccctatgcatacatttttatccataaatgtaatcatcttgtctatgttattttgtagcaagcttttttttcacttaatacataatactattttttccaagtctttatagatattgtttttcttttcttttatttcttttatttagccatcactcagtgattggatatttagggtatttcatcattattttctttgaaaattaaataaaacaaaatttgatgaaaatccaaggtggcccaacacagtggctgaatatatctcatcagtctgttacattattctcatggaaatggaaaaacaacccccaaaactctgcatctgagaggagtatatattaagcttaaggaagtgcttatgaacagtaggaaatgagagttggtaaatggagtcattttatttcataaaggtgcctcagagctttaagcccaaagccctacactttgagtcactttggattttgtgcatccatccatgatgcactgtgattttgtcttacactgtgtttggtatgaagcattaaatcttcctccctttacagttttcagaatctgtgaaataggacctgagctaacctagaaaagtctctctgcttgtcgtttagtttttttttttttttgagatggagtttcactcttgttgcccaggctggggtgcaatggtgcgatctcggctcactgcaacctctgcctccggggttcgagtgagtctcctgcctcagcctcctgagtagctgggactacaggtacacgccaccacgcctagctaatttttttgtatttttagtagagacagggtttcaccgtgttggccaggctggtctcgaactcttgacctcaggtgatctgcccgccttggcatcccaaagtgctgggattacaggtgtgagccactgcacctggccttgtttagatattttaaaataatcttccaattctgagtaaatagtatttgtataatagttgtgagttgaaggcaaatagtttcaaagagttcagttcttttgtcttcaacatataagtcataaaaatgcatgattctccctgaggagccagcttggcatcagactctggagccagacagactgggtttatttcctgccccaccactttctgctgggtgaaccggagtaagttacttgacttgtctaggtgtcagttttctcatctagaaaatgggaataatactattcattcataggtttgttgggctggtttaaataagttaaaacacagtgttaactactactgttttcaacaggttcctaagggtctgtgtttctagcgctttagcacttcaatggcatttataatgttctgcattatctctaactgagtggtttttctatgagtatttctatgagtatttcttccccaactagtttatcatgatggttataatactggccaccatttttgatggagtattataatacatactctacatgtattacaaaatgtacgtctcattgccatttatgaggtatgcattttcactgttttctttttacaagtttagtaactaaaggttgtagaggttaagtaacttgctcaaggtcataaaattgctaaatgtggaacttggaactaaattccggtctggtgtatgtgccaccaccctgcttttgtaaattcctttaaggaagggacttttgtgctttttagatcccttacagatttcagcactgttccttaaacatagtaggtcctcagtaagttttttgttatgttgaatgaatgaaggtaggagtgatcctgtggataatagaacttttttctccaataagaaaaccaacaatattgctttttaatgacatgatattatgagtcttagaattctgttctgcttccatgttacatgtaagagtttgtaattatttgtgtatgaaactggttgtatttcatgtgaaacaaaagtacataccctgtatttgagactctgatttgagaaaacctggattagcattacacaagtaaccattgaagcaattttaatttaaataaaggatacaactaattctggatctgtttttagccatttatttaacagacatttattgagcatatacattgtgcaaagccctctgcaggggactaagggtttaaggatgaatatgatggtttctgtatgaaagaggattttatccaatatcatgggtttacctatgccctgatgctaatgacccctatatatctttaatccaactcttctccttttgccttcattattcagctctatgttggatacttccacatggatgtctcataggcctccaaactgaatttattatctcatccccagcacccactatgcctcattatatattacattcttgtacctgttatatatttcacctctgttggtgacaccactgtctaaagtaaccattcaaaccactgtccaaacttcaaccttcaaacaaacaaacaaacaaaaaaaccagaagtaatatttgattccttttttctccctaacattctacatttggccattcaccaatcctactgatttttttcccctaaatatcatcaagaactgtgaaggatttgagactttatcttacttgcaaatgaacttgcctgccacagttccatagatgctggcagaaggattcgtgggttagagacaaagaaatttattagtcatagcaatagcaatagccagagtatcaacatatttattcactgtttctccaagacccaactcccataggatgtcatgaagagggccaggtgacatccatacatgaagtgcattgcgttacaggagagaaactctgaacttagggaacccaaatcttttatattgggcaacaaagatgcttcacctttgctccagagggagatcatttcttccaaggctgctctccacataaacatctttgaaaagttagtctggaaccaagggcagccagtgctttgctcacaagatgtgcagaaacggaagggactcatggagaatgtctcccaacaaatatatcttgcatctgttccctttgctccttctttttttttttaatcgaaagtgccttactggtcctgcttccatgagtagcagtgaccaggggaaaagggagaggaaccagccagcacagggaggggtcatctccacaacattccatttatacacagaactgaacagcaagcatagagtcactattgtggttagaagttggcagcatgggaagggggaggaacaggttggatgtgggggtgttgttaaaaatataggcccctctccacaactggggtgcctggggggaatttggtttgcttcaacccaagaggaataagaagatcaaaagcagtttggcaagaccagaaccgtcagggatggagggaggaggaaaatccagggagtggggggatctgtttggcaactggagtgaagggattgccctccccctgctgggatccccccagcccctctggtctgggaggaaggggacggcctgcaacccccgagggcagatgtggggctgccagatgctccaggcaggtggccagaaccggctcacaaaggcttgtcctctagggagatgaccgcactgccccccagcttctctgccagggtgcagcggtccttgacctccttgtagcagtttgtgtgtaattcatgcttgatccctgtcagcttcttgacggcgtccttggagctggcatagatcattttgcttttaaggggagcagactcagggacccagaagataaacaccaggtcctcctccttgctctccttggtctcgtaggttgtgtcacagagggtgtagtggcagtccttatctggcagcatcctgacaaaggtggtgtaggggtcgtcgatggtctggctcacatcgcccaccaggatcttcttggtctcctccaggatgatgttcttcttgtcctcactaaggcagaagagcaccaccttcttgagcttcttcacctcctctggcattgaagacttatgcaacttcatgtcgttgaacatgttcatgacaccatcagacagccacaccagaggccatgtttccagaagtgaaaaggagagggcatggagagccgcagaagacaagagcactgcagccgctgctgggacccgactgcactctgttccttctttgcaccattagatcaggctgcacattgctcataggaagattgcaacaactttttagctgatttccctaactctgggtgggtccctcttcatattagtcctccacaccttgctgaagtagcctcctgagacataaatctgactcttccctgcttaaagccatttactgcctgcctattatctataggaaaggcccaagctccttagcatgacaccaaagggattttcagaccagcccttgctaatccctctagccttaggggggcagcatatcagagtgattatctcccttactctcccagtgacttaacctttgtagcctgtttcctcattgctaacattaggatgataaaacctacctcatgggttggtgaggaattaatcagctcacacatggttagccctcagtaaacgttggctgttatggttgtgtctttccactctctgcctcgcactttaagatctggctacatggttttctgctgactctgtgtcccttttcaccatggttagtgcctttattcctgccacccactcttcttgcaatgtcctccaaaccctgttgcctggcttcacgctggttaggcacatcctcttccttctcttggatgctccatgcatgtgtcggccattgagctgtaaatatctactaataagtcagttactgctgctagactatcaactttatggggatggggggtgttttatttatctttgtgttgctagcacatagcatgtgttgaaaaaaatggtgaatgaatacatgaaagaataaaaggaattcacagtctactagggtgtttggggtctagggatgaagggtggaaggcagctaagtagcttaataataacaggttagagaatctgggtaaagctggggctgaggtgagaattaggccctataggagtccagtgtagggagtttgcttgttgagtgtggtgcatgtagtgaggaagcctgtttaaagttatctcctcaatgaaataaagcagccccttctaggcaatcctaattactccctttcctgaaagaatatattgcaaatggaaggtcatgcaatctgccttcttgtaagatcttcaatttctcagaatacaatgaattctctattacctggaggaggggtagaaaggagcttctttttaattaaattgtctctgcagcagaaagtgactttatcctgccttttgaagtcttccagttgtcctcagcctggctcaaatcactctccttgaattcattgttacactagtgcaccctgctttgtgagttataatttaacgtgagcgtatctaattctctaatgagatggagactctttgggagtttatgtttttttccctgaaatgtttaatgtcatgcttttgaattaagaagggcttctacatatatttatagactggctgagtttctccatatatgtgttaagaactttcaaataattagagcacagcctgaatttcagaatgccagtgatcttctccagggcttcagcttccctgaaagaacagctactcagggcctattattaaatgtttaaggtatcattttttaactttgaaataaaaactgaaatatttggaaaatactgataaacgaacaaacaaaaaaacctgaactaaccctactagtagtagtggtaactactatacaatagtatttggagtatatctctgtagtctgtcttccttggctttgtgtctttgcttctctttctctttcaatgaatgaggtcatcttttatcactcatctggcaatctgctttcttctccttaacatcaatagatatttattaaaagtgatgatgctggagtatttcttttaggttcctgtttcaatccttgacccactgttttgccttgtttgccactgcctgccttttcttgatttctgtttgtctctctggattgacccattattgtgttctgatctctgatacctgcatgcatcttcatagtaacttccaacttttgggagtgtctgctgtgccccagatagttgtatgtgttttacctgctttaaaaatctcttttcggatagactggatatttgtagtctccatgtcacagatgaggaatttatttggtgtagagatttagtaatttataaaagatcatgaagcttagatggagcctgaacttatgtttttatactcagcaccccctctagtatgtgaaactgtcatctttagcttctgactccttctggaatactgatttttgggtgctgtgtctaatcagctttcagctctacaatattccttgaagggcaccgcaacccacaaccttgggccagcatagtgaattttatattttttatttgacagagagagagagaatgtgtgtgtgtgtgtgtgtgtgtgtgtgtgtgtgtgtgtgtgtgtgtgtgtgtttgagaaatcagcagctgtggttcttgctttcactcctcatggtgaggaggtggcctacccctcacatctgttttcagcccctgttcctcaataccagagttattttctattaactcaatgcaccttttctttgtaattcttgtcaattttccctccagccacctgcgcggtctctggcttgctctcaggctgtgagtaaattctttgtatacttgctgttttcgataacctcagcccaagacttaatgtcaaggtgggggccctattaaagatgccatgaatcatcttgtctttgtttgaagatttccgtgttggcaagtgggcagatagatgtaggtttcccaaccagatgtactggtagctgagatgggggcattcagctgaagtacattcctatcattatttggcaaagaaagagccactgagattaaaagcatgatccttgcttgtgatctggcttcatcaacggaatcacagagcctctgtgttggaaagggccttgaaatcatctgcaactgcgcggcttgatacttgagggaactgaggcaatagatacaggaagtgatgtaaagttataaatgccaaaccttcaagggacttttgacatgacgtaactctgcgctcttatgttttgggggaagaatagtaaggcctctagaagctcactaacactcctaatgcggcacagcgcgttactgcagagcaaggactctactgaccacaggcccaggacagcggccttggaggtgaagtcactaagggggatctgtaggatttggctggttacaagagctcacccgctatctcctccaggctggcttccgtgggcctctgttgaactatcagtccagtgttcttgcctctgtccccacagccctgcagaggtcttcttccacctgacagatggtgactgccttctccacagtggtaggagtgagggaaacagtgaggggaaatcaggaaacaggaagccagggagaggagcaagaggtgttggggctgtatgtgctggctccgtgccttggtgttgtgggtttctagagggttttaactttgtagtaaagacgggacttggaggaattctccctgtggtgggacaggagttttctccacagccttcacaaagtattccccgcaagaactactcatccttcacggtctacttctatcgtagcagttcagtcttctgctgtttcttctggtaccagcctatggattgggtaaggagaaagatcaggtttgtaaagagatctttctggtccttccagtaataaagccccttggacaagggccagggagattcatctcccagagactcctgtgctctaggtggtggtagaggcttcctgccagaaggatctgaggcagaggacgtggatggtgccatgctggcgtctctgtgcatctggcagcgcaacaaaggacttctgtctgccctgcgaggctgggtcggtaaaacccacttcaattgaaagccaccacactttagcaacttgataattaaaattctaatatgtgaattaaagaaaacaaggggctgtgttcctgccatattaaaatacagctgcagtgattccactattgtttcctttgacagagctgtggttttcctacacacctttgtttgaggctttgattcagatatactccctgctgctgataagtcccatgtgtctactcatcggttagatggtgcatggggatgattcttctgtgatgtggagaatgaaagatcgtgtcttcaagttatgtgaggtggctaagtgacatctcatcaagagcagagataaaaacaaaactcatggaaaaggtacttcctgagctccctttttgtttcctaagtgatttaaaacaataaaggccaaatcgaagagaaaacttaagaaccgatatagctgatacctggacttacggattgatttatttctgtgaacactctgggaaaatggccacttgtcgctctctgttattaataaagaggtcactttatcattaggcctttgaatctgtatttaatggctaaagcagatggttataatttctgacttggtgtggccaccttattaataaaaaagaactgatggaagcaaaaaggcgtcttcatttttaactccagaagcataacacaaatgctttccagtctttctttgtgtggagagcagaccaagtgactgcaataagatcctgttacacatttgaaaaaaagacttttgcagagtggaggtaactcagtttgaatccttcttttgttaaactttaaaagaacactataaatatatgcccctttccttgaagaaggtatttcgaaggaagcttcaggattatattttaaagtaaattaatattttaataacataaggaaactaaaaaacacctaatttatttcagatagtggaggcctgtggtactttctaaaattattctttttgcttaaactactataaactgcttttttggatttaattactaggcttagatgaatgtgccatgcatcttattttggttctttttaaattcacttggaattaaaaaaaatcaataatggcaaaaacgtctggtagtggatttctgcttgatttcatcaagcctgtatattcccctataatggtaaggagtttgaaatcgtggttatcatcctggaaattttttgtccccaaagggacaaacctacatttgtgaagacagaatgatttagaatcttaatgtactcagtaaaccgagtgaacagagcagaaaaatgctgggaattcttcacataggctcagaagagctctttaattcacttagataccaaagacttattgatatgtcaggctgtgggcggcatcctggggtctgttatggcaatgaattcctggtccttaggtgacaagaatgggatgagtgtgctatgcctggctctgagataaagaaaaaacatggaatgttaaggatcttaaagtctttacgggtttctttgcccactagttttcaatgttttttaattaatgatgcctttcaggctgtccatgggcccacgtttagaagtgttttgaatttcaaattattaatggtaattgttgttttctgttttcattaaccaaaggcatgtataacaacccattcagttcatttgtttattgatttgttcattaattcttcagtatttagcttgtatttacttttggcttggcaccatgccaagcacagggatgcagaggagtttgtgatggccaccagtcttatttaaaatgcctaaaatagggtcaggagcagtggctaacacctgtaatcccagcatttttggaggctgaggctgaaggatcacttgagctcaggagtttgagaccagccttggcaacatagtgacacctcatctctacaaaaaataaaaaaagttggcggggtgtggggtgggcgcctgtggtcccagctactccagagactgagttgggaaggtcacttgagcccaggacgtcaaggctgcagtgagcagtgatggtaccccacactacagcctgagggacagaatgagaccctgtctcaaaaaaataaataaaaataactaaagtgctccacaacagtggatggatttttgtttttcctaccatctcagattcctggatatctagaccaatccattgctaagccatcgtgctttgttttcttttttaaactttgaaatgttttaagtgtacagaaaagcagacaaaagtgacaaaacccatttcagatacaaatattttttatttgtttcagatttttaaaagaaataaaacattatagatacaacaaaagctcccagtgtacccctcctaaatcctgtctcttttcttctccagagataatctgtcctttaaatgtgatgtcttttcattcccatgcatgtttttatatttttgctctctgtgcataaatgcactgagtgctactaaaaatagtgctttgcctattttaaaattgtgtataaatgggaacttactgtacctgtcatacatcttgctatttttgctcaatgttgtgtttttggtattaaccttgttaatttaggaattgcatgttgatctaagaagttattttagttgctgtgcagtaagtatgctattgtatgaccatttcacaattaatgtacccattctcctgccttcatttttttgtgtattataaacaattttgccatgaaaactttgacttatctttctgtaaaaatgtgtgaagtttttctaggccaaatacctaggaatagaatagagtatgcatgtcttcggcttccctaggtgctgtggaattgctctccaacggccttatgccagtgcgagctccttcctacaggatataagttcccgttgctctttaccctttctaactcttgatattggaagtatttttagattttgcttattcaacaggtatgagaaactatcacagtttggatgtataaagatatgtcaagttgagtaaagatgttagagcaaagactggagatttttttttccttttcctcctgttctagctgtattgttctagctatattatagggcagatttgagtttctgcttgggtagaattatcctcatcaaagcctactttggccctaattagtttgctatacatccattgtacacagaacacattatgtacatttctaaggaattgaagagacaaagtccaaacttatagaacctatgttgggggtgcatagcaggagatactggggcccaatttacagtaggttcattgcactggccagtgaattcagggaccttgctctctatatcagcagagattgctgcctgtgtggttttttggttttttgttttgtttgctttttgtttgtttgtttgtttgagacagaatcttgctctgtctccaagctggagtgcagtggcacgatctaggctcactgcaacctccgtctcccgagttcaatcaattgtcctgcctcagcctcctgagtagctgggactataggcgtgtgccaccacgcccagctattttttgtatttttagtagagacggggtttcaccatgttggccaggatggtctcaatttcttgacctggtgatccgctagcctcggcctcctaaagtactgggattacaggcgtgagccactgcgcccggccgctttttgggttttaatgtccataaaatgagagattgcattagtcattccttcttcaagagcagattttcttttctgctttcaaaattccatgcttctaagtggcgttgacccttggtgctttaaaacgtcttaaaaatcactgatacttaattggtattgagaacagaggaacttaatgcaggagccaccactaagtgaagagcagttaaaaaatgctaagaagtcacctgcaaaattctaatctaattaaaattatgtaaaaaaagaccaccatcactcatgtataaagatgacagggaaaaattacaatgaatagactgtgggtgattattcccctcattgccctatttttctgttttccaaatcttttttaatggtcatggagtaatattcttggaataaaataataagcatatgcaaacaattataagctcatttggtaggaaaataagaatgtgatttatacaaaacatgtgctgggcaaaggggagaacacctgtatatgaaaaatgatttgtaatgattttgtaaataatcctataatccttccttgggttaagggttggtggatgataagtgtttttctttaggttttgctgctggaaagatccagggaagatggaagacaagtagactggcatcttacctaaaagcagtggcacagcaggtggtagaataatttgagcttcgctcattggattttaagaccaaaagaaaaggcagaactaaagagattttattcattaggtcacgtagatattcctattccaaaggcatatgacaaatccttcagagttgaagtaatcataatgcctacaatatattaagcattaaatatacatatatttttcaattctggaatagctgtgaatgtgggaataactgtactgactgacaggggagagatcagatagtttaagaaacttgccccatatgcacagctcatcagtggtgctgcctggactcagccaccatctgtttcactctgccggggcatacatgtatgtgtacccttgccctggcaaactcttccttttgtagagctgaaagcagccccctgcaactttcctatgtatttattctcatcctgccctcctgagcacccagccttagaagtctgctccctctttcgcacaacagcctttctgatcttcaaagagggctattgtgtccatttctccacttctcccctcttcggtctgtcatcttggaaaagctcagagaggtgtttttattcacagatgccttgagaaatttcatggtttttagactcatgctgagtttgtccagatgtgccaatatttgtcttatatgatacaaattaattgtccagaagaggaagaaacctttgtagacactcactaatgcaaaccagttcctttgagtattgatggaaggaaaaacactaaaaaatgaaacagatcattttcactgggagagtgtagttgttgaattcacattctacttttaggacaaatctgtagcatgacagttcagtcttaccacatgtattaaccatgggaaacctagggtgacatttgcaatagactcctgcttttctgtaaggactttatacagatggagaaagtatgatactcttacattttattaccaagttctgtggcccagggtttacagcataaggtggcaaataatttagctccactcagatttggaagagtaactattattattataagtaagatttaaacttagggacaggtacacactctttaaggagagttctaagactgagatgttgtatcattatcagtacctggcataaatatatgtatctgagttctctttgagaatcataagggaaaagatgtctaatatgatttaacctcaagacactaacaatgattacacctatcccctgctcccagcatcatagtcaccaactgtggcaacagctgctgctaatgttttttgaactcctgtggtatgcctggtgatgtactttatatcagctagttcattctcaaaacttgagaacacactacatataccctagtaagtactattgttagcctcgttttatagatgaaaaaactgagaggttaagtattctgcccaagatcatatataggttgggtatccctaatctgagaatccaaaacccaaaatgcaccaaaatctgaaacgttttgcatgccaacatgatgctcaaaggtgctccttggagcattcagattttggatttttggattaggaatgctcagctggtataaacgcatatattccagaatcttgaagacatctgaaacatgtctgatctcaagcattttgggtaagggatactcaacctgtatcttgtatatagtagagtgagagtctagcttatgctttgctcttatatcttgtttctttcttcagcaaaatagtctgtaaattgaacattaaacagtgcactggggacacagtaaggaatctttcattaccaatggagcatgaatgaaagtttccaaatatgaggtttccttagtgaaacactatttttaggaaaaactattaaaccaaggcttatgataaaggatcattccacatccaaatatacctctcctgtattagcataattctctactaaaatcacagctgaaattcattcactctaagagatggataaaaaccatacggtttcatgtaaagatcaccagcttcccagaactaggatgatgggaattttaactaatgctgctgtgactgtggcctagcctcttactctttctggatctcagtgggcccatctgtagaatgtgagcattggcctctgtgataatgaatgttccttctagctttgtatattgcatagtgcatgactgctagcttcaggaaaaataaaacgttttcaatggaaatatcagatcaccaacctgattccaatgaatttttttttattcactgaggctttatgtcatataaaaatatgtgacgtattactgctctgctgcccatctatttaaggcattcttcagtagacttgtcagggcttatctaaatcttagcaccacttacgtgtggctgattgcttggcaggaggaggttcctgcattttcttcctcctgtgtattagtgaattgaaatcaagggaaaaactgcttggctttctgcttccttccatggtaggtagacttttctacatattttccaacagttctttttgacagccaagtctggaaacagggcaggatggaggttttacaaataggtgacagttgtttgtctcatgaatttcttctatttcctttccctagtggagttaactgcctccttcctacaacaatccgaacgtacttccatcacagagtatctagcagtgtgagcaatagccatttctctcttttacctcttctggattctaaacccatcataggtagagatagaacatgtctgtgcttagatagtatctggcacatacagattgctcacttaatggtgaatgaatgaataaagaagaaaaagtgatgaaagaagaaaaactacagtcgtctcttggtatctgtggcacattcgttccaggaccctgatggatgccaaaatccttggatgctcaagtctctgatataaaatggcatagtgtttgcatctaacctacatacattctcctgtatactttaaattatctctaggttacttataatacctaatataatataaatgctatgtaaatagttgttacactgtattttaaaatttgtattatttattattattatttatttacttatttttccaaatatttttgatctgtggttgattgaatccatgggtgtggaacctggggatatggagggctgactatatatactaatgaacactactttggattatatgaaaatacccatttatgaaatggacagttcaaatgtttcctctttgactgttcttaacctgacctcccaacttgaagtaatctgttcctctcctctaaacagttatgtgtactatgtgtttggtaattaattatgtactgactcatgacatttgtttctgttcttataatactttttgattttcaaataccttatgactttgttttttattacaatttgttttcccatcaagattgtaaattcttggaggcaagggcaattattaaatactatatttgatacttaattcgctcctctcctttgggggctccagttacatgtatattaggccagttgaagttgttcctcaactcactgattctgtttacttttttaattccctttttccctctgtatcttattttggatagttttgatttttgtgtttttgagtttactaatatttatcctctgcaatgtctaatctgatgttaatcccatccagagtatttttcatcgcatacattgtagatttcacctctagaagtttgatgtagctctttttttttttttgagacgtagtcttgctctgttgtcaggctggagtgcagtggtatgatctcggctcactgcaacctccgcctccctggttcaagtgattctcctgcctcagcctcccaagtagctgggactataggcgcatgccaccacgccccactaatttttttttttttctgtatttttagtagagacggcgtttcaccatgtcggccaggatggtcttgatctcttgacctcgtgacccgcccacctcggcctcccaaagtgctgggattacaggtgtgagctaccacgccctgctgatgtagctctttttcatatcttcagtgtctccacttactttttgaacttagggaatatagttataataaccattttaatgttctgtctgctaattctaacatctgtgtcagttttgattgacttttttttttttcctcctcatcaggggttatatttccctgctttatgaatgcctggtaatttttgattagatgccagacattgtgaattttccttgttgggtactggctatttttgtattcctacaaatatttttgaactttgttctggaatgtgtttaagttgtttagaagcagtttgatccttttggaaagtcttgctttgaagatttggaagactgaaatagttgtacttagtctataactaattattctccatgacagtgaaaacactcttctatgtgctctcctcgtggcgtggggaatcatgaggttttccaatctggaaatatctttttggatatttctttccccagtgctgggtagttgccacacatgtatgcactgatcagcactctgctgaatacttgagggggattctctgtggctctttctgcagctctcttttctctgatacttggccttgcaaactctagttgccttggtctccctggactgttagctcaattcactcaactcaggcagttcactgagctctgcctgagttctccctttcctccagacaccttgagctggaaattctctcaggcagtaagctggaggactcgtaggattcgtttcatttgccttccttcttccagggatcactgccctttactgactgttataccagtcttgacaattatcctgttactccaacttggccagaaatggaagtgatacattttattctttctgtctgaaataatcctccatccccaatgtttaaaaactgccatccttgactccatgtgactgtgttaggagccctttctctggtctctcatcatacctgtgcttacagtaatttagtgcggcactcctctccctgcgttgttcttgcatttttttttaccctctcttttctcgttagattttgtttccttgaggacagggaatgtctttaatctcgggatttctaacacctaacatagactcaggtgtgtaacagttgctcaataagtacttgttgaatgaatgaattaataaataaataggattcaattttcaaagtatctgttgttgaacaactttcagaagtttttttttttttttacagaaatgagattagatatgcatcttcatatatgcaattgaaatctctcttaaatttctagataatcagttgttgttgatggcttggacatggtttttacctatttattttttgtagcctctccttagaaggtgttaataaaagccacctagttgatgcttgaaacaacatgtggaggtaaagggaccaagaatagaatagccatattctataaacaaacaaaatgaagactaacttttaggtatctgttttatgatggaccctcagatgtggtatatcccaagtctgccaggaggttgttcttatctgaagtgccttttccatgttggatgtacttagatgccttttatccaggtagactcagatggtctgcaaatagctctatggatttggcattggaaaacctcatggttccccaggcatggggagagcacataaaagtgttttctctgtcatggagaataaatagctgtgagtcgttgcattcttatcaactggagacaattgacagtggatatgtgccactagagttatggtcaagtgcaagttcatactatatttggatctttaagagtcggtagaatgaaccatatttggtaagcctctgaagactgtcttgctccatttcctcagcagctcttggttaccaaaggtgactctggagccccacctccaagtccccatcctgcacagttggcatgatggaaatggcttgaggttcttgttctttcagattcagtgttttcatctgtgcagtaggatataagtaggataagatgtaatttgtcaggttgctatgaggaataaatgaagtaataaatgttagttgcctatcacagtttcaggcacatgggaaccctctccccattcccccaaacttaattgaaaagatagccatcagcctctgaagttgaattgtgctgagtggttactaacattaaagacatatggagttattgtatctgtatctttcacttatcagcttttccttgaaggtttaatgtgtgttcctttgcttttaggccccatgtttattttcctgaaatggtgtcttcttgacttaaagtacaatctttgcttttttattcttttttcactgctcttgcctggtgatcctgttgtttaaagacatctccatccttccctatcctttccctttcaaatctatggcccagactgggggtggctttaactaacaacagcactttgcattagttaagtagagtggaatttctcattctacctctcagctattgatgaaacctttccctgatgcacaaattaagactgggtgtattttgcatattttcctagaatgacacagtgattctgtggctaaaccaagattagaccctaccactttaaaaaatctgactttttgcttaaagtgtaaactgtgttgcttctaaaactactagttgaatttaactttcaagtgtactttgtatttaaatctgatgatagtgttgtttttccttttgtcttgtttagatgagggtattttcttcacttccctgacccctagtgcctcagtgacctaggcagcaagttttttgatgctgtccagaatgctaattaagatatttattctctttggccctattgtttatgatacttgtaattatgtctattagatggtaatctctgttatctcccactatactaagtgtactactcggcacataaagaaatgtgtgagtatgtgaatgtatactcacatgtttgaataaatgtgaataaatcaatatatttatatagttactgatttaaatgtgttccgtcttgggatgtgagatgggataattgaataagaaattagcctgtgtgtgttaaggtagtcaaagtttttatggtacctttgtacaaactgccccttctgttgtgtgtgtgctgacccatgtcatgatgctcagcatgactggaggagtcctggtgtgtttctgtcctcacttgctccctgggttgggcgcccctctgcagggtacaaccaacacagttgtatgaagaccctctgactttcattttctggctggctgggggttttggtgttgagcgcttttaagtaagacagtcaccttatcctactcaatgttttcttgaagtgcaggccctgtgaagatgaagatcccctcttctattttggggacacttttgtgatgcttttatctgtctctccagagtctgatttaatgaaaatatgtacctccctcaccacattctgcaaagcttacttgagtttttaaaatttaatagtaaatatgttagtacatgttgattctagtgcccagcacatagtttctgctcaatacttagctataattattagtttatttaaattgccttaatcattcatgcaataagcaaatgtcccccctgtaggctgttctccagatctgggatacagacatgggtaaagcttggagcttgtgtataagtagcggggtcagtcgcctgccagttcactggagagatgccatgcttggagggtggactgactgtaaggccctcccagttgtcagactctaggcttctagtgtgccctccctcactgtacagctggtcaatgcatggcactagaaagtgcaaaggcttcagtgttggatgagtgtggatttgaatcccagctgtgttgtggactagctctgagcttcagtctcttcctcttaaaatgggaataatagggtagttgcaaagtgtcattgttaattaggccctgggctaagttctttactcctgtgattttatgaaatcctcaaacagccctgtgaggtgtgtcttgttaatatctgtattttatagatgaggagcctgaggcacagaagggtgaagaaactggcctaagtggtagagcttttcactgaacccaggcctattagagagcagaggccacattcttcactgttatgcagtgtcatgctatgttatctgtccagacatgttacgattcctggcacacaggatcagagcaaatagtagctattattcttattactattattgttctaaaattcaggcctttcttcaccacactgacactgagtaatatatattgtagctgttcaataaaactttattggatttaattggttatgaattttatgtgtgggaaggtggttaactttcctatctgtaaggagaaatgctcaatagaatatcttaaaatgggggaagttatgaaaatataaaataacaaccagagaggcaaaccagtttatgagattctgtattagaaagctggaaagaagtttttaataagaagaatggaggctgggcgcagtggctcacacctgtaatcccagcactttgggaggccgaggtgggcagatcacgaggtcaagagttcgagaccagcctggccaacacggtaaaaccccatctctactaaaaatacacacacacacacacacacacacacacacacacacacacacatacacacacacaaaatagccaggtgtggtggcacgagcctgtaatcccagctactcaagagggtgaggtaggagaatcgcttggacctgggaggtggaggttgcagtgagcagagatcgcaccactgcactccagcctgggcaacagagcaagagtctgtctcggggaaaaaaaaaaaaaaaaaagaagaagaagaatggaagggtacaatctggtggtagacaccatttgaaaatattctgtctagcaaatagtgtttttgagtaaaagaaatagacatgacaaatcagttatgtggccatcccttataacaatgatgaacagataggagggtgtgcaatctttaaagtttagaaacaaatttgtccttctgacatccttcccttctcttgacacacggttggtaatggccaagattctgttttgcctgatggagttttgagtgagttaaattaggttgtcttgaaaatagctgggccagaaaataaaaaggttttctctctttggaaaggggctttactccagggaagaacacagctgtccaggaggaatccgggactgttgagtccagaaacttcgatccttctccaccctttccccagtgtttcaccagcagaaaaagaatgttattaaagtctgtgatgaaacaaagctgcacgctgagacgtggctgccagaacttttatttttatggttctcttgagtttggggagaaataattaaatgttgcaaatgtaaaaattggcagtaacattttccattttgccaatagtcattcctttggttttcccttggattttatttatttctttctccttttaggcattgctctgtcatagcctgcttgagtgttgtgtctctaggaaggccagaacaccaggtttggatgttacatagccaagaacattgtgtagcagtgcctggttttgccacaagacaggtctgtaggaaataccactgccactgcagccgagcacgttgaactgactgtgctcaggaatacttcaccagtaggcttactggaaggtatgtctttctgcatctgtgatttgcagaggggcatatgattgccttgctgttggaaacataggaaatatggtttttggggattctactttgaaataatggtactcgtcaatgcagtgggaaactacaatatcaggatgttaagaaagggttcaaaaggttttaggaagtcttgaaagataaatgcccattccaattgagccagtaggtcagtcttcttagggtttctgtgataatataggactttagagtggagacgcctttcctgacaagtctagggttgattttatgtatttgctaagatttattaaaataaaaaatggcatattctataaggaaaaataatattaatggtattttaattaagcttaagcaataaataatggttatcacataatttttatttattattctttaccttatttcagggtctgtcttactgtgaagtttcaataaaatgcttagaactacattttcctggccaggtgcagtggctcatgcctgtaatcccagcactttgggagaccgaggcaggtggatcacttgagctcaggagttcgagaccagcctagccaacatggtgaaaccctgtctctactaaaaatacacaaaattagccaggtatggtggcacatgcttgtaatcccagcaacttgggaggctgagacaggagaatcgcttgaacccaggaggcagaggttgcagtgagccaagatcataccactgtattccaccctgggagacagagtgagactgtctcaaaaaaaaaaaaaaaaaaaaaaagaaatacattttgttttattgcaggcaggatacatttcaagaggcttacttcaccttctctgtctgatctccgccaaatatcttggctttgtatttcccataacccatctgttcttcatgtagctgtgaaagaagtatatctttgaaagcagaattttgagtaaagaaacccgagagttagggagagatgaccaggttccatggctccttgttaatttcaccttcaagccacatactgcctcttcttgggcccttgatctactgctgagcatatctttttctttcttggtgtgaattctgcctctcagtataggtggtatttgttaatttaactctgacataaacatgggaacactgcgcctcagtgtcattgtctgtaaaatggggttataaggtattttctgacctacttaaggttaccgtgaggattaagtgataatgtacaaagaagacttttaaaaattaatattggagtatagtataagcatagtgacatacaatgaattataatcaataataaattgaatttcactttgtgacctcataaaatttgattcctttcagctctatcaaggacagcatcttgcctaatcactttttgttttagaaaagttagatgcttgtccaatgtcacaaagcaagttagggtagaggtagggcaaaagccctgatctcctgactcccacaccagcaggatgcttagttgtgatttctgccttgctttaccacttgggtcatctttcagtgaaggaggtaactatctcttctttcttgagttaaaataataccttagtagaagcaaagaacactatcactttagttcttttcagccttcatttgctgttgccttctgtgtctaggcgtgctgagctggcaggaaggtgacaagtatgatagattctggcctctaaggggctgtcaagtctagtgaaaggaggtaaatgagtaaacagatagacacttcggagcctgagtttctggtgctggcccttacacacagggtctatctgggcaagtcatgcctgtctttgggctcaggtttcccagctgcacattgaggtcctggactagatgtacagaatgatcgtgatcactgaggttccttctaatttgtcaccatctatgggtctgtgataatgcaaagctgtgtgcttgccagctgaaactgaaatgaaggaaagtgattaattcatttcacaaactgaaatgaaggaaagctattaatctgatggcgtatttttctttatttgtgataagtttcacagactacattttccagcattcaacactgccattgtattgtattgtattgtattgtattgtattgtattgtattgtattgtattgtattgtattgtattgtattgtattgtattgtattgtattgtatcatagatggcgatacttgttcagttaaccaaatggtcaactttgcaaaaatagcagaagtggacatctcatgatgatttaatacaggacacaaaaatcaatgctagcattaactactattctcggcctttctgcagtgtttttctgataggaacctttgtattaaaccaccttctttttttcctaaaaaggaccatagcataatagcagctagcatttatttggtgttttcctgtgtgataggtaagtgttgttttaagtgcttcccatataaaaattcatgtaatctttgcagcattttgaagtaggcattattatcatccctattttagagataagacaaccgaggtacaagaaattaagtaaaacttattcaagattacacagctattaagagatggaggcaggattcaaactcaggcggtcagcctcaggcagcctcatgtttcatggctggaccattgcctaaatgaaagctgctcactctcagcctattgagaacctggagaaactggccttgttatgaggccacaggctaagaaagcagttgtatcagcttacttgtggctctaaacttggccagatcctcaagtctaaggattcttactatgcacaggtgttctcagtctggattcatgtctcaggtgactcatgaacccttggaaattgtgtgccaaatgcatttatgagtccatgtgtgttgtgttggtatgacggggggtaggcggtttggtggttttctgcacagtatcagcagagcctctactctgtcactggcaggatcctagctgtgcaggcgtttgtcagcctaaatctaaatcaagattctgggctgggaattaggatatagctccccattgaacaagtgagtggctataggatcttggaagaaccaggctttccaaatgtcctcccaccccttggaactctgctgctgtggagcagttgtacgatgtccttttctctctttgaagctttccaaatctttcaatcttttttttttttgcctccaaattttggaacctcaaaatttcaaggtttttttttttaatttttttattttttttccttttgttttaccttctcctttctggctttgttcagaaatcaggtatcaataagctttttattactcatccaatctgtgagttcagtttcccatttaacttttatgaatgttttctttgttaagatgagtcctttcaaacccctgtaaagaatgtttcactatatacaaacataaaaacgaagtgttaaaactagaaaatccaagtggaaacacaaacatacatatacatttttccccaggcaatttagcttcatagaaattgagtgcatctgcaagggaatttttttttaaatgttattggtagttttgttatttgtattacctgtttggtcctagtctttatagttgattactctaggtaggtctttttaggactgaaaataggtcacacatatcacagtggtcccagtgttagagagatgataaaattctattacaaagtagttttgtcatgcttttggtctaaatgagtaatacaactagcatgtccagtgtcatttttgctgtactctggaaaacttttaccatctatctcatccttatatactgcaacaaacttctgatattatttcaattgcagttcaggcattgccctcgacacaggcttaagttcaagtctcagctctgttacttacaaaccatatgactttgagcaagtttatttaattttgtggagtccttttttttcccatacaaggggaaaacaataattacatgttgctcaaagggttatgaggagtgaggtcaggcatgtttatatgtttcactctggcgttttgcagagtaagcacttgataaatgatgctcgtgttattgattgtcatcatcatcattaatatgtgtaataggctaggtacagtgcttggcacatagcgggcactaaacaaatattttattggatttgattgtacatagcgcttgtgactgaatcagaggttgccaggggtagctttttgctcagtagattaacaaggaggaaattgttgaacagaacaactgatggctctacctttaagtcaatgaatttcatagtgaagtggtcttgaatgcaaatgatgaaatgtggcaagtctggtggagaaaaaaacccaacaatcttgaagctgttttaaagagtagcagttgcctagtcaccccaattgctgaaattttccttctcttccttgaataaggagtagagaggggcagagaggttactggtcatgttcattaattttctttcaagaactgccacatgtcaccagtggtgcccccccagcaccagtgctgtttggcagtcttctctttgccccagagaagccaaaatgttaaattgatggagcttactagatctgacagagaaattcttcacgtctggcctggatgtctaagtaaatttggtgtacttcttgtggtctggagcaaatgctggaagctattagaattctgaacaaaaccctccattcaaagactgctcgtttcctgctggggtaatccaagtatcaaacattaagaaatatgggcaaggcaaatgtggctgctcattgcaaaacccaccaaggtgtctacgacatctccccaaatgacttggaatgttacatccacttgatcatcttgaataagtggtttcttttgaaaacaagagctctacttttcctacaccaagtatagatgggaattggctgaatttcctcttgtcagtcaaatttaggagaagaaagctttcctccttcccttgaagttctagggacctagcctttttttttggttttattttgtttcattctcctttccttatatatttccttctgaaataaaaaaaagtatctttcattagatatagttatggatctattgttttagactaggcctgctcagtggctggaaacgattttattaagaaggctttatagagaagctttggtttatctcatgaaatatctgagtttgtcatagattgtttcctttctgtacagaaagttattttctgtgaaattccaggtgttcttttacatagacttgaaaggaatagatttgatagtccaggttttttttttccctaagaagaatatgttcttgtgatagattaattgaggatgaaatcagataacatagatgaaatcactggataggcatagtgaaaaccattattttaattaatctagctacagtgtttgtacagccagctatgcagctgaaggctgccatgtagtagctgctacactgtttggctcctgtacttatactgtatggggacctctttcttagacagtctcactcctgctggactgtaaactcctggagaacagggacaaagccttgttcattagagtattcctagtgcattccactataatagacacataattaatacttttaaaaaatgaacaaatgaataagacatttgtacagaacttgagtgttagaccaggtggtttcacaaaacaaagcgctcacggaggtttattggccttcctcctatgtctttgaccttttccttagcttgtgtctatgctgtgtttcctgtctacgagatggtggagatggcgagcccagttttctttcatcttgaaaggattcagctccattacttaatagtcccagtcatgttcctttccccctagaatctgtgtatgagatgtgaaatccatgaaaagataatgttgaatgggaaaaattaacctattttgatgacttttaaggagttctaactgtgcatgatagcaggcgactcccttgtcagtaggcagcaggcctgtgttatgtcaggggtaacgaggtggttcacttgtggagagttttctgtcttttcttccaagttatgctgacctcgccgacgaaaatattccccatctaataaaagtcagagcaaatttatgggcctgcccctgaccacttgtcctttatcctttaaaagaaaaaataaatctaggataagatccataggttactgttggaccatggaaatgatgggcaggggccaaatatcccaccttccttgatctgcttctcttttcccgattccggctgtctgggggatgctgaagcttgtggcatgagggttactgccgagcatggccatgtcgttagttccctttggaaacaagctgttgctctccctgcctggagggccacacgccttggcaccacactgaagagatcccaggcgtggctggagtgaagctgctaatgaaaaagcagccatggcaggtcaggacgaatcaagcaaaaaggaggacattctataattaaagattcagagaaatactagcgcagtttttgttgttgttgttgttgttttgtttttttgtttttgccaacgctatgacaattgctctttctacctgttcccgtgggttttctgtcattttatcactcattaaacaagtgtttattaaatctctactttctgtgtgctgcttacctgtgtgctgttgaccatagttcagggattacttaaagcatcaatgagtgtgcgatgactcaggaatgagtcgggtcctcaaggatcttgtcacctagtaagagacagagaaatatgaggcagagggaggctgggccataggatatggcaggatgcagagcaaagagctccagagtctgatagacctgggatcaaattcaggctctaccacttatgagcacatttggctttgggcaatttacttaatcttgaacttcagtttctaaatctttgattgtgcataatacacagcgtcctggaagggttgttttaggatttgaaataagctgtgaaaagggcctggcctagagttagcacttgacaaatggctgctcttattattttattatctctggcgaggtgctgataaccatgtgagttcaggggaggcagtctccaccccgtggacagaagtgagaggatcagcaaggggatcaggagtttcatggggcacatgcctctgcactgagcttgggagaatgagtaggatctgggaacgtcgtgaaggagaatagagaagaaactttattcaagacataggtttttacacattttgttttgtttttagcaaataggcacttattttgcatcatttttatttgcagtatgcaatcaaattgtgagattacttaagccttagcatgaatcccagtgccaacagttgtgtatttctttcttctgctttcttttgttgtcccccacaaccttctctgaacagcatctattaagtgattgcagagtctcatgacttggttgtgttggaatctctgcattagtggggacacccttccaattccttgttaggatcaaatgtgttttagagaaggtatctggttcccaagttctctgttgttttttggaaccatgaaagcctagagatgttatggcaggatgtccctaatatgcatggcaagccctcgacaatgattatggcagttgttactattactgattatttgtaacttctaataatccagaatttaaattggtcaaagacacgctgctcctcagggagtctgaatatactggtatcagcccagtgtccttccacactggcctgcagctcattgtgactgggccaactttggcctttgtgcctggcttctatgccaacctgccaagtccttgagatgctgtgcaccttactattttttgtcaggcctgctaagaagggggcttgtgtcctgcagatcaaggaccaataggaagccctcaccacaaacctgattcacagtactctctcctctttgcactttgcactgaagaatcatcctctcctccatacacattttttccccagtacagaacttagctttgtggtgctgggttattaaggaacccaacttgtatccactgtagttgtaatcttgctggtctttgtctgagttgcaaaacaacactcatggaagtcctcattcagttattctagagcacttgttgagctcctggtagaggcagagtgctgtccaccagatttgtgcctgatggcacagagaatgatcaaaaggaatcttgcaactggacatagtttctttagacagagacagaggtaagtaagtaacctcacataagtatcctaactcttattttccaaatgttaatgcttgactggcatgttataaagctaatttgtttatagttgtgccacataattatacactctgtacataatatgcttttgaaattattatttattgcacaaatattacaacagaaactgaactcaaaacacaaggaaaaatgtgtgtgggctcaccatttgtacgagtaaaacttttaatatatttgtgtgttcactcatagtccttatccatgaattcataacttttgcacacagtggaaatcatactgaagataccattgggtgttctgttctccccattctcctctccccatacaccataatattattcatgtatgctctcaagtttaatcatgtctgcatgcggacatttagctatccttagagagcccataatttgaactctgagcatctagaggaagctgctgcccccagcccacttaggtactttcttttccccttgtggtgagaataggaattaggtagcaagagttcccaggcttcattgtccaaggctatgttagtattttcatcataaatcttgaggcatcgcctattaaagcctttttgcctttctcattaaaagaagagaatttagaaggaaatatttgaaagactctaagatgcccaggagaaaggttccaacattattactctgagtagaccaagttaggtgtgggtatatattaatagtaactaaacacctagcagtttggtgtattctggaatgctcttgacttgggctgaatgtgtctgatgctctaggtgttcttgctgtctctgtctgtcatctgcctgtcattctcctgtgagggtaagtagtatcccttcccagactgaggatggaaatgttgaggggtgtaaaatgataactcaaacctttccaagagtccccaaagtgtgtacagtgcatatgaaattctccaaaaggagaagagggatctggaagtgccactgggagtgagaggctggggaaccagtggagtagaggatagtagtggcttgaagtcacagagcaagaattcaaaactttgctctggcactagcttggtggccttgggcaaattacttaatgtttctgaatctttccatgaggaagataattacattgcccacctcacttggttgtggtcggtattaaactggataatgcaaataatgcacttagcacaacacctggcataaataataagcactcaataaatgtgaaatgttatggttgttatttcctgcttcacattataattttattgctttccagactgatgtctccgaacttaggtagtagtggagtctgtgagctattttcagtatttcaaaatctatgaaaaggagacagttctggtcaccataataagtacatgacagatggagtctttgaaacatggtacccacaggggaagaatccagaaggggtcctttgtgttgaaaagttgaggcctcgagctgaggaagttagcaagtgcttcagtgaaagcttgtgggtttccagttacaatgggagtaaatagagggatgttgtgagcaaagaacttgattggttgctatgagagatcgttcccctgtggagcatcagaagttgatgcactctggagaccccagttgctctgtcatgtttaccagtttgtagaatgtgttatcactgccaagcaccttggaagcagtgagaaaactgccagacaaatggaaaccggtttctctacccaacttggtagaacatttgctccaggcaaccatacaggctccaggagacatttgccttgacagtgcctattttgtaaagctgtaatttaaactgacaaaacttgattttgacattgcaacaaggtctctgtagacttaacactatgttcattttcccatgcttatccctactggagactgatgggtttacaccaacatggaagctggttggaatggaaaccatccagaaaatgattagggagcttgaagctctctgaaactgggcataatgtgtattaagtcattatagttttaatgaaacttgtcttagctggggtctcttaaccacttgttttctagttgtaaatattgagtccctaatttacactaatgagatgctgttgagatttaacgccaatcttatactgcatttgtcaaagtgtaagagctaacctgaaatgtagctttgcaaaatattctattaaataaacttggtggagaagtagcaacaaacaaactgcatgctttcagcagaaactgtcaacatacacatctctgaagaaattcatattttatgccagggtggtctacagtagttcccattagtaaacggttaaatatcacccttccctggtaaatctgaatacttttgtgtctgttgtgaaatgctgtacacatcctcttttgatgatctgcctgggaattctccactgtgagaattgtctcttaaaaatgggaagcagcaaggcatagtagaaagaatataggcactggtgacacatatatttaggcctgagcccagctcccagttggtggccaggtaagttctttaacctccttttgcttattttttttttctccctgcaacatggggttggtagtacttatagggcagtgctatccaaacacttagtagaggtgataatgtaagtagtgaacgtagctcctgacatatagttggtgttccctaaaggatagattgaaagatatacacaccaccaagttgaattcctctcagatttgtccaaggccacccagcctttcttggccttttcttccatcattggttagtgtgtgttcttgaaggcagtctgattttatccttggcttaaaaagtggggaaatatttaggaagcctagcctaatgcaagagaactcatctatcttactgtaggatcaaatacaaatggtttttggattgtccattatttatctctcacttctcttcattagtggtgctaatggaaacacaattatcttcatagactttgttagtcacaatctcttggtttcttcaaatcccacaatagcaagaatatgttgtggtttttataatctcttttggttcctcaaacccaaagaaggacagtgagagggtgggagatgatttgagagggtatttacattcccaggattttcagatatatttatgattttatttttttggagacagtgttccaatagagaggtattctgtcttctcttttcttttttctcttctctctcctccccccaaatcgaggttgtaagtgatgtgagagacctgctgtgaactgctgtcaccagatcctgctatgatttctctttgttcttagttctggagtcatcaaggctacatggagacacgtaccttccactgatatgtttgctccttgattcagggctgagtgcctgtttgagtgattctggctacagctaaatgatatttctgtttccaatagtattgtaaactatagagtaagaattttcttgttgttgttgggagagtttgtttttcttcttagtgtgtattatctcccaccccactcctccaacccgttctttaaaaaacaaaacaaaaccaacaaacaaaaacttgcattgaagcaacacccagaaggagtgagcaggcctaggctggagtcttatcctgacatggtagaatcctgttactgtctcttcgtagattcatttaaattgttttgactgattcatgcaatctctcagtccattgatcaagtcaaaagaaaaagtatcactaaaaactcacaggactggtgcaggtagaatattctttatctatggaaaattcattatcctatctagaaggatgtcttgaaatagcagaatatttttattatgttttttttccaagtaatacatggttcaagaaaaaagaaattttaaaaagccacactaatagcaaaactaaaataagcatgaatcttaattttaacaaagattacagtagtccatgggaaggattgtctgcccattgcagtgggtttgattggtttttttacttggaagtgctcatattctggaatgtgtttatagatcttgaccttagatacttctcctgactcagaaattgtaaaatgttttgctagagtagccagtggtgagagaccgctactgctgtatgttgctcagggctaacctgttaagaactggtctcgtcgctcagagagaaccatgatgctgatgccagtttcttgtttatgtaaaaacatttaaaaatgggcaagatactctctaagtacaagatagttattattgagatatgttcatgaataaattaatgagagaggaacttgagataaaggaaatggaggagagaaattgcatttttcctgcataattactctcttgttttagaacacaagtagtcctttggcatattttcaaagtgtggtatgtttcacttttgtttaaacttgtcaaattctcaatgtaaaagccatttaagacttttttttccttcttttttgaaggttgcttcttttggcctcttaaagataattaagagctgtaatttgtgaggattttgatggcattttttggcagtggtagtgcaggacaggatacatgaatcatagcatctgcttattagcaaggtctcatagatcacttgtccaactttccaccgggtgctgagatggttggtctctgttatctgttcttcccacttctgctggatacattctgggaaaagaatttcattgatgagtgagctgtacttccacttctgaagtacaaaagttattaagctagggagcattttctccatttgacacctacaggccactcagtaaaaaagcaaatgaatgatgaatgagtaaggtccctgggctgcttcctacttcttcttagagtggttaaggccctcttgacatttttggaggatgataaatgtgtgcccttgaagtttccttgtccaggtcaaacagccccaatttctccatgatctttggacattgcttccacattttctctccttcttgctctccacagggcaagtttcatttcatcaatttttttttgtaaaatactgtaaagatatctgaatgaagtagaccaggtataatctgataagcatagagtatggtggagcatttcttttaaggttctgggtattgttattatcctactaatggaaccagcatttgctggaccttttggggccaccatgccttagacaggtagataatggaatggcatagagaacagcctgaagccggctgtcttggtttgaattcagacttaccatttatgaaatgtttgaccctaggcaagttgtttaacctctctgtaaacttgtcttcatttgtaaagtcaggggtaatcatagtacttatttatacagttattataaggagtaaataaattagtttgtgctgagtgcctacaacaatgcctggagtgaaataagcactctgtgttagcttttattgaatttacaatgaaaaacgtccaggtcttactatctgaagtgcagttagttttttcagcaaggctttagaattagacagggctatgtttaaatcttagctctgctgtgtgttttgggggaaattactttgcctttctaagcttctgtttcctcgtctgtgaaaagggcattaaagaataaaatcagttgaatttctgagccctaattaagaaccttgagggcagagccatggtttacacttgctttttttcttctttcttaactttacctggtatgccatgtttataatcactgctaaattaaaatagtaaatatttaaactgagttttcccttcagtctaccttgtagtagaaaaattaaatacttctatgttacttaaaactgcacactcacaagtttatggtggtgtattgattggttgttctgaagaatgtattctgcttgccaccatgaactgggcttcagaataaataggcttccttgatcacttctctcctcattaactactgtctggaatttagagggaatacaaagtctggtagctacattgcctactaatcttgcaaatggcctgtgaggtgggtaagcaatcaggtgagtgacaaaggttatagtcaattttcctggcactctgggatttatttttgtgtccttgaagttttaagcaagtgagttttgaggttgttgagaaagtgggagactatattttaaaatggtttatagttattaatgttttcaaatcttggtgggattttaaaggtgggttaagctgcgaaagtgaatgtaagttaaagccagttaaatagaggagtccctcgttcattctgtctttggtatgcttaggatttcataaattttatgggtttcaaaatctttgccttgttttgaatgtttctaataagatggagtgaagtggcttacacctcatgagacatggaacagttatccaggaatgctgcttggcacacatataaagaaagcactggtctattgattcataaaaaatgtgtgactgattttcctgggacatgtgcattattttcacagaagaatttcattttttacttcctcccaccctgtgcatcacttgcacacgtttgcaattcatcaactctgatttccaaaacttctgccccctcttcccccaaccacctccatccaactacctaaagtgaaatatattagatggagaggagggaaatttccttaaatgcctaatttttatgtctgtaaggggcatggtgaatttgagaaatggtctgaatgttagcccagatgactcaatgcaattatgaaacaaattggaagctgtttccatgaaagagtatgtatgcatgtgtttccacgaaaggggtgtgtgtgtgtgtgtgtgtgtgtgtgtgtgtgtgtgcgcgtgtgtgtgtgagaacatgtgtttaggtcagttctttcattcgttctctttcttcctcttctttttgtcgtttcaaggctatgttttaggttggctatacagcaatgaggttgcactacacagcctcatcccctaaagccaaaatacagcaagtagaagactgcttagctcatccagtgagaatctcatgtattatattcttacttgccattgagttgccagaaaaaaaataaatagctttgtcttagaaagcaataacttttctgcaatgaaataacattaaacaactctacctggtatgccatgtgcattgtttttcctttcttggaaaggaaaaactttcttagaaaacgagggcacacaatgattagcgctaactttctctttcatgtgtccaacttaagattttctagtgaggcagagttatttccccttacatgcttggtttaatggaaagggcctggctttcagttttgttcatattcagctaccaagacccaatcagttaataactttgcccagagttgaaagaaaaattcctctgggtacagagttaaattcctctgcgtgtggaaggccatagtggttaaaaagttaggcttcggagccagatcaacatagattcagatgtgcctctgctgctcaatgtgtgatgagggcaaattgctgaactcaagtctcaagtttcctcatctgtctgatggggatcataacgcacatcacctgacgttgtaataattgcctgacaatgtgtataaggcactcgtgtaagatctggcacttggcaagagtaaaatgcattttagcctatactttttactcttcatttgtaaaattgtggtaaagggattggccctggagggagtagggtgaggtggcattttcaggaaggtagcacaaggttacagggaggacaatagaaatgtacaggatggctgaagactcagtaagtaaatagcattgcttcttacagcaggccggaggagatctctatatttttctttattagagaaaatttaagggatattgatttttaaagggaagatttatattttaattttaaagaggaaaatttatcagctcctatatatttattagacattttgggggggaaacagtgaatgaatgagactggtcccatttgatgtatgctgtcaaagtttataaactatctgatgaattagtaagaacatatcaaacaagacaaagaggctcattgttaatgtgcgcaggtgaggctttgcaggctgcttgtgggtgagggtaaaagttttcttaacctcaagcctggattctgaccatagaaacattcctcctgagtgagtagtgcttctagagtgctttccttcaaggacctctccggcatctggctcaatcacatgccatctttttctcctttacatctgcttccttgccccactttggcacccagctaagtgtgggcagatggtgtggccttggggactccagaagggccttggtgtccttcagtagcatggagtgtatagcagggtctgcccgtgaaggaccagggaggtgaagggccttacaggactcatgtggaatgcttgtgaatgcattatttccaaatatccctgagtatttgcaagcgtttttatatacctttacttccattttgctttgacaacaccattaccattccttgacgatgaggaactgatcggaaataaacctaattgttatttgcttaacagtttcaagacctgcaacttgcagcagtctcctgacggtctctgtacattttctctgtccccttctaatctattcaccacattgtagctggagtgatttttttttttttaaacagaaatctgatcatgagctttcttggtttaaaactccttcacggctgccatttgcttacaggtttagggctgaaatccttgccatggcttggcttacaggactctgtgggtctagcctctgctgactttgctcctcagcaccaacctattcatctttcatccttccctctttccagaaaacctaaaggtggagccctgtctgctccatctgctgccctggttactctcatccagggcattcattctctttttataagtactgtgaggccttttcacaatttgttactactgcatagttatgtacttatttcttgccagtctccctcacaaggctgcaaacttcaggagagtgcagaccgcagcctgttcagtcctcatggtatatgaagcctgttgcattacaggtcctgagcctccatttgttgaataatttcattaattaattaaccaattaattaatttcctctaaagggtttgaaaccccaactattaaggcttatgttgaaaggacaatttaaaggaaaataaactgttagaagagggagagatagaagccccagaaacttggaatgagtcagatcttacagctgagcaggaacgcaagctttgaggaaagctttatttatttaaataggagtctcataaggaaggcagaaaaaggaaacccaagcagatgacttggttcctattatctgctgagaggaagctcatctggagtgatgactttttcctggcactaaatttgacctgaaaattataaaatgaatccatacagaataaaaaataccctcctgctcccattatggatgatgtcttctattgtagtttgccgaagggacagagtttgtgagagggagtgagttgagatgaggtggagatgaaagcctgtatataatttagagagaacttggggcaaactagaaagatagcctgtggtctgagatgagggccgatgccacagacatggggacccctttcctttctggcagcattttcctgtgtgtattctggggggccttcaaggtattctgtgacaaaagggttctctagtcagataggtttgcaaaacactgcgtattatatcctggcccacccttgaagttgtataatgcataccaataaataaagaccctgagaagtgagagtcttatagtgaagagatgtttagctgtttaatccaccatttttcaagcttatttgacctcagaaaacataatcatagaacttccctcaaaacagacctgagtaatgctaatttaggagttggagagaacaagaagtaccagcatgagatcaaggtagagaaactcaattatctttgtagaaacatttctactttgaaatagaaatagaatgatctaagctgaaatagatttttttgtgtgtgttttattatagtagtggttggagtaggggtccccaaaaagtaaggattaagggagtgaggatctttcctttatgaaaatggtatggacccgtgtcatttaatggagggttttggtggttaggaggacaggctactgggtgtgagttcagggtctaccatgttttagctggatgacataagaaattgcctaccatcacagtgcctccttcctcacctgtgaaatgtgggtaataatagtaatgactacaagagctcttctaagaattaaatgtgatgatgcatgtataatgctgagaacagtgcctggttcaaagtaagagcttaataaatgttagctattagtattgctgattaaagaatgccaaggaattaataagcatggaaagattggagccctttactcagagcaaaatctagaaatgtctaatagccaaaatattcttctcatggggccttttccagcttgaggcaaatgataatatgtttagaagctgatggggtaatagtttcccagctggagaaaaacctgagtcttcatacaaggagagagaaccacaatgtgtgttcctgcagtactgctgtggaagtcatgctgtatgcaagtacgtccaaatcaataatcataagtagccccgatggctgaacccaaagtctttctttataatcttttatattatttctttaaaagactctgcctgtaaaagaatctgaatctagtaaacttactcgtgatttaatttgagctctgtttgaggtgttggctctgtttgttgattatgccaggttcttttcggtttctaagcagttgaatcaagtgatagaatgtctggttttctagttgcttcatacatgaagttgcatatccatccatctatccatctatccttccatccatccatccatccacgcagtaaatatttatcagtcaagtactactaaccacttccaatttatgaagcatcctcacaaagcccccaaatgtggtttaaatatagcactaggaattctttaggcctctgaaagttacttatgaaaatgacggagactgttctgtcttattttcttatcctcctaatttacaagttctgttctgtgtacactgtgactctgtaagagtagtgttggagactagattaaatgtagatctaaaataccctgtccataggcagagataggtaaagaatggctaattactaaataattaataatagctggtgatgctgctggcccttatttgacctttacataagcacagctgcctctgggctcatcccaggggctatctttatcaacactagagtgtgataataaatgagtttctctaggaatttttctttttgttcaggcactgtctctgaagagtgttccatgggaaaacaatcctcatgatatacatttttttaatagataaaactttggcagatccattttcaaccctggcattcagacctcctaaaattgctatcagctaatagagatttaggatatagaaagctgggaaggcagtcaaattggttcccggccactaaggccctgcatgcataagtatcacatgagggctatggacaccaagaccaatcaggccaggcttttcaggaagctctgctcagaatcaggtggagaacattcttaagcagtagtcaattattattcttgaatattaatcacaattagtgcaaaagactacctcttgccactaccagaattattttgtatatagagatcttatatgagcatgggaaaatttattttttaaatgctactctctgggaaacaaagtcattcactcaccaggtgtttattgagttaattttacgccagacactttgctaggcctagtgatacaaggtgaatgaggcatggcattgcccctaaggaaatataaaatagtatagagtttcaacttaagtgtcagatccaatctattaattggtagtggctgcctggaggattgtgttggggagaattctgaggctttgtctggacacagtgattgattagaacaatcttccttgaggatagaaaggggataatggtagatgtaccacccattttctgtacctagtcttctgagagaccggcaggcagttgcagctccatatgttaggtactataggaggggatcatataggatactctgggaacacctaattctgcacatggagcagaaaatagcatcacaggcggttgaaactttgaactgagacctgaaaattagtaggagatcccccccggtgaataaacaagagaagtgcattttaggcaaagaagcaaagttggacctggaagcaagcaatggtaggatgtgttgggaaaggcaaattgttctttgtactgggaaactttgccaagaccagatctcactgaaggatttggatgttaggcccaggagccttggaggactgtgagacaacactaaaaaaataccgatccttgaaaaatattaatctgaaaagaaggcactgatggcaggcaccctttagagctctggcctctggtctgttctgttcaacctctatactgatggcttggttagacaaagatgacgtgcatgttgatcagattaatagaagacacaatgtttggaagttttgtgagcctgtgggtgacttaatctgaaaccagatgtctcaaacagcttgaacaattccaaaccagaggatatttgctagggaaaatataaattctgtactctggctgaaacaaccaattgtacaagagcaggatggaagaatatttagcctggcaataatatgtgtgacaagagttagattttggttacaaatgtcaccagtctacaatgtgacatgtccacactgagaaaatagtaatgatgggcatgaagagttctaaaaaagttctaatcatcctgtctccttctgtcatgggcctactacaaaaggagtgttcattttggtaaagatgttaagataaaaattagctggcatgagtccagaggaaaacatctaggctgaggagatattttggttgatgattttagggttactaaacccagaaagagaaaattaaggactgtcttcaaatattttgaagataatcagtagcctagcacttaggcttatgttgtatggagtgatgaaaaatgggtagacatttctggaaagcaaatttcagctcaggttctcaatgaagcctccaatgatgggagcttctttgaagtggaaagggcaaataataagtttcctgtccgagaagtgaggatgcagagaatgggttaacacttgttggaaagattgtagaagggatttatgtattagatattgtttgggctcaaaggtccttccaactctgagatttttttcattctagaggaaaaaaaatatccctacactgtactgtctttgaagccagaaaaagaacatctataaatttgagcccaacctttaagttgtgtctcttgttggggcaggtttcttgacttgctgtgatgacagtggagcctttctatccctcatctggactttacttgtaatcttaaaagtcctctctctctctttttatttttttaacatctccttcctctgttttctgggccactcactcaaagacaccccataaaatatttgcccgggaaagaaggcaccttccaataaaaatacctataacctggaggacaagacacaaaagccttatttctcagctctgagcttttgttaaaacctgtgttatgactgggtgaaatgagctggcctcagagaacaggccagaaaacacagggaatcctttggctgattggcatcctctgccattggtgactctccataacccatgttgttgtctctggccgccagcaccccatcagatgttttgccagcttgagttctgagtctgatttctcatgccagcttcatcttggtgttgctgaataaaggagtttcccaccatcacgatacaccttcccctgcccctaggagaaatcttcctccagagggatgggcagccatgtggctaaatgggttcctgctcagaggcgaggaggtgaggaagaacacagtgcatgtgctgagcagagatccagctcctactcctggtttcttccaaaacctgcctgttaatcacctgtttacattgccaagcatgcttgactgggtaatgatagtagggggaaaagcagtgaaaggaacatcacaggttttactcaagtggagtaatcccttcctgatttacaggcatttcggtggctttggtgcagacagagtggctggtctcattcttttcacaccaatggccagcagcccccagaaagcagttggactcttcgtacccctttgatgtcccctcttgggtgattcccacgtggagggtggtgccactgggcttggttgcagtctgccaccccaccttcccagttagcattcccacctgctgttcctggtgactcttggtaaagtcagactgttggtgcctgcacttgtgggtgttatgtgagggacacatggagaccagtttgctgtagtctcttctctcactggcctgccccggtgccatgatctgaggataccacagctgaaagggaactcagaggtcatcaagcctgacccctttcattttggcaatgaggaaacaaaggactaaagaggtgaaggaaattgctcaaggtcacgcagctagttggtgacagggactgcagcctcagccttttgattcataaaccagggatcctttttctctcctaggttaaagcattgcccttttttaaatgaatatatttatttattcagaaattcagcaaatatttattgaactgtgacagagatgaataaagtctgtctccacaaacaactcatagacctggggaggagacaggggattatacaaattaactcaatgtggaaagtgctggtaaatggaggtaagaatagaaggctattctttcccttctccgggaaaagtgcctgacttgtgttttggttatggtgtgtttttttttttgaggagagtcagaaaaggcaccaaggtaacctggagacataaaatagcatagtgacccaggaaatgggctctggaaccagactgccttcatgtgaatccaagcgctgctgctcacctgctgagtaactctgggcaagttgctttttgtgtctctaatttccactctaaaaatgtgaggaaattgataatacttatctcctagatttattgtaggagttcagtgggttaatacatggaaaacactttaaaagtgtattggcatatagaaaaaaacataatagctatcattattattattatttcaagagctgtatttgaatagtatgctgagtaatgagacagatccttatgtttcaatggtgaccaaagatttagaaatgttagcatagttgccagtgaaagatgctggttttgcttggggctcctagggaaaccaggcacgtagatgggaatggacgggtacagtctggaagcagtggatgagaagggatttggggaagaagaaagccagaaggctagcatttcttttttccttcatggttttatctaagttggggccacagaggggtgaatattgttctgttgaacaaacagggggatatggcagtgtctggggctttgggggatcagtggtggtttctgggtatggcttttgttctgaaggagcttccttccagaagtggggacgtgtgcccacagatgcctgtgccctgaagaggtgcaacaacgaggtttctcttttgggaaagaggagagagaccagtatcttaagatgttgtcatctggttccaattttctctcctcacctctttagcatctcttacctaattatttgcttcctgaaagcatttttctcccaagagtaggtgcccagagatgcccttgggtataggatcaatgcaaccgagcagattgattcctccaaacgtgaaccctcatatgttagatcagtggtccccaacctttttggcaccagggactagtttcatgaaaggtagttcttccacagtggtggggggatgcttttggaatgatccaagcacattacgtttattttgcactctctattattattacattgtagtaaataatgaaataattacacaactcaccataatgtagaatcggtgggagccctgagcttgttttcccacaactagatgatcccatctggggtgatgggagacagtgtcagatcatcagacattagattctcataaggagcatgcaacctagatccctcgcatgcgcagttcacagtagagttcacgctcctatgagaatctaatgccatcgctggctgatctgacaggaagtggagctcaggtggtgatgtgagcgatgaggagtggctataaatacagatgaagctttggtcactctcccaccgctcacctcctgctgtgcaaccccgttcctaacaggccatggactagtactagtcgtggccctggaagctggggacccctgtgttagaccatttcatatgggctgcattcttttttggaaaatgaggtggttgcaatgcatggttcttaaggtcccttcttagcacaaacattcttgttcttgggccctggtattatggatattatacacatggtttttgctacttgccagggatccgggaaggtctgtggcacccggtaatttataattctgctgaggcaaggatttggccagaaggagtcacatggctggtgagtcaacttagctgatcacccaatctccacactcagttcctggcacttactaactgaggttgcaaaggtctctgcatcttctccttcagaatgttgaaggttggctgctacatcattttcccttagatttagagaagaaaagtttttctactagagctcatatttctctcttcttccatagcggcttttatttaaactattaggagagaaaaccctccatactcgaccacccacctccacactggcacaaatccagcctaaatcagaaccgtcagctcaccctgagccgggctgtggacttttcttccaggcaggtgggataggaatgggagttgaagtttgagcaacttttgaattattgcagttacctggatatatgatgtttttctgctgtgtataaagtgggctagaaggatcctcactcttccacactctgtcctcctcccaaaagaatttcctatttgttcaaggtgcaggattgacagcccaggagaccttgtgtctccacctgggcaggtcagaccatggcctatgtgggtggcttgcagcatgtctgtggaaagtgggcacagaccacctttgagggacaaaggggcggttgtctgagggcccctttaggagctcaccttcctttgccctactatttcctgttttgttttgcgttttgggatgggggggtttggggatgtataggccatgcttgttcaccctgagttgctgtcctttcttcccataacaatgtctgaagaaagaagaggagggtgggcttgaaattgtgatggggctaatgcttattttgaatacatgaggtaattttttgggtttttgtttactttattcttgctgttgaggtataattaatatagatgaattatgtgtttggttccatcagtcttaatagtcatgtccactcatgaaactacctaaagcaagctatagaacatttgcgttatttcagaaagttcccttgtgctcctttctagtcaattgtactaccctgcctcccatccctactcccacacctctacccagaggcaatcactttctggcttctatcaccatagtttatacacagggtaattttaaaaagcgtgtattcactgcaacctgtgtaaatccaaaaagggttacagttctttggggactgtttttaaaaaaatcagaaggctggagctagaagcagctttctcccataccttgaacaaatctttgacaatgatgggcctaggtgacctgatctctaaaacaattataataataattcctaccacatagcagaaaatgataataatagctgcatactgttattgaccacttcactcttctgaacattttacttcattatcttatttaatcttcagaatgacaccttgagatgtgtaccattttttctattttaacacatggcgaaaccagagctttcagaggggaagtaacttgcttagggccacagagcagtcagtcataattcaaatcaggagcctttgtgtccagggctttaacctagagcaggcctatgagagacggactcttgtgaactgaagtagcagctaagcagaggtcattattattttaaaagcagtatctattggtcagagaggacagtcttcctttttttctattttattaccttttaaatatttacatagaaaaaaatctagttttcagaatgcttgacatcagtgggtatctgcaaattagaactgtgggtactaagtttaagccttgtgctaccaacaggaaacatgaaaaaaagtctgtcgttaagactgatgcccagctgggcacggtggttcatacctgtaatcctagcactttgggaagatgaggtgggaggactgcttgagcccaggagtttgagaccagcctgggcaaactccagatagggagatcccatctttacaaaaaaaactttaaaaattagctgggcatggtgcatgtgcctgtggtcccagctacttgggaggctgagacaggaggatcagttgagctcaggagatcaagactgcagtgcgctataattgtaccactgcactccagtgtgggtgacagggcaagaccatgtctccaaaaaacaaaaaaagactgatgctccttctacttgtttctttcccacagaaaagcattgtgatggatctgtaaatattatttataaatataaatgacaataaagtgaaatattaattgatataattatcagtgatataatttaaatttttatagctatcatttgagttcctaatatgtgccaagcatatgctcagcatttgacatatattatttcaacatataatgcataagagacattgtattagttatctattgctgtataaccaataaccccaaaatttagcaggttaaacccataaaagttcattatctcatatagtttctaagggtcaagaatccacatgcaacttggctgagtggttcatgagattgccgtcatgctgtcagctgcatctgcagtctctaaaggcctgaccagggctggaagttctgcttccaggctcactcagtgacttttggtaggaaaattccttgacatatgagcaaggaatccatgagtctgcttaagacatggctttcccagtgagtcatatgacagaggaggagagagagagcccaagatggaagtcacagtcttttataacctaatttacagaagtgacatgccatcacttctaccatatactattagtcatagagtttgactgtggtaaatataggagggactacacaaggatgtgaaagccaggaggtggaaacactagggctatcttgaaggctggttaccataggcattattagccccattttactgctgagaaatgcatgctcagagaggttccataagttcccaaagtcatctacccaggaagtgagcaggctgggatttgaacactgatctggtgaactgcactgcctgtatgctttccagaatgaatacccaatgcagagagtcctggaagaacgaagtgcatgcaaccctggctttgggtattctagcatgtttctgagggtgcccccggatggctgtttgctcacagatacctatctttatatagttagtatgtccctgaagagcagggcataaaccaaagatttgcaaattcaattcatttcagattcatgatggaagttcaatatttaagggacttctgcttatatcttcctgtatcacttggtgatttatcattggcttttaaataagcattcaggtagtggagtataccagtagtattgcaattgtgggtgaatgaaactaccctgaagggaagattttgtttttctcttctagagtaaatgtggaattcaatcttatttaaaaatattttgagatccaagaaggatactaataaaccatgtgaaagtctagttatgtttaagattctaggtggttggtgtatagatggtgttttcccagaccatcccaagccatcctggcttaccacatccagaaaagggcatttttatagttgcctccactgcaagaggacctgaccactgagatacatcttcctgtcgtgacctacttaagggaatttcattttagggaaagaattcaggaagattatatggtctgtagctggcctattaaaaatgtaaacatctatctgctttttaatgtccataccaagcaaataatcaaagttacacatacttctgaagctccttttctttggagatctcggactattttatagaaacaggaaaatgtcacctttctagtcctgtttaccaactcatttttcttattaatttgctaatctgtcctgcctaggttaagggaatttgttattcattctactcatttactcatttaacacttatttcatacctgtcctgtgctacatgtaataggtataaaattccatactagatatgaggggaaaaaagatgaaaaagactaatttcctgccctcagggagctcatagtccaatgggagattcaacaaagagaaagaaggttacaactcaaggtaatctttgatttgtcaggagtcatgcaggaaagagtaatttactctggttagggagtactgaaagatttatcttgggtgatgatggatctagaaggatgagggggagtttgctaaaagaagaagcaaggaagggaaatgaaagtttggggtggtggtggaggagtttcaggtagaagaaatcattcacaaaggcataaaagtgagagacagcctggtccattttggagcaagaaattgggccataattgatgtttgtatctctaccttccagagtctcagaaactagaatgtttttctaggactgttccaaatccaaatgttgtctacggccataccacgctgaacatgcccgttctcatccaaatgttgtatcatttatcacccaaaatatagtgtatgacaaggagctcaaaacttattctcaatgccatgactaatagtgttttaaaactatatttttctgcctggtgttcatcatgacccttggggacatatctgggacatgtcacatgggctcaccatgagtcaggtatgggaatgtcacatgtcaaactacttttgctaatcaaatacacaaaatgctgattccctcactgttcttgagatttgcagcagtcacaagttccagtttgctaagaaattctcctatgcctgattggttatattattgtttccatctctttgcatcattagggccctgttgttacaagaaacagcaaaataaaagtatttctcttttcgttgtggtaaattggaaataccctagagactgtcaaagagggatgtgaaaatatttcagaaatattatttcatgcctcctgactacaggatggtggtgaggactcctttgtctgaggcacttagagctgttgaaggtgtgttgcctggaaatgcacctcatgggaagacttgcaggtgtgagcggttgcctaggaatgtcatttcaggattggtaagtgtgatgttaattttaggtgtcaacttgactaggctaagggaggcccaggtaactggtaaagcattatttctgggtgtgcctgtgaagatttccagaagaaattagcatttgaatcagtagactgagtacagaatatctgccctcagatattcatgcctcgagtatgcatcatccaatctgcagagggcccggtagaacagaaagatggaagatgggtgaatttgatgtcaccttgagctaggacacttatcttcttctgtctgtggacatcaaagatcctagttcttgggcctttggacgctgggacttacacctgtgctaccctaatcctggttctcagacctttggactcagactacattataccactgactttctggttctctcacttggcttttggagatggcatattgtcggattgctcagcctccatgattgtatgacccaacccccataatgaatttctacatatatatatcttcttggttctggttcactggagaactctaattcagcaagtcaaaggaggaaagtatattcacctttagtttgtccctactacttagtgattttattcacttctactttaattcaataagcattcattaattcacttctaatggaccatgaatagtgctaggtgctggaaatgcaaagattaatggactatgattaagacacagttcatttccttgaatctcacaattgaataggggaaaaggtacaaggaacggttatactatggtgcaaagatagatgtgtacgggggagctgggcacttcgctgcatctgggagggcagaggaggctctgaaggagatgataacaaattggatctgaaaagatgagttaagaatctgtctgacccagaggtttcatgggtctttaagcacattaaggagacttgagtgtggtttataaggtatgatttgtacaaaaagcacaaatcatattcctgtaaacacttgaaagtatcacagtttcacatccatgtagtgagctgtaactatgtttattgtatatttattgtctattttacagatgtgaaagcctgagaaggcagatagataaatgttacttgccctaggtcaccaaccagtgattagccactgaggactgaaacccagtattttttttcttacagtaaaacccatgcttatggaagtccatactggacagcagtcttgggtttggctaagctctgccaccactaatgagccctgtaaactcggacaagttgccaaccttctctaaacttaggctttctcatctgcagagtggagggagtaggacttgaggcccttctagctatgcagtctgtgatttctagagacagaacagggaagggcaataggggtgacaggagagaccagaagctgccgtcacaaagactagctttatggcaagcctgtttcccaaaagcacaggcccttcagtggccagtgaaactgatgtgtttggatttatcaagtagctttgccaaggaccagctggcagaagaaagcaaaaagcagcacggcagatttaaagatgagttcatttctatggtgtcagccgcagagggtgcggtttccctgtctctagagtggtggacacagtctaccactgtgtttcttcgaggggagattgtgcatgtttcttcgaggggagattgactgtgtgcttaggcagtaaacatcttctgggcacagtgtcactgggaggatttttgtattgagagggcagtgaggcgtgaaacctcagactcctgtggtacttcctgctacccagtgatgtcagaggcttgctgctcacagtccccagcttagggccctgtttctccagctctctgcttacatcatgtgggagaggagcagcagccatgagaaaacctagctcctggaagtgcagagatagagactgggataaaagaggggggtaaaaaaagaattcattaaatttggccttgaagatggttatttacttgtttgctgtgcttgctaatatgccatatgaatagaaaagaggctgatttttgatgacaccatttcaagagtatccttcatgatgtccaggttaaaaggtttttgtgggtttcttaattttgttgtttactgactgggcgtggacatatggactcttattttttttctggttgcctttgctacatttacaggcttccgtgtttctaagaaacgaagcagctgtcttttcatcaattaatggtatcaaaagtatcggtaatctctggatggtgctatacaaagtgggtcaagagatatacagtggtccccccttatctgtgtcctgggaatatgttccaggattcttggtagatgcctaaactgcagatagtaccaaattctatatatactaaacatgaatttctttttccttttttacaatttcatgcatagaagattcatttttactgtagatcttagtgacctcagcatacgatttttttctttcctcattaagtcaagatctttttcaccttttcacttcaatcttttaccttatcactttatagtttattggcaaatccaaatgccagcatcactactcttgtgcttttggactcttagtaagtaaaattaaggttacttgaacataagtgcgtgatattgtggcagtcgatctgatcaccaagacagctactaagtgactcatgggcaggtagcatagaaagtgggaatatgctggacaaaggggtgactcacattctgggcaggatggagcaggatggcccaagatttcattatgctactgagaatggtgtataatttaaaacttacgaattatttctgcaattttccattccatattttcagaccatggtaccttgggtaactaaaaccatggaaaccaaaactacagataaggggggagactactatattctaaaagtttataagagaaagcaatttgatggtgatatcaaatgccattgcattgatctctgcaaaaacccttcccattcattaatgcattcctcatacatagacatatagcctcccatcatcttcacacaccacagacaccttacatttgtgcacttgatttttgtgaagctgatgtttatactgatcatgttcaggatggggctcctgtagcacaggggaggtttttgggacaggtgggtaagagaaatataaggaaggaagagcaaaaaggacttgattctttattgtttatacaccaaaaccactgccttatgcataatccctccttctgggcactgggtagtgagttggcaaagtgagaaagacgaaactggtagttacaaatattctacaaattgttagaataaacactggttttcatttgagttggccattaggttggaatctgcttggccaaaaggtcaaaaccctttctttggcaagagtgatgcatcttaagtgtactttattttgccaagtagactaaagaccttcaaatctttgacagaggtgtgggaaatcctacagcacatgttttctctcagtctagaaaaactcctggacgtggattacaggagcttttagatcttagaatgctctttataaaacatatttggatgacacatgacatggagaaagttatggcatgcttgtgttttatgtaagtatgtgatttgatcagggcttagaaaagtttatcaagctttttagatataattttgtaatctctcaagatagagatggcatttaatggcgggatagttggccaataaaggtcactggacaatttaacagaatgttgcattcttgtaatatattcttgttcttctttgaacacaggactattactcagatttagaaatactagttatctgcatttttcttcattgtctctgttagacagtgggatatagtattgtctttagtttggctacactgctgggcttgaaactgtgggtaaaggctaacactcacttaagaaaataaaccatgtatcttggtttcatgaagaagatggttagacctgagaaagaggatgatctctgttgaccaaggtggaatttgaagtggaggtagtgtgaagtcagggtgaggttttggcatgtttagtctcccagacagaaaagatgaaggccaagaattgatattcacacatctcgattaggtacctggcatatcattagcctttcttgaagtcattgattcacagactgggctgatagtgaattttgaggtgctctgtcaatctcttctccctgtcattttcccacgaaggaaccaagtctcagagttgagatcattaaccgtgaacatttaccagctgttaaatagatatgttctttgataactgttgaaaaattttacaattttttcttttcgtcttgattctaggtgccctatgattttctttctattttgtcttgccttttttatttgatttgatactgagtgttttgtgctcagaaaataatacccagtggtgtcttggagttggcatctgtgagattagaactatgacccctctaagttctggataccctctgttcagtaaaagggctcacaggtcgctagatggacttggaggtcctgatatccagcctcctctaagatgaacgcttccacctacagtgccctagatgagtggctaacccctgcttgagtctttcattcacaatgtgcttcctccttaaccaaaaaagccactcccatcattacatattagatttcatatcatatcatatttattcaatgacttctatcagattgttaaaaaataaggatattttgttaaaaaataatataaatataccctttctgaagttgttttgatagctcctttgatagcaggtggaatttttaaacaatggctttggtgcctggattgtgaggattttgcttggattctggtggcatttctgaaaatgtgactaatgacccctccagtgttctagaatctgtgttcagtaacttgaactccatgccatctgaagccttctccaaagtatgtgctgggtccctcctttactctgaaagatttccataacacttggtagacactaaagaatgcttcctccaccttctccttcattataaactgacttgttggacttaacagttcctttctcatctaatcaaggagctggattctgtttctcaataatgtaatcacagtaagatggtgatattggcgaagcaccggaaatgactggcaggacactggggaaaaactgactagtctacagtttccttagaagacagcctgaaattgcttataagcagaggggagcaggtcactgaaaatgtagactcgtgtgtgaacacatctaacccttgatttggggggcattggggggctgctttctggaaagccccttatgtatgccttgcacacccacatctcaccttggagccttatttcagatgcagaataaaaagaccagagttcgagttctgactctctattaattattagctgttgagcttgggtaaatcccttaatctctttgaggttaataataactaccccagagagctattaaatgtgtcaaatgaagtaataggtatgggaatgctttgtaaactctacaaggtcataaaaagtcaagctgttgttattaacagtattttctgtaaaattttcctggctattccagctctcaggattttgcatttctcttattcactattggtactgccctttggccctttcacgtattcatctgtgatgctggtcagcccttcccctggatagaaattttctctctagcaagtttatggctttcatatttttaattttgtactatttttaaaaatgtaaccttcgacaaaataaaaggatatgcataacatacataaattttaaagcataagactgttttagtcaacatttattgagaacctatgaaatgcttgacattgtaccaggtcctggggatacccagacgaataagacaacccttgccatgagacatctccctatctgagagtgggcacagatggcagtgttcatattcaataaacaggaaaaagggaagagaggcttttccacttagtgaaatcgaggctatgttctgaaagtgtttactgttttccacataaagtttccttgtttctcggttccttctttctttttcctaaaatgtaagctcaatgagtctttaagctatgtcttccataaatattttttgaacacctactgtggagctaggtacccaacaggacatcagcagcagaagggcagagatatttgtctcttttgttcactgatatattcccagacaatatctgctacatagaagtgcttaataaatatttatcaaatgaactgtcacattttattagttaatactagctgtcataactgataatccttggtaactcaaactcagcttaataaaataaaagtacatttcttgctcatgtaaagcccaacttgaagtagattgaatgaccctgctccatacagtcattcagggacccagcctgcagaggttctgccatcttcaacctgtgtcttctttagttaacttactgccaatctccagccaggagacagaggagagggaaggcgtggagggttccaaaagggcctttttggccggagctcattctgttgtctgctacatttagacaactggaggggttggggcaagaaatgtagatccttgctggtctcatcccagcaataattttgcatattgaaaggagtgcacaaatctttgaacagctggccatctctgccttatggacaaaatgccatttgttttctgttcacatgtgggtctttcatgacctgtgagctccttggggtcaaaggctatatattattcaattctgttatccctagttcctagtatagtacagcaggtaaatagatgttttctgaattgaaagtaaaaaaatcgtttttctgttggatgtcgggcaccataatagatgcttacatttttttttttggataaaggaggttttttttttaaaaaaaggaaagaataaaagaagaagaaaccatttgctataataaagatctgcaaagcatggtaccgggttccaggatggtaggtgttcaagaaacacatattgaaaaaaagggaaagaaaaagaagagaaagagaatgaaaggacaaaggaggagggaaagaaagaaggaaggaaggaaagagagagagaaaaaataaaaaggaaagaagagagggaaagtagaaaggagacagaggaaagaagggggtgaaagagaagttgaacaagaggaagaacagggaatgaagtgagagagggagagaaaagagggaagagagagagaacgagaacacaggaggttcctgagaggtaagttgtgtggcgccgtactcactgcagagggagtttttccccctgcctaggaggtcagggaaggcttcccagagagaccttgctctttggcttctgcttttcttggtccttctggcctaatttctgcaactttatgatctgcccaccccaatagaggacaaaaatatctccctgttgtctgatggggaaatgaagttaataaatctcctggaaagtttgtgcttctccatggaaacagtacataaagtactcctgccacccaccaagaagcaccgggacgggcaaagctctccatcacacaggacctgcttcttcaagcctacagtttctcaggccaggttctgtgcagcccagacacagttgttcagatctggggtgtggaccaggtggtgccagaggccctaagaatactctgtttactttgccttcctcatcagtctctttcattcctaactcactgagtttctccacaaaatccacattcagaagattttcagtaatttgactgactgtagcagcatacacagccatgagtatactgtgcccagatgcctgccagagtctcccgaccacaaacccagcacgttgatagttgtgtccttgccatatacacagtggaatcttttgccttttctttccttttgtgcctttaacattttcccctttgtatctcctaaatttgcatactttgtagcaattcttcaaaacgatattaatatgcccattttatagatgagggatctgaggctcagaaagtttcagtgtcttgtttatgctgcctggcatcagtctgaattgctccgagccttaagcccaagcctcttttcaacagtgctgcagccctgtcaaagatgtacttgtgaattcaaaacagcactcaggcatataggttacattggcaccaggaaacctaagcagtatttccatgaccaaattctaagtgaattcaacaccaaaggagaaaaggaaatgttctttgctctctgtatagattcctcttctgcttgcttgggttttacaaagttcttctaatttttatgtgcgattggacaatgcagttttggtaaagttgctaaaaccataactgttactcttggttttaaatatcaaaccaggtaaaagggagggaggaacttaatgttacagaagggaaaaatgacttaaatatccgaacagacaccatatgggaggctttttactcccctttcctcctttaaaaacagtgtgttatttctccctctagattccagttactatggagggatttaggatttagtgagactagtgttgctgaattagctttgtaagacaagtctgtttactttttatactaattttcatgcttaccactgactctgattagtttgaagaaagctatttctaagaatctgttcttaacattatagaaaggaaaagttggccgggcgtggtgactcatgcttgtaatcccagcaccttgggaggccaaggcgggcagatcacctgaggtcaggagttcgagatcaccctggccaacatagtgaaaccttgtctctactaaaaatacaaaaattagttgggtatggtggcaggcacctgtagtcccagctacttgggaggctgaggcaggataatcgcttgagcctgggaggtggaagttgcagtgagccaaggtggtggcgttgcactccagcctggacaacagagtgagactccatctcaaaaaaaaaaaaaaaaaggaaaagttaatgatttaattttctttagctgggcatctggtaaccatgtatcagaaggtgaagcctgtgaggtgccttagagagcatggaatgctgcccccatcccatggattaggaaattgaggtctgtgtaattaatatgaataattattaccatttttcttacattaaaatatattaaaaaccatagagaaaaagacacaggtgatctgcaattccatgtctaaaggaagcccctattaatatttttatttaccactcatctattttctattcgtatgcattatatattaatttaacatcttgctgtatgtatctgttttgaaatgtaatttaaaaaaaatctaaatatatcatgaacatgcctcatgttatggttgcattcttcatttatttaacaaatgataatcactaacacttaacatggctctgtgggccaggcattctcctatgcacattacaaacagtaactcacatatcctcataatgagcttctgaggtggtagcattattaccgtcatgttacaggtgaggatgctgaggcccagaggggttacataacctgcagggtcatgcagttaggaagtggcagagccagaatggtcacccattctgtatgacttttctgtctcccgggacctggcctggcccgctgtaagctagcaaacgtgtgtgctgaatgaatactggtgtttaaaagactgacatggtgcatgagaacagggtcttcctggtttggggaatggtgctgattcacacttggcatgtgtttatttcctgaaggttctacggccagcagagctctatcctgacaatgtttctgaaccaccgatcacctacaggtgtgcagaggttatgacacagcagttttacacttggccttgggagttgttgtccggttccccattatccccagtttacacactttcactaagtcaagattccatgtctgtagctgtaatagcagtgtaatagcactgtgctcaagggcctggagtgttccttgatgtgttttgggatttctagccaaatgaactcagtataagttcatctcacttttcagattctaatgatgtctttagagattttgtcctaaatcagtgaacagaatttgattctgagggaatttaatttggaaaaaaaaaaaccacccagatacatactttcctccttgtagagtaaaacctctctttattaatttttttttcttaaaggatacattagcccttttaattatatcttttgcttttctggggtccagcataacctattctgtatgggttatacatacttccttctatcatatattaatgaatacaactccctttagatggagattgtgctagctagtgtacaaactagataggccctgacctcaagaagctagcaagctagtgagaaagataaataaacaaagatactctgttctgtttctttatttatcctaagacatatggataaagagtaaacaaaggatacacgactctaaatactgcaatacagtatagtggagaaaggttgagtatgaacttgggaataaggaaatatctttttttatggtgacgttattgaaacatccaaaccatgatatatttaagttatattttcgatggttggacttcaaggcttttttgaatatattcagtttaagtctgcagataataggaaaagagcttatccttagctttaaaaaattctttgttcatagctatttaaatggaaaagaaggaagaattgtcatatgcaacattttaaatataattcatagtttcatgtgaattagtggaattaacagtaaccagggaaacttccgaaccttagtgtggtcagaccctagtagacaataacagaccttttttttttcttttaagagtcttgctctgttgcccaggcaggagggcagtggcttaatcatgagatactgcagcctcgacctcccaagcttcagtgatcctctcacctcagcctcctgaatagttgggaccacaggcacatgccaccatgcccagctattttttttttaatttacttattgtagagacaaggacccaccaggattcccaggctggtctcgaactcctggctccagcagtcctcctgcctcagccccccaaagtgctgagattacaggcatgagccaccgttgcccagccaaaagatgtggattataaatctagctccatcactagccacagctgtattacaatctgcattcagctgtgagttcagacacctgaaaagtattggcttaataagttatggagagttcctaaaactcatgttttaattctctcatgtaatgaaaacaggagataggcagtagacatttccatggaaactgacatttccatcccataatgtcttctgggacccagacaccttttctgtttccgccagtcatccttagtgtgtgcttctcatctgtagtcctaagtttgctgatcctccttctgcctcacgtccatgttcttgttagaagaatgagatgggcaaagtgtaggcacaagctgaatcagccctctttcaaaagcttgctcagaaaccctacctagtcacttcccagtccatctcatgtgccaaaaccatgtcacatgaccaccctcagctgccagggaggctggaaaaagctttttagctgagcacattgttgcccccaataaaatcagggttctgttaagataagggaaaaggaggggctggatatcaggtaggagtctactaatctctgccctatcagctgggaaataaacttaatcggcagttagctaacttttttgaatgcaccctccctgccttttcttcattaaatcttcacagacctaggttcagattaaagtatattttctttagttgaatttcgggttggagtgccagggatatttctcccttccactcccacttgatgatgtcattcatttgaaatatagttgggttcatttatttagtttgtcttccattttaggtttttttttttacccacttcactgattttatttatgtgtttgtctgtttatgtgtgaaacattcatatgttttggaagtcagaatgatacaaaaagaaatactcaaagacatgtccctctcatcttccttctgctcctttccaccctcccatcatttccacctcattcctgctcaccccatgtccataggtgctcagtctcatttgtttctggtttaactttactgtatttgcttttgcaaaatgtgcacagattatataactatatagctatataagcatatataaacataactatatatatctatatagttgtatgacatatagatatatttttatatatagatatattttctcattctctttttttcttacacagcaggtagcatactttagatattctttactcaagagtctatgtagatagttataagaaacgaaataatcatgagaccagggagaatgacaggtgtccagtaaaagaggtaaaaccaaacaatacaagggagagacctctgcttaggaaaggttttatgaaggaggctgcatttgagcagagtcttgagaatgggggatatggcaggaaagggaaggatttttctagacattgatagaagaggagaacagtcagggaatggtagggaagcggggccaggtcaggggcatcagttcaggggagccccatgatggagctgaagaactcaagtctctagggaagagtgtgacaagattgcgatgatacaggaagtgaaatctgagtgttgtgtgctttttgtggattacgggtttctagagaatttagacatcatctagtgattcattttaaactgacgttgtgtgcccatgttatagaggaggaaactgaggcccagataaacaaggatcttgctcaaggtctcatagccagatgttggcagagttggaagagccatgcccttgactcacagtcccaggctcttttcctcaggatttccccaggatgtaaggtggcccctgtgcttcatagacctggcagtttttcctttgccagcttgtgtctggacttctcaattcatttagtcccaagtctccaaatccaaccagactaacagcaactttaaaccagcctgttatgaattgaggtgtgtcccttcctccttctctttaaattcgtatattgaaggcctaagcctaactctttaggaagagactatatttggagatggggctgttaaacagattaagttaaaatgaagtcattagggtgagccctaatcctatttgactgttgtccttataagacgaggagattaggaaactcatccctacagaagaaagaccagtgaagatgcgaggagaggacagaagacagccatctgtaagccaaggagggaagcttcagaggaggccaacctgctgatatcttgatctcagactcctaatttccagaattgtgagacaaattcctgttgtttgattctgtggcacttggttatagcagccctagcatatcagcccatgccttaacctacattttaactggctcctcgtgggatcgcacacccaggctggtgtcttagctcctgcttgttacagctcctcatccttcctgttgttaagagccttccctgggccctatcttatgtcacctactcagccacactgcttcagaggcaagagagtagtggaggggagtttgtcttagtgcagagaacatggagggcagattgggagtctgatggagccactcactggccaagaaaataaattgcctaaccttctggattcaatagtgcagttgaactaggaatctctgaagccatttccatctcctcaattctataagcaatgtggacacaaactatttgttgattttaagtgcatactcagggatttaaaggtattttttaaaattatgctttttagcttttttaatattctcaaatgttttgccttactacagaccttaatatacccaggatattaacaagttttaaaaatcaggtgatgggattatgagttttaattttcttccttatgctttaagttcctctgtatgtgaagaaaactaatcaactttctaatgcagatggtaatgaaacaaagggtatacaagtttatattaattgacatatagcatgcagaaacggatgtagtttttaagataataaaatgtgaaaacactagttaagttgaggatggaaaaagctgtcacaagatatctataatctgttgtttgggtcatggcaaagcatacatggtaatagacatgcaccatcatggaaaagctcatcctattgacgttctagcttgaccttaggaagaagaaggtgcagataagagtctaacttaaaattagaaaaaaggaactaaattcaaaaattataaacaaaacaaccaaatagtctcataagaaaaatgcgaaaattttgctgtaatttatagctcaattcctcaagtaacaggaatttttagttacttaactcgataataattaacataaaataatgtacttgaggttattgggacttcatagatcagggaatatcataattattactgataattagctaaatgtaatcaaacggttccatttagaatgtttttaggtaatctggattcttgttatttcctatagacattttataagcaaaggtggaatacaacatgcttataatatggggaagaacagatcttggcaaatgggattgttttgaggccttgttctagggcactaaccaaaacaaactagatgaaaaatcatccacctctgtgaacgtttcagagtcaactgcctgttctacacaccctcagcctcatagatacgggtcctgataacccgaagtcctatgctttggtatggattacaggagtgatctctcctcctgtgtcctcttttgtagaaagcaaggatcattttgtaaacatctggtttcacctcagaagcgcacgtgctatcaagatttgtgtgtatgtgtgtgtttgtaaaagacattttatgtatgcctgcgaatgacctttccaagaatcttgcacagcttgtggctattcaggcctgttccatggatttttcttcaatgcaaatccagctgtgtcagttcccgtaacccctcctgtgcctgctcaaggttaagcgctgcagtctgctctttagtaagtgtccagagggtaattacccaggtgcatctgggtggggtttaacccctttcacccccaccctgtctgccagattcatgggggagattcagatgtgcaagagaggcagttagtgaaatcagttccctctcttggggtaatttgatcttgtcaaacaatgctttttacagaacatatgtgctttagttttattttaagtttctgaaataccattctccattttgctcaccactgaggcatatgtacaaatccaaagaccctcttttgttacacgtgaaactttattcttatttttttgtcaaaagaaaagtcctaagtttcccaaatccaaagcaaagtgaatgcttcaatattactttatccagagccacaggcaggagagaaaagttgtgaaaatcaattcaggaaagaccaggaggaaaacaaaatgatcgccccagaaatgaatatttaactgttgtttgttggttggatttgggagaagagaaggtaaaatggtttaaaaggcaaaatattaaactgcttagattatggacagctctctccacagctttcgcccccagatactttgggtctcatgatgctagaatatctgtcgtatctcagaggctaggacattctaggctgagagtggttgttataatattttgcccaggagtatggtgtgggagcagcacgttggacagggacttggcgatgttggcaaataataagcatggggcttgggcggccggctggtgattgcttaagccaggcaaattacttaagctttctgagcctcagtttccttctctgtaaagaggccattgattcccacctcctggggttattttaaagatgaaatgaaaccagctatgctaagtgttcagtgcttgccaggcacattacacttaagtggtagctgttattttattatttaaaaagatagctttgccacaaaccagatatgtgacattgagtaagtcaggccatgtaggtggctgggctgtggttttctcatataaaatgtgaaatttagagctatagtcccttctacttctaaagttcactgagcctttgaatcccctcttaagcattagttcactggaagaatagtttctgtgcctagcagtgtgcaaggttgccaaagttcagattaaattcttaccaggaggttactagaacttgaaacacttcttgtgcatggatttcaatgtaattaatcatttgaaaggtgaaaacatgtgttccaatcctgggcagtgacttatcccagtgcccaggtgagttactagcaaatcttaggtcttgggcagttctttttgtcctgataccaaagctagagaaataaatctgctttatggctcctcagtcttatttatgaatcaaaaaatcctttcatatccaaaatctatattattctgcatctgaaacttttctgatcttcttcactcctttacaataatattatctaatgcatagataatgcatggttgcttccagagtactttgatttatataattacactcacttgctcctcagaacaattccatgtggcaggtctgttatcacccccaattcacagataaggaaactgaaggctggatttgctgagatcatatagccaagagttgtcggatatgggttacatactcatgtctttcactgcaaaacacacatttctccccctgaagcaagctccctctaaagtgccagagtattttgtttatgaatgaggagtgacaaagcaaaaaatgaggtcacagttggaaataggatatggaaatgctggttccttcatgacccacaggctcagatctgtgattcccaacatctttttatatgagggcctatttttctttggtaaacagaagtttattattttattacacaggcaaaatacagatgtgcaaaagagaaatatgttaatactctggtgattattagtgttaacattttggtgtcttaacctcttcgctcccctgtttatgtatttatatgtatagggatgtgtattcaccagaatgttcttaatttgcacatactgttgagaacccatctttactaacaaaacatggtggattgcccacagatagttgtatgggatctagattttgcatctcccctgataggcttatcctgcctgcctcttgctgaattttgctagaaagttgttactaccaccttgtactacctcactccccaggggaaaactgcagctcagtctgcgtagctcctggtgcagcagaacccagcagtgccagcagccaggcctgatccggcccctaccatgaaagccctgacttctcccaccatgccaggactcagatgaagaatgtgccagggagtgggaagtggtgtctccagtggcctccatagctactgatacaatgcagaagtgcagggagttaaggcccacaggtgaaccttggccaaggggagatagaagcgcaggagactgttctgacccatatgtggtttccatatagcctttgtcttggtgacctagcaaacaggcacttttttgtgaagttgtgacagcttagtaactaatgcaccactctatatttgctctatcttgatgtctacctcacctcctcctgccccctgcgcacctgctttccaccctgggaaccccacccctgccccgataaagcttgagcacgaatacttttcctcagctccttcttttctcttttttaacttaggaaactgagctgatggtcattacatttatagtatctctgttcagtaagtacttacaaacaaaaattcaattgcttttagtgaatggattttattaattacaatagcatctgtatgcacttgaagaaaagtagtatattgatgttatcttcagatgccatttggtgataggtgaattaaaggattccttgaagccactctgtgcctctctctacctgcatgtcctcaagaagaagccacagttgggttgtttaggtgagatacaggtcatcatagctattttaccctcaacttgaccttcgtgctgtagttaaagactctcagacagaaacctcagtccatccagtctcttcctccagctgcctttcaagtgcgtgaagttttgaagtctgcacacgttttctcagggtgaggcactgtacacatctgggtcagctttattccagttttctttttttttaaatatataaagtcaatcagtgtgagtaactgctacatgagaccacggagaaaatgaaataaatatgttggaaatgctagaaagtgatctgcagttgtttattcgcctcagtctcacttcctggcttattttaaagcattcaaagggtttgaacaatcttttgagttgtttggcgtgctgcaaaaaatatggtctgttctctaatatgaaagaattttacactgtgcttcctggcctggaagtgtgtgggagagtgaggaaaacagggagaaactagtctcaagggacgggacctcttgtgctgattaacattctcttaacaaggcacttaatctattatataattcagtgcacttaatctatgaagcagtattcacggggctttcttttgtttctcaaggccagggatgctgtcttgtacatctttgcactctccaacagtgctacatttaacaggtactagctgcactctttgaatgatgaggtggttggtgaacttttcagctagctaagtcaattatggtgagttgcacaagatgcccatgttacaaagaataaatgctagaaaaatgatttatatatggacaaattactgaccaagacaatgtccttgtttgtacaatggacattgttcaggcagagctcatgggttgcattcacagaaagggctcattggctggtttaaacagaaaccaagaagagaggggtcaatgaaggcaggactggtgaaggaaggctgtgtccagggccttatagggatgaaaggggatgagacagtggacctatggactgtgaattctgagttccagtctttgcctcttgaaatttagtgtcacttttgaggcctgtcccctccaggaagcttttcctgatccctgaaccagttaactaacctcctatgaccccatagccctgtgttgggacctttatcctggtgtgctcctgcatggccatttgtgttcttcctgataccgtcctctagatactaagtcatgtctgtgagggctgcgctttttctggttcatccatgtgactcccagactgccttgcactcaggccactgcacaaatgcctgtcgaagtagacgttccaacccaaaggttcagaacaacaaggacgtgcatccagcctttgtagtgcagtgggttgaagagtgatgccctgaaaaagatgtggccacatcccttctcaccagccctgggctgcattctatttaacagttttggttttttacgtcagagaaaaagagatgacttttgtataagtcattgttattgactctgtctctctccaacttgagaactgcaggaagattatttgctcattgcctggccttcaggtgtctgatggaacaggaatcaaatcatagacactttgaacctctcctttgccatgatgcttggacaaaaaacttgtggcctcaattctttaactgaggagccttgtagaataacctctggagttaaacatacctgggtttgaacctcgactattactcatttctgtggtgtggcctaatctccttatgcctcagtgttctcatctgtaaaatgggcataacaatgaccacctcttacagttgttgttctgggcattagaatgatactctatccgttagtacaggggtccccaacctcaacatctgtccagggctagttaggagccgagcctcacagcagaaggtgagtggcaggtgagcgagcattactacctgagccctgcctcctgtcagatcagcattagattctcatagaagtgcaaaccctattgtgaactgtgcatgccagggacctaggttgtgtgatccttatgagaatctaactaatgcctgatgatctgagatggaatagatcccgaaaccatcccccccacccccaaccctggtccatagaaaaactgtctttcatgaaactggtcctcagtgccaaaaaggttaaggaccgctgtagatagtagatactgttggttgtagtattgtgtcattacgttgtttgtactagtgaaatcactaagactcttgttccagggaagagaagaaacaaaaaactgaaggaataaaaagtttaagccacaaagcattaataggaacacttggacctgtacaagagatatgctgaggggcatggggaaggaattccttccttctcaagctgtaggtgtcaggctttggccgtgaaaatgacagtggattttctactcattcagcaaactttctggaaaccccatcacctgccacgtgtgtgtggaggtgctgtgtgggtatacaaaggcgaattaagatgtgatcctgggtcagggacagtggctgccacctgtaatcccagcactttggaagaccaaggtggaaggctcacttgagcccagaagtttgagaccaacctgagaaacagagtgagatccccatctttacaaaaaaaaaaaaaaaaaatactagctagctgagcatggtggcatgtgtctatagttccagcaactctggaggctgaggtgggaagatcacttgaacccagaaattcaaggctgcagcaagccatgatggtaccattgtactccagcctgttcaacagagtgagaccctatctcaaaaaaaaaaaaaaacaaaaaacagaagacatggtcctgatctctactctcagggtttcatactctattgagggaagataaagtttattataatgcaaggagaaaccactctaaatgcagcatttacaaaacgctctgagagcataggggtctgtctgagggaagtggagaaaggcagagctattgccatttaggtcggatcttggatgagttaggagttcttcaggaggggtaggaaggatagataacatgtacaaaggcaaagcaatgcaaaaatacaatggtatgatgttggctgtgactggcatcttatgttatagggctggggagagacagttaagcagaacattcagccggagttgtatccttgacactgttgggctaagaggctgggttgccttgttttagtttgaggaaggctgtggacattttaaagggagggaatgatacgggctgttctcatctgatacttgtgcttctcttctccctgttcttttgagttggactgtggccacggaagggcagaggaggagaaatcttccagcagtcatggggagacacagatatcctttatcttagttgggattaacaaaacaaattaactttgggtgtgaggagaagcgcttcagataagaaatgggcaaacttggcgggggttgctgatagtgacaccacatcttccctgtctttacttggggaccatttatttttattttccccctctctttaaaagctgttgtatctctaggaaaaaaaaaaggctccaccttcaggaatgcagtgtggttttacttctggtaggtgaagaaaatttagcttctggatttttctatgcttgataaagggtatagtgtgtaaatgtaggaaacaaaactatctctaaccagatctcaaattttatgaaagaaacacaaaatatggatatattaatgtagaatagacatgtgtaatatacattgccctttgggttgcaaggtttttttctatatttctatattttcttctgtatttctataaatatatttctatattttttctgggagaaaaataaatcttaaatattttaaacaaaagttctcagtgagtgtgatctctgtactcaaccttggaaacaaaaacagatttcttgggaggaggagggataaaattgggggtatgctgtgtattttgggaagaatttggcttctttcttgctgatacctttcactagttgccgtaagattcaggtggttctttcattattcattctacatgtattcattgagcaactattcatcaaccagctgtacctttctggacaggcttattttggactgaaaggcattcccttgcctgtcccacggcctccccctgagattttcttagctgcgctcagtgtggccacaacaccccgtgattctgtcatcacctcccttgctacgaggctgctctagagccctccataaacaagctgtccaggctgtttggataagagcaggggaaagacaataataaactcgggaggatggcatgaccaaggtgattcgcactggaggtttttaatggctttttacacatgatgagcactttattgtctgcagtttaaaacgccgtcctcacacggtggctctgtgaatgccagcctctcccggggagccttccctagcagtgcagcctcaaattcagggaaggttctggttgtttcttctgtgaacaaatatcagaagttcctatgcctgtgtcaggagctctaggttaggtgtataaaagagatggctaagtttgggaagccgcattagtgtttttgtttttgtttttaaagttttaagattaaaaaaaataaattgttagacttcactagctcttgctttctccttttcagcactggctgaataaccagaacctgagctgaacttgagtattcagaaggtgaagcaaagaggaaaatgttttattagaaacaggctttctagctgtgacaaattatatgtgaaatttcaagtacagacccgcagggttgtgatgacttcaagaatgatcaagtgtggcccagtctaggaaagtggagggacaggaaccctgcgtgcctggtttattgtgtggtttcacttcctagggagaggaaggcaggaggagagagaaagtagcatgctgcagggtgctgctgagttcaggctgtggctgtccccagtatttcagctcatgccggtaatcagcaggcctccaggaggaagagttgggagctgttatgcaaagctgagaacctgtaagtcgaggtaggaagaagacagttcaaatcccttcggatgactcttgggcagtctaaagtctgatcccaatttatctttccagattgttctattaacctggccaaacaccaaatcttttgtgtacacatgaccgttggaaccctcttctctgcttggcaaactctaaaccctccttcaagaaccagttcagaagtgatcagtgtaatcagccattttaaaaaattggtttaaatctgtacccctccacccccatttctgcttcatctctccccaaggcagaatcagtctctcttctctgttgcttccatgcaccttggctgatggacactgttagaattgatgctcacagcttgggagagcagatggggtctgggagagcctcctgagttcactggcacaggatcatacaagacaatatgtgtgaaagtcagtggttaattgcaaagcactgtaccactgtgttcatagctaccctttattgaatacatcgtgcttggtattttctcatcaaatcctcacaacaaccatttgaaggtaggtattatagtcatctttcttttaaacatacaaaaactgagtctctaagaggttaagaagtgggctgcccatggtcacattaaatagtaagtggcaaagttacattaaacccagttctgactccaccatctcaacccatgtcaccatttttctgggcctgtgggcaatgcagacgtgagggagacctggtctttgctgttaaagcttctaatctgggatggagataaggcagtcactgccccctggtgtatagtctaaggtgggatacaggctctaagaagggtgcacataaaaagtgtttggagagcaataaagaggctttgtggagagagctttccttccctgcaccttgaggagtgggcagggtttttatagcagacttagagaatagggaatggcagaaactacatgaataaatgcttagtggagtataagaagagtgcaatggagagaagggtatgagactaaggctatcttaatcatatgactattaccaaggacttagagcccacaacatctcccaccctctgccccctatccttggtcttttatgatgggagatggttgctagcctgcatttagggatagctatgcttatacagaacttctcacacagagtagtactgcttccctgggtttggaagcatttttgattttgccagaaagattggcagggggtggggtggggtggatgcatgtgaagccgggggggtgtgctacaattggcacttggtgctccctgaaccaaatatactaaatatcttgtaatggatgcatcagtcctacccagggaataattctcccactccggagacccagtatctcctgtgtgggatcccccatctacaagtatacatgtaaactttcccctgggccactgcagtgtccctctgggaaacatgaatctgttcctggcacctctctagacactctagaatggttcagttgttttatccctatacatacttgacctccagaacatgctatttatgctactcccaaagcttatagctgaaaacaaacatttctaccctatttttcttcccttgaaatatcctctggctctgaggtcatttaaggaataggcagcccttgcagatttttgtaagtttcctcttcgcatgaacaataactgcaaaatgatccatctgatctggctaccattgttgaaggcaagaggatacaaagagcattcatcgggccaggcgccttctcaagaagggctcatcaaggtggaaaaccaagtggcacatacttgtggagaaagtttgaaaggagtaggggttaagggagtggtagggattgaggaaaagcctaataacatggtaataggagataacagactacaaaacccctgtgaaaccaggaataaaagagccccatgcttcacaaatacaagattgaatgagtttcatgtttaatgtaaatacacctgccatttgttctctgaagcactggttacaggttttgagataaaatagagttttgaacattgtgccagtgtaatttgcctttgcccaggcatagactgtacactttgttcctgaacagtccttagagacaacatagtgctctgatcagctcaaaggtcccacctcctgatgtgagacctctgcttccacctggcctgcatctgagactccttggctattgacagagtagggggaagtgagacagtggcccagggtgccagtgatctcatggctaaagtggatcattttactctcctgcattgaagttactcactgcattaagggtaaagagcaaaaccctcaatttctcctataaagccctggcctaccttttgctcaagtctcaccattctctctgcagttgctcaggcctactttcagttcctagactgttactgtgcagggtccagcctcagggcctttgctgtcctctgcgtgtgagcccttctgctcccttccccttcagctttcaattcttctttccttaagtcaacattacatattatttctttacggacactgtccctgaacccaacctcacagcagaagacatcaggtgacctcttacattggtcactgggcaccatactttccctgtggctcctgtcccagtttataattatacatttgtgtgattacctgatgaatgtctcctcttccactggactgtgaattccatgagggtaattctggcactcagtctaagcctgacacctggcaggtactcaaagggtatttgtttaagaaattaattattaaatgtatcacagatacatcagaagatgcaaataagcaaacaggaagaaaaaaagcaatcacagttctacaaccaaagaaaagccactttccattttttggcatatactttaaaattttttttctattctataaaataatatgattttcccttaatagtatggtaaacaggattaagcatccactaaatttaatttgccatcattttattcaaccaatcccctattgctagactcaaatcagatttgtatgatctattgtttcatggaaaccgatgcaaaattataaaaaattaaatcatttttgcttctcaatcagcattttactttatccaaaaggagtatatgatgagaaatcaagagtgactgtccaggaaaatggagatgtggcagatggagctgcagaccacgtggggagagccctggccacaggaaatgactgtggttggtagaggggaaagtattggacagttaaggagttgccacctgcccctggtggaggcaaatgttgttttgtggaaagcacgtggcataatgacagggcctctgcaggctcagtgatgtgggtgagcaaaatggctgtcttgggattatctaggagcttctgaaggcagtagggtggtggctaatttcttaatgctgctctcccatcctagtgatgggcagagaggatgagaaagccagctctggggagacaactgttgttccaaagtgaggagtcaccactacctgccatctcgcagactcttgtctagtgcccccttgaggccatgcttgttgttagccctgactcgggtgccccggcacctgccgtaaaccaagctagacccagattgcgtttgggtgcctggaacaggagaagttttaggaatttatgttagagattcaccatgttgtactttctgccaaagcgtccctccctgagtcagaatagtggaaggctgactatattccacccagcacgacgcactgaatgcttggtatgagcagcacatcatacgacaggaatctcacaacaaagcaatgaagtagttaccactatgatctccaccttatagatgaagtacctgagacttggaaagtgtcaaaaccagaatttgaacgcaggtctgtctgagcccagaccctttgctttttaaaccactctttatgaagaatctcagtaggttcttaagaacggggcgtggtactctctagagcgtttgtgacccaacactatgaattgaaacaaggcaagctctgtgctcccatttggggaaagttaatatttcacatgctctcgagaatttaggagcttggtaaaaacttactattaaacagggcttttctttaattccttttgtttaaaaattttcttgtgaaacactctatatactgtgcctccctctgagacgtcagtggtgccagagaccgttagggagtttgtgtaaatagagagagggccaaatgctgcccacacaagtagtgaggcatgaggctgagtgcgtggaacagttccatagctagccctaggctctgaagagtgtcctgagacctcatctgggtcccaaaatcggtgggcagtgctgtctccgcgagacaatgaccagcatgaggaaatacctttaaccattcatctttttaaaaagataagtttgctaagcaaataaaaccagttagccttgaaagttcagtattaatgaatgttaatgcatatcttgagattttctaaaaaactgacaaatcttccaaaagacaggaatatctagagggtaaataacaggactaaaatgctttgaaacatctttgaaatgatggttcaatgcacagggtcaaagggtaggactggttctcttcaagcattttaaaaaaatgcctcatttttatttaacattgttttgggaaggagtgcattatattgacacattgagaaaaaaattcctttttgtttttctaaaactaataggagcttaggcattatgattaaggaccaaaaagagccaatgccgatgaatgccctctttcttcagctgtaaaatttaatggccgctaccgagaggtttttcttttaatcagcaaaaaatttattttgtccttgacattttatgccaaaaatcagcccagagaatgtgttttatagcctgggctgaattcccctaaaggtagagttttcctatgagcagtgttcattgaattggctttttttttttttttttgcactagataactatattaatttattagataatctttttattgtttcagcaagatagaggaaacttacacagagacagcagagcataatgggtaagcatctgggttcttttggaagacgagatattggtttccattggccttgctacttcctgtctttctgaccttgagtaaattactcttccagagcctgtttctttgttcaattggggatcataatagtgccgccgtcatcatgctgtcatgattaatgcacctaaagcatttagcacagctgtcagcacttattgagtattgactaattattagcgatgcacagtgatctataacttaaagcttcgtctcagaatatgccttcttatgatctgatagtaataggaatcagcagaaaataaggtggttcaactatccgggaaaactaccaaatatccgcttagcagaggcaaaataaatgtagcttaaatgcagctgaaaatgctgaaagctgcttttgtttctcatgttatagaaatgcagttatttttattaaaagtgatgggaaatccatctgtaatctcctgtctttcttttatctgtttgtaaaaatagctcagtaaacccataaatgccaagaccctgttcagtgtgagaaacattgttgggcaggatgggaaagttcaaagaaatatcagatgcaatccctgctttggtggaatatttggtgtaacttggaaaattaaatggaaaaaaaattaaacaacaaaacagcacccagctgccaaataagtgaggaaggaaagacctcaggctgaagcactggtgatgggaggagggatttatttgagctggtttttcaaaggatgggtaaggaaagaatagcaggaaggcgtctcataggtatggtttaatggtaagagcaaagtcagtgtagtggcaaagaacaaggcaagagggtggagtggttagcaagtgaaggctcattaatgcttaaggctacctttgaaacagaagtgtctgtctgaccggattcaggaggcctgtccatcacgccattctccaccaccatgattcattactccagagtctcttatcttcaaatcaaaagcaagacgagaggcagatacagatatgaggaagtgctttgcttttcgctactctgccaaacatagtttacataccaacactgataatctgtcagcccacctctcctggacacttaatcatttccctggaatccactggaataatttttttatgcattacaaagtatgcttcagagtgtctatttcttaagataagtttgcattcctttaaccaagtggcattcccacaaagccccaaggtggcccgtgttacacattccttcttacagccaaagtggtcagttaggaaggcagctaccttcatggcctgttagtaagaatgttggacacttgttgggcatttactctgtgggagacactgttctcagtgctttacatgtccaaattcatttaactctccagaagagggagcagtaggagagaagggtgatgaacagaccctacaaacggactaaattattaaataatgaatcagcaattagttctaaaaatgtttatgtagtgcttactgtgtgccagacaccatgattaaaggacaatcgaagtaactcggtaatcacctctgaactgccagtatgggtgttttatcaccttccatgttctgtgttgacggtttattgaacacattttgagttcttcagggcagtgcttattaaattcagcgtgcgtttggatcgcctgggaatcatggtaaaatgcagattccgatttgaaagtgctgtggtggagcctgcgagtttgcatttctaacaagctcatgggggtggcgacgctgcacatccaggtgacctcttgaagtagcaagatcttagagaaccaagtaaatggcagaggaaatacaagcaggataagacaggaacatattgtcactttcacaccagaagaggcagtaggcctggatttggccccaggccccagtttaacatgatcattatggttgttgtcgctaccatgtgcaccaaaggaatctaagagcttggaaccttaaggcccaatggcacggtttacaatgctaacacaccttaaagttaaaggaagaatgtacgctatcctaggaacatgactgataaggtgcggcagagagagtggggtggggcgggtggggtgggaggctagaagtcaggaaacctgtgttctcatcagggctcatttacagacttgctatgtgacctagtttaatcactgagcctttcagtgtcccgatatcctcatctacaaagcagactggtaaacatctgctctgcccacccaggactgcagaagtgagacaggatgcacaaaagctcttgggaaaaccaaagaaacactgcaaatgtgcatttttataattaaaaaatatagagtctgtcttcagcagtaggcaggaaagagggggtatctcaggagctcccactttggtttatgtctctctgagggcttgttatgcttctcagcctattctgtattcaggagatgcatagagcttctggcttcatgctgtttcagagcagcccacttcagccttttctttaccaatagaaacccctagactatcacagcttgtccttcttgcactgaacccattaagaataaagaaagtctctgggctggggagtggaagtgagggacataacatttactgagtattttatgtgagttattttacttaatcttcacaacactcctaggaggaaggtagtctgaattatgaaattgttccaatttcatagatgaggcacctaaagctcagacaggctcacttgcctggggtttggttttgtttctctttgtaaaaggtaagtcttttcaatttagtaggtcaaaacacgtgattctctccttttcataagactataaagttagcaacctctggtatctggttaacagttcactttgtgcaggttattccagaggtagatagcatgagtttatgtcgaagcccaggattttgtgccaaacatccgtctctttgcaacagaattggagaattgttccagaattctttgaattcttaatttgcagaatttcataaagagttctacagctcacttttcctaggaatagaggagagcggcaactgaagacagcaggctttttctttttagtattgatgatgatgatgatgagctttaacacagcttatccaggtaatcctcatgtagtgctgtgatgttgatggttttgttacccatattttagagaagaggaaactagagacttagagggttaagagacttatacacagcctaactattccaagtgtttaggactaagtggactttagtcttggtttttccagctccaactctgagggttgtttccatattcccctgtattacatggattaaccagtgttagtgaccatccggctaagaaattagcagtggctctcagtggaaaagagctacttgattctaatgatagtaataatgaaaacaactgccagcttcctgtgctgttggtagggcctcctgggttggccctgtcacatcccatcatgtcacggggcatgtgagatcacggggctgaaataaccctgggcgactgatgtaaaacagattgcgtgtgacacctgcccttgggcttcccagcgtggcacttcagcccctcttggctcagaaagcatttaatatacccacagagtgctgggttcccccccaaaactttctgcaaacttccttgtaactctggaacaggatcccaggccatgtggaatcttgaaaaggtgattgacactggagacgcaaggtcctgttggtttgggctggttactcaatgtctttgagtctcagtttttcacctgcaagtgggaataaggatagtactccgttctctgagttgtgagggttaattgagccagtggtgccagatcacagtaggtacccaggcaaagaggattgttgtagcttactttcttctggattacatcatccttaatttttctctttccctctcctctcagaagtcatcacaaattctgacacttctaaattatgccttaagcctatctatattgtgtctagctaccaccttagtctaaatcagcttcacctctagcctagattactatactagcttcttacctggtcttctgcttgtactcccacttgacagagcatctagagtgattttattaaaatataaaccagatcattcattcgcttttgtaaaactcttcagcggtttccaattgcactttgaatcaatctgtaccccttaccctgcaaactgccacctgctgtggtccctgcccacttacccacctccactggatgcccctcgatacccagctcactgtgcctcggtcatgacggccttctttttcttccttggatgcaccaaaaccagggggcctgaggacctttgcatgtgctgtttgtcccctttgcctggaatgctattctccaagatctttgcatagctggaaattttgtagctctaaacacggggttcttccatttcataagactataaagctagcaacctctggtatctggttaacagttcactttgtgcaggttattccagatgcagatagcatgggtttaggttttcatttagagaaccacctgacctctccgtagaaactcaccacattctctcccccagtgactttctaacacattacagtgttttaattttcttcatgtactcagcactacttgaagttttctcatgtatttgttgacagtttatctccacccactagaaggtaactctggccagggttacagcactagttctaaccagtgtctgctgtataagaggcactcagcaaatattgattgattgaatgaatacattttttattatatattaaaaataagtagaaatgaatttttaaaaataagagggaagtctttcaatgtctatattcaagccgaggtttgggatccagtggccatggacaggcctgatgggaaggggtgggtggaagaatcactcgtcttcagagcattgcggtatggtgagagaccatctcatacagcctactgcctcccgatactttcattcactcgttcagttatttgaaaagagctcactgtgtgctgctctatgtgctgaactctgggctcatagcaactaaccatgaaagacctggctctgcctttaccgagcttaaagtttgacagtgaagactggcactgagtgcaagaattttccattgaaacaagtatttaacaagagagcagcacaggagggcctgggagcattttgtaggaggccctcttctggaggatcagggagtcatctctaaaggagtgacatctaatctaaatctggagaatgcctgaccctgtccacattttctcatcagcccttgagaacggtggaaggttttgcggattggaccagcaaaggggatgcttttttttttttttttttttttttaagaaaaaacttcctccacccagatgacacctttttctttctttattttttattttttatttttttattattatactttaagttttagggtacatgtgcacattgtgcaggttagttacatatgtatacatgtgccatgctggtgcgctgcacccactaactcatcatctagcattaggtatatctcccaatgctatccctcccccttccccccaccccacaacagtccccagagtgtgatattccccttcctgtgtccatgtgatctcattgttcaattctcacctatgagtgagaatatgcggtgtctggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtttttgctatcgtgaataatgccgcaataaacatacgtgtgcatgtgtctttatagcagcatgatttatagtcctttgggtatatacccagtaatgggatggctgggccaaatggtatttccagttctagatccctgaggaatcgccacactgacttccacaatggttgaactagtttacagtcccaccaacagtgtaaaagttttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccatcgcccactttttgatggggttgtttgtttttttcttgtaaatttgtttgagttcattgtagattctggatattagccctttgtcagatgagtaggttgcgaaaattttctcccattctgtaggttgcctgttcactctgatggcagtttcttttgctgtgcagaagctctttagtttaattagatcccatttgtcaattttgtcttttgttgccattgcttttggtgttttagacatgaagtccttgtccatgcctaagtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttactgtagccttgtagtatagtttgaagtcaggtagtgtgatgcctccagctttgttctttcagcttaggattgacttggcgatgcgggctcttttttggttccatatgaactttaaagtagttttttccaattctgtgaagaaaggcattggtagcttgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcagtcatgatttggctctctgtttgtctgttgttgatgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgtccattcagtatgatattggctgtggttttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttgttttgccagtattttattgaggatttttgcatcaatgttcatcaaggatattggtctaaaattctctttttttgttgtgtctctgcctggctttggtatcagaatgatgctggcctcataaaatgagttagagaggattccctctttttcttaaaaaaaaaaaaaaaatagagtagcctctctgaactagcagcagtcctggggggatgttgatatcctcattttagacgaggaacctgtggctcatggaaataaggtgaattgttcatattcacaccactagtaattggtgggttaggcccatgtatccatgactcaaagccccatcccttttcagacaactagaggtgtacccactccattgcaatcatgaggaatttaagtttcaggacattccatcttgcttcttttgtttcctcaacgactaggcctgttctggatttttaggagttaaaatttggttgatgctcttttcaatcctaacaaaatatctcactatccatagtcctttgcgatccactgacaagtgagaaaccaaaatgtaaggggttccctttttttttttttttttgccagccagcctaatgatttggcatgctggcaactgcgtggttttgaaccgtgaggctgctctgagtacctgcatccttgtcctcatggaagtcaccaaaaccgtttgtcaaatggccaattccatcttatacagggagtcggggaaatgctcatgaaattgatcttgaagcacttggcaatcgcaagctccataagaatcctgggtaggagtaattaacttattttggaggacggatttacttaggaaagctccaactgcaatgagggtgggcccttttcttgttgctcctggcatgtgctcttctccaagtaacatttgcagcagtctgggtggtttgtctgcttagagccatccagaaaagttggtgggaaaagccaagaggccattggcactcagagactggggttggcaccagtcacagtgagaagcattacttttattagcaacttagtcattttacagcaggcgtggcagaagtgcctcctatgcagacgcaagacgctaatatggttattagggtaagaggagcagatatgcccagtatcccacaaaattctcaaattataaacatagcacacctttcactaatgtggtgataagacttagcttatataggcttgcatcctgaaaaacctgctctcagtctctcctaggtcatggctgtggtgtttgaatcctaattctgccattactagctgtgggactttgtcatcacaagactagcttccctgttctcatctgtaaaataaggatgttaatggcatctacctactagaattgtttcaaggaataaatgggttaatacaaataaagctcttagaacagtgcctggcacttagtgctcagtgagtccttgggataaccctctagagaggccaagatctgggctgtgctgcggactgctctttaccttatcctaacaatgaaaggacacagtgtgccctctgtcaggccctgttacaggccgaagctcataaaagtcagagggagaggtttggaaatttaacccagctggggcatcccagatgaaaaggattagtatttaaagagccgttacagtttatactagcaaacacacaaataggcagattgacacttcctgcctcagggatatggggcttccaccctttccagactccacaatccgctttgctgtgtgttttctctttcttcccttttcttgtttaatataatgtttgcttcctttgcccatcagtaagcactgaatattggacatctatcctgtagaggactgggattgctggtgtgataagtcatgattcctgaccttggggaattttgcaatgttacaagcaagctgggaaatagacacgtatgtgtgagcatgtttaccctggccaaatcccatttattctttaaatcccatctcaaatatcacctcccctaggaagctttcccagagttctcctagcagagtttcagttctctctctctctctctcggttgctttcataaaactttgccttttaccttattggagatgtgattgtctgcttctctgactcacatattagattaggagccccttgagggcagagaccatggaaaagcagcctagagggatgttatatagttcttatttatctccatagcttctagtacttggggatgcagtgtatgcttattggtcaaaatggtaaataaatgtaaatggtaaataataatagctaacactgagtacctcttgaaaagcagttcttattccttctctgctgtaatgataactaacatttactaaaggctttcttttgttcagtatgctttttccttcagtagctcatgtgatcatcctgccttaggaggaagtataattaacagattataaatgaagagactagaggcacaaggaggttttgggtaactcatgctagaattcagatccagcaatctggcccagaacctggtctcttaacaactagattaatctgcctctcactgtgagtctgtagacagagtgttaggacttttttttattattattattatttaagttctgggatacatgtgcagaacgtgcaggtttgttacataagtatacacatgccatggttgtttgctgcacccatgaacccgtcatctacattagatatttctcctaatgctatccctcctctagccccccacccgctgacaggccccagtgtgtgatgttcccttccctgagtccatgtgttttcattgtttaatgggttctcctctctcttactttaaaggcagggattccggcttattggactctgctgtgaactgactaaagtcattatctgttcaacagtggtcaggttctttctggtgggtttgggaaccacatttcctccccagcaacccaagttacaatgaaagcaagtcataggctaaattattcacaagtacaagcatttattagccagcaagcataaaaatcatcgtaaatctcttttctttaggctccaagtaattccttctttctgtccttgagccccatgaaccatccttgcataaaaaattcaggataagacaagcataatattctgatatcagggttggccagtcttccagctgcatcaggtggtagacttactgggtgggacacacaagaccttacagaagtttggacctaggtacgactcctcttgttcatgctagagtggagatgcccatatgatgttgtaagccaatcatatttcctgaccatcgctcattttatgaatgaaaaattatttctaatgccccatattaactgatcctcattaatgactcctcaaatgcagatttagatagcaatatgtgaagtggttacagtttcctcctttatattcttaccaacttctattcacatgtgtgaattcctaattagtgtacttgaaatgttaataactatggcagggatgtaggtccctatttaggctacacaaatgttaactatccatcctcagagttagattaaatttaacttagaaacacacatgttcatctcaatatcagtactcaagagctttaaagtaaatcacagaaggccggatgcagtggctcagcttacgcctgtgatcccaacacctggggaggccaagaaaggcggatcagttgaggtcaggagtttgagaccagtctggtcagcatagcaaaaccccatctccactaaaaagacaaaaattagctgggcatggtggtgggtgcctgtaatcccagctactctggaggctgaggcacgagaatcacttgaacctgggaggcggaggttgcagtgagccgagatggcgctaccatactccaacctgggtgacagagtgagactctgtctcaaaacataaagtaaaataaagtaaatcacagacaatataagcagaagtgcttagaggttgtgtagaacagtggaaagaggtgtacgtagctctgaggtcagacaaaatgggttcgaatcccagcttctctgtggcagtgggccagtgaccacatctcagaacctcgagtacagtagtcttcctttatccaaggttttgctttccagggtttcagttaccctcagtcaactgtggtccaaaaatattaaatggaagattccagaaataaacaacttctaggtttaaaattacatgctgtcccaagtagtatggtgaaatctcacgccttcctgcttagttctgcctgggacctgcatccttcctttgtcctgcgtatctaagctgtctacaatttctagagcctattagtcacttcatagccatctgggttatcagatagatcctcacagtgtatactcatcttggtatcacagtgcttgtgtttgagtaactcttattttatttaataatggcctcaaagtgcaagagtagtgatgctggcatattactatgttctgttttattattagttattattgttaatctcttactgttcctaatttataaatgatactttatcacaggtatgtgtgtataggggaaaattgtatatatagggttctgtactatacatgatttcaggcatccactggggtctaggaacgtaccccctttggatgaggggaaactgctatactcatattatgtactcataataatgcctaccttacatgcttgcagtgaggattaaattagataatatttataaagtacctagctcaggggctggcactgagccatcgaatacataaagccagtattattaacctcagttactggcctgtagcaagatgctcaatagacctgaggagaatgagtgaaggggaggttgcctggcatgggaggaagaggtggaaaaggtgcaggggtgatagataggattcttggctggcctatgggggccccagctgagtgggaatggagaggaagtgggttgatggagtcccattgtgtgcagaaagaggggacctctgcttgggtggaaaatgaggaaaaaaggcagcactcaggtctcggcaagaatagcccggcctcccttccttcagcccatcttctgaactagaaaaaggctgttgggtgctgtatgagaagtgaggcctaccaatgagagtcatcatcatgtaaattctctaccatcctggcttggtcggtagcatttctactgcccccaaagccaaggaagaatgatgcccctgatggttcttcccatttagaaggaactgcagtttacacacattaccttacctgattctcagatgtcctcaagtgatgttatcatgatctatcattattttccctgctttatagaagggaaaacagtcccagaggaggtaggtgactcctttagccagtaagtgacagaggcaggatttgaacctgcatccagctgatcctgttgctcttgctgtagaggagaggcagtgtatgggtattctcccagcttgcttggtattcattccactgatttttacctggagcttgaagactggaactgggtggtagaatggcaggtgtagggccagagctggtagagtgggtggtgacagttctgagccttctttgcccacctgtctgacagccctttatctctgtaataattgccaagagtcctgaaagatgcctcttcccttcccagttgcaaggcctgagattgagcccagggatcttgccagccttaattgacttgtgttgaaaattataagaactgaccctctttttaattttccctaaattaaacactgtggagggatcaaatggaaaatgaccaagagtcctgagaaaggattatccatctggcatctgatggaacttgagagacagggcagcatagtagtggtgcctgctgcatcttatagctgtgggaccttggccaagcttctggacctttcacagtgcgtttcatttccttatatgtaaaacagggttaataattctggcctcagatggttgtgacagtcattgagattctccatgttacttgcatggtactaggcaggagcttaatcagtgtccctttacatccccagaagtgggcttaaatagcccagtaggagtatgaaaccctcaatcaaatgtctggcatataataggtgctcaataagtatttgctgaatgaataagcatggttgctttgctctctttcgtaagttttctaactccatcgcagaagggttaagagaccattaagatcttgccatttcttgggcagagatactaacatttattgaacaccaactgctttgtacgttttatctaattgcaacaattctgaaaatctttactatgcctgtaatttaaatgaagaaattagggccttgagaggttcaatgagaaaaccaaggtcacccagctaattggtgaagttgggatctgtaggcagagctgtgactataaagcctgtgttcccaccagcaaatgtcatgcagtgttgaacatacacatcccaggtgagacatgccctctgcctggactgaacatacaagacccagagcaagttccgcaccttcgtgtctggatgtggggtcagtacagcttctgcacaatgagccacagtgaataaggaagtacagagaagcagggtgagggctgatgggagcaccaaggcttgggagctgggctctgtctcagatttggcctccagctagctgctgctttgcaggtgcaggattcagtttgggttgttggtggtggtgaggaggtatgtcagggagagcaataaagcagtgataaacatccctcatggtaaatcccctatggtgaacataagggatttgatgataagaacgaggtcaagatcctgtaggtgaactccactggtatggacctgggtggccggtatggagcaagaggccttgagcttcccagtaagggcctggctctgagctagacccccctggtttgaaccgagccataccagtcaccctctgtgtgactttggacaagagacttacactcattaaggctcagtttgctcatctgttagatgggcatgatgctggtgacaccaacctcatggacttgctgtgtggatcaaaatggtatcagacccatacaatcttcagcatagtacctggctcctgtagtaagcatataacaaatattaggtgctatcattgacacaaaggccacattttaccctcaacttcatttatttcctaaatggatcctgtgggatggttttgacagataaaactgtttaccaaattcttaccccgtgacttggacttgcaaggactgcaaggcggaatctaatttaacacttatttaaatttaacagaaagaaaacatttgggttggctttgtcagggtttcctttttttaaaaaagtatattttacaattttggcttttgagatatcagggtcttgagggacagacagcttacgtctaatgtctgggcctgagaagatcctgtaagagacaggtctgtggggtcaaattggcctttcagactgagcctgccatagattttctgaggatttagatgatgtgaaggggagttaacccatcccacattgtaaattattttttcaaaggaaggatgagggagccaagtaacaatttatcatgcttcttttacattttgactctgcaagaatttagcaatctgccatccatctccagctctgtttgatttgggagaattttttttttttttttttgggtagaggggagaatgattgtaaaccaaatgttgaaaagtagcctgttggttttttgttgcagtgtaaaatatggttcagtaattcattgcccaacctccctcccctgccaacaccaccaccaaagaaacaaaaactaatgtccctgctcctggacagcaagagttaattttcagcctttggttaggaaaacagaatggagggagctgtatgaactttatgcttatagcttagttctgcaagcccaggagatcattggtcagcatcagatgagctaagatgcagttctgcaactgctgaggaccaggtcctgtttaccagcagagggcacagcctgtgccaaggtacagctaatgggaagtcagagacagagtgaaatggtcaggttaattgtagagggtggcacagatcaggcctaggtgtgctgaactaagtaaaatcaaatttctctaacggaaaccccaaaaagttattaaaacacaacctccctctaatcatttaccacatggtttttaaattctgtgggtagtttaccaagaaggcctcttaggattatatataatgtccacatacttgattactgagaaaggaaaccaagactatatttaatcacaaactgtacagtgtcagaaaaagtcctgctaccctgtcttgtcactgccctgagtggcagtaatttatagcttgaaacagcagctggagcaggaaggagcctttaaagcagtcacatttgttggttaactttggttaacccagaggtcaaaagcagtttctgtctagcacattagataacttttgaaacgtttgacatattgcaggtagcattacaggaacatccacacttgtgataaaaggagttatttatgaggtagctgtggtttcaaatgtaaaggagaaaaaaaagtccttcaaattatgaaagctttggtaaaaatcccaagttggatgttgctggcatttctgagagggtgaaagggagattaaccaggaataaaatgggaaagtccatttaagtacacactggcatcccagtggcattacctgctgattgaaagaccgttatggagaaaggattaatgccttcagccttaccattagttgtcttttatgtcatgagttgctatgaagaactctactattggtgctttccagctgacctcttattgtccagaaataagtgaagaagatctattggttccaaacacattatcacggagcacttgcaatctattcgttttctgccttggtttatcaaagctaagcaaggggtgctctaaagtgaaaaggtggagaccttagattcagctgctttctgaagtctctcctcttctcccacagaacagtcattgtggtatttcataaaaaatgcatgctttggggggaataatgactgttttctaaaacacccttaccttaaatgcttgaaggttttgctggaatgctaaccttccagcatttaaggaatatatgactaagttaagaattattttttaacgcatgttatgggaaagttgaagttaattggagagaaagaaatttaacttgacaccattatatttcttcttccttctttccttccttgtctacattcaagtcacacaccacacaatgtagtgatctgggaactggccttggaataacacatcctgccgatgccatttttagctagagatctggggcaggtgatgttacccttctgagcactttccttagctccttgtaaagttgctatcaggaacaaatgaagttctatgtataagagtcctctgaacatttgcaaagtactgagcaaatgtacagtggtgaatataaattccctgagggcaggggccgtctctgatttaggcctcttcatattgccattaccaaacacagggccatttgttgactcaatgaggcaatcagccagtagacaactttatctcatcaatagcccagtttttattatgtgtccagtgtgtttcctgtctggagctttgatagtttttagagctagaagccaatgatatggttgagaaacatatcaattaggagatgtctgataattggccaaggaattgggccaagatgttattaattttcggcttccttcacttgactataagctcctccaggccaggggtcatgtctcattcatctttctatctcttagtgactgaggtttagcacaatgctttgcacttctcagtgagccggcagtgcttctggatggaatgttcagtggccctgggccgtccttttactgccatcccagacccattgccactccctgttctgaattgagatctgaacttcagcaggtttgtggacttgctcttcttccactctaggaatgccctttcaggtaccaacactgcaagatggacccttctacattctgcagtgagttcattgcataatctctattgcccactttagagcgcagacatccttctaacttctgcagatgtcattgaagttgtttttttttttaattatatggctgaatcatttatacatgtgtggtgaccacatctcatcttctagtgcaagctgctctggatagccatcttgggcatggctggctcagagaagtgagtggtcctaacgttgaatagagaaaggaaggagccacattggcagtacagttgtaaatcagagcctgaaggtgcaggtggttttgggaaatgagagttttctgaacctagaggcaagaagaaatatgtcatagaggaagttaatatttcattagtgtgtttttagtgttcatgtgacatggattgcaaaggaggaaactactgagtctgtagatgttgattagttacttgttccagtgttaatatatttcctgttgctgtagagcccgtgtagacaggcatttagacttgatcacacattcagaaggttcacagttggtctactacagtgctcttctgcctaaacaccaccagattctccctagccctccttccaaatcctggctccctcttctgtttccagtctcagctgagattttacatcctcagggaagccttctttgatatcccccagagaatatagagttggcctcccatatccgtgggttctggatccatggattcaaccaaagtcaaatggaaaatatcagaaaaaaaatgtgtctgtgctttatatgagcagaattttttcttctcattattccctagacaatagagtatagaatctatttacacagcacttacattttattaggtattataagtaatctggagatgatttaaagtatacaggaggatatgcataggttatatgcaaatactaagccattttatatcacggtcttgagcatccatagattttggtatctgaggggatcctggaactaatctcccatgatactgaaggatgactgtatctggcttggtgctccagagccccctgcacctccccttagtgactttccccacactgagcaccatttatggccattacctttttactcaaggtcccttgaggcctgagtgtgcccacttgctccccactgtattcccagtgccttgcagggggagttgcttcacaaatactgatcggattgctgttcaatgaaatctccgtgaagcccatgatattaatcacatctttcactaaggtaggtttcaaatttttgtttgtccttgtaatttttttgttttaatttttaaaatttggaatttagcctgggtgcagtggcttgtgcccataaacctagcactttgggaggccaaggcagaaggatcacttcagcctgggaggtcaacaccaccctgaacaacatagggagaccctgtctctacaacaaaacaaaataaaacaaataggtgtggtggcacatgcctgtagtcccagctacttgggaggctgaggtgagaggattgctggggcccaggaggtggaggctgaagtgagcagtgattgtgccaccgcactgcagcttgggtgacggagggagaccctgtctcaataaataaatgaataaaaataaaaattggaattttactaaggagcaaatttctgctttaaattcatttcatataataccctgggtcattgtctgaaggaagaaggatcaggttgatttccagaatgcccaaatcactccttaagtttctgaaccaattgagaagcagttgtctttcccagattcttttcattgtggctggcagtggtttccaacctttgctgcacattagaattgtgtaggcatcttttaaaaatccccatgcccaggtcagctttaagccaatgaaatcagatatttggggacgagagcatattttgagggtcctaggtgatcctaatgtgcagcaaagttaaggaatacaggagtatggactattttttcgagagggtggtatgccaggtatatagcccctaagaagtaaaaattttgcttattttcctgaaatctagagaaacaaaacttaaataaatacttttggagaacacattctacattctattttaatgaaaaaatttccaggcatatcaaaaacaatgttattcacaaaaaacaatgtaagttaaacgaaatacaaatgggcttctacagtatatttcaaagtatgtgctttggatttggattctgattttacagttcgccagctgtgttacctcgaatagggaacattatacctctctgaaacatgcaaaattagggatgaaaacacctaccatggaggggtgttacaaagattagaaagaatgtccttggaggatctagtacttaatgttggctccatttctccttctctttcctgcacgttttgagttaatgcattcagctttctttcctaaacctgtcaccacagacaagcctgctacaaggatccctgaagtttagagagattgacttccccaagtactttctcagttaccaaggataattcattcaacgggtttctacactcattttcttgtgaaggaagaaacatgagtgggaagggaggaagttaggagttggacctgagtatcctgtatacaggagtgtctgaaagtgcactgttgtgatccatccatcttttaggaagagttggatgatgattttctggctctgtagtgactcatgagccacacagggaaggcaggtttttattcattcagtcatttgagcaacagctacatgccagaccgagaagtgttaagagtgtcagaccactctaaagaaccaggggtcctcaagtaaaaaggctaattccatggtttgggcagggaaggtacaaattaagcctggagcactttgttgtaccagaaagtatacaaacatgatcagtgatgtcaagaagacagagagaaaccagcttgaaggtcttctgctggccaaatctgggacactttgagtgatggaatagataaggacagcaatggattataaggcattgaataaaatatgaagccacaagtctattcggtgacaggtaggtaagtacgtagatagatagatagacagatagatagacagacagatagatagatagatagatagatagatagatagatagatagataatgtgaaggaaaggaaagggctcttccttaacagtgtaatgccaactgacatatgtgacatgtgatatatgtggaggaagtagtgaatttgtaaagtcatcattttgcaaccctagaattgttgggcaaaaatcatcaatggatgttaaatctagagagagaggggttgataaggaacaggatatttgtatgggtttaaagtatctccccacatattgcttattggctaagactgggcaaatggtaactatacagtggaaaaaatggacaacatctcagccagatgatcaggttaatatcatgaatgagaagcagatggacatcacaaggcatccaggtgtccagatgcaggtacgtgatgcactgggaagggcacagcatcatttgtgtagtattctgaccaacactgcgtaacccgaatttaatcaggaggaaatatcaagcaaactgagtgaagaacattccacataataactgtcctgtatttgtcataggccaatgtcatgaaaagcaaaggctgaggaactgttctaagttaaaggagactaaagagacatggtcactaaatgcaatgggtaaccctggactgggttttgtgctggagggtagaaaaaacaaatgctctgaagtacattattgaaacaattgaaaaaactgggatatggcctctggattagatatatataaatattatacacatatatttaaaaatacatactgaaatattaaggggcaaagggatatggtatatgcaacttattcatctgtagttcagaaaaaataaatacacacacagaatgatacagctgtgctgaaatgttgaaattcacaagtctgggtagataaaggatatataggagttgtctggattactctggcgttgtctggattgttctctaagtttgaaataatttcaaagtaaaaggttttttaagtattggagtacagtaaataaatggagcccggctgtctgccaccacttagctgtcttactttggacaagtcactgagcctttctaaccctcagtttccttgcctttcaagtggggataacataatatcagttctttttgcattatagggttgtgtgcatgacaggtattctaactgcaaagatgtgtagacatagctgtgacattttcatctaaacccttccatacctccagggctttgtatggatcataaggctttgttcccttctatgtattagacacttgtgtttataaaccatgaggagatgatactactactaccagtaccattaataataacatcttggctagccttaaaaagtaataatcatatctgacacttacatagtactccagcttgaatagtactcatgagcctccgggtgccagacactgttctaagtactttacatgcgttatctcatttaacccttacaaaattatctccattttacagaggaggaaaccgtggcaagaaggggaggcagagtgaagattcaaattcaggcattctactctcagtttatgctctcagccagagccctccagtgaaacctttttctcctgtgcccagcaccctgcctggcacggtctggtgcagacctgataaatgtctatagaatgaatggtgggaaagagtgtttagaaagtgtaagggctctgcaactaaaaggacctgacctagaatcttcactctttcttcagtctctacattcagcttttctgagccttggttcccatgtttgataaaaacaatcctggcagagaagaggtatttaacaaatggtcatgattcttctccttctcctttgtctttttgttcttatctttccttctgaacatttccttgtgtataatgttaatactacttttaaccaggtgtttctcctctttagtgtctattatgatttttatgtaccatttttttttcatatttgtgatgacttattttacttaagtgcctccacttagattttcttaagggcaagagccacgccattttcatctttgtgtccttattgctctgtatgatgcatggccttaggagtagggccattgctagcccgtctctcactttggtgaaatttagaaaaaggcggttccttttagaaaaagctttgcagggaggagagctgtgcagcagataccagtatgtgaagaaaagacaccctgtccttggagggttacatttctcttttaggaggcacagcttggcaacgaagctatattctacctcctactcttccccaccgctgggcattttgtgtaatctgcaaaataaatgataaagttggcttggcatggtggcttatgcctgtaattccagcagattgggaagctgaggccagaagatcatatgagcccaggagttcgagagcagcctgggcaatacagtgagactctatctctacaaaaaataataaaattagccaggcatggtggagcgtgacgattgtcccagctactcaggaggctgaagtgggaggatcacttgagcccaggaggtagagactgcagcaagctgtgattacaccaccgctgcactccagcctgagcaacagagcaaaaccctgtctttaaaaaaaaaaaaaaaaaaaaaaaagattaagtgcagcagccatgcctatgagctactcaggacatattgaatgaatgaataggtacacagatgacacctccttcctggattcctttatcttttcaaacttcagactcccattgtgccacaactcactcagcctgagagatgatcccaaggctgcttgttgaactgtgggaatggttgctcctctgtagcaatccttgagtgaagcccaagggaaggctaaacctcagcccaggcaccgacacccaaactcaaattacccttcccaggttagagcaattggtctcagcttggatacagctcagggcaagcccctgtgcttcacagccttgctctttaggaagtccgtagaggaacccagctccactggtccctcaccagtgtggtctccaagtccttcctggagagccattctccccaggcccaggaagggaaaaaagctcatctggtaactgctggcattagcagagcagataccgggtgagagctctgtctctgcaggctggaggtggagccatgtggttaactgctccccgccaccaagctggctggtcacatttgcagagagaaccttgactttgtcatttgattataggtagaggcattcctaattttcacttgtgatttattattgttcttttcccattaaaataattttcttctaagatgcaaagtactaagtatttgttatagaaaagttatgataatgcaaacaaaaagaaaagagagaaaccaataatacagctcagacataatcactgtaaataccagagtttattctttcgtctctgtcttttctgcacacaggcacacacacatacacacacatacacaacatagcatcaccttcatttactcattgcattttggagacttcattcattgcttggaaatttagagattatattgatttgtgaaagcagttgaatgatctaggaatataaagtattattagcatgttgggaatggaggtgagattataccttaaattccacagatatatgcttctagtctctcatgcctgaaataaacttgctggaatgtgagtcttttatgccaagcatttgatacacaaagaacctacttcccaggagattggctaaaccaagcacgttgtgttcatctttatgatgaaatacagatttcccattaaaaggaaaatctcttcctttcagaaggttgaaaaagatgacacttcacaaaaaaaggaagaagaaaaaaaagaatcccagctggttaaatttagggtgcggaaagagatccaatcggcagataatccctggccatgggcccacagcattttcatttgattgtgcattggatacattttcattcattttaagcccttgcctttcagtattttgttccttggagacaggcaaactagtatcaatagctctcttagcctatgtcaaatggtttgatttacttaagtggtctatttcgttattccagtaaggaggaacttgtatttgttgatgcatttctgagaatgattgtgcaaagaaatgctgaaattctaatcatttttcttctatcctctcagtggtctccttgttttaaatggaaagatgttggataaaattgtgagtgtggttcatgggatgagggtgctctggatgcagagtcaggagacctggcttctcacccagctctgacactgacatcatggatacatccttggccaaatctcctaattgccttgggccttaatttccttgtctgaaaagttgggataatcatctcttctctgcttttcccacaggggtgttataaggataaaatgacctaattcagtgtctctcaacctctcttgcatattaaaattacctggggaagtgttaaaaaaataccttttgtcaggccccacccagaccagttagaatccagggtgacctgggctttggtaattttttatatcccaggagattatattgtggaagaagggttgaaaatcatcgaacatccaggcgataatatattggaaggcctgagaatgcaaattatgggaaaaggttaaaacgacccacattagtatggtcctctgtagttttcaaacggtgtcacttggagacttgttaagggtctataaggcagtggacttaaaacttttttgactgttaaactaaaaaagatcatatctcggtatacacatgcaataacatgtaaatacactcagtcccatgtaaatacagctttcacggaacaatattttctgtgtgtgattcactctaatattttttattattttccatttcattgcagtttaaactagtccatttcatttctttcattttatgtgggtgcagagccatggaattgatttaatgatctgttgtacagtcccctgacctatagtttgaaaaacactgatgaagagatggcctatttctggggagcaggctcacccattgtttaatgttgtttccttctagtaccagaatcagtctactgttgcctggatcgactttcccactctccctcccttttatacctttacttgctacatcaaacatacccagcagggttgtcctggttctacacttatttggcccttaattgggtgacttagagccttgccttctcttctgcattctaatctctgaagtgatagatcttaaacattatactttattcctcacatgagatttgttaaacaaattcaagacatattgtcaattgaattacatatagtttactaaatagattcttagcaaaaatacaagaaggtgcagttcataggttgctctagctgcaacatggtgctagtgataattttagtccctctactttggagaactggggagcccccaggccagatcatagaggaatcatctccctcttgttctgccggatcttttcttccatgcttcctggtcctcctaggcaattgtgctatcagaagtaagtttgtttcagctacagagaattctcagcttctctcctgcactcattaaagtttggctgtcatagcccagacacatcctctgtgacatttctttatccctggcttggtactgcttctgttggctggtgtgtggctctgggcaggtgcttgaggctcatagttctctctcaggacacacacactataatattcaacctaatcaaatagctattggttcctcctctctgctttactgccaaggggactagaaggtttgggtataaatttgggcaggaagagaacatcttccagatataactatctctgaaaacctcccccagcgtttttccccaatgtctgtttaaccagttttgtgtctgcttaatttatgctatattgcctctaactttgtttgacagtggcacagaatcgaatgtattcaagttaaaaaaatgtttttgtggtgtacaacatatgttttgatatataggtacagtgtggaatggctaaatcaattttcaacatatactaattgagcatatacctcaacttttgtttttgtcatgtaatttttaaggcaatctttgaagaaagatataatttccactatataaaggaagtaacagaggctcagaggggtgagatgatttatatgactattaagggtcagaggtaggatttgaattcaggtatttagattctaaatcatggcctctttcttctacatccaggctctgtatatctgtgacaggcacaggtcatccttgcttcctcaaggcatgttggatccaagacagaaaaactggtacaaaggatatcctaatgccagacgtgatcttgtcaagggttgaggtggtggataccaccacatgcctggctcctaacggagggagtaaggcttcaccagacctctgacccttctgaagccatacctttcacagtcaggtttgcctgaagctaccatgattcaccagcataccaaatccttcctgccagtggaggctacattaggctgggaaaggaatcttgtgaaaaaatagatctacttctcctgacccgtgttctccaggggattcagggagtcctctctcagactgctgtctcggttccacggtgattggcgtcctgagtaaatactctgatagactaaacacacgttgcccatgttggcccaggagcagcagtccgggagcgcgcccagtacagtcccctgtatggcagcccaacttgttaatcatcgcactggcaggctagccagaatggggatatttagcttggggcttatgcattaccatctatgctaatatggcattcttagaactataatttccgttctgacctccatggatactccttatagagaacacagacataaaacaattcttgaaatgtcaggaagaaattgcatctaatggagggtacctctgccaaggaaaacatacttcagtgttaaagcattcccatccaaacagggaaatttgaaaactgctcttgggtctgcattgaagcctgagcatttttccatgccctttaataacctgtaatgtatgtaccagccagctccactgcaggctccccatcaaccaagagggcttactgtgaaggaggtggggtggccggcgggaggtgatagctgagacctgtgtgagctggtgtcagctagaagaccttcctgggggctaaagcaagaagatttataatgggaacatataccacatgacataatgtcctacctgcatctgttacagtggagaatatgatccccagttgggtcttgaacccttggccctcctgatacctgataccaatgaagcctatcctccaccctttaggatttcatattaggagacacacaatctgtcttctgaaatcatgctggtgaacagataccacttagtaataataatattatgttgctaatagttgctgtcattatgagtgtttataatatgccaggaataaatactttacctaaattatctcatttttaccctgtcagtaacactgcattgggtactgctgttttctccactttacagagaaaactgccgcacagaatcgttagatcacttggccaaggtcacacaggtagtaagttactgacgtggaatttaaaattgatttagccagtccacactgttctagacctgtgcaagttgatcccctgagataataaaacaaacaaacaatgaaaagaaattatcttatcctctacacatttctattttatgtagatgttttacaatagatactataatagtacagaacttcatgtatgtaagttctgaataaataaatatacatatataatagaggtttgtggtccaattttttttttttttttactgatttacaaacatttggagattgctatacttaactataaagttcaatggaaagaagagagtttcttttcctgataactgatattgataatattatgggaaatctgatacttccagagggtataagccagatatttttgtctcatttgctcaccaccatattcccagtaccaaccctaatgcctagtagatgttcagtaaagaagatggccatgaagtttggaaaccagtgaacatacataatgctgactgaatgtttgtgtccactctctgctgccacggattcttatattgaaaccctaacccccaatatgatggtattaggagatggggcctttggaaggtgattaggtcatgaggacaaagcccttctgaattggattagtgtccttataaaagaaggcccagaaagctcccttattctttctgccatgagatttacagcaaaaagaaagccctgtatgaaccaggaagcgaggccttactggactctgaatctgcctctgctggtgccttgatcttagacttcccaggctccaaaactgtgagatttaagtttctgttgtgtataagccacacggtctatgatattctgttatgccagcctgaactaagacacacagtaaatttttcattgctatgacattataactcatgatatgttctgtgacattgtacaatatgcttaatgagctaccctacatgtgctccagtgtgctgtgcagaactgcagtgagccaggtgtactttcctcaagccccgctcaggcatctgaaccattccatataaagaaggcaggagtgagtgcttgcacagaaaggggttagggcaagtcggggacatggaaaagaaaaaaggaaaggctaaaatagacgaaatcaggtccgaattcaatttcatcaggtgatttttcctgattacctattgctccttaccttcttaccaatgactttcttttttcccactccattccccaccccccagagaaggaaaggtttttgcctgagtggaggtaatggggtaagcttccattaaggtggaagatttgagcctggcttgggataggcaggagaacagccacatttgaataatgtttctgtagaaacctgaacttatttcattctgtgagatagcctggttttctgcccattttgtgaattaagaaacagaggcttagagtgttccagcagctttcccaagcttacctggagggtttcctttttacgggtgctattttctttctgcttcactcctccaggagctggcccacattcacagaatgtgtctggaaagtgccataattcctccaggtgcaaagggcttagtaatttactccttcagtctcctgcttgattgtctcaaaattgaaaaggtttcatgccattttcagacatgcttaagtttctcaaagggggtagcccgggaacttgagacttcagtagtttttccttcttgaatgcccctgtccagccagtgccctaacttgtacaaatcaaggaaaatggtttgtgtggggtggaggtggggtgaatgttttcatttttcattagacgacattcgtaaacatacttgtgttttctgggttggtccagttgtcttgaccttcgttttgtaagtatcttgaagattcctttctcatccaaatctgttagaatcaccgcagtttccaaagttggctaaacatcagaatcacctgaggtgcttgttaaacacagggaatgtcctgatagcctctggagattctgattaagtggaccagttaccagaaagcagccccaatccaggccccatgagaggattcttggatcttgcgcaagacagaattcgaggcaagtccacagattaaagtgaaagcaagtttattaggaaattaaaggaataaaagaatgaccactccataggcagagcagccccagggctgctgtttggctgtttttaacggttatttcttgatcatatgatatattaggggtggattattcatgagttttctgggaattcttcctttcagaccatatagggtaacttccagatgttgccatggcatttgtaaactgctgtggtgctggtgggagtttaagtatggtaatgcattataattcacatataatgaccagtgaggacgaccagaggtcactttcatcgccatcttggttttggctgccttctttactgcatcctgttttagtagcagggtttttgtgacctgtattttgtgccaacctccaatgtcatcctgtgactctgaatgcttaacctcctgggaatacagggcaggagctttcagcctcattttacccaatgcctattcaagatggagtcactctggttccaaggcctctgacagacctagggcaagttccccaaatgtttgtttttaacaagcaccacaggtgaatgcaagggcagccagatttgggagccagtgagctatcaaacacttttaaggggaatacatgagagattccctgcaagagttaaactattttgataccacagtgaagggagcagaaaatgacattgaaatttcatcaaagctatacacctacacaggtgagattaccactcatcatgggaaaggatgatgaaaatacaaccaaaaaccttcatcgaacaatactctttactacatttactagaaaatcctagcaaattcaaaaataacatgtgaaataaagccctgaacttttcatcctttaggagcaggaagttctctttggggattggctgaagtagaaggagctctgcaagagccagtaagtggttccttgtctgtggttgttagcaaaagaatgaccatggctcacctcagaggtcacagagaagggaggtaaagaggacagttaatttctttaccaggatctaatttatcatttgggttttcagagaatgtgggaggtggctgttgggcttgttttcttttgcagcaaagctttttagagcatgactatgaggcaggcattgttccaggcaccctacactgttgcaccaaagtcccttaagagctgacgttcttgtggtaaagacagataataagcaactaaatgaaatactaatacagatcatgtcagtcaatgaaagtgatatgaggaaaatagggtaaaagaggggggctggggagaactcgtctctgaggaggggacaactttgaacggaggcctggctggcacagcaggtgccatcaggagacctgagagagaatgatctctcacacagaggcaaagggaataggaatgtgtgtgggaggatttcccagggagccatgaagatgacgttctgggctccaccctttatgcctctccaggggcctaggaggggccttagctattttgcatttgtaatttctcttaaagacacccccccctcaccaccagcccacatgctgcccactctgcctacccacacctagttatagaagctttagaccccataaaacctggatctgcccctgagaaccagaagtacaaatatgctgaagtagggaacaagcttggtgtagtctaagagccttaagaaaaaagaaaattggtgtagacgagctgtgcttaagatggagtttaatagtagattcattcattcattggttcatttattaaatatcaatttactgagtgccaggcactactatgaaaaaaataaggtccctgtcctagtggagcatccattctagtaaagagaaacagaaaataaacaaatacctatataatgtcccaggtgacaatggttaaaaatgaaataggtcaaggggggatatagggttagggtacgatggggtggtaaagtgtagctgttttgtaagggatgggaaaggaagggctctcacagttctggtctgagctgagatctggaggaggtgagagagtgggccatatgggggaagaatactccaggtggtggaatagcaaatagaaaggcccccaaacaggaacatgctgggccttttcgaggaaggtcctagaaattgagaaaagcagaactaggtgatggaggacctaggtaaggaatttggatttcattctatgagctgtgggcagcctttggacagccagtgctctagaagtctagggaaggagagagcatgggacatcagaggcctcacagctgactttaagatgggcctggaagtatccagtgggcagagttcagcatagaaagaaggccagtggcagccactgcagggccccaggcatggagctaggaaaggtaacctgtctgagggcctttgacagaccagtgctgcctggagctggagttctctgagggagagtgctggggatgaggttgcaaaggtacctttgcctgaagcatggagagccttgaagccaggccaggggaatttgatatttactaatgtgaatacctgagtgccctgagaatagtggggactccaaaatttctgtctaggagcaatttaaggatagctctcaggtggagggtaggggtgatggaaggggtagaggatctgtcttagagctagcaagcaaaagattttacctaggttgtgtatttacttgagggtggttttgggaaagggcagtggtaaagttttgaggtcttgccctaaagctacactgcatagcaaacacactgtttttacttggatggtatcctatttggggttactaaggggatggggatcaatgaaaattatggggcattaatccttggctctgtcctgggagaatgaaaattacataatgaaaggtgtgatttagaaaggtggtcaagagtgagtgtggggaggcattcactcattcatccattcatccacttagcaattgtttatgaatactccaatgtgccaagtggcagaatggaacttgtatattcctgtgttcacactctgttcctaccacttactacttgtgtcatcttgggcagcttttatttaatctcttagaacctcagtttccttgtctatagaataataataccagcagtcccctcttatctgtgtgggatatgttccaagatgcccactggatgccaaaaaccatggataacactgagccctatatttactatgtttcctacacatgtgtacctatgacaacaataataactagtaagataggacaattatattaatataccgtaataaaagtcgtgtgaatacagtcatgatccctctctctcaaaagattgttatactgtaccacatgtaactgaaacagtagaaagtgaaactgtggataaagggggactgttgtaacatgcctaccctagtggtgcttgtgattagagagaatgtgcatacagtgtccaacccagtgcttggcacctagtaggtgctcaataaatggtggcgcctactgggttgcagtagatggagagtactgtaggcagaaagttgttactgtggcagcacagatttcccacagtaagggccttcattagggcaagggtgaggtttgtagggcaggagatagttttgagaggcttggaagaacatcttgaataggacttgggtcctgaaggataagatgataatgtgaagataatatgaaggtcttcagcagagaaaatgtggaactagatgcccaaacaagaaggaaaattgggaagaaagtagactggggaaggagtcacactttaggttgaatctggggcagcagccaagtggagagagtctctagatttggagaatacagtggtttgcaggagtgagacctgggctaagcagacacattgattttaatatcactgtgatggcatactagtcaggatacaaacttggttgctataacaaagactcccagataacagtgacatatgtaagagagatgtcagagtaatccatgcagggctttggatccttgtccttttgctccacttttactaattggtagccctcatttgaatgggccaaggtggcacgtcagtgtgcctacattccactcccagggagggggagatgggaaaaagtgagggcacacccagctcatttgagggcacaacctagatactgcaaacccaacttctcacattctgcaggccagacttggtcatatggtcacacctagctgcaagggaggctggacaatgtatactttattccaagaggcctgattcttagctacagttctattattttggaagagggaagaacagatattcaggacagctagcaatctctgccataagcagtgttaaataaagacctgagattggatgagaacatggagaaaaagagtgtgacagaagtatggtctgccctcagtatccatgggtttttgcatccatggattcaaccaacctgggatcaaaattattggaaaaaacattgtgtctgtacaggcatttttttcttgtcattacttcctaaacaatacagtataacagctatttacatgaaattaacattgtattatgtattataagtaacctggagatgacttaaagtatatgggagcgtgtgcataggtgatgtccaaatagtatgccattttatgtcagggacttgatcatccttggattttggtatctgttgggggtcctggaaccaatcccccaagataccaagggacgactgtaattagttggattccattatggcaatggagaaagacctaagaagttaacgaaaaacatggaagatagacaagtaggcaaaatgggatggtgtgggttgtgggatggagcagtggttagctgtgtctgatcctgcaaaatgcaagagaattccatttggtgattagtaacatattgggtggtgacaagcaaagtctggactgcagaggttaaggcatagacaattagaggcagtggacgtggattaggctagagaggtttggcaaacacaaggaccttggaaactccaagggccagccaggttacgtgaaattaagttcaaatgtctgaaggggtttacagatattaattttactttttttcctaattaggaagaagctttaaaaaaatcctcttaactacaaggacctaatccttttggggagtttgctaatataagcataaattttttctttggcagtttttttccccatctccctcagataaccttatctcaattttgaatcagaaatcttatttatagcttttctggagagaattatttcaaagggggcagattctttgccctttggacttattttctttttaagaacagataagttatccctcgtttttctcaggagagacagttaaattattaatttaaaaataatgattttgagctgaaagggggcgtaaatcaaagttggagaaataaatccagctgcttcctgtttttgtgtttcttttcttcttattcttcttcttttgaagggaaactaaaaatgccaaagtttcatttatcccccaggaccagaagagaacttagcacagctcacaatccttaatagacctggaatgaaactgggaatggcatggccttccaggatccttccttccaccctctagctttcccccaccaccgtagcagtttccatttttaccgttatcccaagtacattgccaagcaagtgtgactcaggggctctctcggctagaaggcctctgagcctagttttgaaggccatctgagtcctaggcctttgtgcgtgacccataattatctctgcaaagatgtgtccgttgagtacttatatgggaagagaaggcagaagggcagctgcagcactccctgcacctggtgactcgctctgctggcctcagcccatggggatgaggcccatgtaggtggtggtagttctggtgctcccagccctgttagagcatgtgcagtctggagatcagatgagatgggtttgaggcctctgagcttacacacacactggatgttaggaaaaggaactgtcacggatgtttcacaggcattgagtgggcaactagtctgagtcccacagtgagtccctgtctctgaatacatttcttctgtatcgctctagctgggtggctggtcctcctcagctgatcagtcccagcagagctcatttctaaagaggccagggagtcactgatcagcagagctcagccctcaggaagctgaagaggaaagtggatggaaccagtggccccaagagcaacaatcccagattcttacccaagccctggaagctaactcgtagggtcattgaggagtgagtgagttaacgcaggtgaagggcttgacatagtacatagcacattgtaagcatttaagaaacattggctgttatttattatcagctggacccaaggcagtggcccaaattcccttaattcccactaattcagtgtgtctgaggggtccttaatactggcattgatttactttgtgaatcactcacaaacattgtgatgccttgtggaaaatgcttgtggaaccaactctgttgagaaagacatttttaaaacttaagtttttaaatattttgaaagcaatagatgcctgtagtgaaagaattcgaacctgactgaagagtataaagaaataagtcttctcccacttttcccctaattctcagtcctatttcttaaacttcaaaatggttacttggatatccttctgaaactttaatgtaatggagttgaaaacactaccttgcagatatgctaagaaaatgtagcatctattttattaattaactacttttccccaagtgctacctccttcctagttggggagggccaatagaagtgggtaatagagttgaatttaagccctggcatctggacttgacatcctctgcttcaggtctggctgggcgtcttgggctggtgtctgttaaggaagtctatggctggtgaacttgtaggcagttctcctggtagagattatatgcaatgacaaatgtagcaaacatctcctatcaccatcggctccttctgcattttcctgagaacagtggtagccttggagtaccttcctgcagcctgaatgtgctcaactgccagtgttactatgtcgttgtaatttcatgcaactgcaggatctttgggtatgggggtccctctgtcccccgaggaattcctagtgggaagtagggtacatgctccaagcagctttctcttaacaaacataactctgaccctcttcatctttctggaatttcattcccatgtgggagatgcgaatccatgatgccaacaagcaaacctcttctttttccttctcctgttgccccaacaacagaggatgaggacccccccttgcatcctattctcctcctgccctcattgtcccaccttccctgagggagtgggagagtggctgctgggaagggaatggaaagcacatgggttgcatatcttcaaaacatgatctccactgcatgaagtctgtcagtctgtctgtcagttgatctggccattcattcatctaacgtttgtctacatagtgttttgtaacttgctctttaaccaattgataaccctttttttgtttgttttttgttttttttttttttggagacagagtctcaccctgttgcccaggctggagtgcaatggtgcaatctcagctcactgcaacttccgcctccggggttcaaatgattctcctgcctcagcctcccgagtagctgggattataggctcatgccaccacacccagctaattttttgtatctttagtagagatggggtttcaccatgttggccaggctggtctcaaacttctgatctcataatctgcctgcctcggcctctcaaagtgctgggactacaggcatgagccactgcaccctgcctcaataactcttaatgacctttccattgcagcacttaccacaattcctcattctttctaacagctgtatagaattttgtcatatagctatatcaaattttatttactcattttcttactgacatgaattatttattattatgcaagtatgtctgaaaaatactttatgccctctgcctatgttttctttcctcttcctttgcaaatttccttacttgtcacctagtgtacaatcaatagtatgacagttaacttattcttttttgtgagtcccgcagatactctccatgcctcctgtatgcctgtaatcctttgcttaacaatttgacaacgagaacataggattatggtttcgggggaagaagcagcaataatggcagttaaattttcaattccccaggtgcatatgtcttccttaagtgcatactctgagtcccaagtgagaggagaacatatttagaaagaattgtaaattatttctctttgccaagaggaagggaaggagggtcaaattacgtggttgatcagttaggataaatcctgaatatggtagcttccacaatttaaagttttatcctcttacataaaagaggtctggatgtaggtggcagtccaatgctcatatagtggatctatgaaatcatatctttctgctacacctatgtccgtagtatgtagtttttacccttaggaccacaaaatagctgctggcactccatccatcacatcaacattccaggcagggaaaagtaaaagggtaaaggacaaatgaagcatgtgtcagctatctgtctgcctttttaggagctttcacagcatcccacataacacttctttttgcatctcactgaacagaacttggtcacatgcccacatctacctgtacctaggcacagtgccatcctgaataaaactagagatctgttagtaaagaataagggaagagttgtgtattagtctgttctcacactgctaataaagacatacccgagactcggtaatttataaaggaaagagatttaattgactcacagttcagcatggcttaggaggcctcaggaaacttacaatcatgactgaaggggaagcaaacatgtccttcttcacaagcagcaaggagaagaagaatgaacaaaagggggaaaagccccttataaaaccatcagatcttgtgagaactcactcactgtcatgagaagagcaggagggtaaccacccccatgattcaattacgtcccactaggtccctccaatgacacgtggggattaggggaacaagataagatttgggtggggacacagccaaaccatatcaagatgatactgggtagacagctagcagtaactgtctcttgtgatttgatccatggtttggatttctcctttcaccgagtgctgacatatgggtaatagttgctactcagagcagagatgtgcaatggcttcagttgatttcctcaccctcccccatcgtctgggtttcttcctccttccttctaaggatcttgcctcctgaatgatcagggaaccccagtgtagcatttggccataatgtagaagcatatcacatgtttaaagtttctttttctcaacctcttcttcaaaacttatctgttgtgtgcaccatctttgctgggcacagttagacagccggcttgctacccgaatcaacatgagctaaggagctaggattcactggcttcccattccagctccagttcccattgccctccttacccttccaagtccttaccctccagctgtgccaaatcccctgccttggattcttcatgtccttcaataagtccagacacttgcaccagcagccccttcaacctggagtgtcctcctcatcccttcacttcttctgcagcccattcccagcgttctctgctcattttaaatgacccattttgagcatcacctcccacgagaaggcctctctaatcccttagcatcactatccgcttttgatgtcacagagtcccccaaatgcactgctgtgacagcatgtatcacactgggtcatcagagttaacacacaagcccatttcccccaggtagaccctgcacttttccagggcaggacagtaaatttaccacacaacctcttacatctaaaagaaacgttgttactcattgttgaatgaaagagaatgaatgacaactttcagtacttagatctacagagagaataaaagaattttccctctggtggggagatcttttgggaacgggagaccttcccacagccgtgttgtgatgaaggtatctccttacttcgtcgaagcacgagcatgcttggaattgctgttatattaaagttcccaacagcagctctgtggtcaagaccgtcaagggagaaggtcttagtttgtgcagctgaagggactcatgagacatcatcagccacttgaataaaatgctgggctttctataatggtttatttttgaataggaacaggtccttggcactaatcctgtttgaatcctggagctctgtttagcagaaagatgagccggagacctcaggttacatttgttgctcaagtttgaccagacacttgtgtaagtgtgtgtcatgccggactttgcttaagtaattaacattcctgtcaaggctccttaaaagggtcctgtgttatagagcccctcaaaaggctgatttaaaactttgaactctcagcctttccattcattgccaattactgatatgcttaaatttcatttttctaaaaaaatacaaaaaggattaggtttttgaggagaaatgtttattattaggagaaccaaccttggaaagtaaggtgattttgaaagaagagagtaagtgtagaagtggtattagagaatgtgttgaggagggagtctgaaaatattttttaaattaggaaacaggagaattaacatgactatgacaacagctttcaaatgttttagggactgtcatgaggataagcaatttgatgtaccagagggctgaactagcattttcttttctttcttacctttcctttcttttttctttctctttttccctttccttcttccctccattcatcctttcctcctttttgacattccctctttttttttaaactccccttaagctcctttaatattataaggtctggaacaaaaaaacaacaaatactggcaaggatgtggaaaacggggaacccatacactgttggtggagatataaattagtacagccattatggaaaacagtatggagattcctcacaaaactaaaactagaacttccatatgatccaataatcctgttactgggtacatatccaaaggaaacaaaatcagtacattaaagagatgtctgcattcctatgtttattgctgcagtattcacagtagtcataatatggaatcaacctaagtgtccatcaatggatgaatgaataatgaaaatgtggtacatatacacaatggaatattactcagacgtaaatataatcaaatcttgtcatttgtggcaacatgggtgagcctggaggacattatattaagtagaatatgccaagcacagaaagacaaataccgcatgttctcactcatatgtggaagctaaaaaaagttgatctcttagaagcagagagtagaatcgtggttaccagaggctgggaagggtaggggagagtggagagggatatgaaattacagttaatggatatgaaattacggttagataggaggaataagttctagttttcgacagcacagtagggtgatcatagttaagaacagcttagtgtacatttcaaaataactagaagagagaaactgaatgttccaaacccaaataaatgacaaatgtttaagatgatggatattccaactaccctgatttgatcactatgcattgtgtacatatattgaaataggacatttatctcataaatatgtacaattattatgtgtcatttaaaaatttaaaaaataaaattacccagcactttgagaggcccaggcaggaggatccgttgagcccaggagttcaagaccagcctgggcaacatggcaaaaccccatgtctactaaaaatacaaaagttatctgggcatgttagggtgcatctatagtcccagctacttgggaggctgaggttcaaggattgcttgagcccaggaggcagaggttgctgtgagctgagattgcaccactggactccaccttgggtgacagagtgagactgtctcaaaaaataaatgaaataaaattatttttaaaaagattataaggtctgtaagaataggagatggatctaacttgttaacagagctcctcttgaataagtgaacgaagaaatgaatgttattacaatgtgccaagcactgagaatacggagatgaaagacataagctagaaaagaaaaatgacaaatggttcactgcaatctggagatgttaagtacctggagatgtaagtacagaactgctaagggagtgggagagggtaggtgtctgcccctaactgcagaaggaggagaagaggactgagaaaagcctccctggagttggtgatgatttaactgcatctcaaataatgatcagacatccatcagatgagggagcggggagagtgcctcaggcagggtcaaatgtgagcagagccgggagtggagagtgtcacgatggaggctgagctacctgtgggaaagtcaaaggtgggtctgatgggagatgatgctaggtgaggtcagtggggccacacagtgtatagcaagtgaaggaatgtgggttccatctggatgtgatgggatacacccgtggattttaagcaggaggccgactggtaactgcgtgaagggcacctctgaggggaaggagaaaattcaggagctgttcagtagaccaggcaagatggttctcaagaccaggtgaaggctggaacttggacatatagggtagagattggagaagaagggacagatatgagaagtattaggacttccttcttgttcgggttggttgactagatagacgatagtgcctggtgtacactagacagtgagtttctcagttatagatgacatctgttatctttacacccttaatctctatatcagtatctgatacctagtaaggtttgaactttaatactgttttcttaacaagtgctttaattaataaattatttcatgatagtaacttaatgtgccatatgtgacaaagagtgctattttttttctcctaatatctatttctcttttagaaaaataattctgggctgggcgcagtggctcatgcctttaatcccaacactttaggaggccgaggtgggtggatcacctgaggtcgggagtttgataccagcctgaccaacatggtgaaaccccatctctactaaaaaatacaaaaattagccaggcatggtggtgcacacctgtaatcccagctacttgggaggctgaggcaagagaatcgcttgaacctgggaggtggaagttgcagtgagcccatatcctgccaatgcactccagcctgggtgacagagcaagactctgtctcaaaaaaacaaaacaaaacaaaaaaaaaaacaaaacaaaaagaaaggaagaaaaaaaagaattctgatttgtagatgagtactttgctttccagtgtaagaaaagctacatttcccaggctcctttacggataggtgtggtcatatgactaagtcctcaccaagaagatccaagtagaagtgttttctggaaccccaagaaagactcctaaaaggtgaagaggaagaaccttcagcccctccccgctgctctcctctccatccttcctgctgtctagaatgcagacgcactgcctggggtaccagcatccgtctttctaaggatggcagagcagtaagatagaagaaatctggccttttctgaccgtgaagctactgtatcagtcttatatttttttgagcaaaagacacacttccatttatactacttactttaattttaactttttggatacatgtagctgagcctagtcctaactgggacacttaggaagtgttcaggtatgtaatctcttttgactttaacagctactctgtaagatatgatcatccttatttgacaagtgaggaaactgagattcagaggtattatttgatttctttaggggcatatagccacctaagtcttctgacagagttcacagctctttgctaccagatcccacttcccttagcaggcacacagcaaatgcttattaaatggaattcgcccaaactgcactgtgtttctatacctgctttgggttgggtttcatagcaagagttcagtgtcttgttggcttccctgggataaataaaatcaattctatcctctttcttcatacatatacctacatatgtatatgtgtgtttatataaaaactgacatagcagtctgaattcaacttacccattccaccaattcttcatcaaatatttatacaaatcttattgtatgtctagaactgtgccaggagtagtgaaaacaaaaataaacaaaaataaataaatcacattcccttccccactcggagcttacagttgatcttcgagggttctgacgaatttatttcccttcctaattctgaggtgatagtagattaatatgccactttatcagtttgtatgaaattagttgggcttttcaaagaaagcccataccctcagcagtggggcagttttgatggcacaccatgtgctgatattaacacgtggtggtctgatttaagttgtgattcttggtttctggatgtgtgctgtcacatttcacctactgtgtctgagcacctggttatgtgggccagaggcatgacctgaagcttcagcaactttttgagaactgaggatgagtttctaagctgggccttaagatgcttcgcagttgaaaacctaggcaagggatgtgctaagagtttgcttaggtgtgaagtctgtgttcaactttccttatggccttatctctcaacaggtacaaggaaataaaaagaaagttctagtattatgattgtttgttgaacacttttaaatatggcatgcactttacatactatcatttcattctaagaactccatgaagtatcatcatctgtattttacagatgaaaaaactgagattcagagaagttaagaaatttgcccaacgttaacacagctggtaaatggcagagctcaaatccagctctatatgactccaaagctccacactaaactggcccgccttctttggttactttagatgtgtgtatttacaatccatcctcattgaggctggaccagaagagtgagaccaccttgcttctcggcacttgctcatggcaaaagttgccagtactaactggttactacgatgaagagtgttgtcgttggaaactttagtaatagtgtttctgcatttaacatctccccagacattacatttgcttaggaaaaaaaccaacttgttaaacctgtcttagcaaactgaccacaatttgtaatattttctttaaaggaagaaaaattaaaccctgagtttccaaaatcccataaagacagtggaagggctctttccaccagggacttgcgtagttgcatgttgttgcctccgagaattgaaagtgtttaaagcattattttattctattgtgctgttatcacctcaatcagtataattctacacttttatttcctggtctagggactcagttttgatgagatttattgctttaaagaggatagcccttttttggagactatttagtttcagattagttgacaaagtaacgaacaagcttggggtgatcttgaactaaataaacgtcatgggaggcagtggtgctatcaatgaataccgcaaggactgtggagtcaggtaaacctggctcctctattcactaactgtgtgatcttatacaagtcactaaacctctctaagcctcagtttattcccctttaaagtggggataggactgttactgatagtaaccccttgtaggattgttatgaggattaaatccgatgttagagcttgggtgtagtgcctgacacagggcaaatgctgaacacctgccactcatggttcgttatcattcttatctttatgttctatcatgtaatttcgccaatgtggttaaaaccagttagttccctcggaagttgtcaaacaaggagacaggcataatatgctcagcaattggagatgccgctctcttggttcagttactcagagctgtcaaagcgacagtcggaatccccttcctggagtgttggctgtgcctcctgggtctcccgcgtggattcctcacagatggcagggcacatcccagctcggcatgtcgacatagtcaccaccatggcttttaatgagaaccattcattgtagatggacgcttttgagttttgtacagagataaacagatggcaaggtttgtataatttcctgctgggtaatctggtactagaagtatgatctatctggaaactacaaagtgttacctagtctaaggtgagtttttacaacagaagttaaggaaaggctgaatgggtctcttatggaattatgcccaaatgttttaccctcaactctcattcaggctgttaagtacagttctgtcccatctcaactaagcagtcttaacttagagcttcctgtttctttgttttgtctttttgtaattactttttctgtttgtttggctgcctctgaaaatactgtttcagggcagtcaagttttagctttcctttcaactgagggaactggcattgcatatggtgaggctcatcttctttactggaaaatgaccaagcattgaaccaatcgcttgaaaagctcttacttcagatcaatttcctgtaccaaatgatatcaccttactaggaggccttcactcttgtttttcaatgacccttatttcctctgcttatatgcttgcattctactttggttaggtgctgcctcatcagactggactcttaaactcaatcaaatttagttatttgagcccaccaggtttgggattttctaaaattagttcttaaggggacttgatatgatttaggagaagctcaaatgaaaggaattactgtaagtaaaagatttagaatggtgcttggcacataataagcactcaataaatgctagcaattgtggtggttgttattattccatcattttatgcaacttgttggatagattctgtatccaattgtgggaataagtataagaatttttcattccttctggagaaatgacatcatgagaacccagactgagaaaaaacattcctgcatacaaggtgaagggtgacatattaaagatactatcctataacataaaaaaaatacacagtttcctttactggctcctcttacttttttaaatttggaaatggattctcgctatgatgctcaggctggcctttgaactcctaggctccatcgatcctcctgcctcagtctcctgagtagctgggactacaggtgcatgccaccacccctggcctccactcatcttaggagttctcctcctctatccctaccaccatcatcaaccctgttgggttcacctctatttccagcatcgaatacagtacctggcatttagaagatgttccgttggcactgaactgctctaaagtgacctgccccagtcctaattctgccatgtactatttgtgtgactttatcactaaagtcagtgataaaatcagagtttgccctcagggccccagcttcctcaatcatagaattggagggggagcttggactctaggatctcctgagttcctcctggctctgaaacttgatgtcaccttggggcatttgggtttctgttgactggtggtgtgctggaacactttatgcataaacattcatgtgaggatgaagtatagttttacacatgttttttatcctggaaagtgaaattagtttgggaagttcttcttacaatagatacacaaattccttcttacattttgtttcctttaaggcctatggaaactggtggggttgtctgtgtgcatatgcctgtgcatacttctgcatctgtttataatttacagatagatggtaagaattttttctgtcagatccaagaatgttaaatagttgtatccgaagctagtcatccacttttaggaatatgttctagcgaaatagcctggaatgtagataacgatttatggataaagtgactataacaattttatttacagtactgacaagcagaatacaaaataaaatgctcagcaataggagaatgattatataaacttgataagaatatttatactaaagagccatatacaaagatattttgttccacctcagctatttagaacagtagatataaaaagtagaggaaataaccccaaatgataatggttattactggatagtggatcatgaaatatttttattctcttattaacacttctctttctgttttttttttacaatgagtattatttttcgtatgagaaaaattatatttaaaagttcaaacctcatctgaaatatagacaatcctggtaataaacaccaaaaatgtcaatgcaggtttcttcactgcgtgggaaataccttgacagaaaacagtgagatggatcaaactattctgcccccgagtttattgtatacacccactagtttcatgcttggcatcaggaccttctttgaaaggtcctaactatagcatctgttggactgtctggctgggctccatgtccatggcactgcggttaaaggcggaaagagaaggtcaccctgtaaacttttctgccaatgaccacagcagcacagccagcatatgtctaaatgtgcaggaatttgttcaacacagagttcaatgtttatagaagggagtgcagacccaggaaataataaaatgaatgaatttaatttcccactaagtgttttgtgatggagagcattaaataggagcttccttggaatgctattaatgcagcaaaccctcagtatcactttactccaaatcctggattctctaagcctgcaggggggtgtgggagaagaaatcctatctgaaatcatccagactactgtagttatgccagtttctgattgtgtgaccttggacagtttactcattcactcacaaaatatttactgagttgctgctttttgtgccaggtgctgggaataaaagaatgaagaagatggaagacttgctgtcataaagattaatgcccattggggttggaaggagatgcagacaagatatttcacttcgttgcaactcttgttttctttgtcttttccttgaattctttggttcttcccagtttggtctcaggccttctctcacattgtgcaatctcacttgagagtttcaggctctcctgtccttgcagatactgcttactgaggaaggattggccatctataagtctaggctggggtgccctcctgagctatggactcatagcactggtagtcagctggatagttccccttggcagtctaacaactgtgtataagttggcttgttcaaaactgagtttggtgtcatctccacttctcttccctgcaaactggcttctcctgtgtttcctgtccccatgaatggccccattgtccatccagtgtccgagccagaaatctccgctcttccatgtgttttccacccctccatgtgtgatgaaccgtccagttctgtggattccccctcccgtgttgatctcattcatttcagtccccttctttttaatctaaccactacctctcttgaggtttccctgccacctgtctttctccctttcacattccagacagatgaatctgtctccttgtaactctgatcacatgactcctctgcacagtgcctcctgcctggctgcccactgccctttctctttaatatggcactcctgagttctccagtctaattacctgcccactttttcctcaaatcttaagactttagtcataaatcattactttcttttatccatatcatactcattttaccttatgacctttatatcttcatgcatgctgttacctctgtttagaatgttctctcccttgcgtcttcctcccccactccttccctcatttatctgaaccaccccatttcattctttagatattgaatcagacactacttcctccaggaaatctttatcgaattcccaagtctaggttggacacctctacttcctgttgccatagaccctgtacctcctccatcatcaccattaagacactgcttggtctccttgctatcaccagaagaccatgggcttggtgagggcagaggccaccactttttgtgtttctagaatctagcccagtaatatgtaattgtaggtacttaataaatattgattaaaagataaatttttgtttctccggatgacattagtctggacataaaagtaaggttacacagtaataataataacacaccaattgttttgttctcttggtccttccttggaccaaactctggttataactcttgcttcctttaggaagctcttcaacctctctggcaaactcacattgtgtagttcatgccactgaaccctaagatcaaccgcacttaaaaaaatacattggtataaaaggaatcatacatgggctgctgtctaagattctgattagaaaggagaaaaatgcctaagtaagaataatagttaacattcactgacagcgtcttctgccaggcgccttctaactactttacatgaattattttgatcctcccaacaacgctatgagcaaagtataattatttccattgtacagatgagaaagctgagatccagagaagttaagcaaccagcttcagggcacagagcagaagtggtggaaccaatgcaggcagtctgattccatggtcaccacccttgctgcctccctctatgaactctaaaaaatctttagctctaaccttctatgtttctctggttgtcaaaagcaaaagcgagcctggctaataaggcatttgcaattgcagggcttcctctcactcagacagtatccctggttgctggaggacccagccagtacagatgggggtcagtcccctctaagccctctgtgatcacatccttatttcctagatagatgttcatgctgttcatgagagacagtatagcacagtggctaaaaagtggactctgaattctgactacctgagagcaaaccacaaccctttcactcattaggtatatgaccttgggcaaattatttaaaccccttaggcctcactttcctcatttatacaaggaggatattaataatattacttaacccataagctattataaggattaaaggagttaatatatgtgtaacacacttagaacaaggcttggcccacaataagcactaagtgtgcttagtccactttttgattagtatttttgtaattaaaataatcttgttaatatttactcaagctggtcttagagtgctttgattaagtaccaggttagctcaactactgattgagctgtagatatctggtagatacctaccagttctttcatctcattatgggctttaatatatatatgtattactcagaaagataaaaataaatcatctgcaaaaccccacttgaaaggttttcataaatcttgtaaaagttgggccaagtttaaagattgctgcccagattggtttaaagcccttcattgtctacaatctaatggggatgcttataaagggaggatctggaatggtctgtctggcagtgtgtgtggtcaccggaatcacggccttttatctacctgatgggtatgagtaggaggagttggctcaggctccaggaaagtcagcagatgataaagcccttgtcctcggtcttgctcatgccagcagttggagagcagtatattgtgtgttatcaggttctcagaccctagcctggcattcatgggctattctccagccttgatcaaacccacctttccactgtataccgttccacacttaccctttcttttgcttagaattttctcaccctatctgagtaagacctaatcctaaagaggcccagattaaaagccatttcattcctgaagttttttcttagcactctactggctgtgttcttttcctttgcactatgcctacgtctcatgcctgttttccctttctatatttgttgtgcttataggaatttgccatctaacctgggctctcaaatacttaaagttttcacatccatccttttatttagaccttaaaacagccccatgaggaatgtagcattttcatcctcacttttccgatgaggaacccagggctcagagaggttacgtgatttgcctaaaacacaaagttttaggcaaagttaagtcagactccaactttggtgcattttttctctgccccaggctccctccttgaagtcttatgtcatgtcttgctcaagtttgtatctccctgcagtgcctagcacagctttaggctcagtaaggtttttttatttatttattcaacttacatttattgtatctatgaggtgttagttaggtcttgggtactagcattaagcaaacatagatatttgtggaagaaaagaaggaaagaagggatgtggacatttttgttttacttagtaaggtgggtggcatacgattcataagctcaaatcccaaccagggcaggtaaaaatgagttaagaaggttgggcatgacccactgaaaagtaatggggactcttgctaactggacatcaatactgtctaatggaagcgaccacaacttaattccagttaatcattgccatgttggaatatgggcctagtgttttgagattttccattttttcaagaaaagctggaagtccagacttactatacagtttctttatagtcaatgttgccaactaatttgtttttattttttaattgaacagctaaacaatacatggctcatggttaccactaacctccttgaaatgctgaggattgagccaaccatgcagccagtggtgcccacgcttctgaggcagggagccagtgctcaggaagggcaggctgctgcttctctccttctccttgttagcccccatgtgggtctcacccacctgcaggcctgtcttggctttgcagcaatactccacctctttgcccctgccctcctagcttgtctcccgttctttccctgctgtcaggggtggtgactgccctgtctccttcgcagagatcctcgacactggatctcaccctctaatttagctccttgtctttattgcgatgaatgaggttgagcagatgacaagcagagatctctgggcagaagatcaaacgctccccctgggctgcccagagcatatttatgactgctgctttgggaagttccacccacgataatgcgatgcctgcagagagtgaacttatctaccctctccatacctctacccagtcccagtgggaagatagagatttgtaaagaagacctcagaaaacagaatccgtgacaatctgtttggaattttctcttcagctttgtgatttggtgactataaattaatagaacactcatgtaaaatatgactggagatagttgtgctaagtgactcctgcttcagggactagtcatagagtccccaatattgggacacagggtggctcaaaatacaattttaggggcatcagcaacagacttgctggatgtttgttaaaaaaaacccaatccctgaacttcatcccagatctaggggtggggtctgggaatatgcatcttaacaagaatcacagcagattctgatatatgtgaagattagaaacctgtaactaatgataataatgaacacagaaccctaagtattctaagtgctatgtatttatttcttacaacatgcctatgagacactggtttttctaagtgtggagtagatatcactgtttgcaattattttgggtgctacacggagacattttttaaaaaagatttcaaagttatgtgtttaacttacatataaaactcatatgtgtaataaacccactaaacactcataagttcatcaacattattgcttaagtaaaggctaaatgtatttaaataaaaatagtgaatcaatttaaagggaaatattaaataaatactaattctggtaacaaacattgtgagggtagaatggggaaaattcaagtttgcaaagcattgagatgagtggaaaagctctgtactgagtcaaagaatttgggtttaaaccttgaattaaattcttactagctgtgtggccttgagcaaatctctatctctctgagttttagcttcattcttagcaaaatggaaatattaaaacaaattcagctaggctgtggtgaaaagcatatgagaaaaaaaataaaagaacacttaataggtggtcaagaaatattattgaatataaatattactctaatctttctgaagtattaattcaatatgaggtgtttttcattgttgttgttttgagacagagtcccctgtcacgcaggctggagtgcagtggcgcaatctcagctcaatgcaaccttcgcttcccaggttcaagcaattcttctgcctcagcctccaatatgagtttttaatgtggacattacttgaatctcctttaaaacttgttagaaatgtaaacccttttttttcttttttattgtttttagagataggatcttgcgctgttgcccaggctggagtgcagtggtatgatcgtagcccactgtaaccgcacactcctgggctcaagcaatcctcctgcctcagcctcctgagtagctagaactatataggtgcacaccatcaccaccggctaccaactcttatttctcatatctttctctgagttatgttttcactacatttactgaggtatgagggggacagtgcagaacttgggttccacctctgcctttagctatcgatgtgatctctgacaagacattttgcctcattgtgcctcagttttataatctgtaaagtgggattgcactcaaagacttacaggttttctcccaacgtctttgtattggagctttttttaaattatctataataaactgagaacagtcagagcatagattaaatatcacttttgcccagtaggcaattggccagaactgctctacagtggcccaacttacaggtttcatcttctcacgttctttggaggtgctaacgagcagtaaaaccaaatggctggcagaaggaagaggaaaaaagaggatactggagcaaggaatttggattctcttcaagctcaaaatatctcccaaacgaataaaagttgattatgtttttatagtactatagttcgatggtacgatatatcttgttaatagaatcatgctggcactggactgaagagattcatgattaagttatgtctatttctttctgccttagaaatagcaatgaaacctggattttttttatatgggagctcttcagtctttaaaaaactgaattaataactgagatggcataattagctgcctggatgagctctcagaaatcaacttttctttgggtcagctgtcttccagttaagcagttatgcggaaacctttctttttcatgcccggaagtataaaacagaaaaatcatgggatgctgaaattgctgaacacacacgaagcggtgccacagtgtccccaccctgtgccaaagcaaatttctgagcgttatgtaatttctccctggctttgagctcccgtgatcctgtctgaggtttatgctatacaatctgctaaagctgagctctttcaggcacttccttggcgggtgacatcttgtcaatattagagacctgtgattgggagaggggagagaggctcccatcatttcagtctacatccagcaccctgcattttccaaaattcatgctggggattgctaaaacagacggcatttgttggctgaagagtaaatcacgactttcgtgggtacattcattcatttggaaagtatttttgatcattcactgggctaatagtgctgtggggaatttgaaaaaatgtattttatatggtttcaaaaacaaagtctatggtagagcttttgccctcaaggaatttacagtcctttagagagccaagacatgcatttttaagttaactaacagcatgcacaaaaactagatacccctgtgatacactagtggtaaagctagcaaaaggtaatgtcatggagtgtgagttctggttgggtgatcttgtctaattctcttacattcccagtgaagaaacttaaccacagaaaagtaggaaaggccgacctgaggaagcacagccaggaaaggattgcatttaggcttgaatgcaaatctcataatgctttttgcactctgctttctgctaccccacagccatctctctatatgtttaagcatgaaagtggtgatttcagaaaactgttgatgctcagagggagaaaattggccaactttaggaatcaaaattccaatattgctccaggtaatgccagagaaacataatttgacctaatgtggtccacatctttctagtccagtgtcaacatcattcattaactagatatacactgttatgtactataaaaccataaccaactttccaccattttggagaaatttctagcataaggagaatctagatccctggtttgtcggtgtcatcttttttcttcctccttttgtcagtcacttggtcatattgctcattagcaccttcaaatggatataggaaaatgaaactacaggttgagtatcccttatccaaaaatcttgggccagaagtgttttggagttcagaattttttggattttggaatatttgcatatatatggtgagatatctaggacacaggacatgggtctaaacacaaaattcattatgtttcatatacacctatattagtccattctcacactgctaataaagacataccccagactgggtaatttataaagaaaagagatttaattgactcacagttccgcatatctggggaagcctcaggaaacttagaatcatggcagaagggaaagcaaacatgttcttcttcacataatggcagcaaggagaagaatgagagtgaagtggggggaaagccccttataaaaccatcagatctcatgggaactcactcactatcacgagaacagcatggaggtaattgccccccatgattcatttacctcccattgggtccctcccatgacacatggggaattatgggaactacagttcaagatgagatttgggtgaggacacaggcaaaccatatcaacaccttacacacatagcttgaatatttatacaatattttttagtaattttgtgcctgaaacaaaattttgactgcattttgactgtgacctatcacatgaagtcgggtgtggaatttttcacctgtggtttcatgttggcgctccaaaagttttgggttttggagcattttggattttggatttttgggttagggatgctcaacctgtagtgagttggctgtcactcagcagctctggaaaattacctgtctgcactgaatttcctcatcagtaaaatggaaatgattatagtactgaccttgtaggattattctaaaaatcagagaagttcatgcagcttagaacagtgccaggcacatggcaaatgctatggcatacttaagcatcttcctctgtggtgcctcgtcatcaccatgtgattgtgccttgcttgttcctgtttcacttttcagagggagaaaagtggccaactttaagaatcaaaattctgatgttacttcaggaaatgcatagagccagagagacacaatttgacttagtatgatccacatcatcccctcaggctgaatagtggtggcatgcacatctataccaaaatgttttaccttttttgtagaaggaaaatatttgtatcttctattccatatcttagatctttataagagcacttaagttcaacctcctaagaaactgccaattttgttgatcacgatagtctgcacagattttcgtactatttagtgttgggagtgccttagggaccatcaacaacaggcccctccttttatccatgagactactgaggccttggaggttatttgtccatccatggcgggtgcacactagaggttatctggttagtagcccaactaagattagaacccaggaattttgatttaatctcaaatgacctcttttatttctgcatccgggaaggagaagaggaaagtaaacgggaaattcatgttatctatggaaaagttatcagtttgatgtttattaaatgatttgtttcaggagattgtttacaacttttatcttcctagacaataattttctgtaagagtaaagtcatggtcattaaggtagtcatattaatgtattcagtaagctgtgtggtgtggataattttggttttgacaataattatacttttattgaacacttcctgtgtgacagatcatttatgttcttttctgctgaaaattcagtatgggctgggatcacatttattttgtagattattctgtctgcaattcccaaatatagtgggcagcacatggtaaacactttgtaaataattgtaacatgttgtagttttgttatagcgttatgctttgtaaaattaaaagtagctatatccttctatgatccagaaatttcacttctggttatataaatcaaagaaatcctcatatggttctataagagaacatgtataagcatgttcatcacagcattgttggtgatagctgggaattggagacaatctgaacacacatctgtattagtcaaggttctccagagaaacagaaccaatatatataaagagatttattaccaggaattggctcatgcacttatggagcctggaaaatctgaagtctgtggggtgcgctggcaggttggagaccaggaaagggccgatgctgtagtttcaagtccaaaggctgtcaggccgaagacctgggaaagagtgaatgttgtagttcaagtctgaaggccatctgctggagtaattccctcttgcgctggggaggtcagccttttgttctattcaggcctttaactgattagatgaggaccacccacattatggagggcaatctttattcagaacctacccatttacattttaatctcatcctaaagcactctcatagaaatgtcaagaataatgtttgaccacatatctgggcccagccaagttgatgcataaaactaaccattgcaccatccctgtgaaattatataggtaaaatttaatggctgctgactcgggggtactgtatcaaataaacttccaaagaagaaagagatggtatgctcagaagagttcaactgaaaagaatttaatgaaggtgctgcttacgatggtaaacaaagttaaggaatcagcagagacaggcacccagggactaggaactaggcttgaagggtaaggggagagaatgatgcaattggaatccagtgagactggagccatagaagagggccatcctgccagaagctgtggccataaaggaatagacctactgccaaatgctcaataaggcagagagggagggataggtgaggggccagggtggtagcctgaaacccgacctctttcttctggccttcagtcttctttgggtgtccctcattggtcaaacacaaccagaagccagtgggcatggggctctgggtgatgtgtctgtagagatcagccttaggggcacagagctgggcaaggaatgactcagtggcctggaaagggcacatgatgaaaggccatcataaatagtatacagcagttagaaatgatggagtagatatgctcaaaaccacatggatgaatctgaaaacgtagtgcttggtgaaaaaggtaacaaatagaaagatctaaaacacaattctagttatgaaaataaaatacatatgcacaaaacaacaatgcacatctgccagactatttgggaacaaaagcatacacatcaaacactgtggaatagctgcatgtggtataggaaagtaatgtggattaaagggaataaatgagaaggagagagaggtctttcatggaccaatgatgataatgtgctatgaacagaggagagtgattaagtcaactccgtgcactaaggatccaactttatgagaaaaaaatatatttataaaaaatatataacatatatatatatatatttggtattgatttttctgttatatggatgaggtaccttatccatctaactcatgctgccagattggaggaatttgaggcctgaggggttcaaggaactagcccagggttatgaaggtagtgggtgatctcttgaggaaatgagacgccatggatattcttgatgtagattcttctcttcagtgacattgtcatgaccccacctcattgagatatttgatccacacaatacagtgatttaaggcctgtgtgaatgtaaattactgctgttcatttttgtgctcctgcctgggaccagggaagaaattctccaaacatcctgctttccgagtttgaggacttactttagaaaagtactaccattggctttatacctatcattagctaaaccttctgtaaatggcatcattttgggagcaaggtaattgtcaggtcaggcctggatagacatatacctcctctgttatctgcaaggttgctttcaatctccttcttttccatctgtctacaggcatctcaatggtttatgttaaccttagaaaatagggcttgggtttagccacaggggatggaagatggccttagccacatggctgtggaagggaaggaggtagggatggccctagtcacactgggcctgtgtaaaagggccaaggagcacttgcccctccaagggcacttgtctctggggctgtacttgccacaaacctaatcctctccattacatagctctgcaggctaagttttcaggagacagcacagacggaaaagctccataaagctgttctgatcctcttagcactttgtgcaaggagcacagataagacttttgattctgggaattactggaagaaaaaatatacctttgtctgaatcactcatgctgccagattggagaaacctgaatcagtttgatgttgttcataacaacaacggtagtaatagtaataatgaaatctgtccccaccatttgtttacctactctgtaggaggtacagtgcttgaaggttggcatccgtgatctcattccattttcacacaaccttgcattttgctggcagagagaccaaagtcaaacaggttaagcaacttagccaagaatagagccagaaaatgacccagtctaacagcctcctcagctcctgccctgtcctcacagtggttccatcccaaatgcagtagccaagtctgtcctgagacagggtggcattggggtggaagcccaggaaggctgaagcttcccaggtggggctaagtggaatgtccccaaggcccagattggtgcccattttaagggcagggtttccttgatgaggttgttctctcttcttgcctggagagaaagcctatgttatcttatgaaatatcccctcaggtaagaagggagtgcattctattatatatcaggacatggatcctgccagactgcagtgagtcaaggctgcttcatgatgtcttgagagctggtgtcctgggatcctttggctgggctggaaggttcagctggtccacatgggtaggaggatgtgttgggaaggcaggagaagaaggatggcctggcctagcggtttaagtttgctcctagagagcagaagtcctggcatagaaaaggggattcctgggctgtcacagtgagtccatattagtttctcttactctgatactcttcaaagtccatccaactggagtcacatactcccttcttctttttgcaagcagtgctcaaaagtgaatcaagcccactcagcccaatttgttgttaatgcttgttgctctcgcttgcctccctttttgttttctctttttaaggctgttttgtcctagtaacaaataatataaaaaataaaaataaaataaataataaaatactactactaataattggcaacaagcaccattctagttgctttatgtagatgatctcatttgatcctctgcagaaccttacaaattattatccccaattggcagatgaagaaactgaagcttggaaaggttaagaaacgagttcaaggtcgcccagctagaacattgaggagcagagaacagaatgctattttgtgttccttcaaagcctggcttactctctacttgaccacattgcctataaaatggggatggtaataacagttgccctgcttgctttgcaagcctgcggtgaggatcaaataagacagtaattgggaaagcactttgaaaattgcaaagcgctatgtaaatatatggtattattctaatgtatcacgggcctacaaaaacactgctcaaacatttcatttaagagaagacacaccaaaccattattcaataagataacaccatatgtgatcctttcatcattccaagaatgtttatcaagtccacaaaaccaaagccattagtaaggttttgttttctgggtaggctcagcaaacttggagcaagctcaagtggtctttaaatagtcaagttaaattgaagagaccgcattaagtgtcaaataattaaatgcccttacagactctgggagtttaagatatatgctttcaatacattagaatattcctaagagtagctttcaaggagttgaatgggaatccctttggtactaaagggagcggtaataataataacagaaaataatagcagtaattttaaccagtggagtagtgtgaagaacactggctatccaaccagactcctggtctactagatatataacctggaaaataatttaatctgtctgtgctttagttttcttgttggtaaaatgggagtagtaatagcaccgaccttgtaaaggctgttgtgatgattaaatgagcaattggaactgcacctgccatatatagtatgtactctgtaaatgttacctcatgctattattatgctttcttaagcacacaaaatatttgcaaacaacataagaataaaatggtaaagaaactgacttcagctgtaataactaaggtcctccaatgtgccaggtatgatgctccatactttatatacattatctctttaatcatcataacaactctcagggagagattttctcactctccccctccgcattttacagatatggaaacggaagtccggaagactcagtgtgatcatctgaattgctctttaagacttttttattctttactactttcccaagttgccaaagcctggcagctagcagcaagtcctctgccctggatctgattggtcttgagaatggggaggactgtctagtgtttcagctgtgcctatgctgctgagagatgggcaataggggaagcgggacccctctagaagtgatggctgagaaacttcaggctggactttccacaccttttcagggttctggagtgagtcagtgttactcagcccacttagggctattcttgaagctgctttgaaccagattttaaggttttagaaacattcggtaaggcaggagtgtggctggtaccctgcaatccctccagaatggtctggtttctaactgggttgatttaggatgacatcacatcagttcacagcattaaaactgcctttagcgcctcattgtccaaaaggacaatgtcctcattctttaatattgcggttgagtggagtaagttttgacttcagaacctaacaggcacagatctgaatcttggctctgtcatcaatgagctgaatgattttgagataaggtaaatttctcagagccacagtttccttatctactaaataatgcttccttgccagatcaaataagatgcaaagggacgcaaagtaccccacacctggtgtggcttacagtgagtacttactaaatgttacttcccttcctttctcttagcaaggcacacataaccctttctaaacacacctcgacctgtttattaacatactgtactttttttctatgtgcctgatagttcatgaagaccaagttgaaacatgcctttcctagttttgccacagaaatgagataatctatgtggaattacctagcttattgcctgggacaaaatgggctctaaataaggaagaatgagaaggtggctgaatggtaggagctaggaatgttggtaatattttctcctgaagcgtacccagacttctctgggaaacttgaatttaagaaagcttataagggagactgtgcagtggaaggggtctggtcaaggagaaacagagcactggtgcctgtatactgccctcccccaataaaatatttgtctcctctaccccacaagccagaccacagccattcacatttaaagcttgtggtttgtccatccttgggagggtgccacgtggaataggattatattaagtgcatagtgatggctttgtggctcaggcagggaaatgtccctggctaattgcacattagatactagtcctgtaaatgttattaggctgtgcaagctagctgctactattaactttatgttgaccttctttgtaccaaacacaagctctcaaaagagttctttgcagagtgccatttaagggctcgtgcagcctttagaagttgatttggggatgcctgggaatgcagtctcctggaattgcatttaggatcctgactcaatatgtattttcattctggtgtttcttttggtcctattccatgcgttggatagctgaacatggacagatatacaatatgaagtctctttggtttccatagtaacacattatttatctggcattgtcagctcattaactgttccacccaagtgaattttccaactaatcgaagcatttctcattaaatgccaaacagtttgttgtttaatggaaatctttcctaatggattacccacgcacctctgtcttccgaaggagggctgtcttttcacaatactgcttggacttcattgtgagtttttggatggtgctgtcatatatattactacatacccagggtgtgttgaactctggactaattgctctaagctgttaaattttttgagtccctgggtctccgcactttctcctgagtagttcccagtttatctgcctccatctcctttcctgatctcaatttgttgtgtctagtcaactccagactaggaaatctgataacgaagcttgtgaaaagtacgtataaacagcttctgagtgaaaacctcttgagcttttctaaggagtaagagcttcaatgcaacaaactgggctgattctccacaacagaaagcattctgcctcagacattgttttgtcagatatttgtttacctatcctgccaaatttgagtttcaggaacctaatccaaatgttaattcgaatttccaaatcaccaccgattgcccatccctaatcaaaaaattctaaatgctccaaaacctaaaacatttgagcaccaacatgatgccacaggtggaaaattccacacctgacctcatgtgatgggttggagtcaaaactttgtttcatacacaaaattattaaaaatataggggccaggcatggtggttcacacatgtatgtaatcccagcactttgggaggctgaggcaggagaatcacttgagtccaggagtttgagaccactctgggcaacacagaaagaccctgtctctttaaaaaataataattattattattttatatatatataaagtaagattacctttatactatgtgtataatgtgtgtataaaaaataaattttgtgtttagatttaggtcccatccctaagatatctcattgtttgtatgcaaatattctaaaatctgaaaaaatccaaaatctaaaacacttctaattgcaagatttttggataagggatactcaacctggactatccaagtgctggctttaagtgggatgttacaaggccttcagaaaggtctgttcaatcatttcttgttcactgccaggcactgagcaaagcactggccacctagatagacatagtccttgcttttgggatactgaaagtctagatggaaaaaaacttagaaatatgcagataaacttgaaaaatggtatagaggggtgcatgactaggttctgcatagcacagagaagggaatgatgtctgcttagaagaatcaaagaccataagcaagaggagataatttgccctccctctacctcccttttaaaaattcatttatgtctttctgtatttctcttgttcctatagtcaataaacacttattcaatacaaactatattcctttcactgagattgcagtagcatataaagcagatataattcctgttctcattttgacataaaggatgaatagaaagaaagggaagaggaatgaaaatgggcatcccaagaaagagaatcacggatcgaaagggcaggtgtgtttggaatggtgagctgtcatttagcatggctggaattatgggaaaggaggttgtaaagcatgctctgctgaggacttcaaactttattatatgtgcaggagatgcccagcaaaggttctaacccaggagttcttagaaaagtgtcaccaggctgggcgtggtggctcacgcctgtaatcccaacactttgggaggtggaggtgagaggatcccttgagcccaggaattcaagatcagtctagtcaacatggtggagactctctctacacagaaaatttttttttaattagccagacttggtggtgtgtacctgtggtcccaattactctgaaggctaaggcaggaggatcacttgagcccaggaggtcatggcggcaacaagccatatttgactcactccagcctgggtgacagagtgagaccctgtctcaaaaaaaaaaaagaaaaaaggaaagaaaagaagtgtgaccatatgatgggggattgtggcatgggaggtgggcagcagcagagaaccaaacccacaacatctaataaatgacatgtaattttcaacttcaactttaggtcttaaattttgggttttttgcctcaattacccagaatccatcaatagcttttctgttgtttctgcctctgctcttttcccttgaatgctgtcacacagatccaagcaattagagcctacagaaacaagtagaggctgcctgaccccaggaatgggctaatagatgactcagccatagttttgctgcagaattatgtcagtggaatttattaatgcctgaattatattccatgttgtactggttcttaacccacatcatgaggattaaatgagataatgcatgtgaaatcttcatgcctgacccataagcactaaataaacagcaattgtctttaacccgtgcttattccactctgtcacactgcctgccaacttaacgcacttggtcttttttcaaggtatatgggctgtcagcttatcttcactgtactgttagctcctcaattgtgggatctgggaatgttaatctttgtatcatagtgacttttaagttagattatttaaacatgtcattctaatcataatgcagagacacatgcatgctttcagagagcagcagaaattcagttttaatttatcattgcattgaagctggaagaaaacctgagggtattgttctcagaagttttaacgagaacaacattctctttgcattatcaatgttcctcagtcgccacttggctggagcaactacctctggcttcagttagctatttacattcctctatttttatataaattgtgctatattagcatatatttcacactgtgacctagtgtttcccagatcctttaagccaggctatttgtacattagtcaacgtcaatggaagtaaaatagcaaattgagtacagactgtagccctgctgcattgcccactctgtcatgctgaaatggattccttattctaagaagatttgctgtgaaatacagtctatttacattaagaagacctctgtatatttaaggcataattgtttcagggccttcattaattcttgaactgcaagacctagattttcttttcttgtatcttttctataacaatggaagtcaggagtttccaaaaaaaataacaaattgttcctcattaaaatggaactgaaaatggttttctggaaatgtgctttacaaacaatgagagaatctgattgtaaatcaactccaggacccagctgtctcagggtccaggctgggaagctccaggataaaaggtagtctgtatttttatggaaaaataaaacaattttttacttccgtaattgatgaagtgcttatcttgtcatacaattttaaagtcggaagagatctcagaattcatttaatccagccccttcttggaaaataacttcttccttggtatctctgacatatggacatctagtctcttctagaatacttttagccatgggcaactcactcctttttcagaaaaaattgtggttaaacatatgtaacataaaattactttttaaccattttaggtgtgcagttcagctgcgttaagtacatttcacattgttgtgtaatcattaccaccatccaatgccagaaatttttcatctcctccaactagaactctgacccattaaacactaactctcgattccaccccaccctgcctctgcctcctggcaaccatcattctactttctgtccctatgattttgactagtctatgtgccacatttaagtggaatcatatagtatttgtcctttgtgactggcctatttcagttatcataattgtcaagattcatccatgttagagcatgtgctagaattttcttcctttttaaggctgaataatattacattgtatgcacatgcacattttgtttatccattcatctgtcaatatacatttgggttgcttctaccttttggttgttataaatgctgccatgagtatgggtgtgcatatttgagtccctactttcaattcttttgtgtatatattcccaaaagcaattccagaagtggaattcctagattacatggaaattttatttttaattttttgtggaactgccatattgttttccacagtggctgtaccattttacattcctacgagcagtgcataagcattccagtttctccacatttttgccaacacttgtcattttctgtttttgtttttttttttttttaaactctttagcgttgtaatggcatggactttggctttgaaacctggctcagccacatactaggtgtgggaatttgaacaaattatttattctctctgagcctgaggggtttttttggaaaatgtgggtaatggataatattaattttataaaattatgaggatgaaatgagaaaattcatgtaaaaatacttagttcaccatctgaaaataggaggctatcagtgaatatttgctctcgtttttttcgtggtcattgattagtccattaaatttagggctactctgatgttagactgacttcttcattttgaattaaaacctactttggtgtaactcctgtagcttgtgtaacagttgcctttaattcatcattcctgactctgctctttacaatgtcacatgataaataatatccccctcccacatgtcacctgtctgatatttgaaggcagctatcaagtattcactagtcttctcttgctttggtcgaacactctggtttccttcaactgtttcttaaatgatgtggtttctagatctctcatcatgtatatcagtcaattctggactacagtctagtagaataggataattggaaatcacaccatctctccccttattttggctttcctgccaaactgtgatgtccacatgaaagaacagatgcatggatatgcgtctctcaatcagttcaacacattgagcccttggccatggcttccatctcttactcaacctctccccttcctcattgctcagagtgcttgatgtctaaagcacttgctttcattgagtttaggatcaattataatttcaaattttctccattttgttttttctctcctgtcagctccttaagagagaccaaggactacctgttcccgtgtaccttcctcatggtcccactagcacccagcaggcatgaaggctgtacttttgaaataaaattcagtttcgctctgagacatggagctgtgtcttctgacacaatcacaaaaaccacagagggcattggctagagtttgagccttttctgttgctgaagggaatacctaaagacttgcccaggaagagaaggctagagtgggagagtattttggctggaactccaaggagcactttgaacgtgggtcttcagacatgaaagtgtagggagggcttcactccaccccaccctgtcctgtaattcctggactcttcaatgccaagcgaaattatcagtttctaaatttgcccttaggagggtgaatagagtgccttagaaataccagtgctgtttctgaaagttcccaagcagttgaaagaattctggatttacatgcctaactcatctaaatgtcttttctttatgagctcgttgacatccaagaagacttttcagttttattatgaacctttttacctttaaaaacaaaaatcccaaacctctattcctgagaagggaagttgtaattttgtcaaagataaaatatttgaatggtgctctgtcccagctcctccactgtgtgtttgaaaacctagttcctcatgtattatcctcccaaacacatgttatgtgtttacattaaaaaaaggtaaaagccagattctcttcctttctttaaaaatagaacaaaaacaaaacaaaaagtgaaggagagggaggagtaactcatttcttggcattttaatagagtacccagaatcctcctaatataaggcactattatagttgaaaggcatattaaaactatgtataaatgaaaaactctgtcttttaaaaattgtttatttattagactggagtgcaatggtgcaataacagctcactataaccttgaactcctgggttcaagtgatcctcctgcctcaggctcctgaatagcttggaccacaggtgcatgacaccatgccagggttttttgtttgtttgttttttgttttgttttgttttgttttgcttttttgtagagtcagggtctcactatgctatctaagctggtcttgaactcctggccccaaaagatccttctgacttggcctcccaaagtgctagaattatagactgagccaccgtgcccagcctaaaagccctatctttagtaaaggactggtagatttacttatgatggacatacatgagctttatggcatgagttttgtgacttctacattaaccactcagaacactgacaagctgtaaaaatattatagatcacagccatttttcagatatgtgcagttgccagattgctgatatgcagatcttattttgcaaagtcaaggcaaagtggtcccttcttagtttgcctgtttgccatatatgcatttggaatgatgccacactgcctggtgagaccccaacaaaggcattacttggtggcgtagaaaaataaccaatttccaaggaaagacagaaagaggcaggtcttcttcacccatatgggcctgttgtcttccaggtctaatttgggctatgtttggtttatctgtgtggtagacttcacttttcttacattaattatttgtgatctgccacctggggaagttggaaaacatcagaagttaatgctgttgggtttctttaaggagaagaaagaaaggcctagaggtgtctttgcaacaaagaaggtagctattaacctttaagggtgttgtagaagccagtataacatcactaatgtggttgtcatgaaatgcaatgacccttctctcttctgtcacctgtctcgcttgactaactctaccactcacatttcatgattcagtgtggagaacataatgtgacgaataggaaaggagaatgtaaacacctgtagtaatgtctgtctagtgtgaccaaaatccctgaccttatattttaacattgtaacttttgggaagaatttcttttgatacatgtttttattttatgaacttaaaaaaacccgacaacccttgtatatgtcagagtctgttagtactgtgtgatacattaaatagcagagaatggaacaaatatctgtggaataggttaattattattattattattatatttatttatttatttattttttgagatggagtcttgctctgtcgccaggctggtggagtgcagtggtgcaatctcggctcactgcaacttccgactccctggttcaagcgattctcctgcctcagcctcccgagtagctgggattacaggcacacaccaccacgcccagttaatttttgtatttttggtagggatgaggtttcaccatgttggccaggatggtcttgaactcctgacctcatgatccacccgccttggcctctcaaagtgctgggattacaggcgtgagccaccgtgtcaggccaggttaattatttaatgcagacttctgctcagggtatttgtgcttaaagagatggactgtatagacacatcctagtaaaaggcttgagttactggtagtttaaacagaagccactggtgaacaggggaaagaactattggttcaagtttaatttggcatctttttagcagtgacatttggcacatcaccctctaatccttggttttgtcaccaccaaaatgaagataataacacatcagcaaatgtttgtgaaaatgtataaatgtgctttgcaaactctcatggatagatagcatgttattagtatgattgctctgctaatgagtgtagactttgctgaagttctcctcctcctcttcttcctgcctcttcttcctgctcattactgtcacaactaccccttatgaatttgtgagccattagggtagattctgcatctcttaacccatgtctttttctgcctgccagtcagagtcagcaaatattagatacctaataagtgtccaacacgaaggatttaaagatcagtactcaaaatatacaaatatggacatgcagcgatacctaagtgactgtttacagttccccaaattagtatggctccctggggcagaaaaatcttttgtctacatttctaatgtctactcatccttaaaactcaactcaaaagtcagtatcccttggcaacctgagatgttcatttctgttgccctcctactcgctcttatgaggtgctctttctatggagtcccgtaaaactccgggcatacctcagaagaaacacttgtcatttgacagaggaatctttgagaattgaactctttttaataaaaattctcccattttgcacatggtatagaattttaagagtgcaaaaagatgtacagtaaaacatcctgcttgcccctgacttgaaaccaccagttccccttctctggtgtagacactgttcccaattttggggcatctcttttatagatattttataaagatgtatatttatacatgtaagagtatgcatacataatgcatattatacattccatatgtatctgtgtataagaacacacaagcacatttttgtttttgcataaattatattgttgtatacacactatgagtactttgcttttatttttaaacctaatgatttattttggtgattgttccaaatacagtgcatacagtttccttgtttttttataacagctgcattgtatttcattgtgaattttggatagccataatttatttaggtagtctgctattgctggacaagtaggttgtttccaatcattttatattatagacaatactgccatgaaaatgttgtaacaatatcatttcatgtatgtttgagggcatctgtcagattaaattcctagaagtggaattgatgtacacacagttattaacattttaaactttcatagatattgtcaagttgtaccaatttatgctgcttttgatataagggttcctgattgttcatatccctttcagtatagtgagttatcaaactcttcatatttccaatctgattggggagaaataacatctcattgaagttttatataacattttttatattatcagtcaggttatcatgtttgatatgtttaaagaccacttacatttccttatctgtaaattgtgcactcatatcctttgtccacttatctatttcctccttggattttttttctttctgattggtaggaaattttgcttactatattgtagccctttgccttttgagctgcaataattttgtctccctagtttgacatatgtcttttgatattaataacccatttatgcctaagtagcaattttttgaatttttgcaatcagacctcggcggggaccttgagcagtaggatatcaataactctcacgtgcttagccttccaataatggaacactagtcataaatggttaatacggtcaaatttattacctttttaaaggcttatagatttttgtgtcaaactttgaaaaggtcttcacactacaaggaccttgaagcagcaggtcagaaaaaatgcagacaatggagaaggcttgtggggaaaggcctgaagaagagggtcctcctagtggaatagctcacagtgtgggacggtgacatgaacttaagggagaggtagtaaagtgaaactcattgcattgcttctctctcccaagtgcttccaccagccacagcaaattcccccaaatacctccgtcatccctgactgaaaatggatgaccacattccatatgggaaaagtatacaccacctctgagcatcctcttatcagccagagatcaagttgcccatctcagaaggagatacacaggatcagacaggctgcctcatccatcaagtgcacagtagctttggtcgttcctgttcattgcagttgactggaaaggcctcctgaaatgctgatagctgtgggaggagggagagccctccctttccacatatgggcagatctttggcaaatccaaaggtggtcttgcatttttgtgaaagttcctatgcaggcagcgacaaacagctaggttgtttataaaagctgcaggtggaatgccatttcattttggatgtagatattgacacccggcaaccaagtcaaactgtttccatcagatgtaaaagccagaacagtcttggcaggttgatggctaatgaaaaggagttgcaaaattaattacatggaaaattatttttttttctaataagataatgaaaaaatacatactggattagggaatgacaaactcaccaagcttaaatagcagttgttattagctgaactctgtacttttggatgtgagaatatcattcttcccggatcattgtttgaaagagacctcctgtacttttgcctctctcaaatttgattaaatgagctgccaacacaagaccctgtcagactaagatgactctaataggcagttctccgtagcgcttcacaacaatgaaagtaagttcctccctccatttgtcttttgccttcagtttctcaaacttatttctgaatgcacaaggatttttgaaatctggtcagcttatttagtggaatgattatgggctttgcaatcagaaagactggatttcaaatcttggctttgtcaatctatggctttagattagttcttaacctcattgagccttagagttctcatctgtaaatggacatgtattacccacaaataattctatataacaaattaccccaaaatatagtgtcttaaaacaatgagcatttatttagctgaagaataaatgagctattatttattattatagctattatcaaaaaagattggttaggcggttctctgatctggactgagccaaggtgatctcggcacatgctattagccaaagcaagtctagattcaatggtacagaaatacactccacctcttcattggaggagatacaaaaagatgtggatacagggaggaataaattgtgggcattttatagtctactacactaccttataggaataaatgtgataatatagggagcatgcagctatcatatcacctatgcattcagaaaacgtctattgactacctactatgagtttggtgcaacattgatactgtgagatactgtgagtaacgtagaagaaagtaaaatctcatccccagcctcaagaagcatacaatcttattaaaaagatgtacccccaaagaaactgtagatcaccttacaaagtgcaaagtctcttaagagtggaacagataaaatactgtggggtttcagaagagggagaaattaaactaaaaggctctgggaagagattctcgtcccaacttatgctctgctaatgttttcctcgatttaactttgattattgatctccccaggctatcagtaatgacatggtgcaggaaacccagtccagacaggcgaaacattttaaactggtgcaatttcaggtgaattaagtatttgaacattgccagccatccagattctacacgcccaggctaatatggctggagcaaaaccatcttactgtcttgcaggatgatagtaatcctcttaaatttatctctctgattaagataatttccactaatccaggagtccctcaatcccatgaacttaaacacttgatttccagggacagccagaaggtataaatcacacttttaatatatttttctgaaaatagttctttttttcccccctttcacgcctcacagtttggagctttgaaataattgaattaacagtgcgctagagggggttagacaaaaacaaaaactgggaaagggactttaccagcagtgcagtagagagcctgagtggagccaggattgggtgaggagagatcatggctatgttctggcagttggtgacatgtcaggggaccttaggcaagttctctgcccgagtctgggtttcttcaagtccaaccagggtatgattatctcaggccttgatcctttgcatgtggagtcatgagctaatgtctgttctgtgtacggactttcttgaaaggaaaagtgctacctaaatacaaggtacttgtattactgtaaggtgcttggaatcttaatagctttctcaactgcagccaaagtgggcttctctttgtaaatgctttaagtggctgagaatcaaggctgaaaaggggtttgtttttctccccatctatgcctagagtaggatggctgcacgtttttagggcttgcccaatttgcccatttataatggagggctccacagacatcacagccattgaaatcctatgtaaaatagagaaaggctaagacaatactacacactgctttttgcaggaaaataattttctatgtaaaagtatagttgtctaattcagtggtcaaccaattaagagaaccttcaagttagacctaaatatttggctttgaaagacgttcaagaggtaccagttttgttgttggttaatattcattgagctgtctcaatgttgaggttgctgcccacactgaaattttatgacaaaagcaaaagtaacattttaattggctaactccctttcccctagactcttaaattacattaaagttctcagttcatttaaagctttttgtgtttttcagttatttttacagacatattatctgggtttccttaccctggtggtttgtagaggatcggtgctaggctgcaggttatgttaagactcacctagggagattcaatagtttagagacaggggtcgaaaaatcattattttttttaacatgctccccagctgagtttgggaatcattacattaaacactcttcaggctgtatctatggttagtttctgtatctatgattagtgttttttttttttaaaagtctttacccaattgtgagaactgctacttcgctaaaagtttaccatctgctggacattgaagtcatctccaaatattatcccagttaagcctcataacagtcctgcaaggtcattactattatgcccattttatgaatgaggaactgagtcttagaggtatgaagtaattttaagctggtgtgtaacagagctgggatttgtgtttgaacaacacaaagctgacacctttcatccttgtgctgaactgcctcccatctaacctattccaggatcatttagtagtcaggcaggacacaaagaaagcatgagacatgaccctccctctcaagaagtttactgtctgagaagaatgaaaggaagaacacatactcactggtggccaaaggaacataaaattaagtggaaaattgtaaagtagaaaattagggtaatttaaggttttttttttttgtcttttcaatagtaaactgagtatcattgaattagggggtttattttctttcctattaaattacatggttgttttgctgtgatttgaacatagtgtgaatcagaagcatccttctgtttgaggtcccaacatgaaaaatatttttattgatatcagtgttataatctttcaaggagatgcaatttgtgcatcaacatattctgttttacatattctattttgccattggtctctaaacacacaggttggagcagaaataatgtaacctgtacctagtaccatgttgaatggacaattattttatctttttcaggggctaagtgtaaactagaaagacaaaaggaactgaaagtttagaacgtcttagacaagtacattaggctaaccctccattcccagcagatatttatgttgctagggaaataaaagccagaaagactcagttctgattgaagaatcaatttaggaggttgatatggtttagctctgtgtccccacccaaatctcatcttgaattgtactctcataatttccatgtgttgagggacccagtgggagataattgaatcgtggggacggtttcccctgtactgttcttgtggtagtgactaagtctcacaagagctgatggttttataagggatttccacttttgcttctctctcatcctctcttgccaacgccatactgtaagaagtacctttcgccttcctccatgattgcgaggcctctccagccacgtggaattgtgagtccattaaacctgtttttcttcccagtctcgggtatgtctttatcagcagcatgaaaacagactaatacagaaatacagacgtatacatggccaaggccaaatcactaaaactgagggaggcattctctgtttccaatagaaggctcctttgagtatccaagtttgcaggcaaagacagatacgtgattatgacaggtgaagatgtacccactgtagaccatcttttctatgaagatcggagtctttcttggggaggtgctatcctcaccaggtctcagctcactgtttagttgtggtggaaaattctgttttattcaaaggaagaaattagattatccaggattccatgtctatctaaatatctggtttgccataagccacataagcctcatcaccaaaatctttggtcaggacaagatcctccagaactgtgctaagccctttgtccttcccaggcccctattgcagcatttatcatattatactttaattttttgtttgcttctctgtgttcctaccagaaaatgagctccatgaagtaaagaactgtctcaattttgttcaccattatatcctagcacctggctagcacttagctagtctggaacagaataggtgctcaataaatatttgttagatggatggatggatggataaatcaatgaacaaacaaatgaatttaatatcattaaactccaaatgaacataaggagttgtgtagctccttgtggcaatatagttttctaaactgtctgctaatatactatggctttaggaaacacccagtataacttcattcccattgtgtataggacttaaccaagacttcacttgtttttaaagagtcaagaacaaactctcagtctgtcatggaattgcagctgtgaaagcatcttccttgtgtctcttgtttcttttgagtggcatgtgactttgaattggccagagacaattagtaggtaatagatttttattataaaatggattataaaatatgaaatgaaaatgtacgtgggccatacaaaggggaaaatgaaatggcaaactccataagacaaagacagatgacacagaaagatgagtaagaagaaaaaattgcctggaggcactttttgggggaagcatgtttaaggaagggcagtcaagtggaaataggaaaaaaagagtaaagtttgttgatgtcattggaaacccgagatgtccacagctactgaaaggaaatgaaatggaacctctgtagggagctgagaccagtttctgagcgaagcattctgcagcatgcctcctcccttttatactctgtctttgccagcttcttctgaggccagaaataaacaaattattttattgtattaagcatccattgagtctccagtggcaccatggatgaatgagggagtgttaactttgggtccactcatttgaacttctccttggggaaaagcaagatatgaaccattttgaaatttattttaggactttccactgtccctaaggagatcctgcctccttagtaactagttgggatgtttctttcttgtctttaacaaacaaaacaaataacgacaaaaagaactagaaggccctggattggaaaaagttgctatggctgtagtggagtgagaccattactgagttatttgcacttcctccaatgtgccatggtctttctaatacataggtctcctcttaacccagaacaatctttcaaaggaccaccttcctgccctttgggattcctcctccccaaacgggaatatgtattcttcctcagtgatgtcttagaaccctgtgcctacctctgttgtacctctgatcacatatttacctcttatcacatatttacttttagagccatggcttattttaaaatattaaacacatttcccaatgtatttgcttattattgcttcttacatacaactcttccttctaaatgcagtttcctttttacaggaatgaataatttagcacagaagtctatgcatgggttcatgacagctttatttgtaacagccagaaaatggaaaccaccaaatgtttgcagcgaatggttaaacaaaatgtggcatgtccataccatggaatactctacacagcaataaaaacaaacaaacgattgatacatgcaacaaagtagatgaatctcaagggcattatgctgagtaaaagaagccagtttttaaaaggtcacatactaaatgagtctgtttatacaacattcctgaaacaacaaaattatagcaatggagaacagattagtggttgccagtggtcaggaatggttgggaggagggagatgggtaggactgcaaaggggttgcacacaggaaatctttgtggtgacaaaattgttttatcttgactgtggtagtggttactcgaatctacgcttgcaatgaaatggcagaactatatatacatattttaacaatgtcaaattcctggctttgacattataccataattctgtgagctgttaactattgggagaaactgggtgaagggtgcagaatctctctggtctttacacagcttttgatgtcttatggagacgtttccctcaaccccacccaagtcctgaatggactttcaagagtcctagcagcttctctggactgttaggagaagtatttccagcaccttcccacaggtagggcggctctcccaggctctagtaaagactttaggcagggagctcagatttcgctctggcctagggctacatcttggattattaaatgaacattaaaactgcaggccccagtccacagggcccatattcataggcaccttcagcatcggcgtccactttgtgttatcctttttggcaccaagaatttccttttctttccatctcagctatgcatcatatatttccttgtgacattttattcagtactcttcaagtttttagtctcgttgtggtgggggtggtggctaggggacagggaggctgtttttgtcaggtcttattgttaaccccatcacgctgtttataattgcctgtttgtggtcatgtactcctctcccaccagactgtaaggttttagaaggtgttagggaccagttcaacctttttttttttttttttttttgagacggagtctcgctctgtcaccaggctggagtgcagtggcacagtcttggctcgctgcaacctctgactccctggttcaagcgattctcctgcctcagcctcccgagtagctgggattacaggcatgcaccaccacgcccagctaatttttgtattttcagtagagacggggtttcaccatgttggccaggatgatctcgatctcctgaccttgtgatcctagcctcctaaagtgctgggattacaggcgtgagccattgcgcccggcctggttcgagctttttcatccgagttcttacacatagaaagtgctaatacatatgcatatataatgaatgaataagtcaatctctatagttccatggaagagagcccaagtatgatagttttaaagtaatatagttttcaagaatacagtctatttttattcactttaaagatgtgtgtcattgtggtgctttttgtagcatagtttctttaaatacaagaactgcatgtggtctataggttgaatttaatagattttaaaaaaggaacagcatctccaaagaggaaaaaaaaaggcatttaagtgtgattcaagaagtatttcctctcctcaccttgtgctgtgccatcctttggggattttagaattggtgaaacaaacattgatcgttgaggagcttggcctctggtattggttctccagctatgtactgcagagcttagagttccacaggggacctctggggctgaagggggtttaagccagggagcaagtggttatgtctctcagctccttcccccatcccccatgtggcacagttgaagatgctctggctttgccctcagtcttcctggatttgatgatgatccccctccctaccctgacaagctgattgggcagctgccttcattctgcctcaggttcatcaatcataaaatgaagataataaaggtacctaccttatagactgttgacggttgagaagatctctgagcacaagcagagtcttttggactttgacaaaacctaggcaccttttccttccttttttttctttttcttttttttcctgcagatctcaccatataacaatacaaataatagcacaaattttgatatattatgaatttttcttcaacaaagtaatggattcatcacatatataagaattatgctgattacaatgtaattacatggttaaaaagtgatttcgtactgcaatataggtagtgtgactgggtaattgagcaggggtttaaagttgcaggattgtgccatcttctttctttgtgactatattgataacttcatttagagattgcatcagaaatccaaatttgaggtcactgaggactagaagatccttgtagacattgagcatagtactttccagtcctgactatcccatataggatgaagaaaactccaaattttctctctcctcagtaagtcagccgagtccctagtgtggagaggccccctccttcaggaccccagatgtggggcaattgtgagcctagggctagagcatggctcaggttgactgaccttgcactactggggaatgtagcctgcctgtccttttaagttacagcagactcttacttttccaaacaggcgcctttggttgaggtgatttacctggctatgggcgtctccattgaggcactagggagaggaaagaaacagggctaaaagccttcaccaaacaacatctaaagtaacactgaaaaccaacagtctcaaagccatcagcatctttgactgttttcccgccaccctccaaatgatcacaagtggaggccttcttttaccataggaagaaagtgtgccccttctatgtgactgaccctggctgcttggaaattccttgagtgtctctcaaagctcggcctctgagaatacataccacatcttatggctatacacggcagaacatgcagctcagtgagaagtcagcatgtatttccttttgagccacctctaaagtctggctctatcttagaacttctgtgattttggcgaagccacttccctaccaggggcctcacttgcttcctctgaaaaatgaggagattgtatgacataatgttttaaacaattgtttaaaacattggggcattttccacagtacctgtaaacacaacaatatataaaatagataaaagtagagttgttccttttgaaggagggtctagagcctgtactcttgtcctctggaaccccaaatcctcttatgttcctctataaatagctccaaaaaatcccatggatccaaagaatataatttgataaatatgtcttgggccttgagggcccacccagttataacattctaggactcagtgagtggtcaagaaaggcagtggggtagccacttgcttctcttgcattcagcctttgcagctactgggctggccgctggtcttgtgagtatgcgcatgcctgtgtaacctcacgcatcactgaatcggggatacaggatgtggcatggctgggagcttcttggaagggcctccacatcctgtgaatgttgggtctttacctgccaactgctgagatgaaccagtaatcctttcggagagcacaggcttttatcaatgaggaggattcaaggcttactttttccttccttccaaataacactcccactgttgaggcttaaataccaaaaccttatggtttgcagaatcagtgccaaaaagtcaatcctccgagaaactgcaaagataatagcccctattgatcaaatcgggaggagaatagcttttgaggtttgccctcctaaaagaggtcgagaaagataagggttggagttttctaaaacatgcttggtttgctcaaattggataaaaccatataaaaacacttatgttcttagagaactggtgaccaattcaggaaaacctcacaaaatgaaaagactggcttggattagtgaggcatgtgaaatgcagtgtctttctaagagcatggtaaatgtgttatttcaaatacagacagtgacttagtagctaaccaagtacatccatgcagaggatggccactgtctgccttactagacaaaggagaggtatgaaagcccttgagtctctatgctggacactgtacaggagtcttttggtccattagttaatcattacctcagtcctttgctgctcccattttatggatgagaaaatagaagttaaatgatgttcagtaactttctcatgatcacaaaattaataagtgtcagatagtagtgttaaaatctggtgtgtatttccattaaatagtctactgtcttctaaatggcacatacacatttgctattaccataatgcttttggtgaagagaggctgccaggctggtggtaaatatacctggaaatgtctcatgcttttgccagtggtgaggcgaataggaatccatcagtggagatcctacagggtcaaaacttgtggccgtgtctctctctgaagccactggtggccatggaattgatggagttcagctgagatgtgcttgatttttctcacttaaacttcagttttcctttcagtgaagaaaaaaagcttattaaacatcactttgtgaggggagattattaatattcaactttctacataaaataatcagcctttattttaaaaaaatatggccttggaagatattatttttcagggaagttattcatattttaaaatattttatctgtttttattatcattttatctgagaagctgaacacgtggttatctaaaggaatggatcttgaagttgagaacaaaactccccagaatcagcacaatcacttaatgagcttgcgaattgaaattatctttgctacagcccaagaactgagtggtaattagtgtccagggacacgtggggaacaatttcagtgttagcagtgccaagaatctattcatttgtcattggtcccaaattatattcaatcagcaattcaactcagcttggaaaaaccaagtgacatatagctaactgtctataaaattaacactgtaaaatgaaactatatttctggctgtgagcagcagtaagatgaagctatgaaaatattgcatgtaaatgctgtcaaggttcattttaatcccaccactttccaacctatgcttccttccctgaaatgccgccttggctgccaaccttctattcccaagctccctgaagtctgggtgtcggggtgtttgatgagccttttcataggtgaaccgcagcagtccatactactgaaaacaagggctgtcattattgaaagagccaaagtgggtggcagcagcatggggctcagactggagttggggttggagtcatatgtggagggccctgaaatgtagacaattagctcttctggggaaagcacctgcacgaaatacccgttccccaaacaagaggttgataacagaagcactgctttccactgtggctttgtagtaagcatttctcctacttgggtaaaattttctttttgttttcatattttggaattaagatccctgccatactgcctatctgacatctggtccccttgaaagagtctatgctatttttggctcaggacgttggaggaaaccagggccactgtaggtggggagggtatgtgtggttcatctacttctttcccacctgcttctaggactaggaaagaggtaagccaaggaggtctgcacaaaccaaacaatccttttgtctctgctgtggcagggagataaactagaagtatgcctttgcaaggtctcagtgagtcaacatcctgttcttgttcaagcttagtcagtgacgatgacatgtggccatttggcagacagtcaccatcagtaaatatggaaatacgaaaaatgtgcttatctctgtgaaaaggtgaggccagaggtaaggtgaaaaaaaaaagccaggttttacaggcttgagtactggtcagcatgggctgccagaaggtgtggagtgctagagtcaaagagacctgggtttgaattgcaattcttccacttaataaagttcatcctgcattctatctcagatcaatttttagtggctacctagagcactgtgcttaaaggactctacgacagatcccaggcttaacaggtaaacagagccataattgattaaagatgcctacactggattgaagtaggagggattgacaacttgtatgccttatagctaatgaccctgggtcctctaaggtcctgtccagccctaatattctctagtaatgttctgagtgtgtgtgtgtgtgtgtgtgtgtgtgtgtgtagacatagcctgaggggaggttagtataaccccattacaatatattagtagcgtggattaaattttcaaaaaacaagaacaacaaccaagattatttgtatattacagtctattattaaagagttttaacagcccgtaagtacttctaacagtccataagtacttcatagtgtattatgtcctttagattattgatttgtatgtttgctttgattcatgatggctttgaaaattatattttaagttatttaccacaaatgactctctatattcaaatacttagctttcatttgtcttgacctaaaattccaatgtagagaaacgaatttctctattcacagaaatggtaacaattccaaacacgaccagtgaaattagttacaggagcaatgttgttcttccttaggaaggctattaaatttattagtctaagactggtctttcaacaagaaaaggagtttatgtttgattatgtgtggtcatttctgcagatttgttttcttgttaatgtagtattttaggggcgaggtgtattttgcccttgttcttttttttttttttttgcaatttccatttttattttagattcagagggtacatgtacaggcttgttgtgagagtatattgcatgatcctgaggtttgggcttccattgatcccatcacccagatagtgaacatactacccaataggtagtttttcaacccttgccccactccctctatccttttgtaattccagtgtctattgctcctatccatggtacctatgattttactcccacttataagtgagaacacatgatatttggttttctgcttctctgttaattcacttaggctaatggcctccatctgcatccatgttgctacaaaggacatgatttcattatttttatggctacatagtattccatggtatatatgtaccacattctctttatccagtcctctgttgatgggcacctaggttgattccatgtcttcgctattatgaatagtgctgtgatgaacatatgatgcaggtgtctttttggtagaataatttattttctttggggtatataccttgtaatgtgattgctgggttgaatggtaggtctatttttagctctttgagaaatctcccaactgttttccacagtggtggaactaatttacattcccccaacagtgtattagcattccgttttctctgcatccttgccagcatctgttattttttgactttttttgttttttttgagatggagtctcgctatgtcagccaggctggatttcagtggcaccatttcagctcactgcaacctccgcctcccaggttcaagcgattctcctgcctcagcctcctgagtagctgggattacaggtgcatgccaccaggcagggctaatttttgtatttttagtagagacggggtttcatcatgttggtcaggctggtctcgaactcctgaccttgtgatccacctgcctcggcctcccaaagtgctggtattacaggtgtgagccactgtgcccagcgtgactttttaatgatagccattctgactagtatgagatggcatctcattgtggttttgatttgcatttctctggtggtaagtgatgttgagagggttaatgtaatattttacattttaattttcaagccagtgttttgaagtaaaaatcttcaaatctggccaatagattgttcatttggatggcatctaaaatgcaggcgcctctactggcatctagagccaccattccagtctaataagctatgggattgccgtggtctctctccaaaggcaggccctttggaaatctcctctaatgcttctaacagcctataaattactatatttaatattgcccttgtctttctcccttcccttctttttcttttcagaaacagagctgtcagtcagtgctgaattagtgcctacctcatcatggaacatctcaagtgaactcaacaaaggtacacagtgggggcacacaggggaggcgaggaaagaggtgtggaactgtttttaatcctggcatgaccttctttgaaatcaactgtttttcagatcactgcaaggaggtgggggccaaaataaatccccagcttactttgtgatcatttaacattgaattacttgggattctattatttctggagagtttctttccccccctcgttcctttttcttcttcctctaaaatgttccacatggtaaaaatgcttcaagatgtgaaatagggtcatttctgacctttctgacactacatctagtggatcttatttaggggatttgattcagcccaagccaggattcatcagagctgtttgctcggtgacctttcacgatgagcatttgatgtgcttgcagggttcaggaccgagtatctggaatgtttgtaattgcctgtgcataaggatggcagcttcctttgtgcacgtggggaacaggtttctgctaggagattgttgtttagcattaattaagccccgccatatgttaagcattgggtattttataaagaccctatgtcctggagtggtacatcaggacacattcaaaacctctgcagtctggctcaatctacctttctagccttagttatctttattcccctttatgcatttccagccaaatttcgatttcttcttatacatcctgtgcttttctgcctctctgctctcaccttttcacctggattgccttctcttctttgccaatactcattctcccccttttgcaaggcaacaaattacttctccctcaagaccaagcataaaatttacattatccagtcttgtctaatccctccagctggaagtggcctttccctctttgaaactcccatagctctctttcttctctgttcttctcttcacattttctatatgatgttatggtgatttatatacttatctcacccttaagcttagaagttccttgtaggagggtttctatcttacttttttttttttttggtctccatcacaaaatctagcacaaactcttatttgtaggaaattctcaataaatgtgtgtggaatgatgagtcacatcttacctggtgagaagccatagccatacatatttgtgtgcaaatacattcagcaaacttactgagtttctactttagttcaggcatgattcaaggttctgagattacagtggtaaagggagctcaaaagtcattgtcataaatggtcttttatgattagctctctattgtctactgacatagtttggttgtgtccccacccaaatctcatcttgaattgtagttcccataatccctacgtgttgtgagagggaccaggtggagataattgaatcatgagggtggtttcccccatcctgttctcataataatgagttagttctcatgagatctgatggttttataaggggcttcctccttcgctgggcactcattctctcccctgccgccctgtgaagaggtgccttctgtcatgattgtaactttcctgagacctccccagccatgtagaactgtgagtcaattaaacctctttcctttataaattacccagtcttgggcagttctttatagcagcatgagaacaaactaatacatctactaatacattcactgtaagttgtatttcctctctgagaagagataagtttattttataaaacagcaatgggtgaagttattttgctggttatactttactaggcactttaggatggtggaatgaagtgagatgtcttttcaccttaaatcaaaggacatttagaatattttttctattgccaaatttgacctgacattatttttctattaaatattaaatcaggcactccatgttactcctctccacctccagcatcaaccacaatgcctagaaagcagattttcaacaaatatttatagaatatgtttaatggaaaagaagaaataaaagaccctgaacattaacttagtacctgctctgtgccaggcactgtgctgggtgcttttttgtgaacttattctgcaagttccttatggtgccaacagaaaaattatatcattgcacactgcatgttattgatcagattccagttatggcaatagaaaagcatcaatgtgtgctaagaaaggcagcagagccagcagtctagaacccagcctgccagacttggaatttctaccagaccagcactgtaattagtagtagttgcccattaagaaagtagtggtgtcaatagtatgaacctgctggctgaagggaaggataaaggcaggccccagactcctttatttgttcaacacagacttccagagagtatggatggctttctggaggtacgaggatgcttggcatcatctttctctagaaggtaattagtgtatattctttaatttccattttgaatgagagaggaagatcatttgttgatcaaaaccttatcgattcctactctggtctaggaactctatgaaaattaggatataaagataaaccaggcaaaggcccctgtcctccatgaactcagagactatttggaaagactgatagctaaatgcataatcaaagccttctggtcaatttggtagattgagctttcaagagacacttcttccaatcacagagagatactagtgaaatatacaatgaagaaaataatccattgccaagctggtacacaaagaggtgaaatccctaggttccagaaatgaagaacaagttcaatactagtacaatgatctttgaggaggaattaagcaaaagagtccatgataatttgaaaactatgggtactctctaaggcctagagttttggtatcccatggggataagagttggagccacaggaaacaaactccctgcgttaggatatgaatgaagaatgactggcctaagtatgaaataaggaaaattctgctgaggatgtgatacagaaatctatgaagcaccttgggccattgggatcacccaggagaaatcaaaacctcagcctgtactacatgtgggagtggggttgaggttcttctcaggtattgcacaagccacaaaccaagatggtaacataaaaacttggcctggaattgattaaactaggagacactgacagcagcaaacctaaaaccagctcttaaaaatgtctcaacatcctcatgcatgaaggttttccaccaaagacaaaattttaaaaatgaaaaccacaaaacaacaatggcaaactcctgctgatgttgagcttactttaaaaaattataatgcatacaagggaggggaagaaagccaccattagtaagggttagcagacaaaacacatggaaaagctcataccttagaaactaaacacagtggaccaatttgagagagtatatatgtttaaaacgtttcatggtgaaaaagtagaaaccatggggcaaatgcaagataatatgacaaaaaaggcatatttcaaaataactaaatcaaaattatataattgaagaatagagctatggaaattagaagtttatcaaatggtcttaaagtgatacactcaggtcaagaatagtagtgatctgggagacagatttgagataatacggtggtttagaaaatggacttgagccagggtgactgactaggtttgaatcttgactccactatgcgtttcctgtgtgacttttagcaagcctctcaacctatctgctttggtcttctcatttgtaagatgaggtaagaaaagcacctactgcatagggctgttgtgaaaattcacctggccagcaaatctgataaactcattggagagtaagaagtgatagctgttttgggttaatatggttattactttgggcttgatattaaaatatcatgcgtacttcaacagtctggtaaggcaggcatattttagggttggggtagacatcttagattctgataaatcatccctttctggccttccacactttagtgttcattcatacaagtgacatacttcttagcttggcaacacaagattctccatggtcttacccctactgactcttcttatcttacctcctgtccccatactcaatattcaatttatttcaataatctgcctccgattccctaaacataccattctctttccagcctctatacctttgttcatgcagcttcctctgactgggtttgttcttcacttggctaacccctcttttacttaagcacaccttgaacattccctccttccccatttccccgcagtgcccctaatggacatacttctgaataacacaggtggtattccttccttgttggaacctcctggaggaagagacagatgattaacaaatccttccatcaacccctttgaccatgacatcaacagtgctccaaattatggggtaccgtattagcctatgtctatcttgatcagaatccttacctcggtgtattgaaattatctatttcgtgcctgcctctttaaagtcagggtttgccttatctattgtctaacaccatgcagtaggtaacatgcagtaggaaacatggcattaaattatttgggttcaaatcccagttatggtgtgtaaatgcctaccaggcgtgaggcacctgctaagcaggttgcacgcatcatttgaattcacaccaccctttgcaatagaacagataggcaacagaggctcatttgggctaaaggatttgatggaggggaagtgccaggattcccaccaaggcctcagggccaggtccaaggaccatgtctgttgtgacaactgagtgcattcatatcccctcctcctgtggggcaagttccctcacgtggagaagcagtaaaatacaatccatctcttggtgggctttaatgccttcctcttcacccagctgctgtgttccacctgtcagtcccacagcagctccccagccacactcaggtcccagtgttctgttacatgagtccagtcactggcattaaccagttacctgtctatcctttccaacaggaaatgaaatttaaaagagacaaggccaccctggaagagccgctgaaagctactattgatgggtcaagggggtaatttctgaaacaactgcttcagaaccaaatactgcctaaaataaatggatctacaggggctcaacctcagcttccccataagagtgttggggtgggtgtgataagggcctatttccccttctaccatactcagtcacaagaggtttcagaggttctctatagaaagccaaatgtttcttttggagaaggggctggaaattgctcccataggcagcagaaatggagggaacctactacttaaaaaaaaaaaaatactgaggcctgtttccaactgcaaatagttctctgtgctgacagactatatatatatatacacatacgcacactatatatatatatatatatatatatatatatatacacattttgtcctggtttgccttttcaaatggctttctttaccaggttggagctttagcagggaagtgtgcagtgtgggtcttataaacatgggctctaaagttactatgactctgagcttccttttgctcacctgtggatggagatatatgtatctgttactgtattaatccattttcatgctacagataaagacatacccgagactgggaagaaaaagaggtttaatggacttacattcccacatggctgaggaggcctcacaatcataggagaaggcaaggaggaacaagtcaagtcctacatggatggtggcaggcaaagagagagcttgtgcagagaaactcctgtttttaaaaccatcagatctcatgaaactcattcactatcacgtgaacaacacaagaaagacctgcccccatagttcaatcagctcccaccaggttcctcccacgtcacataggaattgtgggagacacaattcaagatgagatttgggttaagacactcaaaccatatcaattacctaaggtggttttcctagccaactagcatgtctatgggattcatgcccatgttgtgataggatagctgcttgctcggtcacaacatacagatacatcttagactcagccccctggcctgcctcttccctcgaagcttcaccatcaaggcctatgaccaggttctctagctcaggagtggtttgctccctcttgtccccactctgttacttgatttgtccttggcacatggtctatttaaatggtattgactggcctatagcttagagcttgatgcttagctagtcagaatggggtgactgagtcgttttcttgtgctttaattgtatatatttggagctatgggttgaaggtggtattgtaaggatagactggatcttgccttggctcttggcacgtggcaagctgatgaacagtcttcctaggactggggtgtctgagagcttatccatccttgtgttccagcttcaaaactggtagctggttggggtcgtaagcaacatctttctaatattgatagcaccattttctttaaaggttgtcaccttgccattatcaactactaaaacacttagagcctctctaacctcatatggaaaatagaggagtgatatgtacttgaaagggctggtgtatgaattaaataaaatataaatctcatcacagtctctagcatatataggtgctcactactggtagttctcttgaccgccccctccccaccaactcccttctgtttcccaaggggagggcagcatgatttgaggaaacagcactttaacaaggaatctaggttctagttccagctcagctccatcaccaggtcaatgacctatttaagctctgggcctcagggttttcacctgttgaaagggaggcatcaatccttgttctggctgcattacccattttgagactccaatgctgcgtgaaccagtatagtagccactacccacctatgtctattgagaatgtgaaatgtggacagtccaaagtgaggggtagcatcagtgtaaaacacactggatctcaaggccttaatatagaaaagaaaatatcttactaataatttttacattgattacatgttgaaatgatattttcatatattgaattagtaaaatacattaaaattaatttatagtacctgatcccttttaatgtggctagcagacagtttaaaattacacttctcacttacatttgtggttcacagtttatttctattagataatgctgctctcaggaaacaattgctggaaccttaggtaaatgtaacctgtttcctccttgcagcaaaaggaaatgctctcatatccattccagctttaaaattctaggaactactttttataaaaagaaatgtttctaaacactgattttgtttgtgtgtgtgtatataatgctttatgtaccctagaacttaaaatataattatatatatatatataaagattttatgtgtaagggattatcattactgattatagtctgatcattattataactagattacaaattgaccactaatatgattagagacaagcaatatctggagtaatttctcatctgtggagaaaaatattgtgggttaaaaggcgaaaaacacatagggattattattttttttttcttttgagacaagatcttattctgtcgcccaggctggagtccagtgatgtgatcatggctcgttgcagcctccatctctcagtctcaagcaatcctcccacttcagcctccaagtcgctgggaccacaggtgcaccatgtccagctaatttttgtatttagagacggggtctcaccatgtttcccaggcttgtcttgaacttttaggctcaagcaatctgccccctcggccccccaaagtgctgggattacaagcatgagccaccacactcagccaggaacaccttcctgataggagagcagggatttggatatatgcggggagcttcttgcctgctgtatatctcctgtatccctttgctggcaaccagctcttattccctttgcttacacccagtatagaagcatgcaacatgaaaatcagttccctttgaccaagcagctctctctctctaagaccggtattaatcctttttgacaagtctattcactttagggaaaggcattggcaagatgagggatatggaattctatccggaaatagagggaaaatgaccgtttatggtccatcttgattcttcaaaacctgctcaaaggggagagatttgccatcagcccccctgccatccagccatcaatggagcagaaagggtcttcctcaccatgtaggggtctttccagccggttattccagctcttggcacccaagccctcccatcattcctcatctccccatctgtgctgttaggggggcattcagcctagaggaacgaggccctgtgggtgctctgcagatggctgtgtgagcagcatagaaccccacctccatcctcccagcaaccgctgccccagcccaggcaggtgagcaaccgagcaagcttggaagtgtttgtgctcctgtttttaccatttagaatgaggagagagcttatctaccttatatcttgagtctcagattccttactcccttggtactattttcagtaattactggctaagacgaggcacatttctggactcataaataataaggcagtcacagagaaagagtgtctggctttttcccaggctgttttttccttgcctgtgtgtcttttagtttggatttaagcctatctcctcctgttgcacccacttcaaaaatggctttacagtttggcctcaaggtacttccagaaacctatggactagggtcctgctcacagggatcatggaagtctttcctagccctgggcccacagctttggttaaccttatctaaagacttgctgggactttcggacttaaaaggtctgcttggctaaagggaggggaaacggagattatacaaagtgctttaccatggggctcctccctcagtttcctgcttctccttctccacctttgcttgttgtgctctaaaacacaacatcctatttcaagcatctgtgcaaaccttactatttgctctgatgagaacaccctcccccaaccttttgtcattgttaaagacccagctcacacttcaccacttccaagaagacttccctgactccaccttctcccactgatgatcacaccttgttcctccccatgccaggtgatgcttgtttgcatgtatgttcttcctcttcttctccccattcttcttctttcctcatgcaagaaattttattgaagatcttcgtcatttcaagcaaggccctcatgtgtctcccattcaaagagaggttgaccaggaaaagcagtatggagagggctttgagagagaaaagaacagcgtgtcaagctgtgaacttcttgagatcagaagtcatgtcttctttatgcatccttatctctccaacatctagtgcagttgtttgaataaagagagaaatgaatgagtggtgaaaatcagaatacgggagccgaaagttactttagagtagctgtcctcaagctttggtgggtgttagagtcacttggagagacccgggttcgttgaatcaggctagaccctattcccctccattgttaccatcttccaggtgactctgatgcccactaaagtttgaggaccagtgatagagcagtaattcttaacctcagctgtaattggtatcacctggggaattttaaaaattactaatgcctgggtctgttctcctcctcccctcattcttattttattggtctggtgtatagcctgtgatttgagaggtttaaaaggtctccaggtgattctagtgtgcaacaaagtttgagaatcactgctttagagttcttctaggctaacctgccttgtagtttgactcttcatgatattctaacaagtgattaatacaagtataggtgcttggcactttgtcaatttctgtcctcaattttctgaggtaatgtagacaagacctgggcttggagtgagaagtccttggtttatatttaagctctgtggctaactccagattcttgaatattaagatctggattttttcccccatctgtaaaatggggagaataccagccttcaagtgttgttgtaagtacagaatgtaatgacatatgtgagacggctaagcacaagccccagaactcataaaataaatacagaaaagggtagattgatagtgatattgatatatttttaaaatatctgaatgtgttggcataactccatcacttgttccttatggacatcgggagtaacacctccctttctcatgaaataataccaattattaatagctaccatctatcgagggcttatgatatgccaagaaccatgttaagtgatttacatggattgtcacatttaatcctcataaaaattctgagatactgtgacagatttacagatgaaaaactgagccttagggaaaagtcgtattttgaatagtgacatcctgcctgcaaaagatgtgtccatgtcctaaactctggaacctgtgaatttttctttatttggaaaaggggttttgcacatgtaattaaattaaggatcttgagatgagattatccgtcattatccccagaagcctaaatgcctacaagtgtccttataagacagagacagagggagtttttagatggacccacagaggaggaagcaatgtgaaaatgaaagcagagatcacgtgatgcagccacaagctcaagaatgccagggccctcagaaactaagagacaaggaatgaattccactccagggccaccagaaagagtgtggctctgctggattttgtacttctagcctccagaaatgtgaaagaataaattgctgatgctttaagccactaagtttgtgataatttgttaaagtaacatcaggaaactaagagagatttaagcaacttgccctacgtcacaaagcagtgaacccagaattcaaacccatgttcttaatcaatatattatgttgcctttaagctgaattgaactttgtaataaaatgtcttaggttcatttattcaacaaatgtttattcagtgcctaccatggacgaggcctgtactggctgaagatacaaaaatgaaaaaggcagaaacattcttccctttggatactctacaatttagtggaagagaaaaactttagacaaggtttttcacatacacagaaatactgaaaatcatttaattccagcaatgataggtgctgcaaaggagatgaatgaaaaaataagacttatcctggaatataggatcagatccatcctaggtaggcccagctaatggctgaggtagaggtcagctcttcattccctctggcctgtttactgagggtttgagggcttacagctccactttagccctcctgagcttgcagaagttggtccacaaacagattatttggggataaagacccacaaaagaagaaaggcagtaaagaattcagcagacggcgagctctgcaacccgttgcagacattattatgaggcagtggagtgtgtgaaaacttcttttagacaaacttcgaaaatgttgtgttcctgtaccaagcaagatttcctgtagggtcatgagaagctcactaatcatctctttagttccaagctatattacttcagggaagtttctgtcaaggcttcatgcttaagtatctctttgtctgggtttattctgtcaaatgcttatttgcttaaaaaaaaaaaatgccccaagccttagttgatctagcagcttaggaagttcaaatccccgcatacctcagaggcctcctagcctctgccctaattgctgcaaataactcatgatttcattatctgtgggcccaaagtcagaccagacgaactctggccgttggactatggttgtatagaattaaaactgacttacaagatttttctatccatggtctttacttgtcttctgaactcagagacctgaattcttcccaaagatccttcctaggactctaatttcaaccccaatgtcctcaatagttacattcacttatacattcaacaggtatttatggagtaccagtcatgtggcaggcactgtgctgatacagaggtgaaaatacaaaattcctgtctcatgaacctcactttctggtggagttagcaaatccctgtgtgggaagtactattatacctgacacttcctgagcaccatttaatgtgccataaaaactctgcaaggtaggtactattatgttcatttcacaggcaggaaaacaagttcaaggtaaagtgacgcagctagtaaatggcagagccagaattcaaatccaggctttcctggctaccaagtccatgttctcagtgactatttatttctaaaataataatctgtgtgtatagggaggaaagaaggaacaggcttagaaggctttttgctggtaggatatcctttctggaaggggatattcttgattacccttaggtggtttttcttatttgtcttttttctttgattttcatactttctttaataaatatcctatactcttatagtcagataaaaaataagtagaagacataaaaattgtaaaactcatatatacccccaaagaattgaaaacaggtattcaaacaaatgcaggtacgcacatattcatagctgtattactcacaatagccaaaagatggaagcagcctaaatgtccatcagtgggatgactggtaaacaaagagtggtacagacatacaatggaatattatttggccataaaaaggaatgaagttctgatacatgccataacatggataaatctcaaaaacactatgctgagtgaaagaagccagacctaaaaggtcacgtgtatgatttcattcatgtgaaatattcagaagaggtaaatgcatagaggcagaagttgaattggttgccaggggctggctagagtgggagaagggagcaattgctttataggtacacactttccttttgggctgccagatctgttttccaattagatagaaatggtggttgtacaacattgtcagtatattaaatgccactaaattgttcactttaaaacagttaattttgtgttaagtgacttttgccaaaataaaacaaaaataagaaaactctaaataaacaaaacagtcacaatgaagagctttggtcttgctattcttctgtactgccaggtctctgagggctacaaaaatgaatttaacattgcaacgctaactgtttttacttagtgctacagccccatttccccgtaagagccctggcatgtccactaataaggtaaccccaggccattcactaaacctctctggacttcttgtgtcctcagttgtcacacaagggtaaaaatgtctacacgaagtcattcccagatcctaatatgataatgttgtgcttcgtaaaatgtaaattgacttgaatatatgtctctttatttttacatcaagaaacagtaggtgatctgaaattatctctgcttaccaagcatctgtgttaaaagaactgtgagcataaggggtgaaatcttggtaaagtgtctatttagaggccatgctttctgttgatgttgacattgctgttttttgtttgtgggggttttgtttttgtttttactttataataacatttatttatataaaaaggaatgtttgggctggggctaggagaaatgttgaggtaatggaaaactctaataatgcgatcatctattgaagacacgagctcagggaaagcctttctactggtgacaggcatttttctgctaaggattcccaataggaatcaaatactgctgaagatagtagaatcagacttttgtgctggatcgcaggtaaaccctgggtagaccttgagatactgcccttgcagtggtgctgagtaacagaaggatgctagcatcctgcatcgagtcagaggagctcactgtagcccatccctccagtccacccagactagctagacagtgccttcttagctctcagcagccctcatcctactgagagaggaatttggagaagacctggggaaaccttgaaagaccacctcagaatccagctaaacagcttgggtcctctttcccagggccagttgaggcaggagactaatagcaggaagagagatggctcccagctgttcagctcttttaaggtaaggtgggcctgatgtgtcacctgtactgtttattgcccttatccttaaataattttcttcctttaaaaacaaaacaaaacaaaacaaaaaactagctcttgcaatatctaaacatatttatttattgtagaaaatctagaaagtaaaatgaagccaaaattatgttactgctaacagatactgtttgtctttttaatgcatatatttttacagatatatttactgaaaaggaatcatattgagccattctcttttgtaaacaacatttgtcccttagaaacaaattcgcaagcatctttctgtgtcattaaatatttttaacatcatttttattggccatattaaatgttgatatggtttggctctgtgtccccacccaaatcttatcttgaattgtaatccaaattgtaatccccacgtgtcaagggagggacatggtaggaggtgattggatcatgggcgcggttttccccatgctgttcttgtgatagtgagtgagttctcatgagatgtgttggtttaaaagtgtgtggcagttcctctctctctttctctcctgtcaccttgtaaagaaagtgcttgcttctccttcaccttctgccatgattctaagtttcctgaggtttccccggccatgtggaaatgtgagtcaattaaatctcttttctttataaattatccagtctcaggtaattctttatagcagtgtgaaaatggactaatacaaatgggagctgggcgcagtggctcatgcctgtaatcccagcactttgagaggctgaggcaaatggatcacctaaggtcaggatttcgagaccaacctggccaacatggtgaaaccctgtctgtactaaaaatacaaaaattagtagggcatggtggcatgcacctgtaatcccagctacttgggaggctgaggcaggagaatcactggaacctgggagacggaggttgcagtgagccgagattgcaccactgcactccagcctgggagacagagtgagactccatctcaaaaacaaaaaacaaaaaacaaaaaaaacaaaaacaaatgtgttccattgtagaggtattcagtaatttactgaacctattatcacctattgttgaaaagttagaattattctagctttgtgttataaatagtagggtgatgataaatgccttaaagggcccaggacagtacctggcctcatggaggtacctactacacagtgttctcttaaatctctctgcatatttacatccctagcaacagtgcaggagaatgtcctattctactactacttaccttcactcaaactaagtattgtcattttcttggttgttgtcaattttaaaagcaaaaaaatggtatgtcattgttattttaaattccatttctttgataactaaggttgaattttttatgtttagtagccagtttatctctaacatattaatttttctcattctactattaagatactgatcttttgtttgaaatctgcattttttctagtttaacttttaattttgtttgcatgtatattttaacatggaaaaattttatttttatgaaattgaatctatcaatctttggtgtcatgcttagaaaagccttccattctccaagatgatcaaaacagtcacttatattttctttaaggtgttataagtaatcacttccttttcagtctgaatcaaattgagcaatatttccacccctaggaagggcagcagattagtctggtgccagagacaacttttctccacaacctagactcagggaatctccaagttgaatgacctctagaagtcgtataatgtgagctcctggctgataacgtgattcccgtcttccagaagcctgataagtggtggttcctcgcttctgtactactggtgggagtataaactagtacaaccactatggaaaaaacagcatggagattccttaaaaaactaaaaatagaactaccatttgatccagcaatcccattacccagaggaaaagaagtcattatacaaaaaggatacttacacacacatatttatagcagcacaatttgctgttgcaaaaaatgtggtatcagtccaaatgcccatcaatcaatgagtgtataaagaaattgtgagatatatatatatgtatatatacatacacatatacacacatatgtacatatatatatacacacatatacacatatatatatgatagaatacttctcagccataaaaaggaatgaattaatgacatttgaagcaacctggatggaaatggggactgttattcaaagtgaagtaacacaggaatggaaaactaaaccttgtatgttctcactcataagtgggagctaagctatgagaatgcaaaggcataagaatgatacaatggactctggagacttgggggaaagggtgggaggtgggtgagggataaaagactactaattgggttcaatgtttactgcttaggtgatgggtgcaccaaaatatctcaaatcaccactaaagcacttactcatgtaaccaaataccacctgttcccccaaaaggtatggaaataattttttaagtggcgtttccttctagctcaacactttcttaagtgacattacacaagaataacctattcttctttttgagaaactctaaaattaggtaggcctttcttatgttgagccaacttgtcttcattctcactcttctgtgttttattccctcttctgctcagaaagtggctgggggctgttctctggactttgcagtaagattggcctgagtttctaatcttatactcagtagctgtatggctttgggtaaattacttgatcactttgagctatagttttatcatctatgaaatgggggttcaaaaattactattattacacattctaactttgagacagacaaagctaaatgctggagcaagtgggcatcaatgctattttatttagcagttatgtgtggtcattttagacttgattatgactcaagttttcctttagttctatgcttctaaactgtgtatgctgtattcaaagcagtatcttgtagtataatttatgcttaataaagaaagccaaaatatatctgtactagtccattttcacgctgctataaagaactgccctgggcttggtaatttataaagaaaggaggtttaattgactcacggttccacatggctgcggaggcctcagaaagtttacaatcatggctgaaggggaagcaggcatgtcttacatggcggcatgtgagagagagtgtgtgaacgggaaactgtcaaacacttataaaaccatcagatctcatgagaactccttcattatcagaagaacagcatggggaacctctcccatgatccaatcacctgccactgggtccctccctcaacacatggggattatggggattacaattccagatgacatttgggtggggaccccaaccatatcaatatctctagataaaattgtaaatactttgaaaagaagcaagaaggatcaaaatcagtgtcataatatattaataccaacaatctgttatgaaacttattgttacatagatgtgtcctcattagttccagtgttcctttgaactttggataaaatgacaaatagcctttcagaccttgtctgtttttaggtagaggacctggtatatggacacctaaacctcatgaggttgatttgagaattacaggagatcatgcagagctctgatagtgcattttcattatgatgttattgcccacagaatctcttctttctctgactaaagtttccattcatttcattatccccttcctagcttgttttccagatccttccctcataaaaggtgggctcctggagtgagcacagaatactttgtgctgccacttcattttgcactttttttctgctaattcattttatgcttttatttctcaacctaaattatctgctgctccataacatcaacttattaacttattgttgacttttaatcaatggcaattaactaaatctcctgtgagtttcttgcggtttttaccattcacttgcatctcccttttctcatactcattgtttaattctcatctctcattgtataatcggtgttttgtgtcccagcactcactagaagctattcctattatatttcaacatgttagatttgtcatattatttgatgctatcattttgcatgctcataacatcccaactttgtgtatgatattaatttcgttctttttctttttttttttttgaaagagtctcactctgttgccaggctggaatgcagtggcttggtctcagctcactgcaatctctgcctcccaggttcaagtgattctcctgcctcagcctcctgagtatctgggattacaggcacctgccaccacatccagctaatttttgtatttttagtagagatagggtttcaccatgttggccaggatagtcttgatctcctgacctcatgatcttcctgcctcggcctcccaaaatgctgggattacaggtgtgagccactgcgcctggccttaatttagttcctatctaagatgttgatatggctgttggcaggaaaacaatgtagacagagcctctatcatgattataccttgtcttgttgccagtgtggagaactgcctctcttctcttacaaatgcatgtagtttagattttttaaaaaaattcttttcactgatttcagcatcttcctgtttctctgaactttaaggtcagcattcccattttgtcacattaattcactcaacaagcatttgatgagctatgtgccagttactgtggtaggtgcataaataagtaatatgcatctgtcctcaagatgctcacagtctagtggaagaaacagatcaaatgaattgggcacataataggtttggggaagtttgggtaagactttgtggaggtgacatttgagttgggtattacaggatgcatgggcgtttgctaaataggaagcagatcaaggacacatctggccatgacccacatctcctctctttagcccacatgaatgccaatattgcatgcatattttctctcacagttgctgctgtttttctgaaagcagtgttttctcattcacaattagatttttgttcttggcattctagaagatgcaattgccatccagaaatgctaagaagaaaaaatatgcaccattctaagaggacttaaaaaaaattttttagatacatagtaggtgtatatatttatggagtttttgagatattttggtacaggtgtgcaatgcataataatcataccatggaaaattggttatctattcccttaagcatttatcctttgtgttacaaataatccagttatactcttttagttatttaaaatgtacagttaaattattattgcctataatacccctgttgtgctatcaatactaagtcttattcattgttttaaaaatatggaacacttcatgaatttgcctgtcatctttgcccaggggccatgctaatcttctctttattgttctgattttagtatatgtgctgccaaaacaagccccagaggaatttttaaggtgtattcagatcattgaacatcctatatcactcttatgtcttgtttcagtactagttttatgatcattaattatcgtatatttatattaataaaaataatatttgttaacatttatagagtaccttccacatgctgggtggaaggtacttaacctaccatccttctgtgaatagtacctgtgaatcatacctgtgaatggtaccttgcatatattatctccttctaccattaacaaagaagaaatctgagctcagagaggttgagtaacctcaggtcatgtaactaatcaagcagcaaaacagatttgaacattggtttctctgtctcctaagcctgaccatttacattttcttattctaccccattggtcaatataccctctgactctcttccttggtctttacccattgattctcctcgtaattgcccttcgtattagtctgctagggctgccataacaaagtaccacatgctgtgtgacttaaacaacagaaatgtattgtattacagttctggaggctggaaagtccaagatcaaggtccagcaggaatcagtttctggtaagggctctctttctgccttacagatggccactggcgtcttgctctgcccttacatggcagagagagacagactgacagagagagaggtccttatatttttatgaggccaccaatcttatcagattaagaccccaccctgattacctcattaaatgtcatctcctaaaaaccctgtctccaaatacagtcacatcggggttagggcttcaaccctaactccaatataaattttggaggaacacagttcagtccattgtacctttcttaaaacatcacatgtattttcatttctccatggttttgcttatgctgttttcccagcataagctttctgtcttttaaaatctttccaattattcattacccaactcaaatgtcatttcccatgaagccttctctggttttccagtcaaatttagttgccctttcacctactcaataatgatttttttgactgtattttgattgagcccctattttacccaaactacattatatacttaagctccttgaagttagggactctgccttaatatgctcccagtttgctcccaattttattggtactccataacatttatgacttgagtttttcattagctctaaagaatgatggaggcaattgggtgggtgtaggctagataagagaaatgcttgtgcccatctccaagtgttggaagtgatgccttacagaagacagaaaaaatgttgcttgaggggtttagactgagaccaccaggtaaaagttacaaagaagcacacttctgcccagtttatggaagaactttttaataaataacaaaaaggtgaaggaaactaacactcattgataatcagttgctaaactgctgctttacaatttccacttccacatggtcctataaaatagttcccatcttttatagatgagaaaaccacatttccaaaaagtgtaaagatctgatataagatcatgtagcctacctccgtcactcattccttcatggagaagtaatctccctttctctagaggaattgaagccatctgcatgaccagttttcaggaatgctatatcgagaatgctctgggggtgttggtataactaatattttagttttctttcatctctaaagtcttctgactcaggaattctctatccctgacatagacttaatggaaatagacctataaaacctaacttctcccatccctttgtgggtaatatatattagaaaacttatatttagattattacaaattatctttacattgtttcatgtatgttggtccagtgaattaggggtgtgtgtgtgtatgtatgtgtgtgtacatatgtatgtgtgttttgagacaggatctcactcttcgcccagacatgatcacagctcactgcagcctcaatttcctggcctcaatcgatcttcccacttcagcctcctgagtagctgggattccaggcacacaccaccatgcctgcctaatttttgtagagacagagttttgccatgtttcccaggctggtcctgaactcttggacttgagcaacccgcccgcctctgcctcccaaaatgctgggattataggcatgagccaccacgcccagcttctgtcagttagtatttatgaagctgtttggaggacacagcttggaaatatccatactaacaaaattgacttggttctgaccagtagaggctgtatttttcaaccaaaggctacactgtctggggaagaaaatggtaatatgcatgagttgtccacgactgtagaagtcagatggatgaggtacttagccttgctatcctgagtacattccatgctgaaggtgggtcccagcagcctgagccccccagggtcagcttctggggcaggcagccaatgttctgatgtagctgccatttttcttggatgattcatgtgtgaaaatgtctcccccaaaagaatttgggtcatcttgttctttttcccaaagccaggctcttatcagaccagaagagtctcttcatacaaatggatcccagttgggaagtttatgaatgttaaggatagttgctcattccaaaatacataaccctttttgtctgtggcatcttatatttgactatattgctttttctactcaacagaattggatcttagaatcctggagctggtgtatgtgtgacttcagagataacttaaaaatgatcacgtatttctgtcttctaaattcagatggtttaactcattatttcttttttcttgtgaaggcatagccttgaatttgaacacagcttttgcttttgtgtgtgtgtgtttgtgtgtgcgtgtgcatgcactataacattttggcttgtgctatgaaactctttttttttttctggtcagaagaaagatgacaacactgaatcaactgccagtaacatccaaaaccagttcaatattaccccctggtttcttttcctaggaaaaatatcacaggtatcttcctcctcttccattttcattatacaaaatatggccgggcgcggtggctcatgcctgtaatcccagcactttgggaggctgaggcgggcggatcatgaggtcaggagatcgagaccatcctggctaccacagtgaaaccccgtctctactaaacataaaaaaattagccgggcatggtggtgggtgcctgtagtcccagctactcaggaggctgaggcaggagaatggtgtgaacccgggaggaggagcttgcagtgagccgagattgtgccactgcagtccagcccagttggcaaagtgagactccgtctcaaaaaaaaaaaaaaaaaaaaaaatgcaaaaagcaaaatatgttgttcctgcatggagattgggggaggaagagaattatattttgcagtgtcttgcaaggaataaataccatcaaaacacttgaatatgaagttgacactactttggaataatgtagcccattgtgcctgaagcttaacagacatgacccaaagaaaagaatggttcacacaatatcaagagtactttgtggcagaggtgggaccagactccatcccctggtcctcactgcacagccttataacatcatagcttctcaaaagtatcctaagattgcaatggagaccagaccaagcagtcagccccatcagagcttggaggatgctatcagggaagtgtatgtttgtttcttcttaatcacagtcctattgtaagcctcaaggatttaggacccacaaaaggaaattctcaatttccactgctttttgtactcaacttttaaagtcaaagatggaaaaggtaagaaaataaacaagagactttttttaaaaaacaatattctgtatgacaccacttatatgaggtacctagagtagtgaaattgatagacagaaagtaagatggtggttgccagggattgggaggaaaggagaatggggagttagtctttagtgggcacgaggtttcagtttgagaagatgaaaaaagttttgggatggatggtggtgatggttgcataacaatatgattgtacttaatgccactgagctaaacacttaaaaataattaaaattgtacgttttgtcacgtatattttaccacagttttcagaaagtgcaacgtccttggtataatctggaatctccatacccctatgcacatgcatccccagaaacaggatatcgtattctaaagaatgataataacaaatttatgctatttttaattcaccttaattttgttgttttcaaaataattgcatatacgtggttgcatctgacagtcaccaaaactgggagaaaagcataactgatcttttatttcacagatgagtaaactgaggctcagagttacactgctgacaagtaacagagtggtactagaacccaggacttctgacatgtattcctggagccatgcatgatcctgtgtaaaagttctaagttgatacttaacatattttacttactaatcttagaaaagagactaacacattttaaaaggattttcaaaaacttgaagtggtttagaggttttaagcatgaaaataagttaacttagttacctcattgtctagacatcctgattaatggaggttttactatatagtaataataatgacaaacccttatatagaacttcactgtgcaccaggtactgttctaagtaccttaagaacactaactcatttatcaaaatgtactatttgtatttaaaatgtataatgaaatttattgagacttgcatgtgccaaacactttcctaagtgctttatacactttatctcatttaatccgtgtaacagtctgaagcaacaggtaatactagagcttggagatgtgaaataatttgctcaaggatacatgagaacaagtgacacagccaggactcaaacccaggtccacccatctctttactgtgattcagatggtgtcgtgtgtgtctttctattcactgttatctctaaatgttagttacgtcattcaggcagctggagcagtgtccaagtagggatgctggttggctcatagtttacttcttgaagacttctaattttaccctgaaattctggctggaaatttgattccattgctgaaaatggaagaaatacagctttcatgttcatgcacaatttgctttttcatttttttttttttttattatcctgagacttactgtaaatcacactttcccatcagtcctgggggttctgattatgttcatggggtctagctaagagcaagggcagtaaattactgccactttgtttgaaaatttttttagccacagtacattagctgcttttgtttgcttttccactggtggtgtgcccatttttatttcagaatttttgtttcttgaatgtctcatttgtgaataatgtagcttccaaaatggaatgattggagaaaaaatatgaacgagggtgtcttgtttggcacctgtaagttttttaagcatttatagcaaaaatgaattattgagtcccccctctttctctctcatactctctctcactcactcatctgcattctctttccttcctattctctccattctactccatttcccaaaaaacaattgctagataatgaccattatggtggctaatatcaggtaactaccaagaagtgccttcttccaggcttctgtaagtattcttgtttatttgaaagattgatagatcagagggtcaggggatgtgttttattgtaagtttctgttccaaatttcctgacattttccattaaaatatataaataaataagccttttaaaaggaagaaatggaactaataagaaccagaccctaaagtgatggtcaaaatgtcaaaaataactgcttttcctttattcagtatcattaatctcgaggtagatacctacctttccatagactctccctaatagcttgacctgattctcttgctgggctattcacaaatagagtgacttctaaagtgacaccaaaatcctcagtagctcttcaggaattggtgtgggagttcagtggcaatattttcatatgtttttcaaatcacatcttttggtaaagtgatgagaaaggaggctgtggcacacactagcagtccagagcacaaggccccctcatgagtctccatcatcataatgtttgtgagatcatcctaaaggtgctagaaaatagtgatgcttgtgtgcaacctagatgaatttgaaaattaactgattttcctcaagtttgtcagagtttctaaagtggctttggaaagggttccattgcacacgaagaggaagcttaagttagacaatgtttgtccttatcaataatccatacaaaaattgtttatttcattttcttggactttatatgcgatacctttcagggaggctgcctacctcataatagccctctgttgtctgatagctgctttcacgacccatcatgaggggccttcagcagccatgtttgaatttataaccctgtccttctggtgagagttgattggaccagggagaggacacctggcccaggttacgccagagtctctttcccaggaatttgcaattggaactcagaggtagcctgttagtgtttgtcagttgctgttagtgccaagagatcaatctgggggccatagagtgttgatcttctactgtgtgcatagaaaagccaagaaagctggttttcaaagagagatttaagcagattcataaagagaattagagtctgggggtggagggagattcctgatctggttcccggcagctttccagttcttggttctcgttcctcccgaaacctggccagacatcttgccagagtttcacaagaaacccttgcatcctgtgttaaattccccatccacctcgtctgcttttcctcaccctcttacactggcttgagttagttcctgttgcatgtaatcaaagagtcttaacaaagacagattgatacctctctggtgtgtatttgattatagagatggccaagtaaacacatagatggatgttcatacttgccctttggtaccctagaaggtttgagttgggaacaaacctcagagatctcctagccttatcctcacattagacagatatggaaactgaagactatagacaggtaaaataagtgatttacccagggtcacacagctaggactcgatccctagccttctggtcctcaggccagccaatgttctttctaggctggctccctagtgccatccatccatccatccacccatccatccagtaaatataaactgagcaagattctgctacatgacaggtactggggtacatgttttttgtcctcaacaaactcacagtgtggaaggaccaaagttctttatgtttatttttacttcattccctggggtttcccatctggagggcactttactaactttgctagcccacgatcacagcgagttcatccaggagtctcccagaatatactcccatcatgtattctctgtgcctcttgggtctattctttcctaatatttgtgataatccatgttcatattgaatctcccctgggagatccttgaaaccagggactgtgtgtaagtcattgcttttacttcctagcacggaatctgtcacaagatacttctccaataaatgtctgcttttctagagaatttacttcactccttagaatctcaagtgagagctgtgtatcagttagctcctgctaggtaacaaaccacaacaaacatagtagcttccagcaacaatcatgtattattattctctctcctggttctgagagttgactgggatcagctagatgattcttgtgcagagtctctcatgtggttgcagtcagatggtggctgggtctagggtcatcttaaagactttgtcattcacatgtctggtgtctcgactgagaagacaaaaacagctggagtctggaacagctggggctgtttcacacacaagtgttgtttgcacaagagatgtccaagagcttctctttattctctccaagcactctccatgtggtggcctcagggtaactggtgactgaaggctcccagagggattgcctcaagtttttttaaacctgactctgaagtctctcacacagtgtcacttctgcaacattctgttctcagaggtcctgccacatgcaagaaagacacgatcacagaggtcctgccaggtgcaaggaaagggcacacagactccaccttctcatagaaggagcatcaaacaatttgcagatagttttctacatctctgcttgatatgtcttcctgcatgagaaatatgaaaaaatgaacacttttcagggagctttcatttcagctggaagccatgattttcagacaactgatagtttctggcttcactgacagctacatccattgcaactagtttgctagcccgagctgcagttactcacagaatttgctaactatggactttagtggcctaggagttagcatgggcaggcaaggtggatcagggccttgttttatcatgcaattcttgtgtgctgggaactggctaggctctatggttaataagaccgtgatgaaaagatgccttggggttcctcaatgtagtcatatatgagtggttctgtttttagttgtcaccatgatgagggtgtgcagttgacatttattgaataggggtttaggatgttaaacacgctaccatgtgctagcaatcctgctggaggaggaactttcctaccaaaaatgctaataatttctgacctaatgtcagaaacacagtgaagtggggaagctgtgagaagtgcactgtggagtcctcagcagatatgcatggtacatgtcaccaagggtggcatctggtttgtgtgccacactctccccaaaacaactgcacagcttctgcccttcctctcccctctgcagccttgctctccatcaaggcccaatgcaagcaccccctactctctcacaccttccctgatttctagagctggacaggttcaccccctcctgagcataaaacagccctttccttacctctttccttgttctgattattttcatatgtttcttttgtatcactgttttgcgaggccaaggagagatgggacaggtcccccctccatgtccgcacaagtatttaataagtatttgcttatttatcttctgtttcccctctcctgtctactcctcgcctcccctaaatgcctgcacattccagcaagaggacaggaagtctggggtttctccgcctctccactccacactgggtcttgcccactctgcctgataaaagtcagggaaccatctggcctctctgccaccacctcagtaaccttggccagcctgttttgatctcagcctccctttctccaccctatcttgtgaatgccttcaacactcagcatcttgaccacacacttggcttttgctctcactctgacttgtacttccaaattagatccctagaatagctctgctttccttccagatcttaaggggctcctgaaggacagaggccgcatcacctctttttaaaaaaattccaccgattgcaaggtgttacctcctttggaaacccttctctgacacctctggcctggaaaatgggttaagtttcccctttctagggttctttaccaccctgaacatacccagatcacactttatcatgattatctctttacctgcatgactgtgtagccaggatgagtgatctttgagtgcaggctcttaggtttttgtttatctatttataatagatagcaaaataaaaatagatccgttcatctcttcatctagcattttacacgtctatctttagcaagcctgtgatcagtttaaggagccacagcaaatgaaaaaggcatggtcccatcctcaaagttcacggccttgtgtgttgaattgatttttgtctcttgctacaaagaaaatagtagctccttcagtcttcatctccagatttctcagtgcttttctgttttcttgaaaagcagtagagcagataatttctaattgttgaggaatctggttcaaaatttcaaggcaaaaccgccccattcatgagagagaacattcaagtgacagggccttcaccattgcactgccctgctaacaggagaccttgagttgtggtcaagtcagcagattcttttaaattttgaaatacagatcttgcataatgaatggagaaagggagaaagaatggcttgtgtgcccttttgtgctccttgaagtttacattctgggaaaacatgaaactggagtgtcagccttggtggaactgagttggaatgctgactggcacacaaagggattctggtcctgtttaaccaagatgtgactttagaatactgagattgtatgactttatggatccccagaggaatagaaattcatgggccagaatgacaaacttttattttgaaagccacctaggctccacttagagccatcaaatgcttgagaatttattatgactgggcaagccactgcctaagagtcaggccagggtagtgaaaatacacacggactttgtctttgaatgacctgaatgtggcctagttcttcctagcacagggctctctaccagagctgaaagcacaactgttgcatttgcatgacatagaagcagccaaaagcttccacagtgaggatcatgtgtcgtgttgatgctgaggcatctcctgtgcatggtactgaaatcacagagatgacttatgatgtgttctgtttgtgttggcccaaagcccaaaccagaaatgtatttcaggcttggctttctagattctatctccagtcatgtaaaagttcattacgtggacccactcatcctgtcctgctatagttaaggtctgtcagcatttttcaaaggtttataattcaaccacaaaggagaatgcagtctttaggctgcaatgtgacctataaagcttaagccccggggtcagaaactttgcttttttgttgttgtttttaagttaggcccttactaagttatagtgaagcaaagtaatagctggtggttttgttattattatttggtttggttttacagggatgggaaaagcttcaagtgacttcttggaatgtagatgtaccctaaacctaaagagttgttaggactatagatttacttatcatcctagcattcagctaaagatgggggtttagtttttaaaaatttagcattttaaaattgggatggatgaggctgagaaagttagaaacaagattgggaatatttcaccaaaactcaaggaccaattctcaagccagaaactttgtattcaaaattctagttaaaagactttggtcatattatataaaaatcaagtcatttccctgatggttaagtttgtttctgctcataaattctaagtattcccacttagaaatttaagtgaaaagtgcacatatgataaatataaagtaacaaaatgataccttctcataataaaaacacttgaaaatttgaggtaaaatagatacaaaaatacactttctatgtctgttcagctgctataataaactaccatagactgggtggcttataaaacaacagaaacttatttcttacagttctggaggctggaagttcaagatcaggacaccagcatggtcaggttctccctgttgagggctcatttcctggttcacagacagctgtcttctcattgtgtcctcacatggtaggagaggcaggggatgtccctggggtctattttataaggggactaatcccattcgtgaaggtaccatcctcatgacctaatcacttcccaaggccccacctcttcaccctgagcattcaacatatacattttagggggccacaaacattcagaccatatatccacaaaagcttataatcagcaaaaggtctcttagagtaacctaatttgtggttactaaggatcccattaaataacctgctcctggggtaaaaataaagactggtaaaaatcatagcacctttggtgtgggaaggaggttttatctggatggtctcaagtcaattaatagtgggaaaagttcttaatgacagtatgttataaaatgcagattggcagtagggacaggagaagagtgtcaatggaactgagttccagtccaacctgtgtacagtctagctatgctaagacctctataaaccttggtatcttccttaaaatggggctggaaaatcctatgtatatatacagggttctggtgatgacaaaatgcaataatacatgtaaaatgcctgatagaatcagtgcctaatatatgtttttcccttcttctcccacctttattaattatacctgagacataaaacaatctaaatgctggagaccagccactctaatttggtagagatcttttcttaaaaggaaaaagtagtttccctgagcttttaagagtgcatttacatacaatttgtctatttgtaaaaaagacctattcattaaaataagcctctaagtagcaaagtgcaagttttcttaaactcctttgagtggcaccacatgctaactgggcttcctaaggaaagaactataaaggtggctgtctttccccattaaccctgatttatagggggttttgctctaagtgcatatttgcagaaccattcttaatgtgtgtgtgttctctccccaaaaaggaggcacattattggccatttgttgtctttggtccagtggatactctttaaacccactcttactactctgtagtcaatagcccaagctcagcttgatgcattagtccttgtgttttcaagaaaatgtgttcggccagcacccagcccagcacagcacttcttttcttttcacttttaaccatcatatcccctggtttccagcaggttcattcacccagaaaatgtttatcttcattgtgccacctcggtacttaacctggggcagaggtttggatactggggagtgcaagaggaagggttgggttggaggtgcggtttcactctttatcagttatgtgaccttaggcaacacacttaatgtctcagcattggtttcttcttgtaaacaagggattgtagtggagaatactcctgaggatttttgaggaataagttaattacagggtttaacaggaagccaggcaagaatcaggggtcaggaaatggtagtgatagttactgtagccaggtgttctcttattcactacacaggagaatcatttggagaagggcttttaaaaatgctcatgtctggattccatcctcgaacaattaaattagaatctctaagggtgggacccaggtatcagtatttttttctggaatacttttgatattccagagatggattaaatcctttaacccccacaacatccctaatgggtaggtatcattattagcccatttcacatttgaggaaactgaggcttagagaggttaaatcacagcaagtaaaaggtgatgctcagatatgaagccaagcagtctagctccagagcccatgctcttggttggtgtgacgcagtctattattataagcagtgcctccagtgagatgtccggtgagaactaagatccagcaggtggggtcatccgatggtttcggtcccttcataccttcaggttacccacctcctgcttttaccttcagctctgtgtgttcaggacttcccagcagccctgtatcagataatgaactgtggttattcagaagtcccccgctattttcggctgattttattaaactcagcttgtggcttgaactcaagaatgtgcaagctgatttagattatgctttgcattgagtttattaagataaaaaatatttcccgagatagtgagtcagaagtatttatggtgaagtgtgctgaaagtgaatgcaggttgatagcgtgaacagaatgttctctccaagtcaaatgcgatgacctaactgtgtttggcagccttcctttatgtttagctaagcatttcatttcatgttgggaacctcctccctcttctgaaaagcatcagtcatgtgggaggctaggattttggcatgtgcctcttttgataccaagacccaggccctaaacctaattgtgactggctcctcggctgactggctgggttgccatggcaatggactgctcaactctttatatctcagtttctctcacctgtcaaaatgggaatataacacttggccccaccttcctccctgaggagagatgggggcactttgaaaattaagtaataaatgttgggaaggatttgtggatttgtggatgtgacatcttgtcaagtgggtaaataataaatggggtgtctccaaagctaatttgcctaaaattcacttgagccttccatttacttcatcaaccagcgtttattaaatgcctatgaagttcacaataacacatgaagtgctgaggggaatacaaaaaatgtaaaaaggaggaaatagagtctcaattcccagagaggtcataaaataacttttttcttgcagtttgctttttctggttcattaagcctcagtacagaccatgcctgcactgtatttaaaaagctcattctcaatgatgacttccagttacgtcataagcaactagtggtgatttagttgttttcagtaccagtgggtattgtcacatgcttgatggactcataaaaaggcaagaatattttttagttcaggttatgagtggtgcaaaggacaatgaaagactacaggttggattgattgggaatctgattgcatcagaacataatatggtctctgctgttcaaaggcgtgggtttgggtcctggctctgccgctttctggctgtgtgactttgggaaattccttaacttctctgtgtctcagtttccttatctctaaaatgtggtcagttttagagtctacctcataggattgttgtcaagtttaaattaaagtgtgtaagatgctcagaatagtgcctggcattttgtaaatgctcagaaaaatgttagctatgatcatcactttccattgttaatgggagaagatggtggcactaaaaggatactggcatttcattttcctacattgtaaaggtaacaaatcctttttaattcagagtcctaaacttttgcccagatctgacacaatcgcttgggattgccccaaagccccaaactgcttgttcggaaatagaaaacatgccatccaagccactctgctctctgactcataccgttcagggcctgagctaacccattttgttctgaaagccttacaccagtctaggaccctgagggctgggaaagggcagctatggagtgtgatggaaacagcgctgggcttggtgtccaaatcctggctttgccttttattagctgtgaactctgggataggctgttaagtcctctgaactgcggtttacccatcctaattgtgcaaaagcaatggtgggtgaaactgctcaaacaaattcagacaatggcaccaacggtaccaaactagtggtcactgtacattccactgccatatacttgtagttgaaaagaaaaaaaaagccaattgcacttaagaatatcttccatggagcagtaaaaattattaattgtattaaatcttgacccttgaatacatagatttttaatatttcatatggcagatgggcagtatacgtaaagtactcctgccaagtactatgactgtctcaaagaaaagcatttgagttctgagctgaactagccacttttactttaaagaatgaccgacagaaaaattatggttagttattcttgaatattctttaaaatgaggaaaatgaacctgccgcttgaaggaaacagtagtattaattgccaataataaaatttgaactttccagaaaaagttagaattttgcgaaacttttagccaccatcacgagcttgacaacttcttcccaatcataactgatggcactggtggtgatattaatgcatttgaattttctatattagataagtaagggtgtccacattttgaaaacgaacgtaactcagtaaaccagtgttctctaaacaggcaatgcatgatgttacaaaatcgtatgtaggtagaataaccattcaaagtacaagataaatcaatccattataatttaatagattatgaaaagtttattgatatgatttcagatttcacattgcaaccaacgtttaagaaactaccacctatcgaattttggtgtagtatcaaagaagaatatcctaaattatctgaaagactattaaaaacccttcccttttccaactgtgcgaagccagattttcttcaactaaaacaacatacctcaacagattgaatgctgaaacaggaggcttcagctgtctggttttaagacaataatagatattcaataataaaaaaaaaatgccacttttctcactatttttggtatacgcgtgtggaaaatattattttactaaatattttattaaaatatttatgttaagcaatgggattgtttttatttttaaataggttaataaacaaatattttaaaactttctcccctcagtggcatcaatattttaaggattatctaggagtcctgagaccaaagaatttgagaacttctatcctacagcatggactctggagccaaaataatttgtttaaaatctcacttctacttactgtctgtgtgatcttggacaactttcttaccctctctgtgccttaccctctctgttttccatgtgtaaaatgttcataacaataactgtcatgatgataaataccatttaggtgttaggtattaccaccatcattatgaaatcattattgttgtcagtgtcatcatcatcattattactagtattagcactggaaggcatcatttgttcagggacacagagctagaggtggattcagtgggactggaacttttcccttaagccagactataccctacctcccacttaccatctgccatcttgacatttgcagtctagggaagaagggaaaaaaagatgagaaatcttccatagctcaagcacatatcatcagagctactgaatcaaaccattgaaaaaggtacaaacagccaggtttacacataaaagccagattgctttgtctggcattcaagctcactggacacctgctgcctgtcatccagttgttctgcagctgcccatatagaaacacaaactgtctcagaagaagcagacccaaccccaaaggcccagattatgaatccaaagcccagggaggtgaagtgatggtctgacacacatcgctagagagtggcagaactgctacttgagtctagtgtgaattccctctggactggacacctttgctgggatgcccaggtgttctcgttctgcttactaagtaagcagctacagatggccaacaaatttgaaacttcttcttcgtcagtgaaaagttaaaaccaaattccctgtttgtggcaaggctcctttgttcagtaaacacaaagatctatttacatttcttttgttctctctggaaacacactgcttgggtcatctactacactgatttcaaggtgccctgcaaccctcatgttgtttttagatagatattttatagagcagatcaggtgaggtgcctggcctctggagggaaaccagaaagaacatcagccagcacccatggctaaagcttaggcccattaaccagacagtcttggctgaagttaggggaagagcacaaccctgtgggtatatgtgtgtccacggcccaccttggtttagggagatattccaactctccatgggtctcatggtaccaaatctcagccctcaatgggtctcatggtaccaaagcagactggtggagtgaaaagatttgggcttggcagccagagagatgtaaattggacctcagttctgccacaaggcctccggcaagtcactaaaccactctgatcctaggtttcctcattgtaaaacagtgataatgacttctcccttgcaaagttagcatacaggtgaatactaaagtaaagccctagcatatagtaggatttcaaaatagtccattattggtccagaactggccagctgcctcaaatggactttctttaggtgcttggctgagcctgaggattaaaggccattagtgatggaagctttgggcagtttcctgagtaaccatggggcaagtctgctaatctctgagacatgacttcctcatctgcactggaaatcatagtaattaatgtgcctttcttacttctctagattgttagaggataacaggagacagaggctgtgaaaacattttgtcatgtgaaaagtggtatacagaagttattgttataaaaacaatagtaacaacattaattaacatttttgagtgcttactttttgccaaacactggttgaagtgcttcccagatgtcactcactttcattttaatcctcttctaacagttccctcagatggagccctgtttattattttggtttttccgttggttaaactgaggtacaaagaggttaagtaacttgcccaaagtcacacagataggcaaggggctgacctgaattcaaacccagccaatcaaattccagaacctgtccaatgcagtattaatcactatgcttatagtggcattgttatgtgattgctatctctaagtttctctccacaaagggtacatagttatctattctcaatgaatgatatggggctataaaggcatgataatggctccatagagccatctgctaattagtctccctcctttctgggcatacctcaaacatcttaggaacatatgtgcttatatccatgagcaaacacattcgtggattgagtatagatgtatatagattggagaaacatgcccaaagatagagatcaaaatataaatgttaggaagcaaagcattagcaagatcatttatgggctcatgaatctgttgtgaaggataattattcattggcttaagtgagatggaaagtgtcattatggtaatgcagtagtcatgcttaatctgtttcctactgcacatgtgataaatgccattcatatgtgagacacactcctgtgaggctgcccagacattaacaatgttccttctgaatttggggggacggaaattaaagcaaataatgaatcaattatttttagcatttatgaactcattttacagacatttgggcaattaaattacccggttaaatagctcagaaaaatgttacttttcaataaacttccattaaattcaacaaatttgtggcgttctacctgtgctgtccagtacagtagccactagccacatgtggctatttaaatttaaaaattcagttttcagttgctccagccatgtttcatgcattcagtaagccctgtgtgactagtggctatcaatcagacagtgcagattatagaacatttccatcattgcagaaagttctggtggataacactgctagacagtagtatacactgaggatgcagtgatgaccagaacattcccatccctgcccttatggggctgatagctctgctgaacaagttaccccagacttggacctacggaaggacataggacaatgagaaagtatggcaggggatctatccaagaaggggtgcttaggaaaaatgaaaccaaagaaagctccctacccatgaataacagagcacgtttttaaaagaaatcaaacttaattaaaaataaataaataattttatctgcaattggattctacaactaatattaatattgatgtttaaatacttgattgaagaataagcttaaataaaacttattttgttattaaaattcatagtgcaataaatcttaagaggagccaaagcaaaatatacatgcagcatgattccatttatatgaagttctgaaacaggcaaaattaacctatggtaatagaaattagaaccttagttgcttcaaggtggggtgggagggagtggttgggagcagggaccaactacaaaagattgtgggggtactttctgggttgttgatgttctatcaagatagggacatttgttacatgagtatatgcatttgcctgtactcatagaactgtataactaagatctgtatattgcacagtattgtatatgaattaatctatatatatgtgatcaaaataattacatattgtaacatgttatggttgatatcagtaatattatggaaatgtccattgctttattactctgtctgcctctgacctggccttcataaccttatattgtcagtaacatgaaagtttcaggcatcctttctgatcttgtgccatgtggatatgaatgtgttgctcctacttttccaatttttgatgctttctttcttatcaaaagtgagcaaactggaaggatgtttgccaggatgttaaaaatggtgttatttttgggtggggagatttgaggtgaactttattttctctcttttgctatgctggaatttggaacaaggagtgtatatgattttttgatctgaagcacaaaagcttatccatgtagtcttttggagactttgggttctatactctgattagtgacaaattttcttccaagcagcaggctctatgggtggttatttagcagtcctctggtcttaatcaatgtgattgtttctttccttgtctgtctcacctgcctctcctgctcagcctctctgtgatcccaagggtacactggaggggatttggctgcttggaagccctctcaagctgtctgcccctctcacctgcctcctctctgtgctcacagattcttacctgaccctcgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccaccatctatggctctcggctgcggattagaaacctcgacaccacagacacaggctacttccagtgcgtggcaacaaacggcaaggaggtggtttcttccactggagtcttgtttgtcaagtttggtaagcagacccctactggggatggactttggccctcagcccaatgtggtaggatggctagagtccacagggacaggaaggaaggaatgcacacttagtgagaatgtactctgtgcccacaaccctaaacctggtatggttgtacccattttacaaataagtaaactaaggcccagcagttagttaccatgttacccagctagtaaacagcagagcaggaatgaggtccggatctttctgacctcagagcccctaattgaaaccatcgtgccgttgagctcttttcaacaaggatgcttcttgtccaagaagttggaaatgttcgcagcgtgcatggcccttttcctgccatcaaggactagaaggaagccccactcactgttgcaatcaacaccttcatgcaaccactcagcccattggaaactccctgcatagtttgaagatgcttactcgattaactctttttttagcacttgtcttagcattttcaggccctgaattgtgagacatagacacgttctcactggtattttttttttttttcatagagatggttgggggaatagagcaaaacaataaattccagaaaaataaatactacctctgggtggttgagaactttaatttgtaatgatttgactgtatccatactcaccctccaataacctagactgactgtttcttttgtttttctttcatttcttcaggcccccctcccactgcaagtccaggatactcgtaagtacttttatctcctttcttgtcatttctaagtgtttctccgtggttttctagggcaaaagcaatgttgtcctcttcttaagccaaaatactggcttccagatgtcattccattttgccctgccctcattccattttgcttgttctctgctctaaagattcacaggagaccaccattggcagaattctcaagtgtagtaatgttgattctgaatgatcaaagcaaaaatcttccatttactgttttagaaggaatctaacatttagtggcaacaatggattgatttggtaaaatcaaacaaaaaatgatatagtgctggcataggaacctttactctcagggtctatgtttctgcaagcatttttgatgaattcattattgatcagggcaacaattaggtaatcactttattttttattccctttaaagaactcaaaagcagaagttctggctgggcgcggtggctcatgcctgtaatcccagcactttgggaggccgaggtgggtggatcacgaggtcaggagattgagaccatcctggctaacatggtgaaacccgtctctactaaaaatacaaaaaattagccgtgcgtcgtggtgggcgcctgtagtcccagctactcgggaggctgaggcaggagaatggcgtgaacccgggaggcggagcttgcagtgagcccagatggcgccactgcactccagcctgggcagcagagtgagactccgtctcaaaaataaaaaataaaataaaataaaataaaataaaataaaataaaataaaaaagctgaagttctaacttacactgggaaagaaagtcccaagcttggactgagagttgcatggaagtttgattcattttgagtccctcgttaatggagtctaaaggtccaatttctttcactaatgctattgttgatgcgtttgtcatttgttctggctaaaggattctcatctttcactttaagagtatctacttggggcatttttctttatctatatttttattttgggggaaggacccacttattaaaactcttactctacaaaaaaaaatcctcaatactctgtagacttttgaaataaaatttttgtggctctgccacaagagcatcaaaatgtttgatctagactacacctatggcaaatataacagccacttaatttgctccaatcccctctgtgccacttaattacagtgtggggtattttaatacatttgtgtgtgcctggaggcccagtggcccacaatcccattaatgaaataggtaatgggtaaaaataaacattggccttcagccacacagttctgctatttcatcagccagttaaaggcaactgtaaaagagtctttaaaatcactcaagtgctaattgcattctacttgcccaggtagaaaatgctgattgatcttaaaacaggtcagaaatttggtcactctgccttgcatttcttgatgctaatctgctttttttttttttttttcaatggtctcaccattggttatatgtggaatccttttgaagtcttagttaaacaaagatgaaaacttttgttacttgtaaaaatgtctcccaccctggtaccttatttgttcctgttaatctgtgtttcaaatgtggctgataatctatatcccaggctgattaatgtggttcactaatctgcctttactattaagtactgtgttgttgactttcagcctgttgtatttgcattagagttctttttattatcaaaattatgattatatccttctatgttcttcttgaagttttcattcttcactgctgtccttctgatgaacccagtctaggtctctcgtggtttttaattttatacaaagattttatacccctgttgtgaaccgatatctatggagagggtattgaagttccttaaagatgctcaaccacagctaaaaagtatcctttgatatcacgcatctctgttttatattagctgtcagattatctattacattagtcggtaatagcatgaaatgtatagttaccatgtttgcttgcagggagttacaataaaatacaattcaaattggaaatcccatggggccttttgcagttacatctccattctgtttttggcattcctagttggcattttggtaccttttttttttctttcccagtgatgcatcctgctctttatctcttctcttaattgccaccacttcccctgtctctaggagttcttcacttcctgagactaactcccagaaagaatgctggttcccatgcctagcttcggagtagccctcaataggcagccaaccttctctccaaggggacaggcagaagataacaaaatgatagccatggggaatatcataacattgaggtccctctaaaggttgtttgtcaaattgtacactactatttccaaaagaggaatgaaatacagttataaattgctctgtttatttgaaagtggcacagagttactgcaaaagaaataaaaggagcatctatgacccaactctaacattcagaacgtaaggactgtgaaatacattagacatatgaaacctggtgagagctgaggtccactgaggcaacagggctacacaactcctgcctgggaagggcttgtagggacccttgggactatggcccagaaaggcacttgtcacttcctctgagggactgcatcaggtttccacatgaagctttcagaatgatattttagtttacagtaggaacaagcttgatattttcgtttggtttccgttcatagatttaggcttcatttcttctgtcattgctgggtcctggctacccctaacacttataggacctggggcatgagtacaagcagaggttcacataccatatgtctaaatatttaaaagttataaatcaagctagcaacattgttgaataaaatatgttctatcttcccacagtgtcaaatatacctttttaacgttaaaattttaaaatacatagaaagttgtggtgtgttttaaatgattaagagccaggaactatgaaaaatggctattttaatcattgttatgcatgtctggatgttttgttcatgggccaaagatatcatatataattcatagattgttatatattagttccataaaaatttgtttgccttcctttcaggaaaatgactacctaagttgttttatgcaagatttttacagtgtatattctattgataacatcgctaaattagacaaatttgtttttctttttgttttattttattttattttattttgaaacaaggtctggctctatcacccaggctggagtgcagtggtgtatgatcttgggtcactgcaacctctgcctactgggctcaagccatcctctcacctcagccttctgagtacctgggaccacaggcacgcactaccgtgcctggcaaatttttgtatgttttacagagatggggtttctccatgttggccgggctggtctcgaactcctggcctcaagcaacccacctaccttggcctcccaaagtgctgggattgcaggcttgaagtactgcacctggcctgaacaaatttcttaagtccttgtcattcttgcttttttttttggacaggttctggctctgtcatccaggctggagttcagtggcatgaccttggctcactgcaacccctgcctctgcattcaagcaatcctcccacctcagcctcccgagtagctgggactacaggtgccagccaacatgcctggttgtaattcttacactgtaaaactaattttaatttggagaaacttcactccctggagccagtggcagctatagttatcaataaaattcctaaagtgatacttaaatttggaaatgaactaagaattatacatgccatgttcaaacacagaaatggaatcatatatgacaaataatcattattgtagaatatattacaaaatattacaatttaatcatataaatcagtatcatacttcatacattatcctaggtttgtacaaatttaagaataatatgacttgtttaatgtgttaattttcttgggctgctggaaagtatcacaaactgcatggcaaaaacaatagaaatttagtatctcatagttctggaggctagaagtatgagatcaatgtgttcatggggttggttctttcttatggctatgaggaaagatttctcctttccagaagtgtgtcagaatttttccgtattcattggcttatagatgcatctccccaacctctgccttggtgttcacatgatagtcttcctatatgtgtagcccttaatttccccttttcataaggacaccagtcatactgtattgggatccaccgtgacgacctcattttaacttgattacctctgtaaagacctatttccaaataagatcacattccaaggtacctggaaattaggacttcaagatacatatttgggaggacatggttcaacccataacacttgatattgcaaagtttttctcagccatgcaaaactcttgcaaatgttattctaatgtgtgagagctttcagaagcgctggttggaatataatgaaaatagatgtttggtaatattgggaatgatagtttgttgtgcaagaatattttgcattcaaactgagagaagaatttgacacattggttaatttatcttttctcctgctgaagtggctctgccagtgtagtttctcctaggctctaagaagagtccatctcctccactggcagtgtcacaatacacaaaactttgacagtatgcagttgtggtcaccttctattccaaggacagagggcaagacatgtagagaaatgttccctgggccagaacagtgctggtcacaaaaatagatgtctaaggttttgattacattgtgcgagcactcattgccagatcccaagaggcaaagggttccatgcgtactctttactctcattacatatattccctgtgtattttttgtatgtaggcccagggccaggacctttctctctttttttaataacagttttattaagatacagttaaccataaaattcactgttttaaagtgtgcgactcagtctttttactatattcacaaaattttgcaactctcactactatcttattttagaacattttcatcatctcaaaaagaaacttctcccagctatagtagcttctaatttacttcctatccctatgaatttgcctattctagacatttcatataagtagaatccgacaatatttgtccttttgtgtttgccttctttcacttagcataaggatgttgaggttcatataaattatagcatgcatcggtgcttcatcctttttatggctgaataacagtccatgcatggctataccacatttcgtttatccatttttctgttgatggacatttgggttgcttctactttttgcttattctgaataatgctgccatgaccattcatgtgcattgtggggtatgtgttttcaattctcttgggtatatacctagaaatagaattcctgggttatatggtaattctatgtttaactttttgaggaactgcaaaactgttttccaaagaggctgcagcattttgtatttgcagaaggatagtatatgggttccaatttctccacatgctctccaacacttattttccttatttaaaaattatttatttatttatttatttaaaatttattatagccagccgggcgcagtggttcatgcctgtaattgcagcactttgggaggccaaggcgggtggatcacctgagatctggagtttgagaccagcctggccaacatggtgaaaccccgtatctactaaaaatacaaaaaattagccaggtgtggtggcgagcatctgtaatcccagctactcgagaggctgaggcaggagaatcacttgaacccaggaggcagaggttgcaatgagctgagatcatgccattgcagtccagcctggccagcagagcaagactctatctccaaaaaaaaaaaaaacaaacattattatagccatcctcgtgagtgtgaaatggtatctcattgtggttttgatttgcattttcctaatgactcatgatgttgagcatcttttcatgtgcatattggccatttatgttttctttggggaaatgtttgttcaaactttttacccattttttaaattgaattaattgtctttttattcttgaggtgtaagagttacttattttgggtatatacccttattagatatatgatttgcaaatattttcattctatggattgtcttttcattttcttgatagtgttctttgaaacacaaaagtttttcattttgatgacattcaatttattacccattctttggttggttgtgattttgaaaaccatcgcctgatgcaagcgtacaaagatttactcctctgtttttttcctaaaagtttttatttacagttttagctcttacatttaggtttttggtccatcttgaattaatttttgtatacagtgtgtgaggtgggagtccaggttcattcttttgcatgtggatatcctgttgttccaatatcatttgatgaaaagaccattctttacccattgaattgtcttggcactctgttaaaccaattaaacatgtgtctatgtgtctatccctattcagttctacatagtcttgattactataggtttgtagtaagttttgaaatcaggaaatatgagtactctgtattagtattccactggagaaacaaaaccagtaaaattgtgtatgtatacatatataaagagatatattacaaagaatttgctaaaatccttagggcagggagccaggaggcacaggctgggaacttttgggcagttgctcatgccatagtccacaggtagaatttcttcttcctcagagatacctcttaaggcctttcatctgattggatcaggcccacccaaactattgaggatgacctcctacaaccagtcagttgattgtagatgttaataaaatttataaagtactttcacagcaacacctagactagtgtttgaataactcaggactgtaccttgccagttgatatgtaaaactagtcatcacctctttctatattgttctttttcaagacttttgttgttgttgttattctgagtgctttgcatttccatatgaattttagggtcagcttattaatttatgccaccaaaaagtcagctggaatattgataaggatggcattaaatctgtagattaatttggggagtactgctgtctcaacagtattaagtcatctaatccatgaacatgggatgtctttccatttatttaacttctctaaatgatgttttgtagattttggtgtgcaagtcttgctctcttttcttaagtttattcttaagtatttgattatctttcatgctattggaaatggaattttttcttaatatcatctcagtttattcattgctactacatagagatacaattaatttttgtatattgatcttatatcctatacccttgctaacttgcttcttagctctagcagtttttttgtgaattctttaggattttctatctacaagcttgtgtcatctgcaaaaagagattgttttacttttttcttttcaatttgggtgccatttacttatttttcttgctttattgccctggctagaaccctcagtacaatgttgaatagaagtggtgagagtggacatcctgttttttttttaccttatctttagtgaaaagatttcagtctttcaccattgaatatgatgttagctgcgtttttccatagatgccacttattagattgagaaaattccctattattcctattttcttctatgttttttactatgaaaagctattggattttctcaagtgctctttgtgtgtccatttagatgatcgtggtgggtttttttttgtcctttattatattaatgtgatatatcacattaattgatttttgcatgttaaaccaagcttgtattagaataattcctacttggccatggtatataatttcttcttatcttttgctggattcagcttgctggtattttgttgaggatttttgagtccatgtttataaaatatattggtctgtgctttgcatttcttgtgatagctttgtctagttctgatataagggtaatattggcctcagaatatattgggaagtattcctttttcttccattttttaagaagagtttgtaaaggatttttatttaaatgtttggtataatcaccagaaaagtaatctgggcctgaattttcatcatgggaagttttaaaattactaattcaactttcttacttgttataggtctatttaaattttctgtttcttcttgagtcagttttggtagtttatgtctttctagaaatttttccatttcattgagattatctaagttattttattcctttatcattcttttaatttctgtaacatcattaatgatagtcccttttttattcctaattttaataatttgtgtctttttttttcctttgtcagactagctagtctaactaaagatttgccaattttgttggcaaagaactaactttcgttgaaaactggatattgaaatagagtattgtgacaactgtggaaatcagattgcctctcctctgatgttgctgtgtgttgtttttgccgtttgtttggtgaatttcctgaattaattctgtatagtctgtattttctgtcatgtactccctttaaagagagaagtctcagccaggtgcggtggctcatgcctataatcccagcactttgggaagccagggcagctggatcatgaagtcaggagttcgaggccagcctgaccaacatggtgaaaccctgtctctactaaaaatacaaaaattagccaggcatggtggcatgcgcctgtaatcccagctactcaggaggctgaggcaggagaatatcttgaacctgggagccagaggttgcagtgaaccgagatcattccactacattccagcctgggtgacacagcgagactccatcttaaaaaaaaaaaaaaaaaagagatgtctctactcagttagcctagtaactagttaatgattggacagaaatttccttaaaccagtaagtctcctaccctttgccaagaggtttaaggaaacctctgtccagtcattaactgatcactaggttaactgaggaggtccaaattcatcctgcctcctctagtgactgctggggtgctagttttcacggttaccacagaacttgagagaggaaaatgagaacggcaaattaaaatgccataaaattccattcttaacaagcgttagttttttttttcctatatatccactccctcacctatcttatgacatatgagaaatcctaacatgggacttggtgtataattagcattgaatgaatttaagttttctttctttctttcttttcttttatcttctgtggtctcctgcagaatcagtctataaaaagggcatggtaaaaaaaaatctatctcatagcattgttgaaaagattaaatgacataataagatgatgcatatatagtagctagcactgtacctgatgcatattaggagcttgataatattactaacagtatcatcatcaatgctatctgagcaaagaggctgttccttctttccagccagagttcttctgttggataatatttccagctgtgaaccccaaccagagaccttgaagcctttatttccttttctctcattggcctttggctgaagtctcctttctgcagagaacaaagtgaccagcttttgatgaactattttcctcttttatccatttccaagtgttagccatagtgaagaagtgtagctgggtgctagcccaactcaagaagtgataatgtaatatccaacccaagataaactcaaggataactttcaacacggctactcaagcagttcaggggggaggcatcttgtagagaggagaccaggaagtcacttggcagctgggccagcacacagagggccattgctccagtaaagcagctaacctccatctcttcatcaaaccatcctagactcagcactctgcagagaaggagcagatggagggaatgtgtggagagattagataagaaggatttctaatctagtgggggagcgagtaaaatgtacagaagtttgagaagccaagctcttatgtaccaatccacccccatcactcaacaatccccactgtatgaataaagcctggaaagtttccaattaaaacagtgcttgtgaatattggcaaggggtatctttgtgtgcagggtacatttaaagggagaagggtgaagatacacccttgccttctaggagtacactttctgagagcttgttcaccaggctgtgagtttctcagtctatctgtttctcagtctgttagtaatgaatgtatctcccacttagcacagcagctagcacatagtagatgcctaacaaatgtgtgttaaattgaatgttggaagtctgtgtcctgaaagcttttcttcacatattacaaggctttttatttgttcaacacatttttaccaagtttttttctgtgttccaggtcttttgattagctgtttttaagtcacagaaatgggtgtcgggaacaaaaccagtcaaaagtcctcattctacatcatttacactttcccttcctatatttataagttttaatatcagcttctacaataggttccagaacaagtggtgctcaaggaatggagaaaatgactattccaaccctagctgtaggtgaaccaaaaaccccagagaaatcaaagtgtagtttaaagcagtgcttctcaagttgtaatgtgcatatagatcacctggggttgttattaaaatgcaaattctaaaagagcaggtctgggagtgggcctgggactgcatttcttacactttcccagggggtgctggtgctgctggttcacacacttagagaagcaggggtttagagaagaggtgcctggccagatgctagttctttctgtgtaatttgctagttcactagccagtgaccctgggcaaattgcttactttctctgggtcccaagtttctttatttgcaaagtgaagcacttgggcttaatgtcttttatgattttttttctatctacatttgatgactaactgaaactcaacatttcctctgttatagtaagatcttttcattgctgtgaatttcatgcaacttgctcctagattctctttctgtaccctgaggtgttaatcaccctcttttatctgtcaggcgcttctatcctgtgcattctaaacaagatcttatctagttactttcaaacagtgtgaaagatttttacagggaactctcacctggaaactctccctcaaattctgaagtggctgtgatattgtgcgctcctgggtgcagaggaagttactgctccttttgctggtcagtagcagactctacttgcctcctgttgaatagaacagaattttcttgccatatttcttcactaggctcctgctatgttgggtgactgcctgtgttttgaattgaatgaaaggattgtagcaggaggcagtgcagtggtggattcagcctcttaatgtcttcatgtgggtgttttttgttgtttttgttgttattgttgttgttgttgttttagatggagtcttgctctgttgcccaggctgtagtgcagtggcacaatcttggctcactgcaagctccacctcccgggttcatgccattctcctgcctcagcctcccgggtagctgggactacaggcgcccgccaccatgcctggctaattttttgtatttttagtagagatggggtttcaccgtgttagccaggatggtctcgaactcctgacctcgtaatctgcccacctcgacctcccaaagtgctgggattacaggcatgagccactgtgcccggcccatgtgggtgtttttaaagcactgacctttttgcctgactggtaggcccagaaggctgataagaaaaacaagatttctggctttgcatgtgtgacttgtgaatgcaggtccattattgattcatcacgtcttgtacactcatagagctttttgagggaaacaactgaacctcacaacaaacatagctaatgaaatgttatgaataatcttgatgatgttaaagggtggctaagcataatgatcagttcttcacataaatattgtatgtaattagccttcgactttgtagggtaggaaagacactcccctaccctcttaggttctgtggctggagcctatgaaatgaattttgaaaagacagattaacaaaagaaaaaacatacacattttatttgatgttaatatttttacatgacacagggggtttcttagaaagaagtgaaaccccaaagatatggttagacccaggggctcatataccattgtaaccaagaatgataaattgtggagacatgatcaggcaaaggaaaaagaggtttgggatagggtggtaaattgtgggaaagtgactagaaaatgcatggaggaaactaatggaaaaaaagtgttatgttagcaaggtttgtttgtacagattcctctcatcgtcaactcattatcttctgtggtatgaatgttttcttcttcgtggtttagggaggagatctttctcacaggaaatgtatgccctgacttttgatagaaaggaggaagacagcccttcctaaatcttttgtttctcagttgccttcagcccaaaatagtgaatatgccagtgaatcataatgtgggatggcatatcctaatcccctccaacttcttcagtggaatgtgcaggtttcttccttctttgttaagcctctggcttttttcagtgtcagtgttgacaattttatctaattgctctcctcttttttaaaaaattatttttaaaaattaaagatcatctgttgctgtcctctctatgtctctttctctgtctctctctctctctcccatacacacacaaacacactcattcacacagtcacacatgctccagaagcaacaacagctgggttctcattatctagggcagtgcttctcaactccatctccaccttagactcacccagggagctttataaattacctgtacctgggctacaccctagataagttaaatcagaatctctcagagtggtacccagtcatgatattttatcaaatcaccccaagtgatgtcatgtccatgcaaccagataggaccctctcccatcccccttctcacctgaaaggaacttgcattagcccagctctacctttctctctctctctctgccccagcaccatattgtagacaccaaaggagttgcagcagcagaaactgtgcctggatggcaacatgcctacagcatcatcaggatccaatcaggaaagcagaacaaattctggactatttaacacagagaatttaacatagggaattggttacacaggtgatgaagtttgccaaaaaagcaaacaagaaattgtgatgcagcatcagcaacagacagaagccccagctacacttaggttggagggaaaaatagaaggggtaatattaccagagcctaggtttggggtcatctttggaggctggaatggtggcatgtctgttctgtgggcactggagtcatgagaagatgcttccactgctggggttatcacccaaagcaaaaagaaatgggagaaacaacttggctgctgtcttccttcacactttcaaatgccagccagtttctcccattaggggaatgctgcaagaaactatatgacacagggagcctgagaatcacagcctgcagaggtcatctgccttgcagatgctgacccaagcaggaaacgggcaaggaacggatctgaagacaaataggtgcagcaacagcactcataccccagattgatttccatgccactagaaagccgagcctgcagacagccttgaagaaacaggctggggagaagacaaagcattcaaagctgcaattcctgcccaaccttcaggtagaacattcagtggacagtttggattgtggaactgaggcctggagcaaaggtcaaggctgagggggcagacatggtggtacatttggctaagttggtggacaaactttgaagggagtaaaactccccaagagaaactaaaaaggaacaagaataagcagacctcttttatttatagtactgtctgtaattttcagaatattttttcttttctcctttgatcttagagccatctaatagctttgactagataccctggtatttttgttttctatctagaaaaataaaaaattgataaatcatcatacccttgccctttatcataacaagcactttttaattgtgtagaggggtgctctgatctagacctcaatatttatgaacttttgaaggctgaaaatggagacagtaaacttctagatatttgcttcctgggcctccaaagacagaatttgctaactgtggcaaacacttactaagtgctactctgtgccaggcctttttataaaactttgcacaaaaactaatagactattacttccccatttactcacacaaggagactcagcaaaggatgaagctttgatttgagcccatgcaggtggactccagagctcagactttggccagtctgctataccagctgtccttattgtggggagatgatcagttgatgaactcttacctgaattacaaatttagtcaccttaagtgtttgattgctgaaaggactcacaacactcaaatggtttatcctcatggggtagttttattacagacaagggaaacagtacagcaacagcagaagacagataggtaatgcaggggtcccagagatatcagatacaggcttctttatcctcctaaaactgggttgcacagggcactctatctccaggtcttgaaggtttactggcatacatgtgcagaacctcagttccaagaagtccagtagtggaggtcacttatagtgagctgatcacatgggcacattccagctgtgtgacatacacttcagtgattgaagccccaggactccactgaaaccaggtgcaaatcataccatccagttattattactaaataatgctaactgactcatacatcctaccccaaacaacttgaagactcatagtttcagagcatcatttatctttagtaaatacatttcatagtgattgccgatagttagtggttctgaagattagtctggggtcaattcaggccagctgggatcaccctgtgcctttcaacccgcttggccttgcttagtatgtaagtcaggaacccactcctagaacttgaacaatggtaaagtcatccaggtataaatacttgccactgggatgggacgtgttccatagataacagaaaagttatcatggttcagtcattacaaatgtctattacttcagtggatggcctggtatttttgtggccagcttctgatgtccttgtcttctactcattattctaagactgctgggtagctgtcctatgtgcttacatgaaaccccaactttctctcaaggccgttaaaatataacatgatgagtgctgtgatacttatctgtgtctctagagcagcaatgctgtccactagaaacatcatacagggcacatatgtaattttaaactcactttttttttttttttttgatatggaatctccctctgtcgccctggctggagtgcagtggcgccatcttggctcactgcaagctccacctcccaagttcacgccattctcctgcctcagcctcccaagtagctgggactacaggcgcccaccaccatgcctgactaattttttgtatttttagtagagacggggtttcaccgtgttagccgggatggtctcgatctgacctcgtgatccacctacctcggcctcccaaagtgctgggattacaggcgagagccaccacgcccagcctaaactcacttttaagccacattttttaaaggctagtcaaatgaagcagtgagagtggagaaggaacaaagaaatttgcaattgcttgtgatcaatcagttgtaaacacgatggcacttggactagccttaagatacattttaaaaagttaaaagaaacataaaattaattttaatatatattttatttaacccaacatatccaaaatattatttcaacatgaaatcaatataaaattattacccgctttattcagatataattgacaagtaacaattatatataattcaggtatacaatgtagtattttgatatacatgtacattgtataataattattataatggaatatctcatatttttttttctaagtcttcaaactccagtgtgtacctgtagtttatatttacaggacatcttaattcagatgctaaattttcatggaaatacttgaggccaggcgcagtggctcacgcctgttatcccagcactttgggagactgaggtgggtggatcacttgagcccaggagttggagaccagcctgggcaatgtggcgaaacctagtctctaataaaaatacaaaaattagcctggcatggtggcacatgcccgtagtcccagctatttgggaggctgatgtgggaggatcatgagcccaggaggcagaggttcagtgagccaaaattgcactactgtactccagcctgggcaacagagggagaccctgtctcacaaaaaaataaaataaaataaaaaggaggcctgtcgcggtggctcacacctgtaatcccagcactccagcctgggcgacagagcgagcctccgtctcaaaaaaaaaaaaaaaaaaaaaaaagccatacttgatctgtacttatattttataaaatgaataattaaaaacataggttcacattcccaagttatttcaaatatactcaattttctagtaactgaatcaaataccaaaacattatttttctttcatttttgcatccacattgacaaaattggttcatcatttttagaataattgaattgactttgaaccacaatgtatcatttttcaaactatttctatccaagttaaataaattcttttttttttttttttttttgagacggagtctcgctctgtcaccgaggctagagtgcagtggtgtgacctcggctcactgcaagctccgcctcccgggttcaaaccattctcctgcctcagcctcctgagtagctgggactacaggcgcctgccaccgcgcccgggtaattttttgtatttttagtagagacggggtttcactgtgttagccaggatggtctcgatctcctgacctcgtgacctgcccaccttggcctcccaaagtgattcactatatcttgtatcaactcagtattatttatatcaaattcaaagggatattgcataaattgaaaagcaacactgaatttatcaatgtcaacaaaacatttaaatttttcttgcagtttatgcaggcaatttacaaaatgctgtcaattacaattaaaatcttcagcatattgatccgtgttaaatgtctaaaaacgtcatgattgtttatttgtattgtgaaaagcctcagttccaacatacattcttatatctgtctagctaggttacaataagcttttccttttcctggagctgcatattaagtttgttcatatgcaacatagtatcagtgcaaaaatgtaaatcatattgccatttttttttactttgattattatttggcaaccatccttccatttcaagaaagtcttgaggtggagttagcagtgcagtaaatctttgtaaaactattctacagtcaatcagcaagcactggcaaagaatataagatcattaaatccattgcctttgatttttttcaacatctctgcaaactgtcaatgattctatttgcacatatatatgaaatgattttaacgactgtatccatgataccttaatttataaagtctgtctcagaaaactgagcacatatattttcagtttgtatcacaaagtacaacaaagcaataagggaaccatcagtattgttttacaattccactaagtctagttttttgacctaatggctagagtaccatccattgtgatagaaatttttttttcatacctaactgaaattctttgacagatgtaggagattataaagtactccacaagttccgttttacaggctgcaaattgacatttctttgtgaatttggaagtcctttaaagtaaacatacccaaaatatatcttttcaagtttctcttgtatgtcatgcctcatcaaaaactgaagaaaagtttctgcaatttttcaaaattttaatcaattgattttatttttatattctataagctaaataatagctaaaataattatttcttttaccatctctgtatctgaaagtggttttatagctgtacaaagttgcaagcacagattctgttaaaattgtgtagacttttttttgtaggacatttatttaattctaatttcaggtgaccaatttcatcaattttttttaactggtggcggggggaactttaaaaaaaaaatcaaaatcactgtgtatttgctgaaaagggtctctttattattgtccactttattatctttaaagttctttttgcacaacaaacttttttgtgatgatccattatgaaatttgtggcatatcttcttcccgtctcttttttccattacttttttgtttcggagagactttccttgcctcaaacactacagaactcgtaacttctccacaatagtacatgtttgaatcaattttctgtttagggctaaaaatagaaattcagaaaacaggagcagcagtctgataggatttcaaagcagcattcagcagactacatttcctcttgggttaaatgtgtgtgtgtgtgtgtgtgtgtacacgtgttcatgtgtgtgattgggtgatcatcgtgattaaagagaaagggtaaattgcaaaaagaaacaccacgaagttgcaaagtaaaatgttattcttttagattagggttaattttgaaacagcccaccactctagcaggcagatccctgcagaggttcatgacaatgggagaaggcagccagcgctgcagaggagccagggaggccacaactcctggcccagtctccaagtaggtgtgggtacctggctttcctgggaaatctccctttatttttattattattattgtggtaaactatacatgacataaaatatacaattttagccgttttaaagtgcacagttcagtggcacttagtacattcacagtgtggtatgatccttaccactgtctagttgtagaacatttttattactccaaaaattcctcctgtacccattaagtggtcactccccatcttttcccactcccagcccctagcaaccactaatctactttctgtctctacggttttgtctactctggacatttcatataggcaaatgatcctgcctatgtccaggatccaaatgacaattcatataaatggaatcatacacagtatgtggccttttgtgtttggcttctttcacttagcataatgtgttcaaggttcatccatgttgtgacctgtgtcttccttgtgttttgatgaccttgagagacttcctggcatagcaatgaggcctggcattgaagccatgcatacctggatttgaatcttgtcccacctttaagcttcagttttttgttttgttttttgagagagggtctcattctgtcacctaggctggagtgcagtggtgcaatcatggcttactgcagcctgaccctcctgggctcaagtaattgtcccaagtagctaggtctacaggcgtgcaccaccacacccagttaaaatttttttttattttttatagagatgggatcccaccatattgcccaggctggtctcgaattccttgcctcaaaccatcctcgcacctcagcctcccaaagtgctgggattataggtgtgagccaccacacctggcctatgctttagttttttcatctgcaaaatggaaatgatattcatctcaggaatccttgtgggggttcatttgctcattcaaaaaatagtgatggagcagccactgtgtgccaggccaaggcttcacggatatagtggtgaacaataccaggcaaactctttgtgctcatagaacttggttctatcaggagaaatggacgataaacatggagaccaataaataagataggaagaagaaagtctaatgtgtcagagagtaatgtctgggggtaggaaatgggcaactttaacagcttggtgagtaaaggttttctgccaaggggctgacatttgagctgacctctgaggaacagagtgagccaggcttgcagagagcaagggaaagaaagattattctaggcaaaataacagcaagaacaaagaccatgacatggaaaatggttttgtcacgatcatggaacagaaagaaggccagcgtggccaaattggatgagcgagttgtgggaagtatgacttcaggttagaaaggcgagcaggagctacgcgttacttagctgtgcaagccagtgtttgggcttcattccaagagccatggaagccatgggagggtttcagctaaagaggtgatgtgtcctcatttacaatgggaagagcactctggcatctgtgcggagggtggacgagagtatgagcaggagctggaagagcaataaggaagtttttgcactagtctagatgtgaaaataggtggtttgatgacttggaccaggtcggggtaggtgagttgtaaagaagtaagaggatttgagatggcttgaagaggaggcaggtgtgaaggtttaaattatataaataaacaggataaatggaatctgcatccaaaatgcctaactgcttagaacagaggcggtgatcaactcatgtcccgttctggtccactcccccccgccccaccacccacacagacacacacacacacacagacacacacacacacacaaaccttggtggcttttgaagaagtatttatgggtttcatcctcatctggattttcccatcatcaggaatgagtggcaactgcggggagaaggatgtggatgtgtctctgattttcacagcatgaagacagaataagtctaccattttctattcctctataatcttggtctcttagaatagctatagccttcagcaatgatggagaagcagggttctgtgggatgaagcaattagccatgttctaggagagagggaagagccaataaggagggtgttctctcctctctctcagttgccagagctcagcctgaaagggattcccttcctctgctctcccgccaccgtggtgcttccctatgttacactatgttgtggtccatggtttagttctccaaacaggagaactacccctggcacaaagagggccttgattaatatctaaacactgaatgagcaacggaaaacaccagtgcttcttgtcttagagccgagaaacttctgaggttgcagaataacctgtgaagttttttcttttataaagataggaataacaatagcatctatgcaaagaattgcaaggatcatgagagataatttgtgtcattcactttgcatgatgcctggcatatgacaagtccttgatagaagtttgctattactaagggcctgcttcctatggcttctttaagagctgctgtgtgtaaatggccctcagagcctctttgagggctctggactaagaggaaagaagaactctggtgcagggacccaaataagctctatcagttctcactgcagtaggggcttgacggtggaattaacaaagtgccttaggtttactgccagttccctgacagcctgatttcccatgtattgtgtaccagatgagacataagggattgtgaaggcaaatgaaaagcaggatattgtttactggggccaatataaatatgtttgtggggagaggagaacaaagacctcaaagcctgttgttgacagaaaccacgctagtgtttaatacatgacgtcatcctagtaaaaataatagttcccacaggtctgccagggaatgggagagccggggttatctgtacccacacatgccaggaacctcaggggtgctggcaactggtatatgatcctgacccagcttccaactagctccatggcatgtctgagggaggggcttcgtggatagtatcctactctgagttccaaacacacagatcccaacgtctggattccacctctgctagacaccagcttgtagcagagaccttagctgggagcctggtttttcccaaatgtaaattcagataagaattcaacccctactagagtagttgtgatgaaaaaacaagataaataaaataaacaagatttaaaggaaatgctaactgcaagagagcctttggtattcatggtagcctcacccacttctgtgtgctcctctctcacctatgcagaagcattgaaattccaggcttcatctccagtctcaccaccctgaacccctactttgcttagcttccctcctctatgtaaatttgttttatttatttaggccttttgtaaggtgtgtgaaggtatctgggctaagagagtggaaggtcagtgaacccctgagaaaatactagccacttgggggtcctcattcttgcccaatcagtccgaagatccaactactcctctgtgtgccccttcctgctccatgtgctcctttattttacccatttttctccatggtaaatgcaagtgtaaggctttgaaggcacaggggagcctctacaagccctgagtggaaattcgcagccagtatgtgaaagcatgacttcaattttatgaagactgggccctaagaactggacatgatgaagcttaccagtttgccaatcttcaccttctgttttcttcccctgagagtttccactagaaattccccagctttggtttgagtgcttggctctgtaatcttggagacactctgcatacaccccacaattaagacatcgcaactccatgcaatgtttcttcagagaaagttagatgcaattagatcatttgaagatggattagcctgccatctgcacaatattaagaaaaatcatgttggcaaatgatggggcctctttgaagagctctgaaggaaagccactaatgggctctacactgggtttcccccctgttcccgaagggttaacacaatgtgtgggaaaggaaaaaaaaatcccctgtggcattaaaatgctgtgtcagagatttgtaagctcccctttgtagctctgccctggggcctggctcacttcagtggagatgaggttaataagacctctgttgctgcttggcagttcttaacggggttacagtctggtgcctgaccagtgaaggacagttattattaaagtgctgaggaatttaattcaataaggtcagggacatctgctgtgcttgcttgcccaatgtccatttcttcttctttttacaagaactgcttgcttttcctttgcggaaaaccacctcatgcccattctgtctaggtggagctgacccttacctaaatcagggtggccacatgaccaagccagcctagttagtgtatttgggtatccaaccgtgccccaaagtcactggacttgtcagttacataagcctataaacacctttacccctcaaccctcatttttctttttcagcttctgcaaggtggagtagctacattaactatttaagggattaaatggcatgaagtataattagatagaaactaaactctgtgggaagtcaagagagggagaggttgatgtgggtgggtgggcttcctggcagaggctgaacttgaactggtcttaaaggatggagaggattaggtgagaccaagagaatgcagaactctgtgcaaggcacagagggagggagaactcagttaaaatgaagatctgtggacaagaaatgaaaagtgggttttgacaaatagaggcagggaaaatgccagaggacttggaatcccaggatgagaagtttgaacttacctggatagttccccagtgtggacttatgtatgggtggggaaaatccacaccagattgtgctaccagtttgggcaagtatatgactctatgccttacctgtgttagagactggcacaggtgcaggcagggcactaaccttggctccgccacttaataaccgagcaacaatgggggagttacttaacctccaaatctcaatttttttccatctgcacaatgaagataaataataacctgacattcagtgtttgtgaggataaaatgagataacctacgtgggagcccttaggatagtacctggcacatgataataatagtagataatatctgttgagtgcttattagtgttcccgaggcactgtgctaagctcctgacataccttatctcatttaatcctcccaatagccagtgctttaaaaatgttggctgaatccgatttggggtaaccttgtcattcctgtgcttgatcaaacaataagcttatcagacatttactgtccaatgagagctgaatacataatctgaatattcaagttctaatttcttaatacacaccctaaaatgttttaaatttaataaaattacacttcagaacatctagagaatagagtaaaaaaaatgtacatataacttcactaaccacaacagaaccatgtttttctaatatagagggggttaagattatctgcttttaggcccaccagatcaccacagtgtgatctggggcaagttactttatcttctctcagccttagtttcctcatctgtccttatacgatgtttctagaagcttcttcataggggttttttgttttgtttttggcaaggtttaagagtgataattcatgctgtatggagcatctgacacataatacaccatcaatgttagctcctatgaatgcctccagtcactgtcctatacattttccctgtgattgcaataaccgtgtatatgcagttgcatccttattttttcacttaacactgtatctcaggcatctttataagtaacaagatctccctgtccctcattcctaatgtatatgttctcctaaagtcactttaagtgtatcaacttgcccttgcttcatcttttaaaaacatgtataagtaatgctgcactccacacctttacgcttaatggctctaagagttcacgtttcagtgcaccatctctttgagttcaaattatggttctgcccacaccttttcagaatgtggtgagaatgaatgacacccaagtcaggaaaggcctttgacaaattgcagattatgctggcttgataagtgaccacaggaaagtatgattgtcacttttccagcagtgggtttcctccagtgtgatattctgtgcctcacctatcaagaggtgttactgtgggtcttcctgtcagctcagttctcctacccttcttgctgacagaggaagaagaatcccactaccttttagctggaggttattctcctgatctcactgaatcttatttcttggagtagcaaggaatctgcaaaacaatttgaggctgtctttctgttgcaaatcaaagccccaacctcttatttgggtcttagagcaagagttccccaagtactttgaaattggacccttctgtacacacctggagtcaccagtaagccttgcccatagattccctggtggatggacacacaaagctaagggcaaaggtgaccttttcatttcttcttcaggtcctacaatgcctttgaaatctttatgatctgcaccttcagggattatacaaacagcttgaggaaatcctaaaattgtgttttctccagataagcatccaggtcaaaggaaagacctctgcatgccttcctgatagaaagaaacttgcctcaatttagagaatgccaccaagaacaaaattggcatgcagccatttgtgcagtgcattaaaaaccagtttacaaatagtggtacaattctggaagtgtcagacctcatagtgtggtgtagtggaagtccacagactatttaccatatttcaaatgtcttactgtttttaaacagcagcacaggataaccagagtaacacatttctttgtttctgtctcgaataacatcaattaagtaaaaataaaatttattatcatgcaagttataagctttccttggcaattatattttgatatatttatatgctaattttaacaaattttggttaacatatcttacagcagtattttttatattaataacggtaagaggaacagttacttttttacttagctattggttaattgagattattttaaaagctgtgtgaccttggaaaactgattaactaatacaggtatttataagatgtttggtctaaaataaggtatttaaactacctgagcctcagtttcctcatatagaaaaaatataccctcctcatatggctgttataggggaaaaagacacaatatgcaaagcacatagtacggaggcaaagtatctggcacatagtatggttcaatagataaataattttcccatagaaactgcaaatttatatatgagacaaaaaacatttcaagtatatgttcttgagggcagggagatgtaaggtttttaaaggttctttgataaaaaggttggagcatggctctttggctctgatcactccattggatacttaaaacaatgatcaactctgtcatcagaatgaaatgtccactgattcatctccatttcttaactaccaagcaacgttcttttgagggctttcacaccctcacgtatcctttccacctgaacctcagtggctgactttaccccaggccctgaaggcagaggtggagctgagctctgtgtctgggaagagagaagcaggcacgtcctctgatccttgcccaagggcctgctttgtgagtggggcatcaatgctgcttttgttccacctttagcgtctggcccacagctgaactcaaagaggctggctgctcggggcaaccctggcccacaaaggacagacagcaccaagcccagccaagggttcactcaagaccccaagatccagcacggtggttctccccactggggaggcagcctcagggaacattctgtctgcctttggcattctaaaccatttcgaatttcatgaagataagtcagaggttttaaatgtgatatcactgctgaaaaggccagagccatcagcgtagaaccagcatgtccttgctaattacaatacacaatcattgccttgtgttgatgcagtcatttgctcattcatcagctattaattgagttcctactatgtgctcaatgtgatgctcaatgtgagggacatggaggtgaaaagatgatgtccctgcccttaactctctggtgtactggcaaataaactgtcacctgctaagacaaatagaacataatatctggacactataacaaaaacctggagaagcagaaacagtctacataaggggccaataataaccattgctacagttgatcaagcatttgctgtgtgccactcactgtgctaagcacttagtgtgtattatctcatttaattcttaaaacacagctataatagtagtttgattctcttcctatctctctgggaaaggccatgcaaagaaaatggcatgtgagggtcttggaaaaagaataggagtttgccaactagacaagcaggggagatcattgcgggcacaggaaacaaaaatgatctgtttggagaactgcagatctttggtatgtgtggagcaaagggaatatgcagggcctcgtgtgagaatagtgattgcagtgaagtgagaactaagtgggatgaagcttcaaatgtggaagactgtaagcagagctaagatgtggaggaaggagactcggtaggatagtgcttcagttagaaggagggatggccacgtttgttggttcacttttgagatgcagagcctattcctagggtaggctatgagaagggaacaatgagagggagaaactaaaaatgccggacagagagtgactagtggagacaggacctcaccctcctctgattggaagaaagataagaagagaaccaaagacatagacacattctaagaataggtgttgggaggcagaacacaggtaagagggggcagaaggaaaagatacgatcttaagagttgtacctgcatgacgcctgatgtctctgaggttaaaggcaagtccaacaaggagagtgagaggtgacagagtattatagaggccttggtgaaaggagtaaaagtttggagtcattgttgagtacgatgatgaggtgctgataacacaaactcttgatttcgaggaaggagtgttcaaaggaggaggaggaaaatgactgctagagagaaaggtgatggatggcatgtgaaaatagttgagtgtgctgagaatcgttgattagagtggcgaaaggtaatgaagggaagacttaataggtgatttcaggttcagacatctgaatgagggcatggacctattccatgcagcttcaggagatagaacgaggtccaacaagtggtcattcctaggagacagattctctacccccaaacattaaacattaaaacatgtaagtaagtgtacattaaaaacattaaaatgtgtaagtaagtagcactatccagcaatggaataatctgcctcttgaaggatttcaatcatctgccaaggatgttgtgctggaaatttggtatgcttaattagatggcttcttctatcttttttaatactaacatatcatagatacttaatatatggagcattgaaatagatagcagccaattttggcattcttgcaggttgtcccactgtctgagccagagaatcttgattgggattttttttttttcttttttggagacagagtctcgctctgttgccaggctggagtacagtggcgcagtctcggctcactgcaacctccacctcccaggttcaagcaattctcccacctcagccttccaagtagctgggattagctgggattacaggcacctgcaaccacgcccagctagtttttatatttttagtagaaacggggtttcaccatgttggccaggctggtcttgaactcctgacctcaagtgatctgccctcctcggcctcccaaagtgctgggattataagcatgagccaccgtatctggccttgattggaattttcagtaagatttatgcagtttaagaactgtggaaacaatcttgattttttttttttattccaggaggatttttgttaagattagcagaagccatgctctagtatgagaaaaatacacatggtattattgagttaacaggcatgatgtgtatataatacttactacggagagggcttctttctataattaaggcagaatgcccatcccttctcattgtggatctggagaggacccttagctgggatgactaaaggaggagcctctgttcttaccttatttggagtcctcttctcatcatgaaagatgtttgcgcatctttcatgccctgtacctttcttttcatttgccccctgcatttgggattggttgctttcttttttggaacctatgagactatttcagtggttctcaactgagggtgattttgaccctcagagggcatttgacaatatctagagatatttttgattgtcatgactggagagggatgctgctggcatctggtgggtagaaggcagggatgctgctcaaagccctacagcgcacaggacagccgctctcaacaaagaatcagccagcccaaaatgacaatagtgctgaggttaagagaccatggtctgtttttaagtcttccttctaaatcagctgccaccaatacactctgtaaaaccccagatgcctacttttattttctaatttaagaactgttgtgtggttgaatactctgtctctgtgaactctacccccacccatcccgttcttcatgctgtagcaataagaaggacattttaaactccctttgaccagaaaagtcacttttggttagggtccaaacaagaaacacatccctccctggataaaggcagagatgccacagcttgcagagaaaaaacatcagacatttcccaatggcagcaactctgggccaagagtacggatggaggacaagctatagatacagccacatggtgcccttcatttgcttttgagtaggagctcacactgtctttaaaagattggacagtagagctcagccatgaagggcccctgtagcctttccaagccaggataagaccaagacggtggtatgaaagcaactgtgactttggcacaaatacagactgagaaaatggtacctgactaggttactcttatgaccctctgagaatccccacacagcacatgctaacatgtacctacacctctgtgtcccaaattaggctgaagttttcagttagccagatcataaattaggcctttgtagctctaagatcccctacccctgaagaatcctaggaaagcctcccttactacacttcatgactcagcattgatagcctgctccaacagaaatagcccaaggctgagatttcccttctcatcccttatgtttttcaggctgagcagtcatagggaaatcattcaaactcttagaacctaggttttcttatctctgaaatgaagacatcgaccttccaatttctgggaacctgtattgaaaaagtactctcaaatacggacataattttatgtacaaagttacttattgcttcattatttaatgttagacatattgtgaaatagattaaatatgacacatttatagaatggaacattatgtacccatgaaaaaataatatacatgaagagtttcattggctgtgaaaaatgcttgtgctctaatgtcaagaataagaagcaggccgggcttggtggctcacacctataatcccagcactttaggaggctgaggtgggaggattgcttgggctcaggagttcgagaccagcctgagcaacatagggagactctacaaaaaataaaaaaattagccaggtttggtggcccatgcctgtggtgccagctactcagcaggttgagatggggggattgcttgagcctgggagatcgaggctgcagtgagccatgattgcaccgttgcactccagcctaggtgacagcgtgagacactgtcaaaaaaaaaaaaaaaaaaaaaaaagcggcaaaatataacaccccccacacacatacacaaacacacatttatatgcttatagtatgatctcaattctataaaatatgtatagaaaaaagtctggagggaaaccaaactattaccaagagtttatactttgttttatgttagtatgtttataacgtttttaataaaaataaagctgaggtatacaataattcttttccctttaaaagcagagcatataactctcaagattgagaaacactgatttacagctgtagacagaactggggccagagataaaattttggagtcatagatgttttagtagagattgattactggataagatcacctaggatgagcctgtagagtgagaagagatgagagccaaggcttgaaccctgggaaatactgacatttagggaatggatgaggaagacaagccagagaagggaataagttcgtggcagtaatccatatgagataataacctatatggattaccatggtggcgttgggacatgcaagggaatgataaagctgataggcattttaaaataaattaagggttgtaaattacatgtacaagatgagggtaatggaaaagccaaatattacttaaacctctctagtttggaatatggaagaatgctgatatcaaggaaagcaatgggatagttgaaagagatgcatatatggtaggagtggggaagaggttaggcttagtcttgtatgagttgggtttgagatctctcttcaagaaaataactgctctaagaagtgcagttatctgaaagtccccagctgcagccccttggggatcggccataccatgcaagctgaggtcaccctctgcccaggcagctctcagccatgactaagcttagaagcagcattagagctgatcctctctgcccatgcgagcctcctctagtaagtaggcagtccttgcacgtgggctccccactaggctgacccagattctgagggctgaccttggtttaagctcttcccattcaatctcccttcttcccactcttctttctcagatatcaagtctgtatcatggtctgaatgctctccctgcctgctcttctctctctccctctttctcttccacaaacactgcccccagtaaatctcttgcactttgaattccatcttggtatctgctttccagaggaccagaaccaacacaagtgatggttacatatccaaaagaaattattgtggaaggaaaatagtacagttcttgaaagcaatcaggattgagggataactgaatctcaagagtctccctaatagcataattagagggaggagtggaggacaaggtttgaatcttatgttacagtcataattgggaaagagtacagttagtcttgtaattgggaagagaattcaggatggtggggggaagttattgaaaaagtagaaggaaactctgggaagtgtaggatcatagaacatgaaatagagagagagcgttttaggaacaggtgataatcagcgcagatgtcatcaaagaaaatctgagtagggactgaggtcttgtatttagagactgacagtgtggctggctggccatcaagtgattatttcagggaaagaatgagaataggtgccaagtttacaggaatgaagaagaaacatagtgggaaatagctagaggtaatgacagtagacctcacattgaaaatgtttgtccatgaatgagaggagggaaattgagctaattagagtaataatttccaagattgagtgtgtgtgttttaggaacacctaaccatttccagaagagggctttaaaggtgctagagagagagagaaaaaaaaaaaaaaaacaaccattgtagaattaaaatgctgaaagcagtgggaagagaaaagctactgaggccagagggaggggttagattttaaacagaagagagaaacctcttttctggaacgtggcaacaagaagatggcagaaatgacagagatataaggggtgagagtgaagaacctcacgcttagaatgtgttcctggtacaaaagtaacaagaccaacctctaagaataagagaatgagatggggaaaatgtgtaaagagagtggagatgatcaggaatggctggtgagcatactgttattccttaagaaatgtgatggggcaaaggaaaatcttgccttaaatgcatgaagttggatctctgtcaagtactggtccaaaggactgtgactctaattggtaagaaagaactaataaggtcctggcatttctcttacatcttgaattttcctagttcaactataactcaagtgttcagagaaacaaactggctttacgcagtccacttttgtaattatcaacaatcatagaaaaggaactagtatatagctacttatttgctttgtttgaatggcactgtactttatcataacaatgggtgataaagatgataaaaatatccaagaaccacaatgctctatgtcagaactaggttgactggagaagaaatgctctctgaagcaaacgttctggatactcaaagactggatttgtacagtggtctttaggcgttataactctgtccaggtctctcaacacttacagctatcaaggaaactttattattgatattctacagaaaaaatcacgattactgcaagtctgtaagctcttaagtatttttcccattgaaattattgtttcattaatataatatattcaaccttgtgctatcttgggtatgcaactctacagttagagcagatcaaagggcagtagcctgaaaggagctgaatgacaaaatccatggcatttctcattagtcttagccagaagtggctctttatggagaggactcatcctggtcttgtgaagagaaatgcactgaaactggaaaggaatgagctggccacatcagtttcttcaaagctgccagttgatatgtctatgtctgcaagtatgacttatgcctgttaattaccccccaaactccttcaacagacaaagctctttattctgctgactttgaagtataatttggggatgccttgagaaggtcaacgcgacaggccagcttttgccctgcagtgggctgtgcaggtgtgtgctagctgttggcttccaggcctgttttattccagccctggcagagtttgcaggaatgtcatgagaagagatttataatactttctgattccatccagtttcaaataattttatgaataatctttctcatagcatactagtaattctacaagcagtcttggccaaaatcaacggagtgagcatgcttaaggaaataattttctttttcctttttaagaaatcattttgctgaagttttacaaacctcataaaaattaagggttggtttgaatttgggagaaagactcactttatctgaactcatttgccaaaaatatttaaatgagcacatgctggatgtaaaagtgccaaagcaatagcatcaattatgcattctcaaccttccagactttccagagtcattaaaaggcagcgttttcctacaggtgttaatgggatcctgcaaagaggaaggtggttttaggtaggattgtgacagagtggctcgtgcgttgggtgctatggaacccactgaggggcttctgaccacagtcccatgcagagccaacaatggcattcgttgttataagcaagtgtcagtcacaagagagctgccattacagagtgttgcccagctttccatattcccaacatggccagaggtttcattctttgagaatgtgtttattcagcctagtaaaaacattaaaaaggggaataaatctctgccgaccccaaaatgcttttcaccacagctgtaaaccataaaacatttagaaaggtaagcaggactaaagataatatagtttccccaagcagcatggagggcagacctggaggtggcccttgcaaagacagctgcagtgcacagagcttccctgcaaaatcattaagacagggacaggttctataaggtgctaaattattattagtttttttttaagttgagggagggcaataataaaaaacatgtgctcagcagcctgcttggccatataaaacagaaaggcctgtgactttaagtgttgtaaaaggggttaattgtcgatttctgaatgtggcaagtttactgatcttgttaacagcaacggggcatgtgccgttggttatcatggcgggaaagaaaaacagccatccatcccttattccctggatgccgttattagtcttggaacccaagttaagggacatatgggtgaatgcagtcttaaaattgctcctttccacctgtccaaatttctacccattctaaagcttccagttccacctaacaactgcatttttactgccatttttcaaatgcctgctgtggatcagttcctttcacacaaaatgtgttgtctatttgtatgacaacctaatggagtgggcaaggatgatacaaccattttacagacaaagcaactgaggttcagagaagttaagaaagttatctatggcgacagagctatgaagcagaggttcaaacccgtctttatattccaagtccaggtcttttcaactagttattcaaataattcatttgttcatccatttactcaatagatagttattggccatgcactaagagccaggtgctggtctagttgttgaggatagagccctggacacaactgacaatgttcctgccatcacaaggcctatagtttaggaagcactagtctaacttccaataaccatcctctcttctaacctactttcacatgcacagtcagcatctgtaatttgatattttattttgctgttgagtattgcacattacctttgagtatggtgtgttacctttggctcccccagctagatgatgagcctggtgaaggcagggctgttgtctaatatttctctttttcacagtctacccagcacaacccattaaataagtgctttttttctcctgtagaacatctttattactgtgatcttaagatcatttggggttttatttagagcttagctattgcagcttctgttattgagctttgtcaaatgttatgtttatattgtctcattagtgctgacaccacccaactataagacccattttacagtttaggaaattgtggcttatgagggctgagaaacttgcccgagttcttagagtcagtaagaagaaaagctaggattctgccagtggctgaattcaaaagcccaatttctgtataccatgtacttgagcctgagcagtgagggaatctttgcccacctgaaacatatagagaatatcaaaagaccctatgatatgatatacatgatacataaggtgaatttaataccagccattgattcatccagtcactccaatcactcagaccttcatagtaaaattcatgtggcatcttggctcctgccccaccctctattttgtggtcttcttaaaatgctatcttttttcaatagaataattttcaaaggaatccctgtgttcctagaaaggtgacaaatcagagattgactagcatgaggagggtagtggaaggttcacacctgtttgtaataactggcttatacaaaacgtaagtacgaacacaatggatggcgattgtgttctgccaatgcggttggcattcattctgagaaaagatggcagaccaaggccagagcatggcccagttgctgaaaatcagaaccacactggagccaccagggaccctggtaactaggtggagctgaaccatttatttctgttttgatggcatagtttccactttaagtaatgtgggcttaatcttcatttacattcttcaatctacacagaagtgtatttattattgtcttgtgataagcagtagtgttaatataaagcagtgctccctgaaactgcagacagtttccaaggtctgggcaaaaagaaacaaaaatgtagggaggggagccctgcagcatgacaagagtttttgaaaatgaaaaccaaaaaaattttaaagaaaatgaatcctaatccttttggaactttcatcagtcagtctgtcgacaaggaactgataatttctgaatgtgaagatttggataacaaatgagttacatgtataactaggcttttgctgggtttctctatgtagataatgactcaactggtgagtaccatcagagaaaggccagtacactgggtggcctgtggatgcttgtgtttatttgatgcaaggctcctgctttcgttggggattgctggaagagtgacacacaccaagctacatttctgccagttgtggttttgagataacaaggcttaaaatttgtatgccaaagttaaaattcatgatctttttcctgtgggcacattttagttcagtctctttgctcaaaagaatttgacaccaattattgcttttcagtactattgagcatgagacaatctatagaataatccaaaaaggaagatctataattatacaccttctcataaagggatcatggatattattgctatgtatgtccagaatagctcttcttacttttgaggagtaactattagagtcttaccaggtgccaaccacagtgcttcacattcttgccacagagactggtccaaggataggcagatgacaaaaccaggcaaattctaattcttccacaaatgttttctaatatagagctgccaaaattgctctcctgcattttttaggtgtgcaattgcaatataaatctgaaaatgcccatggccatgaaagatctggaaatgaaaaatagcattatctgattctttggatctagtcttccctgagccagctccacttttcccatgcatggggcgggggggtcggggctagcgagctaataaatatccttttattgcttaaactagctccagttctgatcccaccatttgtaaccaagtgtcctgagtgacataaataattaaatcaggcccagagaaatatgacccttagtatctgacaattaggagaagcatacaaaccataaattaaatgacataaaaataattcttatgcaaaagacagtatacctcaagacatgaagggttgttttgaaatccttggaaagcaatacagactgcagaatataattcttgtgggagaatcagtctccacagtgttttctgcagaactgagaaagtatcacctacctgccagagcagggctttaaaatgacaaatctggtttgttctggacacagtgatttttttaagaattttttttactatactttaaataataaaaatatattttcattgttattaaatattattataatacttttattggtattttaggagcattactccaaagatggtgagaaattattatatacaaaattgtaatgtgtttcaccttcagaatgctattttattttctcagctaatgattattattttagcaagatttgacaataatagtaaaataatcgaaccagtatttttttttttgagacatggtctcactctgtgtctcaggctggagtgtagtggcataatcatggctcactgcagactcaacttcccaggctcagatgatcctcccacctcagcctccccagtagctgggactacaggcacatgccacaatgcccagctaatttttcgtatttttggtagagtcagggatttgccatgttgcccaagctggccttgaactcctgggctcaagtgatacacccacctcagcctcccaaattgctggctttataagggtgagccaccgcgccaggcctcaaagcagtacattaagaactgttcgtgtaaataagctctgttgagggacattaactggggaataaagtggctggaaaggacacattgaactcctttttcatcttctctgaaaatgttaataataactgagacacatctctgtgtctatatctatacttttcataagtgaggaaagaatatgtgaaaatttggccaaaacttaaagtttttgaatgcaggaaaaggtttgttattcacagtggaacaggggaaatgtaagaagatgatacggtttggttgtttccctacccaaatctcatcctgaattgtagctcccgtaattctcacgtgttgtggcagagacctggtgggagataattgaatcgtcggggcagtttcccccatactgttctcgtcataatgaataagtctcatgaaatctgatggttttatgaggttctcattcccttttgcctgccaccatgtaagacacttggttctcattccctcttgcctgcctccatgtaagatgtgcctttcatcttccaccatgattatgagacctccctagccacttggaactgtgagtccattaaacctctttttctttataaattacccagtcttgggtgtgtctttattagcagcatgagaacagattaatacagaagtcttctgcatattgaagagaaaaagcctattgtcttctcaatgtccagatcaattgcatttattccaagtctggggtgtctcatggttcattcaaggaacactgacagtgagtcatgtgacaggccttgggaaaaaaacataattgtgttcataaatattattaagaaaagcagaggatctcaaaagtcagatttggatgaacattagttgatgcattgaaacatggattatgtcaaatatcccatggattctaagctgccttaattgtaaaaaaactctttgatgctctgcttagtacgtaagcaccttcaattgctgtcaagtgtacatacagcaacaattaaagataaacaaataaacatattgggatatgctgtcatcagagtacagggaaatgacccaaaagctcaatgtttccaagaggaaattagttccgaccccacgtggccattgttacagactagaatctggattttgtttgctcttgattacacagaggaagaaacaaaaaataagttgtcctggtgataagcaaatggctgggatggttttcctcagtgaaaatcaatgtgatgtcttattcccaggcctagagataggtgggagatggggagggaagctatttagtttaccagcattactaaagttgcccttttttccctggtggatttccttttcctgatttcagagcttagagaactcagttctgtctagaggccctaacattccacttcccacactcagcatgggcctattgtcatcatggacattttttaatgtataattcaagtaatcctcaaagcagccctaatagtttggtatctttattgttatcagcctctcttgagaatcagaaaagttaaatacttttttaaagatcctgtagatggttagaggcagctaggattcaaatacccatctgtctggatctgaagcctatctcttaatccccaaacccactgcaacatgcagtccattctcacatgtgcaagtgcatctaacccacaaatgctttttttaaaaaaaatattaaggatgagctggtggtgtttcctccataccccggccagtcacagtttagcatcatgggataagtgtgggaaaggtctgactagagtagaaatacagattgtgcccagccttaaaacaataacatgtttctttcacatttcacattaacaaatctaaacagctgatgaaatactgtaatcctaggattatataccatgaggagcctaagaacccctttttaatttatcaaagattcagtatatttgtaatcacatgtaataagtgaggttgctgatgtagaggaaaaagaaatgacaatctttgatcccattgtaccctgggatcccgaaaatcatccttagcctgctggtagccagtctggtctttggtgttcctgggcatgtgtcccattctgagccatgggaatacttcttctcatgtcctaccctctcacacataatgcccacctggtattcttccttctcactccacaccacactccccaactaaccacagccaccattatattctcttcttccctcttctccccttccctgcccttgcttcctttcttctccatgtgtctcttctcctactctgttcccaacataagatttagcatgaagccatgccttttctcctcaaaactgagtttctcaaagatcattcacctccatatccctgcaggaagcgatgggtatgagcagtgtctactagttggatggacagatcaagggatggatggggcttttgaccatgtgtttctttcaagacttgttgaagtcattttattcagtgaacaaatagccattttgatatcatttcttctcccctttcaaattacttattacaattttgggtgtgggtttatggtgggtggcggtagttgcccatgcttttggagctgagatgtaattcttccctccctccctccctccctccctcccttcctccctgcatgcctccctacctcccttcctcccttcttccattccttccttccttccagaaattctttagacaagcaaagaaagaaacttcacagagactttaagcagtttatatccaactatgtgactcctaagaggtgaccgcaggtggtttcaaaaatcttctgggaatgatcccatgttatataataatgagaacactgagcttgacatcaggaggcctggctttagctttggtctcccttttcagtatgcctggaattctgggcagatcacttggcctctctgtgcttagttttgtcatctgtaaatagggaaggtaggactaatgagtgatttttaaactgttcctgggagccctcaaagattcatggaggtgtcttgagagtctgtcctacaagggatgttatggtagagaaggaggtggttgcatagatcaggcagggctgagtccctcattcctacttcaacctgaattaatgttctggtgaaactttttgaatgtatcccatttttaagctttctgctagaaaacctactccaaaaaagtttgaaaactaccagactggattatctttaaggtgccttccagcatacctgacttcaatatataaattatctgtgtgtgatcttcctttacagaaataatggagcctttcttttcctcgtgtggttgttgctctaagaatgcatttcttatcaagagaataatctgcttttcattctgcttcctacctagctcaacagagcacaaaatgcccaagctagatcccttattcccctgtgaatatcttctgtttagactcatccatcatcggtggggcttatgacagacatagatgttttcacagttaccacacagggccaactgttttagtaagggtgaccacttaggacagctttgggctcttgagctgtcctctgttgaagccgggaaaccctaagctgtcatctaagcaacgccgggttgttcatccactttgaaagagacaactttatggtcctgatgacatttcctatattatattaaggatgcatcttgagaggatgtgttgggtttgttttctggacaagctggatgagtctctctctctttctgttttagccactgccctttgtagggtttgtttttcctgctgtcccagaatagatgacttaatgggttgctgaaaatgtccaggctgcctctggctctgggggtagctcggccttaacaatggaaggcatttagcagagcctcatgttttagagcaagaaagacttgagagagcatctcatctggtatttttcaagatgctttttaattttttaaacagcaaaccttttctttccccaatacaaatctgacacaaaacctcaatttataaaacagatttttaaaagaggggtgggaggtaggagaaattctaccaaatggtactttccttgctatttatcctccccccatactacctcctaccacacacacacacactcagcaatacctaagcacttctagggaacccttggcctcccaaaagcaatagaaacccccggtcctgaacctctttttttttgtttgtcaggaaactgaaaaacagtgagatacggtaacttgcctaagaccccacagctagagatctcagtgccagactgcaacacttctaaatctggtttaatcttcctctccacccctctctaatttattatgccacttcacctttgaaccctggaaaagggcaggaagaaaaaattatgtaccagtgtgctcaattcttgtacatctgtctttaattctcaaagcaactttacaaggtgggcattattattatgcccattttacagaaaggttaaatcacttatccagtgaaactcagccagaagtggcagaacttacattgaaagctaggcctatcaaatttcaaagctgttctttctactataccacaggattaaacaatgccaactattgcttgtcataaatgaaaccctctcttaacataagtttgactcaaaaagtctgactcataattcatgaaatactaagtaactcttcttaaataactaccatagactgtccctctccaaagttttctatgtctattgcaagcatgttttgcctttaacaaacaacacccctttctctgggaatcattctctgtcattcctctaccctatctcatccagaaactggggctctagaaaccatgattttgatgtttaattcaagtctggtcttgagtgggccaagctaggaatgaggagcaggagagagttaagacgtaaaattttactcactgtatggattgagcagtggaaagagaaccaagaagagagatcttgtgacaacttacatctccggtttacttttgcatttcagttcaatgaaacagcctacttaccatataatttagtctgccttttttttcctgaagctttggtgtttgtgtgtgtgtgttttgttgtttttgttttgttttgttttgttttgttttgttttgtttgagacagagtcttgctctgtcacccaggctggagtatagtggcacaatcttggctcactgcaacctccacctcttgggttcaagcgattcttatgcctcagcctcctgagtagatgggattataagcatgtgccaccatgcccagctgatttttgtatttttagtagagacggcgtttcaccatattggccaggctggtctagaactgctggcctcaaatgatccactcgccttggcctcccaaagtgctgggattacaggcatgagccgctgtgcccagtctccttcctgaagctttgaatttatgttactagcaaaccaaacaatcctactgactatatcatcaaatcggatggcctgaggattcttcaggtagattcaggctgccttcttgttgcagtcagtcatgcttattttacattcatatcatacagtgctgccatgattggagtcctcagcaatcagttattccagtcctctttgtttatactgaaacaagtcactataaaatctcctgttcacatggataaggtacagtatccagagaaagccaatcttctctagccttattgattttgtctcttagacttctccctgctggacagaaaatgtaaaataggaacgttcaaaataaataagccagggatactaagttcaattaaatagaacaaaatgctttatattttacaaacattaacttgagaagagaaatctaagttattatggtctccaaatggtaatagcccaaatttctactagcaataagatagataattatggtactatgtattcatacagcaaaataatatacagcaacaaaaagtaatgaattatagttacaggcagcaacatgggtgaatgccatgttaattcccatttgtgatagaaatcaaaataatagttacctcttgaagggaatgaccaggaaagtcataggggaggttcctgggtgccataacatttgatatctttatttaggtggtagttacagagctgtgttcactttgcaaaaattaattgaattctatagttatcatttgtgcagaattatgtatgtatattatacttcaattgtaaaagcttaccccaaaaatatctgaattattagaaattagacataaaacttacttcctctaggtcatggtctcccattatataaaacaagaaattaaactcaacattcttaaaactggaagtgatctaaggaagagtatctagttcaaacatgaaatgttttacagaaagagagaccgtggccaaagaagtaaagtgataggctataaattatgaagtttataattggtagagccaagattagtccttagatcttttagctatgttaacaaagatattctaaataaacctcttaatactattctaaaataatttgctctgaagtatacttttgtactaggaacaaagggtttgtaaaataaataaataatgtgaacaataccatcagtgtttgcatagaaacaatatgatatcattcttaaagataaaatccctttgtcactcactccatgagataccatctgatttggtttctgaaaattttggcaaaattatacattgcttgaaatctcattcccaggatgtatttgaaataaagtcttttttttttaattttttactttaaatttcaggggtacttgtgcaggatgtgcagggtttttacataggtaaatgtgtgtcatggggtttgttgtacagattatttcgtcagccagatattaagcctagtatacattagttatttttcctgatcctctccctcctcccactctccaccctccaataggccccactgtgtgttgttctcctccatgtgtccatgtgttctcatcatttagctcctacttacaagtgagaacatgtggtatctgcttttctgttcctgcattggtttgctaaggataatggcctccagctccgtccatggccctgcaaagaatatgatctcattcttttttatggctgcattgtattccatggagtatattatacatgccacattttctttgtccagtctatcattgatgggtatttgggttgattccatgactttgctattgtgaatagtgctgtaatgaacatactcatgcacatgtctttataatagaatgatttatattcctttgggtatatacctagtaatggaattgctgagtctaatggtatttctgtctttaggtctttgaggaatcaccatactgtcttccacagtggttgaactaatttacactcccaccaacagtgtatacgcattcctttttttctccacaacctcaccagcatctgtttttttttttttaataatagccatgaaataaagtcttgatgatgataatgatgatgatgtcaaggattctgacaatgtaaacaatgatgacaatggtacagtcttatgggtggtatgttagtttcctcatttgctaaattaattttttaatggctactctaaaaaagtagcacaaacttgttgactgtcttacagttttgaaagtcagaagtccaaaatgggcctcactggcctaaaattaaggttccttttggaggctcaaggggagaatccattttttttttgtcatttccaggctttagaggtgacttgcatttcttggctagcagccctcttccaaattcagtcagcaacagacagtggaatccttctgaacactgcatcattgtaacattctgactttctgcctctttcctccatatttaaaggatgtttatattccactggacccacccaaaaaattcaggagaatctccttattttgaggtcagctgattactgatcttaatgccatctgcagccttaattcccacttgccatgtaacatattcaaatgctctggggattaggacattcacatttttaggggcctttattctgtttatcacagacaagattgtatttatgcatttttgaaatacatacatatatacatatttcatatagtatatatatatataaggccttgagacaatgctttctttacctagaacaaagttattttgtcctaggtataattatttccattttaccaagggaaaaaaaaagaataaggtgaagcaaattgcctacatttctggagctggttatggcagagccaggactggaagccagatttccaaacccagtgttctcattcagtgaaaagtggttttcctaaacccagctgtcatgttcctcaagctccagaacctctggagggtgagctgtggtggacaatttgagaatttaggtgggttttgtttcagagattgaaggatttgagagatgaaggattggcagttgctgaatagtaagtgctagtccatggacaaatttatgcaaaaggctgcgttctccgtcaatttacacacaattgctactcatctgtaagacttagcatctgcctcacactcccctatatttaaccctcagcctggatcatgtgcttgtcacaaatcaatatttctgccactcgacaggaacttcagccctttcaaattcgttccaggtaatttgaggagactccagggcagtgatgaaataaagtgaaagcccctgatttactggatctggaggcttgtgctgtgagtgagaagtgagggtgaaagacccttatcacaagtatttgtgcttttagatgcactgagtccccacccagaggtaggctccctgccaactcagtcccaaaccccctctgaaatggggaagaaggggcccgggctgtgcagttcaggtaccacaaggtcttcatttgtgcttgcagcaaatagaaaagcatgtttctgacttggcccctagtgtgaggtctggtcttggaggttccgcggtctctcttaagactctcactggctcacctctgctgcccctccacatgccagaattctcaggcaaactaagcttaagcacaaactagggctccagtgcagcccagaacttaaagcactttgctaggtgcagacctggctttggtatgagtctgtgtaatttgtcccatgttgtcacagttgtcagtcacacctccctgtttatagtggttccagggctttgggattcttcaggatcagtcctgcatagtccagccagaggggattactgttccccaaggtactacaggcctcttctttcatcccagctgactgtggggcagaatcagctctgtgatattgataaagaactgaaatagatccttttagacttcaggacttcatcagcctgaaataattttctcagtactaaataaatagttgccccaacaatgatgaaaaataaatatcggggctatgggtgaaataagttgctgaaggaaatttaatgttatcaataatataatggaattttgccctgttttacagttcataaagcactttcacacatgttattcatgtcatcaggaaatgtttactggcgggccccagtgctggagatacaccaggaagtgaagcagagattgtgttctcgcaggccttcttctgggattataaagtggggctgctgaggagtgaacctgtaatcttacacattagcgtatactcccaccatggagccatatcctgctcacagtgcatgtcatcacaaacaactccccgaggcaggcaagactgttaatactacctccacatcagggatcaggcaattgagcctcagagtggtgaagaatcttgccaaagccccacagattgatatgttaaatctgtgttcagttctggcgatccttccaatatgctggtttgttgcaaagcacagtgcctggtccataggaagccctcagtaaatatgaatagctgctaagtgctcagtcaatgccacctgctattatacttgtcacggtggtgtgagaaggataacaaaagtcatcggagcatctgaactcatcagaggccgccagaggaacattctgctccagagcatttgtgttccaaatggaaactataaaagcaaaaataaaatgtttatattttctagttggctgtaaataaagaaataatgataaaaataaattagttgcctgacctaatgctttaaagtttgcagattgagtaatgtctttttccgacagtaaatttagttaacagttatttgtaaaataattaaaatttcaagtaacacatgctcattttgcttaactaagtttgtgggtttattgttgaaaataaagatcaaataggccgggtgcagtggctcacgcctgtaatcccagcactttgggaggccgaggcaggtggatcacaaggtcaagagtccaagaccagctggccaatatggtgaaaacccatctctactaaaaaatacaaaaattagctggacgtggtggcgcgtgcctgtagtcccagctactcaggaggctgaggcaggagaattgcttaaacccaggaggtggaggttgcagtgagccaagatcacaccactgcagtccagcctgggcaacagagtgagactctgtctcaaaaagttgagtttatttttcagctaactggctattttaaaattttggaaaaatttaaaaatattacaaatcatacacaatagatgttgagttaaattcaattcagttgactttattgatttggtattttttttaaaaaaaagttgaccatgtgtggtggctcgtgtctgtaatcccagcactttggaaagctgagctggaaggatagcttgagaccaggagtttgagaccagcctgggcaacatggcaagacctcatctctactaaaaataaaaaataaaaaataagctaggcatagcagtgtgttcatatagtcccagctactcaggaggcacaggtgggaggatcgcttgaacccaggaggttgaggctgcagtgagctgtgatcacaccactgcactccagcctaggtgacagagaaagaccttgtctcaagaaataagcaaacaaaataagcctatcagtaatatccccaaatgttaataattgataccttgatttaaagatagtgatatctatttactttatatcagcatcacttaattttgataaatactccaagccttcattttgtttttaagtaaaagatgtaaaactcatctgggaatatatcaaacccctactagtgcctgccctcaaatgatcaagcctacacatagctgagtcgtaacaaatgtgttttaagggaatatcaagcattagcaatctacccaccacaggaaaacatctaattctataggagtcaagagttagtcctcattctaaatgcagatactctggggtgtgtaattcaacccatgtaagtgccccctctgtgcctggaccatggaatagatcgttcataagattgctgcatctcaggagacgggtcttttcaggagcactggatgattaggccaagttacttgggaaagccagtcactgtatttatttttacaagccagatgctggcacgtagtgcattcttttacaaaaataaaagggatttggagaaaaagaaaggttcagggtcacagatgaaatcatgagggtattttacatggttttatgggtagaaatttttacttttaccttctacaatggttctaaaaaagccgttgagctgctctgtgcagaaagtaaacagggaagagttttatgcccacagtagagtaaaaaccttaaactgggacatcaagggactccatgcctgaggccgtggagaggctaatagtgccacggggtagggaacaggggagtctctgttcaccatggtcctgtctcattcctaaggagtctttgggagcccatagttaagctgttttgataaacactaagtaataaccagatatggacatgtggaattgattaagagaggagggattaactaatgcactaaataacccatcatgcgtggtgggttggggaggaggtagagacataatggtacaagctcctgacgaagaagggccctgagattttccttcagcccacagatatttactgagcacctactgtgagccagctcctgttctaagaacgaaggatatgacagtgaaacaggcacaaattctgctctattgcttgtggagcttacattcttgagggggaacccaaggatgcttaagaagagacagaaatcacaatgagtagaaagagagtgatgtggtagaggttgctactttacatgggttgattagaggaggcctctccgataaggtggcatttgggcaaaggcttgaatgaagtgagagagtgagccatacgtttatctgagagagaggcagataattccaggcaaacgggacagctaacctaaaagctttgtgacagaatcatgtttggcagaatcaaggaataaaaaggcatcttagaaattgcttgggtaatgctttaagatcaattgtcatctcctttcaacttgttacagactcctgcttttaggtgtatgctatatagttattggtcaaacattaagagctggtccccattaataactataacacttcctgtattcaggtgatgagaaaaagaaggtcctgctctcaagaggtgcaaatagggctggggagaggtctggagagaatgagagacagaggcaccaatagctaagtagactagaagtaggtagcagaaccctgacctccacatttctcctgtttgttttaacagctccgcttagcagcaccacaagaaggagcgtggaaagtatggaatcagatctgtttgtgcggtttttacatttcaggcgattaagtgaaatggtaaatgaaaccaaatctattgcctctatccctgtcagtgtgaggcaaagagggaaaataaacttcaactcctggtgtagacagtggaagggtgagacaagcaaacccagctccttcacacccacttcctttcttctcacaaagagaagtccctctcagtccctcagagcttacattgatgtgtccagagagggaggttaaggaaccctggagattcattgttgggcctcatagctgtgcttttattcacctgtcttttataaatgtccactgtatgccagcattgtgctggtgatacaagtgctgtgatgggaatatgcacaaaggtgggcttagaaaaatcttcctgaagaatgcaacaggtatctatctcaaagccagacaagtagggtttgatcgccttcgcttttttaaaacagttccttcattgttaatctgctcaattcatctccgagccatggtctagggcaggatttttttaaccttgacacttgaacctggataataattccttgttgtaggggctgccctgtgtattacaggctgcttagcagcatccctggcctccacgcactggatgccagcaacccctttctccccaatttcgacaaccaaaagtgtctccagacagcgccagctgtcccctgggatgacaatcacccccctgttgagaatcattggtccagatgaggaagtcccaggccaggcctggtgttacttacaaactccaggtacacaagaatgaggctcttcttatgaacatctggtctcattttccactgaagtttgaacaataggaaacaggctaaaaaagcagcaggaagatgttaggttcgctatggaaaagaatttcctgcttaagaagttagtaaggactgacttggcgatgtgggctcttttttggttccatatgaactttaaagtagtattttccaattctgtgaagaaagtcattggtagcttgatggggatggcacgttgtgcacatgtaccctaaaacttaaagtataataataataaaatttaaaaaaaagttcaaatgcaaaaaaaaaaaagtaaggaactagaaaatctcaatgcaacatttataaaatatcctctagatatgtgagtgaaacaaaacttcattaagctgcttatttaaagggaaagttaatctgcagtagaggacaaagtcagaaatagttgctttgtttcttaaaaaatatataattgccatttcaatatatttaactgcaattatcaattaaaatttgcctgaaatggttggtgatttaaaggtgttttctgaggctttgagaacttagtatattaactgaatgtgaatgactttcaaatgagtccttataagtagtatgttttcataagtgaatacacagtgttctctaaataactgtggacactgttaatttttctgtattactgaaaatatagatttcagttctcccattatctgaattaacatgactccaagttagttgtgtctcacttcaccttaaaaaaaaaaggtttctatctaaaaggagggaaagaattaacattcattgaccacccatttgtgccaggctttgggcaaggtcagcagttctctagtgagggggattttgccttccagggaacactttgcaatgtctacaaacatttttggttatcacaactggaaaggtattatatgagcatctagtaggttaaggccagagatgctgctaaatatcgtacagtgcacaggccagctcgctccaacaaacaactctccagccccaaacgtcaatagcgctgagattgagaaactctgcactaggctatatatctatgttatcttatattacccttaggacatttcttaaaacatctttactattattatcccctattatagatgaagaaactcaggcttagaggggtgaagcaacttgttcaagatcctaaaactagtacatagaagagtcagggttcttatccacaccctaggtgctgtgggcagctgtctctaccacactcagctgtcctcttgtaggtggtttttaatttattatcattattatttttacttaaagccatgtgtgacaggactttgcaaggaggatgctgatgagtccaaaggaaaatcacaagtgtgcccagtcctctactaatcaatatagcatgaagtcatatacatcctgtcccctcatgggtaataaattcttttttttttttattttactttaagttccgggatacatgtatagaacacgcagatttgttacacaggcatacatgtgccatggtggtttgctgcacctattgacccgtcctctaagttccctcccctcacccccacccttcaataggccctggtgtgtgctgttcccctccctgtgtccatgtgttatcatggttcagctgccacttatgagtgagaacatgtggtgtttggttttctgttcttgtgatagtttgctgagaatgatggcttccagcttcatccatgaccctgcaaagggcatgatctcattcctttttatggctgcatagtattccatggtgtatatgtaccacattttctttatccagtctatcattgatgggcatttgggttagttccatgtctttgctattgtaaatagtgctgcaataaacatatgtgtgcatgtgtctttatagtagaatattttatattcctttgggcatatacccagtaatggggctgctgggtcaaatgttatttctggttctaggtccttgaggaattgctgtactgtcttccacaatggttgaactaatttacgttcccattaacagtataaaagtgttcctatttctccacaacctcactagcatctattgtttcttgactttttaataatcgccattctgactggtgtgagatggtatctcattgtgattttgatttgcatttctctaatgatcagtgatattgagcttttttcatgtttcttggccatgtaaatgtcttcttttgagaagtgtctgttcatatttttcacccactttttgatggggttatttttttcttgtcaatttgtttaagttccttatagatgctggatattagacctttgttggatggatagatcgcaaaatttttctcccattctgtaggttgcctgttcactctgatgatagcttcttttgctgtgcagaagctctttagtttaattacatcccatttgtcaattatggcttttgctgcaattgcttttggcgttttcattatgaagtctttgcccatgcctatgtcctgaatggtattgcctaggttttcttctagggtttttatggtttggggctttacatttaagtctttaatccatcctaagttaatttttgtataaggtataaggaagggtgatccagtttcagttttctgcacgtggctagacagttttcccagaaacatttaatgaataggagatcatttcccgatcgcttgtttttgtcaggtttgtcaaagatcagatggttttagatgtgtggtgttatttctgaggtctctgttctgttccattggtctatatgtttgttttggtaccagtaccatgctgttttggttactgtagcctgtagtatagtttgaagtcaggtagcttgatgcctccagctttgttctttttgcttaggcttgtcttagctatacagggtcttctttgattccatatgaaatttaaagtagttttttttctaattctgtgaagaacgtcaatggtagcttgatgaggatagcattgaatctataaattacgttggacagtatggccattttcatgatattgattcttcctatccatgaggatggaatgtttttccatttgtttgtgtcctctcttatttccttgagcagtagtttgtagttctccttgaaaaggtccttcacatcccttgttagctgtattcctaggtattttattctctttgtagcaattgtgaatgggacttcattcatgatttggctccctgcttgtctattgttggtgtaaaggaatgcttgtgattttagcacattgattttgtatcctgagactttgctgaagttgctcaccagcttaaggagtttttggggtgagatgatggggttttctaaatatacaatcatgttgtctgcaaatagagacaatttgactctctctcttcctattagaatatgctttttgtctttctcttgcccgattgccctggccaaaacttcaatactatgttgaatagagtggtgagaagagggcatccttaccttgtactagtattcaaagggaatgcttccagcttttgcccattcaatatgatattggctgtgggtttgtcataaacagctcttttattttgagatatgttccatcaatatctagtttattgagtttttaacatgaagggatgttgaattttatcaaaggccttttctgcatctactgagataaccatgtggtttttgtctttggttctgtttatgtgacggattatgtttattgatttgcatatgctgagccagctttgcatcccagggatgaagccagcttgatcgtgatggataagttttttgatgtgcgggtaataaattcttagcacacgggtacagtcttttgtttcactttgttttcctcgttattctgtaaacctgccagtttatgcacgtcaaaggtctagaagaccttgccagttcctctgtccagagtccccaccctgccactgaggagtagcatgcagtttcacaagtcgtgttaccccaagagcttcggtttcctcatctgtaaaacaaggatgataacactttcctcacatgattgttgaaatgatcatagagtaataataatagtcagaggtacaatttattatgtgtgttatgtactgggcgttatattaagtgctctacacgtattatctcatttaatttttagaataaccttttcagtagttgttgcccccattttgcagacgacaaaagtgaggcactgagaggttgtgtaatttacttgagtgcaggtggtcagtaagtagcagagccagcatttgaacttagaatgtctggctctaagcctcagactctcttaaccacaaagctctctgtcaagtgctatacaaatgtgagaattattatgagcaatgatagctagtttaggtgattaaaaagctttatgtgcttcagagagttttcacagggtaatcatcataaattcctttttcatcgtctttgctgttccatccttgtgatcattatgcagtacctattatgtttcacctttgtgtttttttctttcttttcacaagtttaaataagggaactaggggtcttttttttaagtcaagctttgttaatagattttcagaatgcacattaaagtgccagaaattgagtgcttttctgattagtaaagattgtattggtttttttttttaacaattcactttttagatttctattttaagcccacttagagctgattacaataacccctatttataaatagaattttactgggcctcacctctgacgtattttcaaattcagtctcactcactctaagtaaaataatcattcatcaagtgaaggtagggtagaataagagcatatttctgcagctacctctgtgttctgagggagccagccataaatattcagcatcggtggtcagagtttggctctgcattaaatcataatcattttactggtgaataaatgacatgtttaattattttatatggatgtataaattttggtcttgatctgggcagcatatttttaacatctggatttttttgttttcttgttgtgtgtgtgtgtgtgtgtgtgtgtgtgtgtgtgtgtgtttaaatcactgtttaggctgggcatggtggctcatgcctgtaatctcagcactttgggagaccaaggtgggtggatggcctgaggtcaggagttcaagaccagcctagccaacatggtgaaaccccatctctactaaaaatacaaaaattagccaggcatggtggtacatgcctgtaatcccagctactagggaggctaagccaggataatcacttgaacctgggaggcagaggttgcagtgagccgagatcacaccactttactccagcatgggcgacagagtgagactccatctaaaaaaaaaaaaaaaaaaaaaaaaaaaaaaaaaaaaaatcactgtttagctttaagtgctaggacacaaaatgtgaagtcactgtggtctttaaaaatctcaattaaccagaacattcaaattgctgggtgtattcaacactccacttctgggataaagagttaagtgacaagggcagagctggccgtgggaatcactatggggctcccagtgcctaggcaagtcaggttgagtgagcctccactccacccatcacataacacacacacacaccaatacaacattctacaacaaaaagttagcaaaagagtgttcagcaatgacagtctaaaatggaaaagtcagagagatgaagtctcaaagggacattctgtattctggagattatgtgtagagagatacagaagaaagtcatttggcaacaagtttcaacaagcttctgttatatgggtcacccttacagggtcgtaagcatcccttgggggattgttaaaaataatgtttaggaccctgtcctagtcctactaaatccaaatctccagaaaacccagggaaaatgatttatttaaagggccacaggtatcttggacacaccccagagctactgaatcacagtctctagagcttgggccaggaatcggaatgcaaaagaagctccacaggtacttctgatacaaacccccggcttagatctctgggggtggttcctggcaatctgcatctttagtccatcctctaggtgtgtcttacagacaccccagtttgagagacatggcatcaactattgttctgagttttatcagagcagaggtagccaaatcttctagaccttatagatcagctccgatgcacaagattggcatgaaaacagcttacattaaagtttacttaaaaattacacatttcctattaattttaatcttcacagtcttatgaggctgctgtagctggaattataagtgaagaaaatgaggttcagaaaggataagtaacttctccagggtattttctgagcactctgagcaggtggcagagtttgggctcaaatcacatctttttgactcaagccctgagctccattcctgcacttatgatgtggtgcacagtgcctagatagcactttcacacatagaatcttccttgtgctatagaagagccctgtaggcaaagttacttatcctttctgaaaaatcacaatctcggctcactgcgacctcaacctcccaggttcaaccaatcctcgtgcatcagcctcccaagtagcttggactacagacacacaccagcatgcccagctaatttttgtatttttttgtagagaacagggtctcactttgttgcctagactggtctcaaactcgtgggctcaagcagtcctccgctctgccttccaaagtgctgggattataggtgtgagttacctcattcaggccctcctgccttccttttattatatggtagggtgggatgggcaggaatttgttgtcttttgggggcttctgatgtccgaatgtcttattaattagccctaccaacagacacaactcagaccagagctaaccctgtcaatttagacatcacttcctctaggaagcctttgctatatccctccagtaaaggtcacatgacctcctctgcacactcagtctccctgtctttgtccatatcacatagcactatctgttccatgaggccaggtattgtccatatgtacaataggaacataactcttaatcaaatattcgtggagttgatgaacaagtgcagttagaatcagtggataaatccttctaatattcaaagcaatgaaggcagctcacttttctcctatgcctattctaaaatcaaattattcttttattcatattgtctgttttaactagattttatgtgcataagtgtattgtaaagtgggaaggaagaccactagaggcaagtacttccttctccatttgatgatgaggaatctgaaggtaagaggcagcaagtaacttttctaaggtcacacagcctatcagatatagagctgggttttgcattcaggtcaattgaacattgaaccctgaggacaggcagctggtaagtatcacagctgagattaaaacgcaagccatctaattcccatcctcatctttcttctgcttgcttcctgcctaaaaaacaggataacaaaggagggttgtttctgtttgtaatttcaaagttagtactcaatatatcacaagggtctcttaaatcatacagtgttcattacctgcatattccttgtgagagttaagctttggtcttcctcattttaccagatgggaaaccaaggccaggaagtttcagcattctcaccagctcttcagaaagctcatgtatcttggaagcagaatgcaggatggtgctggaggggctgagagtaggtaggaaattaagggactctgttaggagcagtggagtaaagacctttaacttgaaaccatttaaaaaatactttcataccatatatttgtgagcccaggtaatttctgaatttctgatccaaatcttttcctccaaaatgcctgctaagaaactctagaggtcgggggtgaagcggggagggagaaggaagaaaaaaaaaaagaaagtacaatgattccattcagaaacttggtccaaatccttgtctctttcttctatcagaaatcctctgttgtcagtccctggcatcacctagagatttccttaccagcagcattcttatgtttttactaaaacttctcctagaagagcatgttttgcttttaggagccagacttaagaaagtgcatcagcttaaaaatacatttgcttgtaatttttgtccatgctgccatctgacaggatttgaggatgcttccatttctgccaggataatagctttgttatctgctgagatctgcaatagctcgacagcacaggaaatctgtgtctcagccccctgctccaagtttagctcatccattacctaaaattgggtttacacaaggaaaattactttagtgctaatccagttgacttgtaaagtaaatttagcttcctcgggttcctagtcccataatctaaactgatttcaacaacagctttaggagtcctcccacacttcttaagaaccctcaggagcatgggtccccagcaagctgaccacagctactagtcatcttcaagccagtgatgtttgctgccttggtacattgtccgtggctccacaattacacactggagggtagggctgggagtagtgggagaagatagccttgggctattcatttcacatttctgtgtctccgtctgtaaaatcctggtaacaaatgaggtgccacatagagggaaaaagtggaattaaatgttttgaacccaactcacagaaaatctgtggagtaaaaagctgattacaagtaacaaaatcttcctttttttctcccttgttcctaagtgttagacctgggttcacttgccacaacttataaaccaatcaaatgtgatgatgtttaagacttgcttacagtggtttccccaaagctaatcaatgaaaagtccttacattccacaaactagtcagctttgcagcaacagcctcaccttcttggggaggcacatgatgtgagtcacacaattttcatgccagcccagagcgttgggtgccattacaaagccatgggtgtcttacatgaatgggagcctcgcggggggttgaagaggctgatctgatctgtggttcctcaattcagaggacatgagcttttgaaaataggcctttctaggtgaattggcctgcatgtcatagtttacacatactgagagctgatcatatatcaataattgttctaagttccattgtgggtgagtgctattgtgatgtgctattgtgtgtgtactattgggtaagtgctattgtgatgtttatcagatcctcatcataaccacatgaagcagtaaaggtattatctccaactggggcacagaaaaaaaaagttaacttgtccaagtcacatagctagtaagtggcaggcctagaattccaacccaggcattctatcatgattactagtggccacgaatcagatgattgtagtaacttgtcctggacttgggagatctgtatgctgactcatagagccctaacagtgtcttaattgatacgcccagtggtttcttctcagtcaccagtgaactttgtagaataggatgcagctggttaccctttcatagcatctttcacccttttttcccacctctttgagactctttttagtgtgctttgttgacttctcttcctctttcaacctcatatttgtggattcccccacaagtttctgtccctgcccttcctccttccctcaccatctaatctcacctgcatacccagtgtgctcatcaattcttataggttcaactggcagttctataaggatgactgaaatttatcagccaaccctgactcttttcccgaatgcaagacctgcatttccagcctcccattggacatttccctatggacagcctgccagcattccctatttcacctctccacattgccgcactaatttgcacagtagccagtacataataagcatgtgataaattggtaatagatgaaagaatgcataatttaatgaaacagttgccaccttccatagatttaatcttccagactgctcttacctaagctactttcttccgtttttctgaatcccctcacttaaccctgctctcaggtgcccctcaacctgcatcttttgtttctctttgttctggtgcctgttttcttctcttctacactcttttatagttatttctgtaaatgtcttttctattcaagaatgtgcatacattaagggaagagattgtattttcttcattggttttcactaaatagcctaacaccgtgcatttcacaaagaggcacaccatatctatggaaagagtgaatcagtgaaagtagacatagcactctgcagtttacaaagggcttcacaggtaccatccctatattctgcagtaggccgaagagatagccgttgagtcattagccccattgtacagatgaggaagctgcaagttagtgtggtcgttaatggtccagaatctcactgctcttaagtttccaagccattcttatgattttaaactggaaggcagatcatcccctcatcatgactttctcccccatgtactcgggaaaaatgagggagagagacaagagaactttggggtgaaaactcacattgggaacaattacaagtgtgtctgatttggtagcttggatgttacaaccactcatcaattttcatgtggcttcaaagaccctcatttgaagctcctaagagcagctcacttcagaagagacccaggtaccaatttattctggagagttccagtgtttcgtcctaaaaaaaaaaaaaagaaagaaagaaaaaagaaagcataaagtttaaacagatccaaggatttttcttttggaatctgacagatctgggttggaggcccaactttaacatttaacaatcgcctccctgcccccatttataaaatgaagataaaaacactcttactcgtggtgatatatgtggattaaaaggataaattttaaagtgcttggcatgactcctggcatgggaactcagtccattttctccctctgcccctgaattgtgcctctgcctttaactccttctatatgtgggaccatgaccggtgaacttggggccaagatgagcctcacctaccaggggtagagagtagaaagcccaagctgatgactgaagctggaagtgtcagcttcttgcacaattgctgccctcttagagctgcttgaggccatctcaacgtgcaacatgactgacatgcagttaggtcattgaaatcacaccatcggaattcttcagcttaatatgtcgcttcttagaaagttaatgcccttttgatactatcagtatgaaatgttgagaagcaaaagctcaaaggcttaattttagaagagagagagcagtttctaaaggagtgactgatgggagagagactcagtagttgactatgcaaaggtgcccagggcaggtgtgaacaacaaagctggcttcctgatacaggtagtactgaaagaaccccggctccacagccctgcagcacctttaaagaaagggtgagggagacatgcttaagcatttttttttctgctccacaacagggcccagggtattgacagtgctgacagaacaactgagaagttgtttaggttggcattaacaaacccggcacattgccttttctgattgacacaattcaaacgggtatcaactgcctttcagtaccactgagaagtggtgaacgatgagggaatcatagggccatccaagtgcattcctagcagggaccatgaatcagccttatcttgtcccacctcctctttacacagggaggtaagccaaggctcaggacatcatcagatatgtgataaatcctccattaactggaatagtcagttaacaagacttgtttgccttttatattgttatagtccaattttggttaagtagaggtaaaataggtaaaaataagatggttgtttgtttgcttgtttttgagacgaggtctcactctgtcaccaggctggattgcagtggtgcgatcatggctcactgcagcgtctacctcttggactcaagcaatccccctacctcagcctcccgagtagctgggactacaggcacgtgcccagttaggttgggattttttcattgaagtgattttaagtaatatgtacagtttcacatctggtaccttgctccaccatttactaactaggtgaccctggacacatttctttatttttatttttataacttgctctgttgcccaggatggagtgcagtggtgcaatcatagctcactgcagccttgaactcctgagctcaagggatcctcttgcctcagcctcccgaagagctggggctacaggcacatgccaccatgcctggctaatttttaatttttatttatttatttatttattttgtagagacaggtcttgtcttattgcccaggctggtcttgaactgctggctttaagcaattctcccaccctagcctcccaaagtgcatttcttaaattcttatatatgcctcagtttactcatctgtataagagggtaaatagaacttacctcttatggttgtaacgataaataaataagataaagtatatatatgtgtatatatatatatcacttaaaaagaataagcactcaatatatatttattttattaatactgctattatcatctgcttttgctctatctctattcctgcctgatgcacctgaaggttgagcggcattgtaaacagagggtggcagcatgagcttaggcattgtgtggaactggatgtgaacttggggaaattgcttcattctctaaacctcagtttcctcatctattaaatgggaggagtaatacctgcctctgcatgattcttgtatggaacaaataagatcatatttataaagtgcttaatacacacctgccaataaatggtcaacatgattatggttagaataaggattctaaaagcattataaagtgccggatcatgaaagatcgtagctcttcattgattcagtatttatctcttgagtacttgctttatgccagatacagagtttggcactggggacccagatttacaatgtgttgaaacaaatggaagtttctcgtgaactcttggtcactaatgagatgagaccatcccgttccaccgcactttcaagttaatccatgctcttctatagaatccttacattccagctgtgggatggctgtgtctcatatctcctcagatcaaaaagcatttctgcgaacagtgatattgaacattaaactggctgcatcaaacttgaaaggatggggcggtgattttgtgtcacaatatttttaacattatgcctggcgaatgtgcacatgttagatataaaggaggtttccaaaggggaagctttactacttggacttttaaattgccaggctgcattcttgggaaagccacataaaagaatacccctttttaaatgagtattacctcaaaaagtatagctcttttacgaaaggaatatgttgttctgaagccttgtccttgatgattttactgatattgtgatggttatttcaactaacataagaaggaatctattagataacaaacattcacagattgcctctgcttgctgggaattacatccagcagcttgaagagctgggtatattgaaaggaaaagggcgttttaaatgtataatctactcttccctttggcaccaatccgtgtagtgagacaacacttggctgggactcgggatctggccctggcttccattctgccatgactttgagaggaaactcaagttccgccttctccaggaagttatccctgaccaccccagcctacggtggattttcctgcactgaatgtgttacacttagattccatggtatatgatttaacacatggcctctcatatgaaataacatatgaaatgttatttcaacattttatatcttgtctctccagaaacgttacatgctccttgagggaagaaatcaagtctaacctgccttttgaaccctctatgtagtgctataaaataaatatgtcctcaaccaagtcctgattgactaagaaaaccagtgattggtcaatgatgttactttgtcttctgctaaacatttttggggcaggggatagaggggtgtgggagaatgggagttcaactcagaggaaacttagtaaagaggaaaagacataacagacctggtattgagtccccatctggccaattaatcaccaagttatcaaataaagcctatttgatctcttcgacctcattttcctcatctttgaaatatcttcctcttagcatgattttgaggatcaaatagagataatatatggaaaattctttgtatgcaggagcccactttgtaatgttattcattgcttcaattttcaatttggcttgggttaagaaaaaaagtatttttttttctctcaaaccagtgagcgggggaagaatgataaaaatcacattttctgaaattactctagcttatgtaagaagtttgatctgccagtatttgcctttttctcacatcacctgctgcatgccacacacctgatttgtctgttgtgttcatgtaggattttgtagctcacaaaagcattttcacatgcattatcatacaaaaaccctgtgatacaggcactgtggaagtaagtattcccatttcattgatgagtaaactgagactcacagaggctttaaaaatgccccaacatcaccctatcaggctgacagtgcctgccttcctccagccttgtcctctttccacaacaccacactggttctcctgtacaaatattaggcagctcccacaagacattctcagtcacaaacatgatcaccatctacttcctagtcaaggagatcagttcacgcattttgtcttcatacaaataattaaaacagggactgggtaccttggcccatgcctgtaatcccaacactttgggagttcaaggcggggagatcacttgagcccagggatttgagaccagcctgggcaacatggtgaaaccttttctctacagaaaaaacacacaaaaattgctgggtttagtggtggcacttatggtcccagctacccgggaggctaaggtgggaggatcacccaagcccagtaggtcaaggttgcagtgagctgtgattgtgccacagcactcctgcctgggtgacagcatgagaccctgtctcaaaataataataataattaaaacattcaagcaagatcccattcagtttataagtcattaataattcataataaatgtaaacattgtaagcctggcctttctgtatttagcagtatagcaaaatggttaagaattagatggacctggccgggtgctgtggctcacgcctgtaatcccagcactttgggaggccgaggcaggcagatcatgaggtcaggagttcaagaccagcctggccaacacggtgaaaccccatctctactaaaaatacaaaaattagctgggcatggtggtgcatgcctgtaatcccagctactccggaggctgagtcaggagaattgcttgaaccgggactcgggaggcagaggtagcagtgagccaagattgcgccactgcactccagcctgagctacagagcgagactccatctcaaaaaaaaaaaaaaaaaaaaaaaaaaaaagaattagatggacctgatcctaatgctcgttctgatgctcagatcaaggggaaaatgaggaggctttttaggcctcggtaaatcagagttaacaacacccagttaacaagcccagtgtcacagtgagagtgaaatgagataatgcatatatagcactttctcctccatgtgactcatagataaaagctgttgatatttcaactgttctgggctatggaaattttaaaagatttcatgtctaggtgacacgtgaaagtccagcacgtggaccataaatgttgtcatggtttgacagtattaatgaaacacttcatcgtgtgtcagccagcctcaccttgacaggtcatctctggctggcgtaacccaagggccaatgtgaaaaggacatttcactgaggacatgatggggttgccttgtttttcttgcttcttaaagagccatttcaattaatttttttcacacataatcctgaccccttggcctcccagtagaatgctatacgtgcacaacaggaattttggcgtttattgtttatcctctgggggaatgtggtcccccttttactgcctttttcagcccactccccccagttgaatttttctgagaggcagtggaagggaaagtatatacccccatagttgtatttttttatccttattcacgattctcaacagctttttaaaagtgatggctggcagccaggtacagtggctcatgcctgtaatcccagcactttgggaggctgaggcagaaagatcatgaggtcagcagttccagactggcctggccaacatggtgaaacctcgtctctactaaaaatacgaaaattagccaggcgtggtggcaggcgcctgtaatcccagttacttgggaggctgaggcaggagaatcacttgaacccaggaggtggaggttgcagtgagcccagactgcgccattgcactccagcctgggtgacagagcgaggctccgtctcaaaaaaaaaaaaaaaaaaaaaaagtgatggctgggggcctatagtctataatctgagctgacctatatccatggcacatgtgttaaaggtggaaccatagtaggtcaggacagccatgtaaggtgtaggtgataatatcctgactttggaaatgaagaaatggatgcttaaatggctaagtaattatttaaggccacatgggtaagaaagggcagagctaggatttgaactctggtttatttgattccaaagcccttgctcttggatgctgtgacttagagattttcaaatgccactttcttaaaaaggggtcttctagaaataaaaacttttaagaaaaggtgaactttcaatggtggaaatgtgtgtattgtggcagtccagtcaggaaatggtgtgttatttttgagaagcaaaaccttttggtggttctcgactgttctccaaagacgcaatgtgcactgggcctccacgtagggaactccctttgctgagtctttaaaggaacctactggctgatgatgattattattaataaagtctaatatccagagagcaggattctttcccatgaacaggaccatggaaagcctggagttgggggaggcctagggagtcaacaatacaaaggaggcagtaggttcatggagagcgctgtgtgggggcacagtgaggaattgctacggggagcctaaagcagcattgtccagtggaaccacatacgtcatcttcagtttttaagagctacattttaaaaagtaaaaatgaatgaaagtaattttaataagctatttttaacccaaagatccaaaatattttcattttaatgtgtaataaatataaaaatatgaatgagatattttactcttttttttttctttggtactaagtctttgaaatccagagtgtattttacacttaccacacatctcagtttgagcccaccacattcaaatgctcaaaagcaggcacgtgtggctagttgctaccatactggaccatgtaggtctaatggtaacaatggcactgcagcctccttgacccagcaacactcactctcctccaccccacttcattttcctgcatacacttaacacctgccagactatatatttcctttatttgtttatagtctacctcccagtattatttagggttcagtctaagttggtgtaataaatggatggatgggtggatggatggatggagaatggcttaatcaaggtagaaatggatttccctccagtctagaggaggctctccatagctggaagggtatctctgttcccagtgttcacattaacatccagcctcagtctatcttatccctctgccagcctcaacctgtagtgtttaccttgttctggatgacttcttcagcatttctcttcatggccacactccagtcagggagatacccctttttttttttttttttttttttttttttttttttttttgctcagccctatcttctttcttttcttctttcccttcccttccttcctgtctcctctctttctttccctgtccctcccttccttcctttcttccttcctccctccctcctcctcccctgctttcctcctttcctccttccttccttccttccttccttccatcctcctgtttctttattttggtaaggacctgacccagaggtggtacaccttgatcagaaggtaaacacctccttgatcagaacatagtcacatgaccatatctagctgtggtctccagctggtggtcagttaatgtaaggagttctactattaaaattgggagagaagagcagatcttgatggacaactagaagtctccaccactgtccctcccccggaatgtaaactgccatgagggcagggattttgggatgttttgttcaatgtagtagacccagcagtggtgtaccaagggctgggcagtgggaatatgcaccctggcggggaagagtattttaaacaacattgtttgaattgccggtgcataacggtaataaaagtggactaacataattggtctcattattgtttttatattatccacagagtctgcatccaatattggctgcaccagagcagactgctctgttgcccagcccttggtacaccactgagccctggcacctaaaatagtggctactcatagcaagcactcagtatctgcagaatgaaccaatagatctacctctgcctcttttccttccatttcttcctgacttctacccttggagaggcagccctcaccaggtagtagaccttatggcatttcattatggttagctacttcttcctctttaaactgtgagctctttgagcaccagaacctgcaccagctgccacaacctggccaccaaccaggtgctcaattagtgctagttgaaggaaccagtaaaattcattgaaggctgctccccttagcctcacttagcctgcatttagttgactccaagcaggaattttctatctgattctctttgttttgtctgaacccgagatgttgaggctggaaatacagtcaagatccaatttgtgagctagcttatgagtcaggttaaggaatttacactgtatcctaaaaacagtaggagtcatcaatgcaatttaaccaggtggaactttcattaaaatgtaactatgtgatgtgaggatggggaagaaggaactaattggccctttctcttcagacctcttgacttcagctttctggggactggcatttccactgttcttccatcatttctgagggtatcattggtttaccctctcaatccaaatgttcctctgtggttccccattttgatgtttaatctttgaggcatccacttatgtattcatcgatccttcagcagtcatgtactggaaacccttaggatgcatgctctgtaagacagggcgttctgccttgtccactgctgtggccccaagagtgggaggagtgggctgtcagtaggccaccaataaatatctgtgttctggctgacccccatatgctaggatactggagatgaggaactggagaaggtgcttaaagagcacatctgtctggtagaggacacagagctgtccttcaagcatttgaacgatgttctcatttccctggaatcttctcctctccaggctcacatctctagctccttcaatgattcctcttgcgacatcattttagttctcttccccaacctagtctttttgcttttaatgaatgatcactgatgtatagccctgatgacatctggtgtccacagtggtgcctgatgctccgggtgaagttgaagtttgaccagtaagagggaagaaagaatggctcctccctcatttcagagaatacatcctagtcacaagtgcccctaatgtcactcaggtttttgatagctacattccctcactgatccagtagaatacactaccaactgatgcaccatcttgattaacaacagcaagcctccccttccttcctcagtatctctcctcacatggtctcccatccagatttgctttaagcctgccactctggaagggacaccagagatcatttaaataaaacacattatagaactggttaataggctacctctatgtctctgcaaatattccaagcatagtttggtgagtataatcaaagaccaaaacaatgtttgatcctcatggagggacactatgtcttgttatactattgtaagttcccggggttttattcattttggcatttagtggatttgtctttgacatgttggatttaaggacatcattattcttggaatttagaaaagaacactgtgcctggcatgacatgaagccaacttagaaaacccaaatttgaatcccatttttgccacttaactagctgtgtgatcttgggaaagttggttaatctcataaaacctcagtgttttcatctaataaagaatactaatataaacatagaatggacagaaaaagtgctaaaaatgtacaaacagttcatgtaataactagtacaaaagttttacaaaggtgaacatatgaaaaagatgtttaactttactaaggataaaaaacgaggtatgatcttaaagtgattttacctagcaggtactttaacaggcacttgtaggcattgagtgcagaaaaatagatactcttccccattgatggtagaaatataagtcataacagttttcttaaaagatatttataaattcatgtaaaaaccctgaaaatgtgcataccttttaccccaaaataattccacttattgttttgagcctagaaaaataatcatagcagtatataaggatctatctacaaggatgtttatctcaacatttttataaataatgataagttgaatataatggtaactgtgtaattgtggtcactaaaagtaatattttagaagaatacttcataatgtggaaaatacatattacattaaaaagaaaaaactatgtctagtataattccaatttgcaaaaataatttgtgtgtttatatgtatgtgtacagaatatatgctacatattaaccttaattatctgtggtttgtggatgtagatgattttaattcccttctttgtgcttctattcttcaaaattaccacaacaagtattatttttaaaagggtggaatgagaatgccctggggtatcttataagaatgtgatgaaagtctaaatttaaattataaattaaatcatgcacatttattgtattattgttagatattagactgatctcaagctttgcctttctttttctcccttcttccctttctccttccctctctgtctccatctgcccctttttcttttcttcactgtctattctctcctttccttctaggcccggttttttcctgctccttccatggggagcattgctcagctgcccctaggattcagagtcaaatagtttgctgaccctggtctgaagctcatttgaccaaactgagcaagaagtgcacaagtttcttgcatttccttccagacctctagtagccctgacacacatcctggactaatcaagactatgtgaaacgtacgtccatcagttcagagttgagctcttgtcatataggagcaaattaccaacttctcaaaaactgccaggggtgggaaggggttctttccttctgcatcccaagtgctggatgcctctgccttccaacactactcgaaaatagctttgtcaaacaaagcatgaacactaggagtttctgacattttcataactatgagcatatgatttgcagttcatattgaataacgatgtaagaaatctgccaagaaagctccaaatactatttccagcactggttcataaccagttacagctgcctcaccacagaatgtgagcacaatagactaccatgttccatggtctcttgcttgcaaagtttgtattgagttactaggagtcattctaatgggggaagtcactctcctggaaagcatttaagatgaataaagtgaagggtttaatgttctaatgaaaaaatttgtcaatatattaatcaaatgtgtgaacactaaacgtttttacgtatgtttgctgtagaggttttaaggcgggctttggctttccagactcaaataaagtagatagatgcactgttaaactttcgaacaatgacaaagaaaaacatggggtaattgcttcactcaaagcctgccaggagattaattgcctaagagatgtattttgtgcagtatccaaaaactgcagaatctacaggagtgtcttgctttcactaggagaaaacgtatgtcacctctcaccaaagatgtttatgtcttttcacaaacctgtctttttgcagtctaaaaacattccaactggaaatgactacaaagctgggagttgataggttaggggtgtttagtaaagcttcaaatactctcatggagtcagatacgattccgtactacgagccccacataacagcaacctgggcccagggattgtgaagccttttcatttctggttaatcagtgggagaggtggggagccatgagcctgccttggacccgccagccccgaaactaaaagactaaagttgcagggcttatggggagttcgcctagtgcacttaagaaatagggatggaacttgccttgttccacctttgggattgtattcaaatgagggcttgctaaaggctgaaggtgttggaatctgtaggaggtctgtgtagccatagcagagaaacatagagtgcgcttttataaacatttatttggtgccttctacaaaccaagttatatgtactagactctgctgggagtgagactggggttgcattactactacatggaaaagtaagaacagttgctgtatttctggaacattctgcctggtagaggaacagacttctcaacaaataataattatacagtgaaggatgctagagagaacatattttctcatgaactaatctgaaagtttcaggaaagcatcttaaaggagataagactgaaccgaaactggaaggatgagggacagagagccaggtgaagaaaaatgagaatggatttcctggaagggaaatagccaaggcacaaacatcagtgccagtgtgatatgttcagaaactataagctgttctttaataccaggacctgagaaccaagaggggcaatgcaggagactgggctgaagatgtccatggggcagttatatagggaccttgtgattgctgttaatgtgctaggactgttgccagtggactttatacaatagagagtcactgaacatttgtgagaaagagataatgcaatctacctattagctcatcattctatggcaacaggaaagatcaatttacaggccaagaatggaggtagagagaccagttaggagactcctgcagccatcttggtgggatattttgagagcttacactagagtaaccataaaaggttagaattggaaagaacatattatacagttcaacttccatattatacaaatggagtaagtgaggacaaagaaggtaagtgacctatccaaggttgtatggaaataaccttgttggcagccaaagtgggaccaagaccctggtcttctcatttccagtccggtgacttttccactcagcaatgccaagttcagtcccagcatcatgcttcagttagggaatgccctagagaaacttgaaatgtacttggctggcatttttcctggccatatctaggaagtgagaacagtccttgttggatggagggaccttgaatccagccaggctgcctgggagggatctttttctgttcattatctttctggctttaggtacctcccacatcttccaccctcttcttctcctctaaaaatccttcttcagccattgcttacaaattctctcccttctgctgagtctaggcagtgtagaacaaaacctagcaccttttttcaagtttgtttcctcaatattttaacctaactattgtatcactgttaagcacttgggcaattttgaggatgaataatccaataaaatcgaactgtttccatctaaactccttccacactttacatggcggtgttatttgtgcaaatactgttttgtgttgtctctttttcactaaatcatatatgtacacatttcaaagctcttggctttattatatatttcttataatggacactgcaagaaatttggagcaagacctaagcttttgggaaagagacttaatctctggacctaattcttcaactataaaatggagataatgctacctaccttgaggggttcctggtacaaggtaggcgtatagtaagctttcatctctctctctttctctgtctctctctgtctctctcctctttctctttcctctgtgtgtgtctgtctctttctctgtctcctctctctgtctctctctctctctgtctctctctctctctgtctctctctcctctttctctctttgtctttccgctgtgtgtgtctgtctctttctctgtctcctctctcttggttgcttctggtttggggcaatgtagtattttcataaacatgtatgatcacaaattatatccatgctgaaattcaaaggtaatttttttgatgtctacctcgaggcctagaatactgttgagcatagaataaaatctcaatagggcataatggtaggaagaagaaatgaagaggagaaaaagaataaaccatcttaacttgaaaaccaaattagctgagatgctcgtgagcttccaatctcatacaggcattctaataacaagtattcacttactgtggacccaagaacggccagatggcttgtgaagaacatcagcctcagcaatcacacagatttccaccttagatggccttttgcagcctttggaggatggattggaagagtggaaggttggaggcagggctctcagtgaggggcagctgacaggtggtgggacctgagccatgagggaagaaagtggtcaaattcaagaattcctttggaagcaaatttagttttcaaggttgctactcttagaagctgcccctcttcctcttctcattatttcttccatttagcaaaactaaatgcatggggaggccaggtatggtggctcatgcctgtaatctcagcacttagggagatcaaggtgggaggattgcttgagtccaggagttcaagaccagcctgggcaacatagcaagaccctgtctctacaaaaaaaaaaaaaaaaaaagtaaaaaaactagccaagcatggtggcacaagcctgtagttacagctactcaggaggctaaggcaggagaatcacttaagcctggaagtttgaggctgcagtgagctgtggtctcaccaccgcactccagcctaggtgacagagtgagatcctgtctcaaaaaataaagaaaaatgcatggagaggttgggtggctggggtggggaagtagagagattgactacacatttcagattgctagaggatgccaccacacagaaattaaaataaaaagtgggagagatttaattcacttattgaacgtttatttattaagtatcaacaacttgacactgaataggcactattctggccattagggacatagtagtgaccaaagcaaagttcctagtcccatgaagtttgtttataaacaataaacaattgaatatatcaatacagagtatgcctgatgagactaaatattaacacaagaggtaataatcaagtaagtgtcggggggaagtggcagggcatgaggtcagagaggcaaggtgaggcaggagaagatgatgtaaggatattgtaaagatgccagttttacttagcatgacaagggaagcctttaggaagattgaaacagaggaggaacaggacaaatctgtgcattacaaattaatcattattttaatgtgaattgctgcttctgccattataaaaatttgtaagattctacctgtgacatgggcatctctgtattgcctttgggtgggtgctggagttgagggtacagagaggcattaaactcaccattgctttttacggaggccagtagtctttttttaaccaccatcagcagaaggaatgggaaacaaagctgagatgagacagaaaagcaagaattggggattgggtttcaccccacttctgagtagtaagatgaaattaaaacccttctaagatgtccctgaattccatttaccactctttccacaaaccttctctttttcaatccatgcccaaaggcataaaaggaaagaaaaaaaaaatcaaagcaattccagtaacacttgtggtagaaaatctgcctagattggtatgtgtgaatttcatattattctaaagtcccattattcttaataggcaattttagggggtggtttgaatgcctgatatttggagaactttcaaagcacatccaaggggtctctaataagaacttgggggcgctgaactcggggactccaagtgtcacctatgcatttccagcttcagcctaaccttgggggcaaagcaggcccttaacagaggaaaagtaaaaacaaccaaagcattcttagaggtgcaaggccgccctatcatgaaaacctcagtaaattgaagacagtaaaaaatcactcattcttttgattagcagtcttctgtattcttgcaaatactgtactagtgcagtcctatcatttcaaatgtgtgtttaaataggaataaaatatattacacacataattttccctcaaattacgtttgtgagatacaagcctgggtaattctgctcctgttccaagtgaaatgcaaacccttgtgtttccaaacatcactatgaagcaaagccaataccttcccttttctgagttggacacaagtaactcttccgtgctgctctggaaactatgacagaacgttattcatctgtttgttttaatagccaagggaaaaaaacttcaaaattttgatttaattttttaaagaaaaaaaggtggtatgaaacaggtcgagggactctttagctaagcgaataaatgttaaccaaattgtcactgaccagatgtgggaaccagcatgtgatattcgacacagtcacctcaaaattgcttatgcttacaaaggcattccaataaaagaaaaagggatgtaagggttagctgaattctcaaccctatagatttaaggcttctctgtgagtcgttggccctctgggttgacatgccttgattggctccctttcaaaactgaccttaaaggtcaagtatgttaacatgtactttttgatgctcactttcagaccggtctttagaaagcagagtttgtgagataacttcaggatcacatatttaacctgtaatctcttgaccacagccagcctgaggtgaagtctgcttttggtgctcccgacagctccccttcctggatcctcaccctccccagccatccctttccttgtctctgcctatacctgtccagagatgctccctctcccagggccatcatttcaaggtgtgtgcagctagggctgataagatttaagtgatgccccctcctcctggttagcagttaactaaggttgcttccaggcttgaagtctcctccagaagaggaaggaggtaggttggaataggaggtaacttttcagaccacctccaattataatctgttcttaaagtttctatgtctctgatcttctgtctacattggaataattctgcatcttttacttggatccttaattttataatgtagccccatttttattaaaagccagggctaattttaccttgagagatctgtttgcccctcccaagggagaagaacgctgcctctgaagtgggaagcttcacactcagctcgaggttactagagccattatgtggccatgcttttaaccagatctgctaataggtggcccgattcacaagttttaaaaagggatgttttccatttattcatggccatgatggtcttttgggaaagcattagtaagttgtgtttgcttgggtaaagagaaattgctatccatatgacagaaaataactcccactttaataaactgctcactgagcaaacctatggaccgtccatctctttgagctgtgtgatgactttccttcaagggttttaggggcagccatcttgatgtgatttcctctccatggctcaaaacagggtgtatgaaaggggctggggggataaattcagaggtcagaggtgttgggctatttatttcactgctctctgtccctatgaggctgccatgctgtgggattgccaagtcactgtccccggcattccatttgaagagccatgagaatcagaacaaaagaacctgctgatactgagtaaactgctcatgcttatatcagtttagtctgcttggaagtgacttacaaagctacccccacgacctcccccaccttgaggcctgaatttgcaaccattggccctctcccaaggtccctctaccttggcccttgtgtaaatgatattttttttttaattaaggtggaattcacataacatagagttcaccattttattttattatttattttgttatcgttatgttttaaagagatggtcttgctctgtcacccaggctggagtgcagtgatgtgatcatggctaactacagcctcaaactcctggactcaagcaatcctcctgcctcagccccctgaatagataggactacatgtgtgtgccaccatgccctgctaattttttcatttttaattttgtagacacagagtctcactatgttgtccgggctggtcttgaactccaggcctcaagcaatcctcccaaccttgatctcctaaagtgcggggattataggcatgagccactgcacccagccagaattaaccatattaaaatgaataagtcaatagtagttagtatattcataatgttgtataaccgccacatctgtctacttccaaaacattttcatcatcccaaaataaaattccttgcccgctaagcagttacttcttattcctccctgtccccagcccctagcaaccaccgatctgcttttctctaaagacttacctattttaaatatttcatataaatgggatcatacaatatgtgccctttttgttcagcttatttcacttagcatgtttttgaggctctcccacatcgtaacctgtttcagtacctcattcatttttcatggctgaataatatagtctattgtatgtatctaccaccttttgtctatccattcatctgttgatgaacacctgagttgttcccacctttggactattgtgaatagtgctgctctgcacatttgtgtacaagtgtgtgtttgagtacctgttttcaattctttggtttaagtgagattttacagtcaggaaagtccctctgcatccattctcttctcattaagaagaggtaggagacccggcgtggtggctcacacctgtaatcctagcactttgggaagccaaggcaggtggatcatctgaggtcaggagttcaagaccagcctggccaacatggtgaaaccctgtctctactaaaaatacaaaaattagccaggcatggtagcacacgcctctaatcccagctactcaggaggctgaggaaggagaatcgcttgaacccaggaggtggaggtttcagtgagctgagatcgcgccactgcactccagcctgcgcaatgggagcgagactccatctcaaaaaaaaaaaaaaaaaaaaaaaagagagagagataggcattttaactgaaattatccccaaaaagaatattttaggaccaaatttgtcagtaccgatcggttcagctatgtctgcccatgccctgtatattctgatgaggaagaaaatcgcttccaattagaggatactcctggtatggagaagggtccactttggtgggctaccctgggatagtctcctcatctcttctagttctattggcctgtcagtggtaaggtgggcgctaaacagataaaatagtatatgaaactggaaatctgtggaatggtttgatgaaagtactgggaatgggtggggttagtgagtgactaactttccagggaaggtaggggcatttgggtctgaaagatgagaacattcacaaggagaacgagggggtggagggcatgccagccctaaggatgagcatgggtcaagccatgtccgcatcgaagtgcatcctgtggtttgagactagcaagatcatccacatgactaataccatcaggcttgtaggcttgtctggcagggaaggaagctggaaaaactggcaagaactagattatgaagtctctgcagaacagcatttcctttccttgctctgcagtggttcctagatgggcactccttttgctgccgcactgttccacgatccctcttagcactcttcaaatatccttcataagctccttgccctggagaaggaggagaccctggaggtggattacagaccacatttgcgtttcccaatcccatggcagagaatatggcaggttgtagaggctggcaacatggtaactcaattacctttatgagaaacatgagctcccatcacaaagcacccctgcaccttgacatcatggtgaggcagcggcgcacgctggtgccagccactgtgatgaatggccaaattccatttgccctttcacaatgcacttttcttctccattgaatgcagccttgggcacgctcactgcaagtgcccttgcacttttgctaccttgccacttgcttcatgtttttaatttgctgagcatggagtaaggcaggaagacatcaatgatgaaagaagtgtgagctggaaaaaagcataaagctgattaatgctggaggagcatttgttcccctccagccaaagccagtggggaaaaatggaaaagaaagaaatgtgtttttgactttatgtttaaaagaaaaccttttaccacccagaatgcaccaaagcttctccacagcagaaagcccctctaagcagtgcaaaaactccattgccaagccacttggaaagaagttatagagtgtggttagaaacactatttagagcaaatctagctcttctacttgctgcgtaactttggataagttctctatgctttctgagtctcacttttctcatctgtagaacaggaataattacatctttacctttttttataagattgttgttgggataaaatgacttagtatctgttttgtaagtatataaaacttagcagtatctgatacagaatcaagactcgttataaggtctctttctcgagtaggctgatttaactaagagtagtattgaaacgcagaacatagttacagatctaacaacatgggatagtggcctcatcttgagtttcagtttaaatcctagctccaccacagactgactttgtgaatttgagcaagttacttaacttctctgaatttgagtttctctctcgtaaaataaggataatagctcatcaggggctgctttgaagaaagcacctaacacagtacccagcccagagcagcagacacttaatacatgtttggtttttttcagtgttgtggttctcaaccacattcaaatcacctgataggtttctttaagcatagatacctaagcctcatccccagagactatgatttaataggtctaaggtggggcctgggcattcgtatttcctaaagcttctcaaggagattctttcattcttttttttttttttttttgagatggagtctcactctgtcacccaggctggagtgaagtggcatgatcttggctcactgcaacctccacctcctgggttcaagtgattctcctacctcagccccctgactagctgggattacaggcacctgccaccacacccaactaatttttgtatttttagtagagatggggtttcaccatgttgactaggctggtcttgaactcctgacctcagatgatccacccgtctcggcctcccagtgtgctgccaaggcgattctcataaggagccaagacagaaccactccccagcagataacagtacatactggttttggggtttttttgtgttcttttttaaaaaatctgtctcccaggagactgaacaggatagtaggaattctgggaatagtcaaaaatttaatacacctgcagttctaagcctttgataagaaatgtgcagccaaggaattgcattccattttattctgaaaaaaagtattcaaagagtctttttaagagtcttgaactggaaaggtggtaagaagtttagcctaagcctcacacataaaatatgggaactcccagtaggttggggatttatatctgggggtaattccagggttttgtcctcccaagagatataaattgaagccttgagagtttaatgtgggggagaaagaagtgttctcataatgacaccttaaaaatccagggctctgctaatgcctagggatagaaaagcatcatctgtaatagcaggggggtggcatgggggtgtattctggtctctgtacttaggtttccaagatccaagtgtgggtcatcaagaaccttctttctccccataggtttatggtattagttacccaataaaagttgggttaattttacaacccaagtaaaatttaagccaaaaaggcttcagcattactctaggatttatgaaagtaaacatgtggagtgcttgcaggattgtgcaacagtaaaatttcaatgtctttatgtcaggtatatgatatattcatttgtatgtgtatttaaaggttaagtttttaagagctttgcaacacaaactattttcagtactaaactgaagatacttcccccactttcacctttaaaatgattcttttaatgaatgggagtagagagaagcagaaaattagtgtcctatcaggtgatttttccacttggtttgctcctatactttgactttctagactcctacgctagaccttcaagctgggaagtgagcaccacagcactaaccgcagtgcctcttacgatgtgggagcttagtaaataactgtcttttaaataaatgtccctttggtcattgtaaatactttaagaatagccatatattatctctacaatttaaaaaagcttttacattatctgatgggatcataatgactttcccatgtagggcagagaagtcagttactgtgtccaacttgtagatgagaaaattgtggctcagagggctcagacagcttgcctaaggatgcccaaatgttaaactcaggaagagaattttgttctcctgactttgctctgagggatttttacttagaagaaaccaaaggggaaaaacggtgtatttttttttttttttttgagatgatatattgaggaggagcatccagggttgaagtcaacttatacacgtggcaggcagactttggtttggctatggtctgcctttgagaaacagctggatgttctgcactcgagggatcttgtgctcatcgtaggccctcgtgggagatggtagcctctgccctttcaggttgagcctgccatcttgggtcttcatctccagccttagatctccagtccttttacctggcacatgaatcatgtcatttctggtgtccctctgtcttcaagatgaaatctattacccctccttataaaaaaagtcttataattttgaggccgcaaaattttaataagactatttttttaaattgtagagaagcatgaaagcaaactttccatggacattttctctagatttccttggatttagtgactcaattcaaactctccagactatggtttgccctggtcctctttgggcagggtagagataatggaggttcagcagtgaagagtcacctaactgggctaccctcgggtttctttccagctgcacccagcttctcaccccatggatccccctaattgacgtgtcagttggagtggatctgttcgcccacgcctttgtagcaaatgaagcagaaataatctgtgcttaaaaaacaaaaaactgtagaacatgtgcccagatttccaactcatttcctctttactcctataactacatcatcttccagcccaccaccagctgcgaaaataaaagcattttctcccatatttaaggatgattttgtgcttcaggatgactttctgggggtgtaggaaacttgaccaatgtgaccaacagatgttttaagaactgagcaaaagcccaattccttagcccagtcttttgtatattgtgcccaactgtgccccctagtgactatttagggtatcgcgcagtcagagcttgctgtgccctgtatgtatgtggtgcatcagctaatgtctgtctatgctttctttcagagatgagtatgaagaagatggattctgtcagccatacagagggattgcatgtgcaagatttattggcaaccgcaccgtctatatggagtctttgcacatgcaaggggaaatagaaaatcagatcacaggtaggtagcaccaatgaaattatatttgtcccttgaataactatttttctcgccaaaagttttattgagctcctctcttgacaaaggattaagctcagcatggaggttgggagcaggaccataaaaaagcatgagacatgatctctgtgctctggaatttacattaaagtaatttattgaaggttgctcttagaggaaaaggaagctttgtgaaatctcacattcattcaaacactcaataaatattattaagtgctttcaccgtaccaggaactgaatctgaatgggagaggtgatggtgtgtaaataagccaggtacgtctctgccctcacagagcttactgtttagaagcaacatgatgtcgactgagaggggatgaatttagagtttagagttctggacactcatcccagaactattatgacagtgaactttggggaaatcgcttactttcccaaaaagtccccttcttcatctgtgaaatgagtgatgaagcaagatgaccattggtctcttcttgctctagctttcaatatttcactcttcatttttcttaattgaaagtatccttttgatagaaatctaatagcgaagcacttactagcacacatgagttaaagtagcataggctgcctcataggattttgcacgcatcgttctggtggttacagcagctttgtccccttccattagtgtagttatgatgcctctgtgtcacgtatcctttgcaatccattcacattgtcttcatgacattctaatgaggttgccatatctagcaaataaaaattcaggatacccagtaacatttgaatttcagataaacaacgaataattttttagtataagtatgtcataaatatttatctgaaattaaaatgtaaccgttgtctttttctttatctggcaaccctagggtctaggagaggtaagaacaaacccaaggcagaaacatagaacagcaaaaggcccagaagctatgtggaagctatgtgctatgaggaatgtgaaggaactgagaggaggctggggggaagagggaggaggactttttttttttttttttgagatggagtctcgctctgtcacccaggctggaatgcagtggcgcgatctcggctcactgcaagctctgcttcctaggttcatgccattctcctgcatcagcctcctggaggactttttaaccaaccaaaagaagcaactgtaggaataggtagttgccattttctgaagccctcatttcaacaggaagagaattctgaaatttcaaagagcagtaagactgacagggaggagctgttaaacacccatttcaacctaatgtaagaatgccttaatgtacttttaactgaatatccacaaaagcaagtagacattttgggccaggcacagtggctcactcctgtaatcccagcactttgggaagctgaggtgggcagatcacttgaggccaggagttcgagaccagcccggcctacatagcaaaaccacatctctactaaaaaacaatacaaatatcagctgggtgtggtggcacatgcctgtagtcccagctatgtgggaggctgaggcatgagaatcccttgaaactggaaggcagaagttgcactgagctgagagcgtaaccctgcactccagcctgggcgacagagtgagactgtctcaaaaaaaaaaaaaaaaaaaaaaaaaaagtggaagttttgatgtaaataattggtaacctatttataaaaatcctctcttggagatttctaatgggtatcagcctggtggaaagtttttttttaaattcatttacctttgtttatcccagcgtttcccaaacttgttggcttgtttctcaagcactattctatttcacatgattaatgttctgagcaacatacttggggaaataatgtatcagcaacctcctaggtttccttgtgaggtgtaagctccttgtcaatagcggtattcaaaggtaggctggtgcgctttttgtgcatcttaccctactagtaagagattaagctaaggaaccactaatattcgatgatacacattggaacaattgtactgtgctctttgagaacttccaagtgagttgcctcattttcagaagatggagtagaaagtattccagccacaaagaaattaagcaagttaccctaagtcatccagcaactcttgccgtccagcaagacacagaactggatcctgtgctcaggctcagccactgcggaaacaagttctgtccctacagctgtcaaatgttttagaagcctcacaaaactaataaaaagcaccagatgaaacacaaagttcgattgctttgtagtaaaaaatgaaaaatatattgtactttaacttaattaatttttttattaggaaatggtacatatgtaatttaatcctgttttattaactttgtagtcaaaatggtttttttcaagccagtgaaagtaagctgcttagacatctgaaatgaatctccttctctgggccttgtctgtttcagcacggcggattccttgcaatgtgtgtttatatctgatatccgttgactagataaccaaagaagataaaccctggcctctgggagttaataattgtgtttgttttccagctgccttcactatgattggcacttccagtcacttatctgataagtgttctcagttcgccattccttccctgtgccactatgccttcccgtactgcgatgaaacttcatccgtcccaaagccccgtgacttgtgtcgcgatgaatgtgaaatcctggagaatgtcctgtgtcaaacagagtacatttttgcaagatcaaatcccatgattctgatgaggctgaaactgccaaactgtgaagatctcccccagccagagagcccagaagctgcgaactgtatccggattggaattcccatggcagatcctataaataaaagtaagtggtagcccctgaccttctgtgctcttctaagggtcagcaacctgttggcacagggaaaactggaccttgacccatagtgattttcatactgttaatcaaattattttccaatgggctgagtactgtgcctgagcattcagtggtggattagacatagttatcttcaagaagcttcatgaagacaataattttaaaatattggagctggtttctcaataacttaaacatagaattactatatgacctagcaattctactcctgagtatgtaatcaaaagaactgaaaacagatgttcaaacaaaaactcatatgagaatgtttataacaacactatttacaatagccaaaaggtggaaatgacccaaatgccatcagtagaggagcggttaaacaaattgtggtatatccagacagtgaaacattatttatccataaaaaggaatgaaatacagatacgtgctacaaacctggatgaacctggaaaacattatactaagtaaaagaagccagacaccattgtatgatccatttatatgaaatttccagaatagataaatccatatagacagaattcagattagcggttaccaggggccaggctaggggtagtggagagtgattgtttaatagatatggggtttcctcttagggtaatataagtgttctagaacctatagtggtgaaggttgtacaatattgtgaaagaactaaataaatgcactaatggtacatgtaatggtaagtgtattatagcatgtatcagtacattctcacattgctataaagaaatacctgagacagggtaattgataaaaaaaggaagttcaattggctcacgtgtggttctgcaggctgtacagggagtatagcagcttctgcagaaggtgaacggagagcaagcttcttacatggcaggagcaagagagtgagtggggaagtgccacatgcttttaaacggccatgagaatgagaacttactatcccaaggacagtaccacggggggtttgtgctaaaccattcacaagaaccctgcttccgtgatccagtcacctcccaccaggccccacctccaaccctggggattgcaattcaacatgagatttggtggggacacagacccaaaccatatcataccgccattttaaagatatagatgggtttgcctccatcccctaccccatcagcagcaccacgcaaaagactatttcagtgtacatttccctttcatctagaattaatctcaccggcaatttttcagtttccttttgatcgttaatactattttgtgagttaagtaaatgagtgcatctaaaatgcttaacacatggtaagggctcagtagcaacattattattattgtcattactcctccaaactccagttcagttcgactgtgtagattctgcagtgcttttaagcccctctggccacgtgcgaggtcttcttaatgggatctgcttctcaagggtgccgaccccatcagcacagagatagcccccacttttgttagaaacccagaatgcacagcctctgataagcatgttctgtgaattacaataccaactagattccttattacatgatttcatgtctaaggctgtcagtcagaatggaaggaaaagtttggcttgaaccttccttgaaccattcactaggaaattacttctgtgcccccaggtcccaccccagttccgatttcttctgtgttcaatgttagaaatacttttggaagactgattttattcctgaagcaaaagctttaaatcctcccaggaatgtaactgcaaggcaggccctgggtccaagcccagcaaagcagggagactgtcctgcatggcccctgaccagcagggaagctgtggccacgaggttaattacctgccctcccctccagaaactgctggctagaggagagctccagcatctcctatgtttctttctaattgtttgggtttttgtgtgtttttcagatcacaagtgttataacagcacaggtgtggactaccgggggaccgtcagtgtgaccaaatcagggcgccagtgccagccatggaattcccagtatccccacacacacactttcaccgcccttcgtttcccagagctgaatggaggccattcctactgccgcaacccagggaatcaaaaggaagctccctggtgcttcaccttggatgaaaactttaagtctgatctgtgtgacatcccagcgtgcggtaaatagaagtcattgcccctaatgtattcaatcatctttaaagatccctatcctacccctcttatttaggagaatcctataaggggggcaaagaaaatggacagtatttgcttgatctcaatctggttttagggtaaaccttgccgtttctacataaaacacctcgtaaggtaccaaaacacgttctcaagaagtcaactgcctttatacctgcagccattgcactcatggatgtaacagggacccagcccttcagaggcacagttgagacagtttatcacattgatttttatagaaaaagatgttacccagaatggtctgcgtccaagtggaccttttcagcaaaaaaaggaatattggaagcaggaagaaattgttttctgtatgccttaagaacaccacaaggcaggatgaatctacaaccattactcggtcatccaggacaatctgtgggtaaactgtgtccttcgttatgtctgttaatactgcagaagaagcatataggtatctagtaagaaaatggaattcctgagtcagttaactgttcctttttctagaaaatgtttggagaaaataatgaaaatgggccaagcatggtggcttatacctgtaatcccaacactctaggaaggccgaggcaggaggatcatttgagcccaggggttcaagaccagcccaggcaacatagtgagactccatctctaccaaaaaaaagaaaaaaaaaaaaagaaaatgttggtgaaacctggagttaggaactattttggaactaattcatcttcctgatcctagttctcatagatatcatagataatgccaagtttcccaggcatagtgggagagtcaggatgtcactgctggaaaagcaaaagctacagggtaggagggtgggcaaacaagagcaatagtcatgggacccacaatacaaagtgagctcggtgtttaaccagatgattattcaagccattcattcagaatatttgttgagtacctactaagtgccaagtacttactcatccgagcatggggagacgccagggaccctaaggagggagtaggcatagcacatccacaaagaagcaaggagtcatggaggcggaacaagcaaaagggagagtagcagaagattaggtcgggaaagtaacaggacccaatcatgtaaagctgtgtaggccattggaggacttaagctttgacgctgaatgagttgggaaagcatgagagggttttgagcagaagggtgacatgacctgacttatatgtttgaaggctcacctgggctgctgggttgagactagcctgtgggaaggatgcaagagcaaaagcaaggagatcagttgggaagctactgcaggaatgcaggggagagataaagtggccttgacaggaggaggagtggaagacggagggacacgtgggcagattctggatatgtgttgaaattggagacaagaggagtcactgatggatcagatgtgggatataaatgatggaaggaatcaagagtgactccggagcttctccatggaattgccttttgctgagacggagaaaactataggaggaataaatttagtgggagctggaatcaagagtttttgttcatgctgagtttgagatgccttttagaaatccaaaaagagatactgaggaggcagttttatatcacagactgaagttcaagtcagggtctgggatgagatggatacgaaggaaatgttggcatacagatggcatgtaaggccatgacacctgaaggaaagaggagcatatctacttaacaaaagagaaggaaatgtcagtgcaagacaatgaaagctagctttagactctgggtcaggggcagtagcctcagttcctaatgtaataatgatctaactgagtggctaccatgtgccagatcctatgtgagacaccttacctctgtcacctcattcaatcttcatatccagcttctatcatcctcatgttatggataagaaaactgacactcagtaagaattaagaggtttgctcaaagacactcagctatcagtgactgaatcatgattttaactcaggtcagccggattcccaaacctgttggctctttccactaagcatactctctctctagagagcaaaatgaatctgcttaatggcaacaataacaggtaaacaataaatatatagtttgtagtaaaagcagtttattgtaataggtaaggacatgggttctcatgtttaagtgcctgggtttgaatcccaggtcttcaatgaaatagctgtgtgctcttagccccttctaatctcatttttcttatcagtaaaatgagaaaataatgatatacacttaggatttattgtgagaataaattagttgttaactgaaaaaccctatgatgtccgaacatagtaaatgttcagtacacattatctattattatatagtcaatatataaagataaatcgattcgaattatcacatagtcaacatatgtaaataaatgcttgctctcagctcagcaaatattgtttgagagcccaccatggagtagggaggttataagaggaataaaatgattcatgcttttgaggtatgtcagttacaatgcagtatgtatgatacaatagaagttagcacaaatgttatggaacaaagaaggggaagggcttaaaaaattactaaagaaatccataagaaaaagttttaaaaatattgaaaagaaccctagtgatgaaaatttgagagacccttattctataattttgttcctacctgttacttgttattatagtgactttacttgcaaaatggttttacggaaagttgaacacaacaaattttagaaagatcaccacaccccctttgtgttgccgggtttcatacaccttcatatgggctttaatatactttcatacgtattacaaagtaacctcttgcagagccattgttgatcatttcaaggaaaattattctgtattttgtaatggtttgcacttcatttatgacattttccgtgttattttcaacagtgataagaaaggaataaaaacaaaacatagatttacttagttgccccattccttctcctaaaccaggtaaggtatgagagtctgcaagagagtccaggataaaagcagtacttactaagcaccttccacgcaccaggcacagtgctagggttttcacatgctttctttatcctcatcctcatactctgacaggtattattaaccctatttttgctgatacagaagctgaggctgagaaagccccagggtcatccagctagtaaatggaaggtctgtctgattccaagctcatcttcttgctactcttctgtgctacttcgggttattggttgatgtacagaggaaaccaaatgaactggtttgttttgtttctttgttttttgagacaggatcttgctacgttgcccaggctggtctctaactcctgggcccaataaatctttctgccttggcctcctgagtacctgggactacaggcatgcaccaccatgcccagctttaaatgaattgttttaagaaagaaatgggctgggcttggtggctcacgcctgtaatctcagcactttgggaggccgtggcaggcagatcacttgaggtcaggagttcaagaccagcctggccaacatggtgaaaccccgtctctaccaaaaatacaaaaattagccaggtgtggtggcatgcacctgtaatcccagctagttgggaggctgaggcatgagaatcgcttgaacttgggaggcggaggttgcagtgagccgagatcgcaccactgcactccagcctgggcgatagagcgagactcagtctcaagaagaaaaaagaaagaaagaaaagaaaagcattatttgttccaccctaggtaaacactattgttctttgggtgacttctgacccttaatttccaaccaatgcctatcagaagtagggaagtaatttgtccagaagctggaagacatattgatactctgattcaaggactcaagctctattacgattagtttaagcaaggattacaaattatacctaaagtactcgttttcatttcgatgcccttcctgcagcatccagatcaaacccatgctaggagggatgaaagaaaccttcgaaaggtctttcagactgagtagaaagagggagatcacttacatctacaggatacctactatgtgcctgcatggtgcctggtgctttacatattcatctccatttaaaattcacaaccatgctgtggggtaggtatgattaacatatttcactgaggttcaaaggggctacaggacttgtctaaatcacacagccaaccactgtctgcatagagctctgaccaaactcaaagctcatgttcttttaccagacactctgctatctctcatttgaagatttttctgaaataaatacaagcatgatgattggttccacctctggattacatcatgccgatttccattatatgatatgacatcaaaatcttcccgtgctgatgaagaactctatcatagtattactcagtgtgttattatcttagtattaatcagtatagcaatgttgaaaacccttggaatatttcttttctgaatatatgtgcagaggacacagtgaaaatcctgaggactggttaatactagtcacatgagagatgaatttagatgaaagttaaatatagagatgacaaggcagttttcaccacttagatttttttttaaagaacattttcattttattttaaaacaaagcagttcctcttgaattcttcaagccaagccacgaatatatccattaaaggaacagggaagccttgacatatgatcaataagctgctggagggccagtagctcccaggtgggattcctgagaagacagtaggtcagcatcagctgtgctcaggggtatgcgtgtcttctcccagtcgccctcagcccacctctaacaaactgatcatcatggaatcctatttttataactcctttggggcatttgatttttttttctcatttcattgtcacaaaaccatgaaagatcaagtaggaatttccagccctgttttaccatatgagaaaatcaaggcccagagaagtgagaaggcttacctaagatcacaaatgaattcatggaaaccaggtctcctatctctaggaccactgctctttgttctacaccagtgattctcaaccaggggcaatttcatcttccagggaacatttggcaatttctggagagattttggttatcacaagtgggtggggttgggggatgctactggcaactgttgtgtagaggtcagggatgttgctaaatacactgcagtacccagaacagcccacacaatgaatcatctagcccaaaatgtcgaatgttggggttgaggaactcttttctacactgtacaattgtaaactatagaataacaataatattcaatagtaattatcatttattgtatgcttacaatgagctgaaaactctgctgacacttttaggcattatctcatgtttaaatagttctatccccctaggagtaggttttattatacccaagaaagaaaactgagacttggagaggttaagtaacatgtgtccgaggtcacatggttaataagaagtggacccaggactcacatctgtactcagccttttaaactgtggtttatgcatgtatgttgtgtatgtgtttttgtgtgtgtaaacagataaaacttgagaataacttcattttacagtgagttgtaagctagtggggcagatttgaaatgagccctttttctcctccatcctgaatgagacagagtctcataggaaaattcctgcattctttagctaactcaaagttaaggagatttcagaatctccatggggtttctcattttcctactgataacttttgttttagtttcaactaagtagagctaaaagaagcataggcctaattaaatagaaaatgtgaacgtttgttgtactttctctaataaaggcgcttgagaacagtctgctgcagattgttttatctgtgaaccttcactccagagcagaatataaaattaagtacaatcaaatatggctgttgtaaattctgggaattggcttggctaggattatatgcatatgcccagacagtgcttagagaaagtgaaaaaaaagacaaaagttggtttgggcaagacctggcttctcatcctccatgtcttttctttcatgtcacaggcatctaacaattagaattactaattatttattcattcactcacagaaaccaatatatgttgagcttctactgtgtctcagaccctgtgaacaagctaaatcagaccatgcccttgtgtagcctacaatctaatgaaggaatcagatggaaaaaaaaatatgaatcacattaagtattgtcatatagttcccagttttatgtctgctcttatgtgcgtggcattttaatgatgactactgcttgttgaatactgtgctaagatatctgtgccggcatctagcctaggacttagttggtgctcaataaaatgtgttgaattaattggtttaatccacacggtaaacacaagataaaggtgtcatctccattttcctaaaggaaaaacaggcaatgttgtttttactgaagccgagattcaaaccaattccatagaatttcatatccattcctccatctaccatgccataactgcttaaacaatagagtcctgattatttcagaggaacacacattcctttattattttccctttccctttgatcattatgatctctctgggtctttgggatgctgcccattgatattcttatttgcagctccagggatataggaatgaagcccccagccacaaagatatctactctgagagaccctactgtgctcctcttagatgcagccctgatatagattagctccccagcagctccacccacatctcacagggtgtgcccttctcccattaagtcccatctcctctctttctggaagccccatgtctcctccagtcctcaaagttggccatcttctctgcctgcaaagcttcattcactatgctttcaccttttgttgtggtcaccttccaagtcaaatatcttgggttgggtgtaaactaaattgagaaagaagcattttgcctaagttctttctaactggcatctaggcacactgcctaggttcaccatttcactgtagccctttatcattgcttttctatgcagctctgggggtgtagctgtggaaactgtcaatacctctgagaactccttttgcaacaatctgtccattttactttggttgtattttattaataccacaagacttatgttctctctctctctttctctctgtctctcatttagatcccctatttgtttctttcttgatttgtatgggaaggcagaatctcaatcgtattggtatttttatatttaaaccatgggcctttgttttacccttgatcaaatcctgaggtcacatttcttctcctagccatgccagcatgtctgtttctcctctaagtaaaggtttctccctctaccaaataaaagttccaagcagcagtattgtttttactcctaaaccagcttcaccaaagagtatccatgataagaaaagtggtgaaccatttggctccatttggagttttcatacctggcctattgcttttgtatttccttttaagtcactggcttgcaacaatttgccaaagggcgcattgcccagttttgtgcctgaatagccttgacttgtcctataatcttacaaacacccaccctgggctccagtttgtcacaaaccatattctgcaacgtggtggtttacagttcggggcaaggcagatgttttccagattgtgaacactgccatttttaacttgctctgtcagcagccttctcccatatttcatagaagacctgttgtaaggcaatttgtctttcagccatttcttcaaaataaaattgaacgttacagtgaattggatggtggagggggtaaaggaggaagaagtatagcactgttttatatagtttgaagctttctggaagagttatttttatactgcagagattttcaagatgtgctttcatttccagtctctatacattttcaacaacaaagtaaagaacaatagtgacccaaaacttatagctaagtcatgttccatgaacatttttaaccataaaataatttctctcaaaggtttttttgttgttgttcctagtatatattgagtcatttacccagtgtgtaagctgctctagcaataagcttctgaaacctctgaactttttgggctcaccaccatgccagtaagaagtgcttgttggtgtcttaacctttgctgacagaaatctgatataataccacaatgattgttgccactggctttgtaacaaactgttttttggttaagcttctggcaggaaacacatggcacaagccgatagactaagggaaatgttataatgtaattatttagggaggcattggcagaattaggagaaaccattaaggaaaggtgcgagacctggggctaacatgaatgggaggtattaccatcctagatcagttaccttaccttgcagaatatagctgagactgaagagagggctgtccagcacatgctgtggcctttggtagagggatatagtcaaccctcagcaacccagcaaggaggaagccagaggaacaagggtttcaacccatactcttctcctgcctttcatctctggcaaatgactcccataggttcaacctaactggaagccacaggtcaaaggtatccattgacactatcagtagaggttggcctcagcaaggagctggtcagaaaggactgagactggatctggtgggctgaggatactcaggggaaatgtcatcactgactttaaatcgcttcataagagtcagctttaaataaattgtttcaagaaagaaatgggctgggctcggtggcttatgcctgtaatcctagcactttgggaggccgaggcgggcagatcatttaaggtcaggagttcaaaaccagcctggccaacatggtgaaaccccatctctactaaaaatacaaaaaaaaaaaaaaaattagccgggtgtggtggagggtgcctgtaatcccagctactcaggaggctgaggcaggagaattgcttgaaccccagaggggaggttacagcgagctgagattgcaccactgcactccagcctcggtgacagagcgacactccgtctcaaaaaaaaaaaaaagttcagtaagggcctaaataagttatttcaactgaatttataaaatcagagaaccttgggagcaaccatagaaatcatccagcctctacttgaacattgccagacatctccagagacagagaaatccttccacttcaaagtgattatggaatgattccaactgctcaaaagttctgcctttgtaagctagaaaccaaaactcgtatgcaaaatctgattttttttaaatgttggccactgattccaattttttaaaaaacctaataaagaacaagtctatggactggatccaaattttaacttctggataatttcttacacaaatttgaagacatatgtcacatccttcatttgattttctctttggcctaaagatcacatgggtcctcctacatttccttccccattcttctcctctaggtgtttcctagtcctttagagccctccttaaaaatgtggctcttagaagacacctttcagtgctttttaaccagagcaggtagaagaggaccacgatgttcttgatcattacccagtattgccaatgaatactactatgttgctataagtgccatatgtaaaattttttgagcaattgcatcatgctgttgctgggttcatctgagcctttaaatcttcagtaaaacttattagtaatcttttgtttgtttttagggtttggttacatcaacaattatttagtagatttgtctaatcatggattttataaacaagatctttaaccttaaagcaacttataatatttatttttaaaatttcagcttctggtttggattcattatattagcctgtcgagtacgatcctctaaaattttattccataattaaacagttaggtatctttcctagattctggccatttcaagtttgataaacatatcatcaatgataatgttgagcaggcaggattcctcaagcatagccctttacaatttgatgttgattgactgattaacactattaaataaaggcagatgatgaattacaaatacatctgatgatattattattcaacctttcatcttgtccataagaatgtcataagtcacttgagtcatttgatcaaatgttttgctaaagtttaaatgtgcttagtctgtcactaataatctcatcaaaatgaaagagatttaattttatacaacctatagaattttgtcagttaaagattggcccgattaaaaagtgggcaaaggacttgaatagacattcctccaaagaagatatacaaatggccaaaagcatatgaaaagatgttcaatatcactaataattagagaaatgcaaatcaaaactccagtgagataccatttcacacccattagaatgcactattaaaaaaatagcaagtgtgaagaaattggaaccattgtgatctgttgataggaatgtaaaatggtgcagctgctatggaaaacagaatggaagttcctaaaaaaaattaaaaatagaattaccatctgatgcagcaatcccatttctgagtatttaatccaaaagaattgaagtcggggtctcaaaatatttgtacacccatgttcactgcagcattattcatgatagccgtttaaggcagaagcaacccaaatgtccatcagtggatgaatggataaagaaaacatggtatatgcaaacaatggaatattattcagtcataaaaagaaggaaatcctgtcacatggtacagcatcatgaacctagaggacattagactaagtaaaatacaccagtcacagaaagatagatactgaatgatccacttatatgcagtacctaaaatagtcaaaatcagaaacagaaagtaccatggtggttgtcagggctgggggaaggggggaaatggggagttattcaatgggcatagagttttagttttgcagcatgaaaaagttctggagattggttgcacaacaagaataaatatatgtaacattattgaaatgtaaaattaaaaatggttaagatggtaaattttacggtattttttacaattaaacattttttaattattaaaaaagattagcccaattcttttatagaggaggaaactgaggccctgagagtttacagaaacttttagtgaacttgtgtggattccagttactaagatttttcccaaatgctcacaaatgagttgctctccctaacttattgtagttaaaaccttttctgcagggaaaattttaatcaatgtatatggcctattcagcatttttttttaaagaattcatttgagaatacataaggcaatagatcatctacttagtatttccatcatcaagtcaagagagtgaatgcctgggcccagcctgccaactgaaggcctaattacctctctctctcgccttccaggcatatgcctaaatcactggtgcaggcccctatgtgctaccaacctgcttattttatagttttcaagtaataaattggtagtgattcctgtttgttttctatggtttttaaatttttttcagtcaaggttataatttaaacttgtttaatttcccttgaattctaaggttctgtaagatttcttcccacctttgccatatttaaaaccagagccttttcttgttttaactcaaagtaatatcccagatgatgtttcactttattaaaagtacctctttaataagaaatcatgattactttgctttaagcttcagggaaagaaaggagtattttctccattatatttaattactaatcaaagtattgaatatcattgtaaaaataaaataggaatgtcagatgtgaactgtgataccaaattgtttgatttttaaaaggaaattaatcatgtgatctggactaagtggttggtttcaaaaatctcaagtatttaacttgatgtaactaatatgtgcatttcacttttaaacagttattccaaagtattaaaaatcttcaacattctaatttccagccgattttctctgtaatgcattggaggtgtccattaccctttaaaatgactagtaagaataatgtccattgttccaaagtgattttcttaaaatagtatgattcccaccagatattagtcttcattgaaagagaacttcggactcttaaggagaatgatgaaaaacaattatatatataatgttttagggtaattttgattagtaatataatttactagaagcactgaaggtagacaggcttgcattccaacccagactttgctactttgtagctttgacaagttatttttcctttctcggtcttaatttctctgtgtgtaaagtcaagataacaccaatgtgccttccgggttaaaatgaggaatacaaatgctcggacttcaaaaagaacctaggcagatattagttttctaatttttcatttggaaggctcattgttctatggaatatttttatagaagattttcagagccagcagagactgaatccccttctggccaaatgcagagagctgtgtagggaaggaagcactttgtatggaagacttacaatgggcctgaatgtgtttctgtcacttccaacatgaccatgtattgttctccttgattatttcacttggcaaaaagacactgggccccttgtgcttgttagcatatcctcagtgtaatcagaaggagccaagcttgactgtttaaaggattcagcttcttgaagtttgttctcctgcagacctacagggggatttgtcccagaccctcgtttacaatagaagaccttccatgaataatctgatagggcatgaatacagaatagactcctttgtttgccaggcaggtgaggccctactttctcttgttgctaaaaatctggcctggaaaaatgactagcattgcgttagtactaaattagcctcatcgcttttgtaatcattaccctcaaaatgatttcactgaaaaaccaagaataacaacagagactttacccccctagggtactgagaaatatgaaaatggtttataatgttaataataaccataacatccaacaactgtatggcaattttcaattatccaaggttctttcatgaacattatctcatttgattctcaggtgaaccaaataagattggtagagcagggactattattcctgctctaccaatcgtatttattccattgaataaatgaggaaatggagatcagagagattgtttcttgcttaagattatctagcccaaaacttttacctgtgaatccccctctagtctaagggtaaagggtaaacattgagtggtaactggtactagaatagatttgttgcttacagcaattctgtgaagtaggtattactcccattttacagatgagtttgcttggagtggcaaagggcctactgaaggtcacgtagataatgaaaaggcattattcagaggtttctgacttggtgccctgtggcagaccgtcttctactcaggtgattcctttctgtctatctataggcatgtagacacaatcattactggtgcaaccagcactgactacgacggcctccagtgatgcctgggttatatatttacctgtaacagtgtataaagcagggattttctgtaatcccagcactttgggaggccgaggcaggcggatcacgaggtcaagagatcgagaccatcctggccaacatggtgaaaccctgtctctactaaaaatacaaaaattagctgggcgtggtggcacgtgcctgtagtcccagctactcagggggctgaggcaggtgaatcgcttgaacccgggaggcggacgttgcagtgagccgagatcgcaccattgcactccagcctggtgacagagcgagactccgtctcaaaaaaaaaaaaaaaaaaaaagcagggatttcaaaagcatcacatttggcaaaacttcagtgttattcccttcctttcagatcaccctcatccttcctacctccatgaaacaagaggaaccctactatgagaaaataggggcaaaattctccaattattggcagtgaagtgtagtagctagaatggtgggcaaaaagcaagaccgacgatggaatcccagcttttgacttactagcagcatgtccttgggcaacttacttaaccactctgtcttccagcatcttcacctataaaaattaggataaggatgtcatctaccttatagagttggttgtgacataaaatgagtttatgaaaagcacctggtccatagtaataatagctaacatgattttgcaccagtagaaaatatttgataaatattaaaattgcgttttgttttgtttttttgagacaaggtctcactctgtcacccaggctggagtgcagtggcgcaatcacagctcactgcagcctcaaccttctgggctcaggtaatccttccgcctcagcctctcaagtagccaggactacagacatgcaccaccatgcctggctaatttttttaattttttgtagagatggggtttcgccatgttgcctaggctggtctcaaattcctaggctcaagcaacctgcctgcctcagcctcccaaagtgctgggattacagacatgacccactgcacccagcctaaaattcgtattatttttattctactctgtaaccagatttaacccctctccaggctcttctgagggctaactcacagggcacagtcccaaaaccaggttttggtattccttttgaataactgatatgccatatctcacctgccaaacagttcccaaacaaggtgtgtacaagtaaaaactacatatggtttattctcatttacatgtactagggtaactcatcatttaaaggaccttttgggtcttttcatcactatctttatacttccagtttagcatttacaggacatgtcattatctttcttctattttccttaccagacgatgagctccttaagggcagaggacatgtcatacctaattttgtattcccagtacctacaatagtgcctgacatgcagtagcttttgtttattgacttactgaatgagtggaagggtaattgaatgaatgcatggttaattcttttgtaaggtaaataatcatctctgaattttgtgtcaatttgagttttcacactttgagttttcttaaagatagctgatcttcgttatcagggcatgtcattatgtaacccctctaattactatcccataattctgtgtttgttttaccagtcaaataattcattaatgacaatatatgcctaagtatttggtttcaatggttaggctcaaactgataaaaagacaagtatgtctcgtgttctacacatattatattcttttccaagcaatgggatataagatttcaaaaatatacttcaaagtgttagcactcataattattgggctcatatgaaaccatttaagaattctggggtttcaataaagtgtcagattatacagtgctgccatgctggaaggaattatagacaccatccaaaacagacacttcacttttgcagaggtaaaaaatgaggcccagagacgtgaatatttgttcaaggtcacacagctgatcaaagatcaaactgaccctgacttcaggcccccatattctcaggccagtggctttttggacactgggaccaggattccttagtaatgttgattctggaagatgcaggcttggccccataagtccaaaccagccaagacaaggtcatgatttctagaacaccatcttgtgggggctgatctgggctggcagccaatggaagaagagccctgtggtccacattaaggctcttggatgtatacagtccattcacgtggcgtttaacttttaaggtgttagagaaatgtaggtctgccactaaagagaggcaacatcagaggaggacccacacacgtacaaagtcttcataatgtccctctgcagtttttaaacatttgaactttaaacttttaaacttcaataaattatgttgaaggtttgatggaaacaaatggtaataagcagtggattcctttcttctcacagtggatttgtgtgtataaaagaatagaagaggtggttcattttaaactatgcaatgtaatattatgcatgttactttaaagagtataacttttgctctttttcatttctgcacccagattcaaaggattccaaggagaagaataaaatggaaatcctgtacatactagtgccaagtgtggccattcccctggccattgctttactcttcttcttcatttgcgtctgtcggaataaccagaagtcatcgtcggcaccagtccagaggcaaccaaaacacgtcagaggtcaaaatgtagagatgtcaatgctgaatgcatataaacccaaggtaatgttagcagtacagagctacatttgttccgtgggcttcaagttaaagcaccatgttataaccctcccaagcttggaaatcgaatgatatggaatcagagttttataagtgctaaggttcattttaaccaaatgcaaagacgaactacctacctctatctaaaccaagacactttcatcagtatgtctacttcagtgttgagccagccatatcactgccttgccatagagtcattgggctagaagtgatccctaagaaatcatcctgaccagcccgtcaggactcagaacgtgagcaatttttcaaaatttcaaagaggaaatttcatacttttccatccaaattgcaagagagaacaagatccatcattgttcacaaacttcactgtcaagaaccttttcgttgcataatatgcaaatagttaaaaccactgtactatatacttaaaaatgattaagatagtaaattttgttgtgtttttttaccacgatttaaaaaaaatcctttgtatgcctaacttacatccctttttctttggcttaagtatattttaaggaagtgttgtccttccaatagtcttcgaatgctgttttatgataaccaaccttagccttccccactttgagctaaatcaaccccttcccttttgcttttcatccacatctttcaacgtttgagttgctcgaggtcctggcaaggaacccagggtcactggcccttaccttaaatggagcccctgcactgcatcttggaactaaaatacaacagagtctttctttcaggaaagccagcaccacaatcccaggcctctcagcaaaaagatttcatttaaataatttaagactcttgcatctaacagcctgtttttttttctaattattccaattccataagaacattcattcattcaacaaatatttatcttccctgtggactagtaactgtattattcttttgatcctcataaagaggagaagcatcacttttaataaaattttaggaaaaaaaagtcttcacactcaaattaactaatcctcttatctaataaatggagtagcgtaattgggctgacacagagccctcatttttttttctgctttactgtttaaattttttttatctaaaaaatcttgaaaagatttttgctattataaagtcatatttattaataggatttggaattccttaaatgctaaaaattcagtgtatatattctgtattcagcaaaaccactgatctcttgctgagtgtgaatttttatcattaaaaacaagcaaacaacaaaaaaaaaaccctacaaatcctgaagaccatagagttcacacagtagcctggaggatgggcagggtagggattcaactcttttgacatcccagcttctagctagctgatttacatatattatagcattttatataatatcacatttaatccttactacttagtgctactataaaagtagtgaaagcaaatggatgggggttaatattgctacacattcacctagttgacctggcagatacttttacctagctcatgacttcaagcttctagtgtaagagtcattgttccatgagactctttccctttcatttctgttggtaaatgttgagaagtcttagaaacaccagaactctgggcgggggagagacctagatcattttggttacagcagacggcagtttggtgcagtagccaccatcctggaaagatgtactcctcattgccagggcaggaaccatggaagaatcatttccatttttagaaattatcaattttgtgggttagccttaatctgcaattgaattacatttttagtggaggtttgttttatatcacatgatctccaacagaaattccagagagctttgtggcataaatagaaaaaaggctaatatatatatcgatgaatacaaactgtcaagaacaataccaggagcttttacatccattatcacacttaatcctcacagctattatataaggcaggtattattattactattgtacaaccagggtaattgagacacaaacagactaagtaacttccccaaggtccaagagctagttattagaagcaataaaatgtgaatacaggatctttcaccttttctaaatagagctggcccttgctcttgcagaatccgtgataactttttcacagaacagatcaagttgggaaggaggagggagggttaggcaagcaactgagtgtgatcccatttggtcagtttgtgcttcagagtaaccacaggcattctcctggcttctgacaaatatttaaggggcctgcatggcagtctctgaatgatgtagccctagccctgccagggacatgtacaatttggctagagcaataatagttccccatccttcatggtcagagacaaatgtgaaatatactggcatgagttttcccagagactgggtgaagtaaacattgttttcatagtttctggatcatttctgaggtgtgccttgctaaatctcccagtgtcaagatttgtccactatgaggcttagagcttagccttaaactcctgaaccagagaagtagaaatggcttaaatatttgaatgggttggggaggggaaaggaaacaacaaaaacaaatgctaacttttttttttcttacacttctaagggacttggctccgatcaaatttgagttattcaattgtttgttttggttcttactgagtgcctttcctggaaaaagcacaaaggactctgtagaccttaaagaaaattcctaaatgtaaacagaaaatctctaaaactgctttggaaggtcactgacacataaatattacatgtacctataaaatctaaaaggaaaggacacacataagaaagaaacaaagaaaagtcctgaaaacaaacactccaccagagcaaaatcaaaagaatatttggaggcgaggatgaaaaaggaatgaaggatagaagccagtctgccctagccttattcttttttccccttggccaattcaaaagtcagagactctagggttcttatttatccaaatgaatgtgcccttcagggtttaaactctctgcttccatctctcttcacttgctgagccgctaaaattctcctgagtgtttggattgagaagaagaggctcctgtgggagattagaaactgatacccttgagagaggacaatagggagctgccgacagactggctgacgaggcccggcttgggtccccagagaggtaggacagtgcagttggaagtaaaagcttttgatgagccatgagtttccttctgatctgtgggcaaaggaagccagtggaccagagaggcaccttaacgccgaacaatcaggaagatggagatgtcctggctcccatgccaactgctctgtgactctgagaagccatctagctttttgcagttcaattttctcagctgttcaggagaagaagtagactgcattcaagtataagactgtttattttcctgttattttgtttagccaaagatttgaagccattcaatcctctaacgagtactgtagtgttgcctaaactaagcaggattttctatattgcattacaaattttacaatctgagtgaggttgttttttcttcttttagtacagcagaaattgaaccttctcagaggagcctggaaactctaaattcccttctctgtttcttttcctttgcttctccttcccttgcccctacatcccctgccaggtatgactctggaaaacagcattctgtaagcttgcttgggtaagggagagaagctgtggtatgtgctactgtgggagcagggagggggcagagtctccccttcaagaacaggatgggtcccattcagcccaggcctcctggctcctcacctgcctggaggttaggcagacagagaggttaaaagatggaggagtctgaggggcatggttgctcacacctgtaatctcagcatttgaggaaaccaagctggacagatcgcttgagcccaggagttcaagaccagcctgggcaacatggggaaaccccatctctacaaacacacacacacacacacacacacacacacacacacacacacacaattcgccaggcatggtggtgcatctctatactcagagctactcgggaggctgaggtgggaggattacttgagcctgggaatttgaggctgcagtgagctaagatcatgccactgcactccagcctaggcaacagagtgagactcatctcaaaaaaagaaaaaaagatggaggagtctgagaatgggggcgaggaagagtcaaggcaggccaggggtgtgagatgcagccaaagcctggacagcccccatgagtcgaactcctgcagctcctggctgatgtaaggaacatcgcaggggaaagaaagcaagactggcccagctttccaaagctgatggctgtgttttacttctcaatttaccctcatctcttgccagcttctctcctttttcacttccagacaattcatctctccgttttcctttccagccaaagtagttgctgaatatactgaaatttgattacattctctggccctgtcccttttgccagcaacatgcttccatctaaaagccctgctggagtctggctaccctttttaatttgctgttcttaccaaatgtcaccacacttcatgctaaaatatcctcgataatttttccactcactccttaaagctattgtctcccaacacttctgagctcaccattctattaacatgggcctcttgggaagcaccagtgatgttatttaatccagtgacctttgccaagtcttcctcccctttaatttctctggagcctttgatattcttaaccaccatcctgaaatatatttttttttccccttgactttcctcctatctgcttcccacacttccttcactagttcttttaattcccttaatgggagcatcctctgacattcttttcctctctcattctcttgagctgatttcatcctctggcattgctctagctcccccttgagtgtaatgatttcccaacctggaaggcccagtttcaagttataaaattcttgccaccaaaatcctgccacccaaaagtccatactatcggggcctagcttacctttccagccacacttttctcttagtttatttctggaaagtagtctgatacacttcaaagagcaagagtgtagagacaaagagatatgattacaaatcttggctctgctgtcaactggccacaagatcttaagcaaataactaacttctctgaaccttttattttctcatccataaggcaaggataagaatagtacttaaaagggatattttttacactttgagatagcatgtctggcacctcacaggtacttaataaccagaaattactattattgttataactgatgagtacagatcttttttttaacttttattttaagttaaggtgtacaagggcaggtttgttatgtaggtaaacttgtgtcatgggagtttgttgtacagattatttgatcacccaggtattaagcccagtactcattagttatttttcctgatcctctccctcctcccaagctccaccctctgaaaggccccagggtgtgttgttcccctctgtgtgtctatgagaacaacatttagctctcacttaaaagtgagaacatgcggtacttagttttctgttcctgtgttactttgctaaggataatggtctccagctccatccatgtccctgcaaaggatgtgatcttattcttttttatgtccacatagtattccatggagtatattgtatgtaccacattttctttatccagtctatcactgatgggcctttaggttgattccatgtctttgctgttgtgaatagtgctgcagtgaacgtatatgtgcatgtgtccttataataaaatcagttatattcctttgggtatatacccaggatttaaattgctaggtcaaatgctatttctgtctttagatattttaggtttccacaatggctgaactaatttacactcccatcaacagtgtataagcgttcctttttctctgcaacctcgccagaatctgttgttttttgaccttttaataatggccattctgactggtgtgagatggtgtctcattgtggttttgatttgcatttctctaataatcagtgatgttgagctttttttcatatgtttgttggccacacgtatgtcttcttttgaaaagtgtctgttcatgtcctttttatggggttgtttttctttaaattccttagaaatgctggatataagactttcaccggatgcatagtttgcaaaatttttctcccattctgtaggttgtgttactctgttgatagtttcttttgctgtgcagaaactctttagtttaataagatcccatttgtcaatttttgctctggttttgattgcttttggtgtcttcgtcatgaaatctttgcctgtgcctatatcctgaatggtattgcctatgttgtcttccaggatttttataatttcgggttttactttttttttttttttttttttgagatggaatctcgctttgtcacccaggctgaagtgcagtggtgtgatctcagctcactgcaacctccacctcctgggtttaagcaattatcatgcctcagcctcctgagtagctgggactacaggcatgtaccaccacacgtggctaatttttgtctttcttcatagagatgaggttttgccatatttcccaggctggtctcaaactcctggcctcaagtgattcacctgccttggcctcccaaagtgctgggattacaggcatgagccactagggttttacatttaagtctttcatccatcttgaattaatttttgtacatagtataaggaaagggtccagtttcaatcttctgcatatagctagccagttatcccagaaccatttattttactagggaattctttccccactgcttgcttttgtcaggtttgttaaagatcaggtagttgtaggtgtgcaatctaatttccgagttctctattctgttccattgttctatgtgtctgtttctgcaccagtaccatgctcttttggttactgtagccctgtagtatagtttgaagtcagctagcatgatgcctccagctttgttcttttttcttggctatttgggctcttttttagttccatgtgaatttttaaatagttttctctagttctgtgaagaatatcaatggtagttgagtaggaatagcatttaatctgtaaattgctttgggcagtatggccattttaatgatattgattcttccaatctatgagcatggaatgttttttcatttgtttgtgtcatctctgatttctttgagcagtgttttgactacagctcttttaatgaagcaaatgctgtgcaaacatagattaatgaagcaaatgctgtgcaaacataggatactgtgggctggggaggaagctataggatccagcaatgcacagcattaactggggtgaggacacaggcaagagaatcccagcaaagattatagaggtagctctttggacagctctcgtattccttgtgtccatcctgttagcatacattctcctgccccacaccctgctcacatcctggataaaatccatcagggtggagaaggtctgacagtgagggctgggaggctgcccggtacataacctcagcttaaaccaatgtctatagaaactctacttctgggaaaaacaagtcctataaatgactatattataaattggcatcataaacggactaaagtacttcaatatctcaatagaatctttgtaataaccctatgaagtaggtactaatttaagtctgatttttaggatgagaaaactgaggcttcagattcagaattggcccaaagtcacaaattattaagtgacagagccaaacttgaacccaggtctgctcaggtgcagagcccagtgcttttctatttgcctctactgcctttattttcaggctgactgaaatatatgagcccaagttatgagcacgtgatggctcaagctgacattaaaattactggcatctgttctgtctatttccaggcagaatagaacctctcccattggcattataaagtaactcaaccacagaatcaaccctgctcaccaccaaacattcaagctaactatcagaaagttacgttatagagaaaagaaatgcttctgaagttaaatcacttccagagaaatgcagctgaactccaagcaagtgtggcaaaatattggttgaaactccctctagaacttgattgcataagccagaaggcacttaatccagctgtagtctttgaaaatgtccataacctcccaaaacaaaatggctgtggcctctaagcttttaaaatgtaatcatttccatttatgagtagagtcaattgtttcataattctaacactgtttacctaagaaccagtaaaatgcacaagaaaggaaaataggttttggagtcaagcagatccatgtcaacagccaagtctaggtactaagaaatcttacatctatatactctccagggctctcatgctcaattcaggtgaaggttgccatggacaggttttgttcatctatcccagtcaactagctagcagagacaacagagcatcaacggagtgaggtctaactcaaaaaccagagagctcttataccttgagcatttcacttttgcatcaatggtcctcatgcttttaaaatgtagagtcctttgaggatcagatggaaagtctgcctcctcttcccagaaagctctgcaactttggtgtcagacattcttggatttgaatcttggcatcaccacttaatagttgtgcttctttaggcaggctacttaaccactgaatgccttatgtccttatccataaaatgggggcagtcgtaatatgaatctcacagaattgtgataaggattaaatgggttgatgcattaagcactttatgtccgagagcagacaaggagtatagtgtggtcattagcaaggcaggctctggtgtctgaattgaccacctaccagctgtgagaccacttaactgacctgttctttggtttttccatttgtaaaataggtgtgagtcatagttaccaatctcatggggttagtgtgaggatgaaaggagctaatatgtgtaaagtacttacagcctaacatataagcattcaaaaaatcatagccattattaggatctcagtgtctggcacatggcagatatttaataaatggtaggtattgttaaattcagattacagatatctaggataggagccatgtcttctctcttcatggttctttcatggcccctcatatagtagtctgtatgtatattcttcagtatattgtatatacagtatcagttgactgactgatgcaactagctattaaaatatatcctaaatgattggctctaattgaaactaaaggaaactggtgatatggcccaagctatgactacaagtagtcatgtagtatataaacctaataaatgctggttaatggttcttatatttttctctacctgatatttccaaagcatcttttcaagcaagagtattgttttctctcagttggataagtttaaattgcccaactaggttcatcagacacattgtggtcattcatcatgcagagagaagggacccagatcactaaggaattgactgatccagaaaactacatccatttattccaggggctctcaaagtgaggcctctaggccagcaggagtctcctcaactgagaactgtcagaaatggacaatctcagacccacataggaactcttgaggtggagcccagcaatcccagcaatctgtgctttaacaagtggcactgatgcctgctctgatgtagactatgctggtcagtacttgagattcaggaagcaagtcagcccatagggaataccaatctcagagaaaactgtgcttccaaagagaaaaaggacctgggatagccctcctattaccaaaaatactcctctaattttagtagggccagggtctgctcatcattcctctgatggggtgtattagtctgtttgaacactgctgataaagacatacctgagaatggaaagaaaaagaggtttaatggacttacagttccacatggctggggaggcctcacaatcatggcagaaggcaaggaggaccaagtcacatcttatgtggatggcagcagacaaagagagagcttgtgcggggaaactcccccttatagaaccatcagctctcatgagacttattcactatcacgagaacagcatgggaaagacctgcccccatgattcaataacctcccactgggtccctcccacaccatatgggaattcaagatgagatttgggtggggacactgccaaaccatatcatttgacccctggtccctttcaaatctcatttccttacattttaaaaccaatcatcccctcccaaaagtcccccaaagtctcaactcatttcggcattaactcagaagtccacagtccaaagtctcatccaagacaacgcaagtcccttctgcctatgagcctgtaaaatcaaaagcaagttagttacttcccagatacagtgggggtacaggcattgggtaaatacagccattccaaatgggagaaattggccaaaaaacaaaggggctacaggccccatgcaagtccaaaatccagcagggcagtcaaatcttaaggctccaaaatgatctcctttgactccatgtctcacatccaggtgactctgatgcaagcagtgcatcagacacctctgcacctttgcagggtagagtacccctcctggctgctttcatgggctggcattgagtgtctgggacttttccagactcacagtgcaagctgttggtgggtctaccattctggggtctggaggacagtggctctcttctcacaggtccactaggcagtgccccattagggacttgttatggaggctccaaccccacatttcccttctacactgccctagcagaggttctccatgagggcctcacccctgcagcaaacttctgcctgggcatccaggcatttccatacatcctctgaaatctaggtggagattcccaaacctcaattcttgacttctgtgcacctgcaggctcaacaccacatggaagctgccaagccttgggacctccaacctctgaagccacagcacgagctgtaccttgaccccttttagtcatagctggagtggctgggacacagggcactaagtacctagactgcacacagcagagggaccctggtcccagcccacaaaaccattttctcctcctaaacctctgggtgatgggaggggctgccgtgaagacctctgacatgccttggagacattttccccattatcttggtgattaacatttggcttctcattacttatgcaaatttctgcagccagcttgaatttctcctcaaaaaatgggattttattttctattgcattgtcaggctgcaaatattccaagcttttgttctgttttccttttaaaactgaatgcctttaacagcacccaaatcacctcttgaatgctttgctgcttagaaatttcttccgccaaataccctaaatcatctctctcaagttcaaagttccacaaatctctagggcaggggaaaaatgccgccagtctctttgctaaaacataacaagagtcacctctgcttcagttcccaacaagttcctcatctccatctgagaccacctaagtctggatttcattgtccttatcattatcagcattttggtcaaagccattcaacaagtctccagggagttccaaactttcccacattttcctgtcttcttctaagccctccaaactgttccaacctctgcctgttacccagttccaaagtcacttccacattttcgggtatcttttcagcagcaccccactctactggtaccaatttacaatattagtccattttcacactgctgataaagacacacctgagactgggaagaaaaagaggcttaatggacttacagttccacatggctgggagcgcctcacaatcatgacggaaggcaaggaggagcaagtcacatcttacgtggatggcagcaggcacagagagagcttatgcagggaaactcccccttatagaaccatcagatctcatgagacttagtcactatcacaagaacagcatgggaaagatctgccccctgactcaattacctcccaccaggtccctcccacaacatgtgggaattcaagatgagatgtgagtggggacacagccaaaccatatcatgaggcaagcacaaatgccatgtgaaacctgctattcttctgtagacacttgtgtccagccagaatcagcttcaaaagaatagcatagatttgaaaaagggcagcagtcagtcttgggacattagaacatggggaattaactggccttgagtgaaagggaccacagggggaggtttggagctgacttatgaatatggatcctgtttcagcacctactgttgttaaagccccgtttctgtcccagagaaccaccctgggctcgattccctgcaccctaatgtagctctgtttttcatctgtgtgtctacttcaagttagactcaaaagtagagcaattatatgacattatgttcaaggcaaaaagtgacagagcaggcttcatgttgcatacaaatgttggcagctattgcaaaatcctcaccgcatatcctatggtaatcacttccttaaagtaagcaggaaataggttagtagtaggctgcttcaccaggagtcatttcaaatgtattgtcacctaaggtataacttcccaaagatggaaagagataaagccactgagtctgccctctttatccatctacagccaccaaggtaattacagtttttaaaaacgctactcatagttcattgctttcatatctaaagttaagagatctaaaagttcccccacatccccacttagcagtcatgactaaggtgaaaaaagccaccagtatcagcctggtctctcttatcagcagtttagaaagtactacaattttcccatctgactcacatctaaatgactcgcatctaaaatgtttttccttaattttccttccgtaaagagttcatttaaactctaatactgttgcttttcaaaaatttctaaagaaagaagcatcttggaacaatgtattaacttctgcatcaacttttatttcatataataattttatataattttttaaaggcagatgtgtgtttactttgagaagtaaaaatgttaacattgaaactgaaagcctgtttcagttttaaggtacttaattgccttacagcatataataaaccgaggccatcttgtccttcaactaatggagggagtgataaagagataggagcccgggaccctattcattccagttttcctttgtacttggtttactttggcaccatgcctcatgtgtattttacacttctttacattttgtacatccctgtatgacaaatacttgtcaaacaaaaactaaacagatttataaccccttaacttgaaatgagccaaaattgaactgccaaaactttatgacttcattttctttcatagttttccaccacattggttcaaacagacaaactccacttgaggtcaagcagaggtcatttcactttcattactaaaatataatttacaatatgccagacctaaacaagtttagcctaaagggtttgtataatgtaaaccatctgttcctcaacaatacagctaatttcctgccatcaccgtacagtctactgactgcttctttaagggtttttatgattttttaactagttcaggatttatgtaaaatttgaaaatgagtctatagttaggattcatttgtaccaagtaacttgagcaccttaaaaatgcaaatcactgtggaaattgttcccctgaaaccaagctaggagcattttttttctgggcacttctttgctggcagctgcacaggtgttcgaagggaagattttgtggactctgccattttagatgctttccatgcctctttgcaaagcaaaccccccaaatttagttttcagtagctctagtaaatgactccttggagaagacttgggattatatgctatatggcccactggatattggtgagataggacaagatacactttggggtaaaatctactttctttcatgtgtctgaacagggaggaagaacaattataattccatagagtgaccacatactgaaggctaacctagctctgtgaggtggcaggcctctcaggctgagcctccagagacattcggcttcaatctgggattgctggccagcaggcttctctggtttcaaacagaatgctggggccgaaaaacagagagccttggagttgcaagtgtggctctttcggctctcctgaaaattcttgatactttctttagcccctttctccatctgtaaaatagcaaaattaggcgttctgtttccaaaggcaagtatatgagaacaaatttgcttacctcagtggaggggaatgcagctggccttcttagccacgaagccccaaggccatgtgtagggctgatgccaaggtcctgtccacctcttcctcttttcccacctccagaagtttggctggcttgcttcctttacccatctgctaccatccactcttccacacgagttcttgttgccttcaccttcattcacatctcagaggagccagctacaggccactcaacttctcacccaccctcaagctccaaaacaaattccctgtcatttttaaaggattttttttttttaactagcaactacaggagaacagagaaagattaacaggaagaaagttaaacactctgcaactacttaaggcttaaatggatctaaatcatttgcattactttacttcctggatgactttcctaataaggataataagaatgatttaaagggcacttattaggtgggaattacgttcatacatcgttgtatttaattcctactgcaacagctcaagctagatagtacattagttcatagatatggaaacagaggttcagaaaagttaagaaattcacccaaggtcagtgattaatattataagacctatgccacaggatcatggtgttaaataagttaatatttgctaagtgcttagaacattatctggcacaaagtaagtgctatgtaagtattaactattattcataaaaagcagcagattcaagatgcaaacccagatttataggagtccaaagctcacttagtttgaattatgccatactgcctatggatacttttcaagcagtgaaggaggagagggtattgggtttctaactcctcattataccagcctaatattccatgagtttacttcctaattcccattttccacaaagaagttttagtactcagtcccttaaagttctctgtctccaaaagcgtagagatcttatttttgtcaaaaagtaagtgatgtctactttgccattcaagggaccttcacctaaactggatttatttacatcattaggaaaagttctcatggaaatctccaatcttaatgtcatgcaggaaaaattcaccttgagttactcttgccagcaaaagtaaaatcatctgagtgctacaagacaaaaaaagtagggttggctcaactggttacctttctcatcacccacaccttgctctctcaaaggaattctacaagctcccacaagaatacagaccctaaaagcaaaaggaaaaatggtggatggacttacaattgcaaaagatatttcctagttcagtaagatgggaagattcgcctattgtttttttttttttaaaaaaatagttatttaatttaaaaaaatagtaatttaataaattaaatagttatttaatttaatatattcacctggttgaaaaattttaaagcatagaaaagcagaacctctgcccccctttttctagtttctacttccatacccccaataatcactgctatctatttcccaagtatcctttcgtagtttctttattcttatacaaagaaatatgtttcatgtgttctttttctccttctctcttacacaaaagcagcatccagcattaactgttctgttgctttttatttttagctgagcaaaggattttgcagaccttcccataccagtacatacgaaacgtcctcattcttttttttcaaatgtggaatattctatttactagctccactgtaattgatttaatatattctctatagggacatggaggtcattgataatattttgctattacaaacaatactatattgaatagaactagatcaataagatttaatttactgaaagtttaaagcaacaaattaccattactttcagcacaagtaaactttctaaaactcatttccaaatataaacctcacaaaatctgctttgatgaacaaataagaccaatttataatgagacagtttatttgcatagaataattaatgttccaaaatccccaatcccaatttgtccttttaagtgagtattttgctgcaagtttatttacacttacaattaggttagtgggcattttgccctggaaaatatcagcctagaacaaatctaatcatcatgaattctaaattagtagagtttggataagagaacttttttaccaaattatctaaactgttgttttaaactctgtacagagagctctggatttcatatgtatttcaacattgtcagtttcagttagaattttcagggtagtattcttttttaaaaaataaggatttgaaggatggggattatttgaaaaatcagttgtatgtaaaatgcattgtttttattactttcttttctaacaaattaaatgaaacatcagactaaatttgaggtacattttaaaatagtaaaaacatataacattatagacatttacttgccaagatcaaatgtcatgattcaatacttattttcattgtgagctaatgccttcacctgtctgtcttaaggtcaattaataaacaacccacttgcgaagacctagggatatacgttggtatgaagggcagtgcttccaataagatttcccttgaaatctcgttgtgaggacaaaatacatgcataaaaagaacagaaacatcaagttgataataataacaaaaagttaaatagtacttaccatgggccagacataggtctgagtgctttacaaactttaactcataggtctgagtgctttacaaacattaactcattaaaagtttgcaataacatggtaagtacaattattatcatcccattttatagatgaaggaattgaggcaaaagttaaatgttgtatctggggtcacacagctggtaagtggagaaggcaggattccaactcagactggctatggaggccacttgtgtaaccagccaccacactgctttgtgtatgtggtggcattcacagtaaaggcaaaagagtctagcaaagaaatgaccatagtggtcagggaaggttttgcgggaagtggggcctgaaacaggctttttagaaaacaaaggatttaatcaatggagaagaccgcatttcagaccttcccatctctattgtgagtacttcagaaggacaatcttttgttttggtttctcttttagcacaataaatattcgaagaatggcagaacattggaggaacaaaagtattaggcaagaatgtaaatggtttcaggagtggacattgagaaaacctatttaactaaagtgatgccatcacacagagaagtagcaagggatcatgtcaggaaagtgagttaggaccagattacaaatgctctgagtaccaggctgtagcctctgtggtagtgcttctgacaccctaatcttcacagaaaccactggggtcttgttaaatgcacatgcagattcagtaggtctgaggtgggcccaagagtctgcatttgcagtaagtttgggtgatgctgatgttgctggtccccagaccacagtttgagtaccaagactctagacaacagcaaaaaaccattttgtggctgggttgagggaaagggatagggtagtgatggaaagttgtctatggcacctcccctgagttgcagccaacgatttgaaagatatatagacctacaatattttattgaatttgtttatagaacctttttctatatgccccgtccctcctttcggatgcaaagctgtcttgcctgaagatatgttttaaaccacgtttttcctctctttcatacagagcaaggctaaagagctacctctttctgctgtacgctttatggaagaattgggtgagtgtgcctttggaaaaatctataaaggccatctctatctcccaggcatggaccatgctcagctggttgctatcaagaccttgaaagactataacaacccccagcaatggacggaatttcaacaagaagcctccctaatggcagaactgcaccaccccaatattgtctgccttctaggtgccgtcactcaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccag

SEQ ID NO: 36806 - DNA, 1852 bp, Homo sapiens
tgatggtcaacatgtcagcaccagccatctgcctcgtgccctgggttgacctgggtttaggagaggatcccacatctgggcagaaagaccccaccccctgaaaaaagagcaaacagatttcttgcatctttcgttctatgtggctctcagaacattaaatccaggagtgctttaggaattgggtgcacagtgcctgccaccgaagaggagaaaatgaggtgtggaaacgtgcaaaccgtttgtgagggtctcagcgaggcctcttcatgccccaggcaccaccagctccccctccccagctcgttcccagccaggaccctcagctgtcctctcaggccccctgcgacagctgaagagtgtgcgggggaggggactaggggtccgggcggcgctggtcacaccctcgttgctctcactcagggcccccactcccagcccctccccccccaagaggctcggcactattttgggtggtgtcgaccccgcccccacctcctatcgagccctggctctccgggcagctggaggggtcgcgctgcgcctgttggggctgcacctcggaccagggcttctgctgcatctgcagccatgtcgggccgctcagtgccacatgcccacccggccaccgccgagtacgaatttgccaacccgagccgcctgggtgagcagcgcttcggagaaggtatggcacagacaccacccccttgccccccacccccaccccctgaaattctgggctgacctcccaacgttgctggcctccaccccactctgggcttaactgatctcctgggaccagccaccccccaccccagactacccctcatcccctccaagcagagatctttcccattcctgctgacctcaagacacacttggtgcttgcagtgctgatacctgctctttgccggcctgggtgtgcctccttgtcccccttctatccacccaggccgtttggtgcctcctcctcctccccctcctcctccttctcctcctcctcctcccttacctttccgttctctttcccctcttccgagctgccttctcctcctagctacagtgtggcctccctcccgttccctactcctcctgactcccctcttgctcttcccaatccctcctctccagatttcccatttcgcccctgtgccagcctcatcctccctcatcctgcctcttgccttctctctgccctttaggcctcctgccagaagagatcctgacccccacactctaccatggctactatgtccggcctcgggccgccccagctggggagggcagcagggcaggggcctccgagcttaggctcagtgagggcaagttccaggcatttctggatgtgagccactttaccccagacgaggtgactgtgaggactgtggataacctgctggaggtgtctgcccggcacccccagcgcctggaccgccacggcttcgtgtcccgagagttctgccgcacctatgtcctgcctgctgatgtcgacccctggcgagtccgagctgctctctcccatgatggcatcttaaacctggaagcacctcggggtggccgacatttggacacagaggtcaatgaggtctacatctccctgctccctgcgcctcctgatccagaggaagaggaggaggcagccatagttgagccctgattgccacagacccagcacccagcaaatccctctctacctcccaaggtgatatgggcagctgcccaccactccagaggtagcagcatccttgggggaagggaaaggtgcatggtccacaatgtatggtttggtcccatgggacatgtcatagccttggtttagttttgggtggagctgaataaacccaaatctcagggc

SEQ ID NO: 36807 - DNA, 7078 bp, Homo sapiens
cacttcaaccggttgtcgccccagtggccgccctctgagcacgtgttactgccagtctgcgtcagcgttgggtaaatacatgactggccgacgccgccgggtggggctatttaagagacagccgcccgctggtcctccctgaacttggctcagctgccgggctgctccggttggaaacgccaagccagctgcgtcctaatccaaaaggtaggtccctcggttcgtcagcgggggatccaagtgtcgtgtgtctttgaaggatgctgtcttcagctttgtgcccatttccattatgcttttctattttctgtgtcttccctccgagagctcgaaagacatttcttgaagtcagaaataacggctctgggtctaaaagtgaggtctgggtgggtagagctgctttagagcctttcatacgccagcatcattaagggatgaactacccattcgctaagattcgcatgcagattgagtttgctagctgttacacagcggtgcgggggactttgcaatcttttctaataaaatattagagggttttaagatttaaattcattttctaaatactgcagaaaatttcgaggctttacggatagaaacttgagggtgttttatccactagcgatctaaaatgcacggggctttcgaagcctgagcgctgggcacatatttctgattttaaaacctgcctatgttctgcgtagtggcttattgccatttcccacgtacactttgagaaaaactttataaatacggctttatttattgctcctacattttaaactgtgcttctctttttcatcatttactgtatttccatattgaaagcttgttagctatctggaaaagtgctttccccagggttctcatttctcccacggagtcttccctttaggatatttttttcacactatttttaatctcgtggggttttatttttcttctttcggttagaagagaggcactctgcaaacacttcctcaaactttaggaaagcaaaaacattccttctgctcaacacggcagaaaacagggtctctgccccttggcgctgggtgaggagttcccaaagaccagccaggtgcgcccgggggcgcgcgccatggcactcggctggggtcagcgcttggcgagccctcgtgcttgcggcggcctggcgggtctggagcacctgtgtttgtcctaagcccgcttctgggtgcccggcccgccgcaggagctctgttgcccagcctttcagttaacgcgccctcctcctttgctcgctacagccatgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatcgcagagaacggatggcgagtcccgagcgcacctgggcgccctgctggcaagatacatccagcaggcccggaaaggtaagaatgctgcctccccatccctcacttctgcccttgttcccaggctcccgatgctgaccctcttctctagcgctagcctgatggggatgacctctctcggtaggaaacaagcaacatgatttctggcggtcctttgtagcaatctgagaaggggtatggaggacttaatttataagtaaggggaaccttcttgaaaagctttctttgaactaatttttagcagtgttgctgattaagttcaacaccattttaccaagccattaaaagataattattgaagcctaggaaagggttcctagatacagtgaataccctctactgaaaacgcaaaggaccttggagccacccagataccaacccttggaaatcctctagcaggaaggggtcaatgctgagaatgcctgagatctggctacaacagtttaaaaaagcagtgacaatgtgtccatttccaccaaagtatgtaacagaaggaaagaatcagcagcagttttgtgttctccttgcaatgacttacaaattattacccaacaagagaggtatttgtttttactttactgttgcagagatggtcacagttgtagcaagagctgagcaagtcagttttctcagcatcaaagtctttctccaggaataaggtgattcagcagctcactagccgagtggcatgcaggcaattctgacctgaggctagctttcccctaagctccttccaattctttgtgtgattcagagggaggcccattcatctcttgtgacccataggaatcatgctttggattggggcagcttttttctgccaactttatccccagtgacactaatgatgaacaccggctgtggagcagtgtgctgaacagtacaaacacagctggacattaaaagaattcagcaggccaggagcagtggctcacacctgtaatcccagcactttggggggctgaggcaggtggatcacatgaggtcaggagttcgagaccagcctgaccaacatggtgaaaccccatctctactaaaaatacaaaattagctgggcatggtggcacatgcttgtaatcccagctacacgggaggctgaagcaggagagtagcttgaactcgggaggtggaggttgcagtgagccgagattgtgccattgcactctggcctgagcaacaagagtgaaactgtctaaaaaaaaaaaaaaaaaaaaaaagaacttagcaaacactgctggaagggatgtggtaggtgtgttgccttttccatgaagctctcttacccaactggtgttccagggcctggatttgaaccttaacccctggcttgaccagagagggataagatgaagagttttggctctgcagagttcttctgtgggttcacatgaagggaagactggaactctgacccagaggcttcagaaggaaagaacaaatcagtgatttgttgtatttcttcctgtctttgggaaattgccccacccaccaccttgtgttttgctttcctgctaattaaattgaaaaagatagaaatacttctcagatggagagagaaagtctgaaagcttttgagttcctgctgattctctgcctgaaaataatttagtatctgtccccagatacaggctgaatttcagccagaccagtctgaaatatcctaggcttttcatttaactgtggacctggactcccctcctccaatttaggaaagaccctggtttttcttctatgtaggctgaggatatctgcaaaaaggcctgaaatgtgccgaattgagtcttggttccaaaattgctctagggaaaaaaaagaaaaaaaaaaaagctcattaccaaattatttcctagaaccaatactagacaatggctcttatagcataaatcttagctggaaagttctttctagtccctcttctcagcccccctctccctttgccttcagccaattgtgccaaacaaacccaggagggaatagcaatcacttggaaatttagatgccaacacctaggatcaactctagctaaaaaacaagcaaactcttctatgtgacaaacatgaactaggactaaatacttacacatatagatactgcacagtttctatatgtgcagtatatagaatattttacatattttgaatattttacatattttgagatcatatcagatttttgctccactatagtatatattattcttaaaagttctaaacaagacaatgcattctttgagcagtacttaagagtttatcattaggaaatatctgcagcactttcaatggcccaagaagaaacaattctattggagggcagtgggtaaagatatctagaggcatttagtgtgcgcctcccccatgcccagcaaagcttcaatgctacatctatattgtctttctcagtacaacagccctgcacagtgaatattattatacccattttgccagtgtggaagctggggctctaaaagcctgagtaacctacatgcagttgcatatctacgcaacagcagggctgagactctatctagtcctgctccccccaggagggcctggaagccattcagcttcctagctgtactgcctattccacattttaaagtttaaaagagctaaacccttcagttttagcaagagctaagaaagtcactgttttctcagcaccaaagtctttctccaggaataaggtgattcagcagcccactagctgagtgacatgcagacagtcccgaggctagctttccaataagccccttccaattctttgtgtgattcagagggaggcccgtccatctcttgtggcccataggaatcaggctttgatcaattccatacatcagatgtaagcccctactctatgtcagcactgggaaagtgagtgaggaccctggtaaatacacatgacatgaggacagaactgtacgtggaacggggaagtcagggtgtgtgataaatgcagcttccatgactgaacatggtgcccccaccgttaactgaggctgcttgctcgtattgaagctgtcaccttgcttccattagatggaaatttgggttgtgcccaggccttagagtgggcactcatcatcacagcaggcagaaggatgggtcatgtttccatgtgactgtgtacaggtaactgggtctataggttttcctgaattcaagggtaatatttcacctgaatgatgaacaattaaatagcaggggctatttttcttctacgtaggctgaggatatctgcaaaaagacctgaaatgtgctgaattgactgttggttccaaaactgggaagggttggggttggggagagaaagggtggggacgttgttctgtgttgtttctgtttttaattaaacttgcttaatttcattacccagggtaactgcctttgcattttcatttatcaacacataagccatagtctgactctactcagcctatgggtaggagctggcaagggcagcctcatgcagaagggatatagaccagcatgacaggaggtggggatacagtggcccccaacacagtgggagtcattgagtggtcctccactcctctacccttgatttggcctgggctttgtccattgaagtccctgaagggcctttcttaagactgagcttgcacaggagaaggtgttctgctgatttcataccccaggaggcttctgtctatgaactttgagctaggactgtctcatgtctccaaataaactgcctcttcatgtccctgctcactcagtgtgagctctacaaaaggatcacactgttcctgaagacttaacttccatcccaatgggacaatttcaggttcagttattgcattttggtcaaaattgctgatttaaatcacctttgttatcacctctctcccccccttctttgagtcttactgaggtgccaagatttaatccgacagtctttttctgaatatcatttttaattgatattgatttatcattaaaaataaaatgatcatcaactcaaaacacttactgataaatgacaaaagctttctgaatataactttcaaattcatatttttaaaagagtatttatgtagcaaaggagctttatttatctattttttattatactttaagttctggggtacatgtgcagaacatgcaggtttgttacataggtatacacatgccatggtggtttgctgcacccatcaaccagtcatctacattaggtatttcccctaatgctatccctcccctaacccccaccccccgataggccctggtgtgtgatgttcccctccctgtgtccatgtattctcattgttcaacttccacttatgagtgagaacatgcggtgtttggtcttctgttcctgtgttagtttgctgagaatgatggtttccagcttcatccatgtccctgcaaaggacatgaacgcatcctttttatggctgcatagtactccatggtgtaaatgtgccacattttctttatccagtctatcattgatgggcatttagattggttccaagtctttgctattgtgaatagtgctgcagtaaacgtacatgtgcatgtgtctttatagcagaatggtttataatcctttgggtatatacccagtaatgggattgctgggtcatatggtatttctggttctagatccttgagggattgccacactgtcttccacaatggttgaactaatttacactcccaccaacgatttttttttaaccattccaacatcaagatattataattgtgccaccttaataacaagagctctccaggagtcaggaatgttgatggatattaagggatgaatttaggaacaattaagtactggaaaaatctttggttggtttctgctgatgccatctacaaaaggaaaacacccatctaccaaaagaaagcaaacggtagggagactaaggaaaatctaggcaagtccccagactgcaaggctagagaaaatgaatccacctaaatacttgcagaacgcaaagcacacccctaacttgtaaatatattgtcctctctccagttacacagacattggtccttctcctctctcagattttggtccatcagttccactactttgatagctctttgatacctttaaggtggtgtctgttatattgcgtctggctttttccattgctctccttcccaaattgaactagagatgcttttagatgcaatgtccctgtttccttcctccctgctccttgtagctccttctggacgaatgtccatcgttaagaacctgcagaacctggaccccagccacaggataagtgaccgggactacatgggctggatggattttggccgtcgcagtgccgaggagtatgagtacccctcctagaggacccagccgccatcagcccaacgggaagcaacctcccaacccagaggaggcagaataagaaaacaatcacactcataactcattgtctgtggagtttgacattgtatgtatctatttattaagttctcaatgtgaaaaatgtgtctgtaagattgtccagtgcaaccacacacctcaccagaattgtgcaaatggaagacaaaatgttttcttcatctgtgactcctggtctgaaaatgttgttatgctattaaagtgatttcattctg

SEQ ID NO: 36808 - DNA, 3835 bp, Homo sapiens
ggcagcggctgcggcagcagcaggtgggttgcagcagatcctgcggggacggggactgggacgggctcaggcccaagaacaggcgaaggcgcaggtgtccggggacgggggcgcggcggagcaggctctagcagcagcggcgtgtcggacatggggaggtgtgcgggcccagggcgcccctgcattccgcctggcgcgcggataccccagcctggccacgggtgcaggggcgggggtgtatgtagccgccactgtctgtctgtggccaggtggctgcctgggccacacccgccccgacgcagagccgcggctcctgttccgggtccggctcgactctggggaagcctcggtttcacctggctctgggaccccaccactgagccgttcccagcctctcaccctgctccccctggagctgctccctccccacccctcagggccaccgagcgggtgagcaggtggggcctcaccaggcctcctttgctgcctgggatgcagacagggcctccaggcttcctgtgacctcctgcccacaggttctgacacctgccccattccagctctccagcaggcccctggtgagggtgtccaggtccccaggtcagggacagagagaggactgggggtggtcagaccaggagggatggaaggctggtcaggccccggctacgcatcctgtcattcccctctggccctagcaggttccagtagctggctcggtgctcttctcggccacctgccatggcccgggggctgcccaccattgctagcctggcacgcttatgccagaagctgaaccgcctgaagccgctggaggactccaccatggagacgtcactgcggcgctgcctgtccacgctggacctgactcttctgggcgtgggtggcatggtgggctcgggtctctacgtgctcacaggtgccgtggccaaggaggtggctggccctgctgtgctcttgtccttcggtgtggccgctgtggcctccctgctggcagccctatgctatgcagaatttggggcacgtgtgccacgcacgggctctgcctacctgttcacctacgtatccatgggcgagctgtgggccttcctcatcggctggaatgttctcctcgaatacatcatcggtggcgccgccgtggcccgtgcctggagtggctacctggactctatgttcagccacagcatccgcaacttcactgagacccacgtgggttcttggcaggtgcccctcctgggccactacccggacttcctggctgctggcatcatcctcctggcctctgcctttgtctcctgtggagcccgcgtgtcctcctggctcaatcacaccttctcggccatcagcctgcttgtcattctcttcattgtcatcctgggcttcatcctggcccagcctcacaactggagcgctgacgaaggcggctttgcacccttcggcttctccggcgtcatggccggcactgcctcctgcttctatgctttcgtgggcttcgacgtcattgccgcctccagtgaggaggcccagaacccacggcggtctgtgcctctggccatcgccatctcgcttgccattgcagctggtgcctacatccttgtctccaccgtgctaaccctcatggtgccctggcacagcctggaccccgactcagcgcttgcagatgccttctaccagcggggctacaggtgggctggcttcatcgtggcagctggctccatctgcggtgagagactcttcctgggcagggtggcagggaaaagagcaagggggaccttgtcctcagattcttggggaatgcaccttcaactggggctgttttactagttgcataatggggcaaggaaagtgctaattattagaaactcttcacttcaaaaaaagtttcttcagaaactttggaagggaccgccccacacatggtccatagcatattagttctgggcatgtccttatagattatttcctaggcagagggactcagccctcatccgatgctccagtgggcctgtgacctaacccagatgtcctgttcttgggcaaagcgctgacaatctattactcctacacaaactcatgcttactctgagagcccagacaagctcatgcccttgttcccaaggagccacccatgcaccgacccccagcagaggcccctggtgggcttctccgccatgctgaccctccccactctctctgctacagccatgaacaccgtcctgctcagcctcctcttctccctgccacgcattgtctatgccatggccgccgatgggctcttcttccaggtgtttgcccatgtgcacccccggacacaggtgcctgtggcgggcaccctggcgttcgggctcctcacggccttcctggcactgctgctggacctggagtcgctggttcagttcctgtcccttggcacactcctggcctacacattcgtggccaccagtatcattgtgctgcgcttccagaagtcttccccgcccagctccccaggcccagccagccctggccccctgaccaagcagcagagctccttctcagaccacctacagctggtgggcactgtacacgcctccgtccctgagccaggggagctgaagccagccctgaggccctacctgggcttcttggatgggtacagccctggagcagtggtgacttgggcgcttggcgttatgttggcctcagccatcaccataggctgcgtgcttgtctttgggaactcgaccctgcacctcccacactggggttacatcctgctgctcctgctcaccagtgtcatgtttctgctcagcctccttgtcctgggggctcaccagcaacagtatcgggaagacttatttcaggtacctcccctagccaacacccactcacactcggcccaggcagctgcctccccttcccccactaccatcccagaatgaacaagtctcacggggctggggaggaccacacacccatcccgcacccctttctgcatggtgagtgagcacatgtctccacaatctcccgtgaggaacaaaggctctatggattcccgagaaagtgagccctgggctggcagatctttcctgcagcccggcccagccctgccctgcctctgcctcctcagatccccatggttcccctgattccagccctgagcatcgtcctcaacatctgcctcatgctgaaacttagctatctgacctgggtgcgcttctccatctggctgctgatgggtgagtgggggccaggctgggaccggggtcaggaggagggcaaagaggacaggaagggctggaacctgtacctcaggctcatgccctgcctcctgccctgtctaggacttgcagtgtatttcggctatggcatccggcatagcaaggagaaccagcgggagctgccagggctgaactccacacactacgtggtattccccaggggcagcctggaggagacagtgcaggctatgcagccccccagccaggcaccagcacaggaccctggccatatggagtagctgatcagcccacacttgccccgccctcccacacctgcttgggaggccagagaggccagacaagccgagagccccttctgttgtgggcagcctgggtttgcaggcctgcacaggctggggagtcctcaggaccttaggaccttcatccaggggctgggcttcgggtcttcaggagtgggccttggctggtgctggtgccatggactctgcccagagccttcttgtttatgatcagctccagctacctgggcagttgtggtggggtggatgggaaggcccacagcccaagggatccataataataattgcttggccagccatgtggcctgctggcgt

SEQ ID NO: 36809 - DNA, 39587 bp, Homo sapiens
ctccgaggaggggtggggacggtggggacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgggaaaagttcccttccttccggaggggaggtctgacaggcgatggggagaagggttcccagcaggaggaatcgccctgtttgtctgttgtaggtttctcttctctgaatcaaggtgacagacaggcttgtgtgtgtccagtgtgtgagggatttcgtgattggattttcacatactttgagtggacaccttggagtaaggcagcgaggtgtgtgtggtgcagcagggacgggtgctgggtggaggctccagaacctggcttttcacccacagctgtgccactccttggccctgtgtgaccctggacaagctattcaacctctctgagcctcagtttctctgtctgcaaagcagccagctcgctggctccctgggggtggcagggttaaatcagaagcaggcgggggtgggggggtttgtgaatgttggctgatgcgcctccaggaggcaggtggtagtgactacctcagatgggcttagagaccctcttcccacggtcctggctgaccagggcagggggataggatggtgcaggggttccaagcaccggctttgcatccggcccaggttgcagctccagccctgctctcaccctgtgggtgacgtttttgggcgagttattttgtcctgtctcctgagctataaagaagacctggaagttcctctttatgcaaagatagaggtaggctcttgcctgtgaagcaccacgtatgtcataggcactaaataaatggcagccgtgattcgagttgctgagagtaggtcgtttccgcagcctgggtggaggtgaacagcaggtgttgctgttccaggcaggtcagaatgtgcctcactgagtcacaggccgcctgtggctccccagcctacaggaagtgggagccctggcctgggtgtggggtgatgggggcctccctggccaaccccgcccctaattccatttctgagttggagaagggcttaggtggtgggggaacaggtaagcaaccccagaggacattgcaaagaggccctgcccgaggttctctggagaaaaaactgtgctgcgtccttcgggccctggcagcagcaagagacattccacagttgtgagccccacaagcttggaggaagcatttgctgtttcccctgcttggggtgagagcaggggacagccaagagaaggcgtctttggatgaaaaagaggaagcatgcgtgctgtccccacaggcagcaccccaggcctcatcccagctctccctgcaaccctgcactccaagcctctcactgcactgatgaggaaactgagtctcagagggggaacatgacctcagccagcccttcgctcagtgtccagggaaatgcctcaatctctttgggattccctcccttgcaaacggggaggttcccatggttgggcctgcatgatggatctgaggactttgaaagtggtatttgcctgccggtgggacccaacctggaaatattaggttggtgcaaaagtcatctcggttcttgccattagaagtaatgccaaaaaccgcaatgacttttgcaccaaccgaatagctgtgccacgtggtttttgctaacacagtgactggctcagtaacaagtttggtggctccagaggtaacattagggcggcctcctcacctgtgctgcttgtggtcagggaggggcccacctgggcgcggtggggggagccctgcagatttgcccagtgtcatagcctgtttgagctgctataagaaatactttagactgggtaatttatcaaaaaacagacatttattgctctcggtgctggaggctgggaagcccgagatcaaggcactggcagattgggtgtctggtgaggacctagtcgtcatagatggcaccttctatgcatcctcatatggtggaagggtgaacacgctctcccaggcctcctttaaagaccaccaatcccattcacaaggagggggacctcatgatctaatctccccccagaagtctcaccttttaatatcaccagcttggagattaagtctcaacaggtgaattttggagggacacaggcatttggatcatagcaccgggggactctggttttcagaatgaaagtaggggccttgtctatccgctcaagctgcctcctctgcactgaaaacgatgcctagcccaacatggatggatcagtgtttgctgaaatgctgaatggttaaatgaataaataaatattgctcatatagcaggcaataaaaaagcatacagaacctatcactaagtgaatgaagctactctgaaaaggcatatgctgtatgatttcaactatatgtgacattctggaaaaaggcaaaactatgaagacagtaaaaaataaaaaaaatcagtggttgccaggaattaggggagggaggagagaatgggaggagcccagagacttttagggcagtgaaacttctgtatgacactgtaatggtagaggcatgtcattgtgcgtttgtgcaaacccacagaatgtccatcaccaagagtgaaccctgatgaaaactatggactttgggtgatgatgatgtgtcaacgcaggttcatcaattacaacaaattgactgctcttgtgggggatgtcagtaacgggggaggctacgtatgtgtaggcacaggggatatatggtaagtctccgtactttctgctcaattttgctgtgaatctaaaactgctctttaaaaaaaaaaaggcacacagagcagatctgcatgttgttttgaggattcagaaggcacttaggacaattacggtacctcagggtcatgagtcaaacaatcagacctgccaagacttgacaccccaaatgcatcacttctgacatccattgggtccaggaatcccctgcctcatgaatatccatcttagtgtgcatgcctccaagaatggggagctcactactttgcgaggcagcgcattccatcttaggagagttctactgtttaaaagctcttcctccaactgcccccactgagcaatgggtccactttcatttccttggggtttgtaccattctagtcctattgcttctctctgagctaaatatccacagctactaaatctgccccccttgaaaagtgttaaatcctcaattcctcctctgagctcctctggttttcctggggacctaaggctctgcttccccaaaacacccactccagggttgttttctagaacaaacgtaaggcatgaagtatttctttgactctttcatcacagtgggttctggaagattctggaggctggaaacatatgtgcctccccctccccacacacattccaaaaaagtcatcacagcagaaagcacggtggaacaaacagctctcggttcgaattcaccgtcacttactggccaggaaagttatctgagcctcagtttcttctcctgtacaatggggagcatcattcctatttttgaggaccactaggaggcttacctctgtttgtgctgatgtagtgaaaggggatgtcaggcacactgcaggagctcaggtaccagacggactgtctatggaggcaggagtgagggcctggggcggtcacagaggttgcatttgctttgcagtaaggccatggccgcttaagggtgtccagaaaaaagccctgtccgacatgcacacactcctgtgtccaggcaatgagcctgtgggcactgacagcaagagtccttctcacgcttctcttcagggctcaaactttagatttactccggcctgtcccatcccattcactgccaacccctctgagcctctctgatctgtgccaccggtgaagggcagtcgtggggcacagagaagtggcccagctgagtgacatctggaaatgagcagtgcctgaggggacgcccgtggggtgttgtgacctgtacagtgccaggctccagcacagccccgtcgcttctgtggttcttatcatggtcatgaggtcgcttctcctcttccctgcgggtttcctaagtggtcacactccagtggcagggtggtctgccggagaaagaccaaaatttgtcatactttagaatcacctggagactggtcacccacgcaggtgcgggggtcctgctctggggactgtgatttgaagtctgggtactattcactgaaatgacagactgcggcaaatctcaatcaatcaaggttcatcgagttgataaacttcaattgacatttatcgagagtttgagggtgcacctgggaaaaacatgagccacagaaaatgtgtgtggcctatgctctccgaagagtcatgagacttagtgttgtaaatcaaagagaaactgactgaagcaggtctcaattatttttgaagtttattttgccaagattaaggatgcacccaggaaagagggacacgaaatcacaggaaacatctctggcccatgcttctttcaaagaagggtcttcactattcaaagggaaaaaagcaggcagtaggggaaagaaggaaaaatcgggggaaggtggccaaaagaggcaagcagttgcacccctttgagccttttcattaacttcactgaatgcacatttttcatgtgaaagaagcaggtggaggaatcatcaattccgcattcacctggtgctcagtcaatctgcatttttatataagataaaataatcatagggctgggcacggtagctcacaactgtaatcccagcagcttgggaggccaagttgtgtggatcacctgaggtcaagagttcgagaccagcctgtccaacatggtgaaaccctgtctctactaaaaatacaaaaactagccaggcacggtggtgcatgcctgtagtcctagctacttgggaagctgaggcaggagaatcatttgaactcaggaggcagaggttgcagggagctgagatcacaccactgcactccaggctgggtgacagagcaagactctatctcaaaataataataataataataatcatcatcatcatcatcatagcatataggaagctgtcagctatgcactcgtctcaggtgagcagagggatgactttgggttctatcctttgttccatacctgtgaagctaagctgttaatttatatcatgagggtgaaatacaacagagctgcttgaaggcaaagatcctggggcccacaaggaatttcactgtgagcaaaatgtgagggaagtaaatagttatccatttagacacaaaacgggaggcgggttgcatgacccagctcccagctagacttttccctttggcttagtgcgtttggggtctggggattttaattttatttttctttcacagtatttacacatgtccttgaagtggagaaagcatgtaggaagaggaggttaggcagaaggaggcctgatctcatcttgcctttgtcttgcttttatgctgtacctggggagatcagcaccatcagcgtgactctaacagacttgagtgtgaggagctaggcttggattgcagacctcaagttacaattgatgtgtccttgttttgtggtaagatccacatcttgaaaggtttcacccagcaaagaacaatttgtgggggcagtcatggggagatatccgaggccttttcctttctgtgggggtctggctaatgtctaaggttgtggagtaacagctgtcattaggaataaggatgacaatgttggctgactcagtctccaggcttaactttccctttggcataaagagtttgggggtcccaagatttctgttttcctttacagtactcaaggacttgctaatatctcaggggatttcagccacactttgaaacaagctaccttagcaaatggtctgtcctggacccaaaagccactctcctcaggcccttcctcctagtcccaccagccaaaaaacttggggaccccaaacctgttcttcactctctggcacctgtgctcatgtgcctgctgcctcaggaaaggacagaaaccctccccgatccaagttattagcaaactgcccatctccacaaaaatttaaatggacagattgttaaatgcacacagctcacagccagctcctttcaaggtagatttgggcccaaacatttcgggaagcatcaggctgtgccccgccatccctaccaaacaggaatcctctcgagggaaaagactgggcctttccctcagcccctagcacccactcatgcttggcacctgctgtgctctaagagtgcaggggtcactccctgaccacagagggaggctctctggggttctcccggagcctcggagattgcaccttgtgcatgcgctgctgcacctggggtacatcacccccactctggagcccactggccggttagcaaagtgagaggtgagagaaggacctcttggtcttctttgaacagaaagatccagaaagcaatggctagaacacaagaacaggtcaggggaggcaggagagggtctgcacacctgctacaggtgtgctcacacgtgggccagggcctgcagatgagggatctgtgctgatcatttgtgatagccaaaagtagtgaaaacctggggggactcctcaaatgaactgtagcacattggggagatggactctgtgaagatgattcctctctccacccacttcccttctccctcctcctcccgctcctcctttttcggaagccaggcacagggattgaatcccaccccattcctcccctgctgtgtgacctagggcaagagatgtggtctctgggatccttcggttccttcagctataaatagtagtagaattgcaaactacctacgaaaactgggaactccctgcgaaggccggtgcattacagggcagtcctactctgaaatactgtgaggctattgaaaagcaaggtgggtcgacagattgttaaatgcaaagaggtgaggacacagccggcggtgcatttagggtgcttctgcaggcgtccttatacatggatatgtgcacatctgctcctgaaagctcagaagatgtctggaaagcaacaggagacaccagtgagcctggctgtctcttgaggcaacaggcagggacagaatctggagggagacctacccctcactgtattctttttcgcactctgaaatgttaccatgaggatgcatatctctttgcaaaaatttaaatataaaaagcaaaacaaacttgaatagaaataaactacttgaaaattttagaaaacactgttacatcaaagagacagatcatcaaaactgaaattatagatatttgagaaacaactaactataagaacactgcttaccaaacttatgggatgcagccaaagccatagtcaggggatgagtcatgcctttaaatttttaaattattaaaccaaaaagattgcaaaaaaaaactgttcaattcaataaactagataataatgatccaaaaaagtagaagaaagaaaagaattacaaaaacaaaatgacaagttagaaaggtaaaaagcattaatgtcagtaggccatctaaggatggctctttgaagagcagacaggagaagggcaatcccaggaagtgctatgtgctatgcagagaattagaataagttgatggcagagatcagtgggtggcggctcacttgggtggtaaagagtagcctgcagccaaagttgggcacagcagtgcagtcttcactgggggaatgcctgggaaacaagatttgcctgggtaggagtttccatcagcacccccagaaaggtctcctttctaccctggcccccagttctttgatgggttttgctgatgctcctgtgtctctgaacagcaggcgcctcacctatagaaaggtaggatagcaggagttaacgccccctcccccattccatggcccctgcctgggattctaccatctctgcttcatatgctttataggagttcggtctgagcccacaacccaaacaggctcacagatgtgctagctatttcgccaccagtatttttttaatagtcaatatttagaaattggcaccaactggcccgattgttcaacagtcctgggttaggttactaggccaattacttgctgagtaacccaggacaggtcactgacctctccgaacctctcctttctcacctgtgtgataaagactactgctgtgccaacacaataggactgtgtatgaaagtacccagactgtgcctagactcaggaagctggtttattccttcctcccctaaccacttactgagagactgctcagggctcccctcagctcagagatctttccccacaaggagctgagagcctggtgggagagacaggcagagacccaagtggttctaacacagctctctgaatctgtaaccccaagtcccatccccagaggacactgggacagtcacactgatggtttgtccctaagcctccagcatcaggagccatgtggcaggatctccactcttcttcttcctgggcctctgtctggaccgacccaaacacacacacacacacacacacacacacacacacacacgtgtacacacacaagttgcttctttgctgcctgcatgtcctcacaccagcttatgacacacctacaatgtttgatgtgtcattgtgggcaggtttcaagttggaggacctagacctaggtaaagtagagggtctccctaagtaagggagggtgcacagtggagagaaagggtaggggagactgcccagtgccattgacatatgcctgagccccagggcacccttggccccccaaaacaatcacaagtatcccccccgacaaacctgccaagtaggcattgtgtctccacttgacagttgaggaaatggtccctagaggggagacagagctagctagagactgggctggccctggagcctggcctgggtcttcccatcgcatcctgcctccctacataagcaaaggtcgagaggtgggaactcccaaagatgctcaggcagggccaggggagaccagtggggcagggaggggacaggaggggaaggaggagctggggctggagagatgggtaggagcatgagtcccttgcctgggcctccccatggtgggcggtgatccaaaagccccagtcagagccctctgccctgtgacgggggcaccctgcatgtcccctcactccctgccctccagtccccgccagtcctcatgttttccatgaggatgagtacagccgcagggactttccctgcaagtggtctgggccatatcttccgggagtctgtttggactgtggtgtctgtggctgagggggtggaggtgagggcacccaggcccatcacttgacagaacaatctgtggatttgggggaaagaggaggcgactgtcattcctgagagaggacgggaaccaacaggaaggattcctgagtgccagggatgaccacactggatcctcacaacagccctcctgccggggacaatgctccttatcccacaagcggggacctgggctctgacaggaggccacacacttacagtccctcccttagtgaccggcagagctgggatttgaacacccctggtgagactccctcgtccagaccccttcgttgtacagcaggtttgcctcacatgccagagtcggggtggcctcagggcacagccaggagatgtccccaaatcccgaaatgtggtttgagtcccagtccctcatctctccagcctccaagccctcacctatgcaatggtgccttgcccggctcacaggttatgaaaaggggtgagacgagacagtgtcccctaaatacatctgacagcacttttgaatggaaaagagaaaaagaaaatactataagcatccagattgactggaggttggggagttggtgggggcggggacaggcaatccataaagcaagaaaaatcaggctgggttcaggcttttctgcagcagcgaatgcatcagagctgccaggggggcagctgtagacctaagagagttcctttaagcacaaattggctgattatcttttttacgtaaataaacccataattcattccaaacacttggcttatttaaatatttttattgccaaaggaatatatgttcttcacagaaaacttggataccatgacaaacagtaaagaaaacccaaaagcaacctatgatcccatgctcaaagacaaccagcgccagtaataatttggtattttgccttctcaacttttgaactttgttgtatgtacaatttggttacccagctttttgttcccctaacatgttatcagaaacattctctcatttttggtgaactcttagaagcatccttttttcatgtctgcttgacatttgttgaatggatataagatcatgtatttaaccaactgcctggtcctaaacatttaggttgtttcctgtgacccttcttctgcatgatgaggaacatctctgtgcataaagcttttcctgtccttttgattattttcaaaaatgccaaacaaaaaaaaaagggagggggttgaaggttctgggttttcttcactgaattatccaaatattaaatgatctagagacaggtttgggagccactaaaccctctcctcctgtctgaccctattcagagaagacattggaagctgccatctgctttcctctcacagtctgtaagtggctcattaaatacttgcaaactagattatttttatgttgtcttggctacaggagtttctgcaggaatcagaaacaggaagaaaaggcaggtccttggagacagaggagctggcatctcatcagatgcaatttcttattaatagtcatccctaacattgattcggcatctactaataatcaatcccttcttacagataaggaaactgagtagcaataatctatcccatcttacagataaggaaactgagactcagagaggttaagggcactgcagtaagcgcagacacagagctatgactcccgttctccctgtgtcagcccctgcgcagtgcgagtgggaggtgagccactgttgcgtgccctctgccagacacaggcctgcaggtcagactcacaggagccaagcagagcatctgggaggattttgtttctggctccaaaaatgaaataccaaggaaagtaggcaagctcatgcatgtcagaatcctcaatctcagctcaggaagtaggaattttccacctttgttagcagcagagatgacaaaccccagggccccacatatagcctgtgccttagtcactgcctcgggccaggttgcaagacccctcctaccaactgagctacaaatcacagttcctggagggtgggcctttatataacagggaacagaactcttctgtacctcccacctccccgcaagaagtaggccaggcatggtagctcatgcctgtaaatgaagcattttggtagaccaaggtaggagggtcacttgaggccaggagttcgagacaagcctgggcaagatcccatctttaaaaaaaaatttaaaaattagtgagctgtggtggcaggagctgtggtcccagctgcttggaaggatgaggtgggaggatcgcttgaacccggtgggtagaggctatggtgagttataattgtaccactgcactccagcctgggcaacagagcaagatcctgtttcaacaaaagaaaaagaagagagaagaggaagaaagaaggaggagaagaggaagaagaaggaggaggaggaggaaggaggaggaaggaggaggaagaggaaggaggaggaggaaggaggaggaggaggaaggaggaggaggaggaggaaggaggaggaggaggaggaggaggaagtaggagaagaagaaggaggaggaggaggaggagatcctacagcactgtttggaagattatgggaaaattaggcccacacatctgatatacaatcggcacatcctacaaatgtaaaatgtgtgtcttgaaccagaaagcccaaggagtgaggggctgtggcattgagtggggtagctatacatagccctagggcttaaatctatagaatttaagtaatcctggtccaaattcaccagaaacattgcctagactttacttgaatacctttagtgacagggaactaactactaccaaaggcaactaactcagctcagcaaacattcagtgatagctgcgcttccccaggaccagagattcagataagcaaacaccctgttctgtgctcaagggactgatggtgtgtgacaatcgagatagtgtgaagaaaaaggacagcatatgtgtgtctctgtgcatgcatgtgcaaacactgacactgcagtatgtattcagaggaagtcactacaatggtgaggcccacctggcaccagaatgaacagatttaagaaagctagtcaccgcagacggtcacagctggaaggattttacaaaataatctatcttatcatcctcctttgccctagagatggggaaactgaggcccaaagagtgaaagccacctgctcaaaggcatattgttgagtctaataataaaaataaccatagcaatagcaacactgagggcagctgtcccagatggacgctggctccatgccagcccctgggctaggcgtctggtggcactacctcatttcactgccataacaactgggtcccccatcttgcagatgaggaagcccaggttcagagaggtgaagtggggggctgggggtctatcccagaccttgttgtcacctcctcactctcccagtagcgccagccagagcacctgtcttgggagccccgaggcagggacaggctatgcatccaggaagcccccaggctctaaggaggcggccctataactgctggatgaccaaaaatcaggcagcgatccctaagtcccttctgagccccaggctccagactcctccaaccaggtctgccttacgcttttgaccacaatcaacccggctctttctcggttcttttcatctctctggtggttttgtatgcagagtcacccaggtccccacttacgagcctgtgagatgggataaatcacttccctttgctgagcctcagttccttcacctgtaaatgggcataacaagttcctccaggacaatcgtgaggctcagggaaaggactgtcgtgcaaacccaccatggcatgagctgtcgagtgcagtgcccgctgccactaaggaatgagtgccactctgggattgtggaaagtgcagacgggcagggttgagatgctcgtgcatgactttggacaggtcacctccctctcagaggtttagtttccttacttgttaagcttggactaaaaatatctaaatggtgagatttttccaacttctttggctctagcatgtctgtggtccttgatggtttacaaagcgcttttgcacttgagacccctaagtgctaattctaccacatccccatccacttcatagtgggatgaccttagccaaggctcttcacctaaacctccataagcccctcgctggaatttgagcctgttttgcttttttaaagtgagggcaatgctactggccccacccatcttacaggacaagggaagcccaaggacatgagagctttctgagctgcatcccaggccctgctctgccactgactcgctgaggctgggtttccccatctgcaaaataaggacataaaaacccatctagagctgggcatggtggctcatgcctgtaatcccagcactttgggagtccagggcaggcagatcacttgaggtcaagagttcgagaccagcctggccaacatggtgaaaccccatctctactaaaaatacaaaatattagccaggtgtggtagctcatgcctgtaatcccagctactaggaaggctgaggcaggataattgcttgaacccaggggacggaggttgcagtgagccaagatcacgccactgcactccagtctgggtgacagagcgagaccccatttcaaaaaaaacaaacaaacgaaccaaaacaaataaaaacccatctagagtgttgtggggattaaatgagttaatatctgtgaagtgctttgaacagagctggcacggccgggcacggtggctcacgcctataatcacagcgctttgggaggccaaggcagggatcacttgagcctaggagttcaagaccagcctgaccaacatggcaagaccctgtctctactaaaaatacaaaaattagcagggcgtggtagcatgctgctgtaatcccagctactcagaaggctgaggcaggagaatcgcttgaacccaggaggcggaagatgcagtgagccaagattgcgccattgcactccagcctaggtgacagagcgagactctgcctcaaaaaacaagaaccaaaaaccccttaagagaaatggggttttctcttatgagaaaaataaatatctccggtgtttcctctgacttgcccagggctgcacagctcacaggggaggggtggggaccgggacctggcacttggctcctgctgctctgccctatgcccttggggacttctggacaagggtgggcttctctgggctgacagaggagacagaggcaatggtgtgctggtaaatggttaacaactggctctctggaaaaaaatgccctaactgtagcaaaaaaaaaaaagagactagaactggcacattgcagatgatataggcatttgctgtcactatcagcatcagcatcattacttgtcctttcaacaaatatttcctgagcccctgtcgtaggccaggcccagtgctaagaggtggggacacagtggagggaagacagaaagttaagtgtgctgtttccataaagtgtgctgacagccatataggagcactggggctggggtgtctctacggtgcctgggagggtctcctagagaaggtgacatcaagcaggttctgaaggatgagtaggagttggaaggagttggaagagctcctgccctttgtggagcaggagagggaggtggtccagggacctttctggccgaccaagcctagagccaattgcagtgagccattgtgacattggacttgaaactggtcactgcgagagtatttataccatagaaatttgcaaatgctacggttagggcatttttttccagaaagcccgttgttaaccatttaccagcaccccactacctctgtctcctctgtcagcccagggaagcgcacccttgtccagaagtccccaagggcatagggcagagcagcaggagcccaagtaccaggtcccagcccccacccctcccctgagagttgtgtggtcctgggcaagtcagaggaaatgccgggggtatttattttaaaaagtgtctatcaggactctacattatgccaggggtctcaaaggtgaaagaggcatgagtttgtccctcaagcagctcaggaggagctggaggaggtttcctaggcacgagcttatccacaccatgacacatagaccctgaagtgttttaaatcaattacaaaaagcaaaaatacaaggaagctgacagatctttactttgggagaagtggaggcttgggaacaaatgagatcatcaaggtctttttgtccgttttctaaggagttggggtcattggctgagatcctgcagatctggaggtaccaacatgagactccgagggccacctcctctgcccctccctccccaccccctttaaggccctctctggaatccatcccttttcctccatctccccagacctggctgaggcctccgttgtgcctctggtctggtgcctcagccccctcgcttcctgcttccagattttgccaactgccccccacctttgaccatgtccaggcatcctggctcaaaagccaagatgagatctatacttgagagcgtatatgagagggatgcaactgaggctacctggagtgcgtggacacagccatggcctcaggtcatcatctcccccacgaagcctcccacacctcctgtccccaacttgggcacacttcccaccacctgggagacccctgagggcaggcaccatctgtccttcaccactatatccccctataaagagagataatgcagtgaggtgccggggttcaaatcccaactccacccatcaccagctgtgtgactctggacaagccacctctgtgtgactctggacaagtcacctcactgctctattcctccaatttttataaaattgggatagtaccagtgcctgcatctaaaataggtgtggattacatgaattatttcatggaaagtgcttagaacattgcttggcattcatagtaagcctccaaaaactgaagctattattattccctggttgctggcccagactaagcactcataaatttgttgaatgaatgcaatgtaaacagggaaatgctctgtaaatgctggtgcaagctcatcagcttcgttgtcgtcatcagcattgtcctgatgctattcatggtgggtgtcctgtctggagccctgctggctgtagaccaccaatgtgggcacagtcctagcccctcgctcaagtagggtatgcgaggactcaggagacgtcaacagacattcacagtatttacactgggaccttggaaccagtgtggttgagtagacacccggaggacagagttctgagtttatttgggaggggttgccggggagagtcagctgtctggaaaggcttcctggaggaggaagatttgctagaggtgcttgagtggttggtgcaagggggcttgtggggaaccagagcgtcctggtgtttagagcagcaaggaagaggctgggtaaggacaaaggacattgggacagacagaaagcctgactctagaaagaaggggccaaggtcactggagaggagagagaggaaggattaaggacgattgagtgggtcataggggttgagggctctgtgtagggaaaacagtttcccactcaatcctttcgatgccactgtgattaaatgtgtgggtttatttcctcagaaattgtcttacaattccgttcagttctgacattatctgcccggaggcagcacaggataagagctcagtcccacaagactgccgccacttcagaacccatcgcaagtctcaagtggcctgcacttctgaccaaccagctgtaaggcagggttcccacaaccccctccacgggttcagtaatttgctaggatggctcacagcatcagggaaacatttacttacattactgacttataataaaagacaccactcagccacagccaggtggaagagaggcacagacccacacgtggggcaggggcctggagcttcggtgctgtctctgggggcaccaccagctcagcacttccctgcgttcaccaactcggaagctctcccaatcctgtcttttagggattttgatggaggcttcatcatataggcatgatggataataaattcaatctccagcccctcttcccttcctggaggatgtggggtgaaagttccaagctttgtatcatggcctggtcattctgatgacagcccccatcctgagcctatccagccaccaccaagagccacctcattagaacaaaagatgtgcctatcatctagaaatgtcaagggagttaggagctccgtgtcaggaactggtgtcaaagaccaaatatgtatttcctaatatatcacgatatcacaggttgtgagaagaatgcaatcaatggtcaaactccagagctgcacactctccaatatggcagtgaccagccacatgcagtcaccaagcacttgaaaggtggctgcttcaaactggtatgctaagtgtaaatacacactagattttgaagagttagcaggaaaaaataataatataaaataactcaatgactttttgtattgattacatattaaaataatgttttggatatatttgattatatctcatatataaccaaaattgatttcacctgtgtctttttactttttttaatgtggctactagaaaatttgaagttacttctgtggctaactttatagttctattggacatcaccgaccgctctaggctatggaaaattctgtagaacaaacaactggaagttggaagaaaagacagtaagaaatagcaaggaagggtgtgctgttgggagttgcttggaggttggcggcacagggctgaaggctagcaaaccgagcgatcatgtcacacaaacaaattcactattcggacagatacgacgacgaggagtttgagtatcgacatgtcatgctgcccaaggacatagccaagctggtccctaaaacccatttgatgtctgaatctgaatggaggaatcttggcgttcagcagagtcagggatgggtccataatatgatccatgaatcagaacctcacatcttgctgttccggcgcccaccacccaagaagccaaagaaatgaagctggcgagctacttttcagactcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctcagctgagtgtgaccctaggaggcacaatgtgctctgtatccagaacacacttggcagatggaggaagcatctgagtttgagaccatggctgttacagggatcatgtcaacttgctgtttttgttttttcctgcctggtgttgtatgtaaggtcacttgtggatttatgtttcagcgtactggaaactttccattttattcaagaaatctgttcatgttaaaagccttgattaacaaggaagtttttataatctaaaaaaaaaaaagaaatagcagggaaggctgtaggtgaaaagaaacttaagagacctatcaaacaacccaatgtgtaaagtcatttgcattctgattcaagaaaaccagctgtgaagaaagtagcgtgaaattcatatgattgaaagttgtaatacttcctggatagttgatgccatttaggaattattgtcagtttcttcgagatgtgataatggttgtctagttatgctttctgaaataagagtccttagcttttagagaagaatagtgaaatatttacagatgaaatgacagacatgcaggatttactgcaaatattacaggaggggtaaggtaggtttgggcatagagaaaaagattggctgcgagttggtaattactgaagctgggtgaagtatgtggagtttcattatgctagtctatctacttgtgggtatattccaaattttccataataaaaagttaaaaagcaaaaaaaagaaccatcatctccacctgaggttctggcccagactgcttatgttcaaatctcaactctagtcttgctagctgtgcctctgtttgctcgtctgcaaaatggggatgataatattagtccctacattgcaggggtttctctgtaatgtgcttaaaaatatggaaacaatataaatgaaatgaagatatgttgcaggcactttgcacattgtcacggtgctcccagtgccttgttccagggaggttatccttatttaccaagaggttaagtcacctgccctaggtcttccagtcagtggaggcaaagccaagacatgtcccgagttcatctgacttctgagttcaggcatgacctgaatgttcttgcctcgggctcagggctcaacatttcctgtcttctctgcttctccagtcctgagagattctgggcccgtttccctgcagatcagctctaaggaacatgcttctctcctgctcctttctagaaaaggcgtaacattggcagaaccaggaactctggaattctgaaggttgactccctcaattccaaggggctccacctcctgagcggaattggatagaagacaaaggtcacatggctagggtgaggctttgagatgggcgagactgtgagcaggactgacaggtcagggccaggacccaggatcttcagaagccacagggagcaaggcagggagcagcctcctttgtgccacacccagtgaaggggaacttgctaagacagatttgttcctcccatctccagaagagccgttggatgccaatgggtgaggagctgaacctctgcagactcagtgtgctgatcccattgcctctgcttgcatgcctctcaggatggggagttcactgcatccccctctttaaagacattacggttgtacaaaggtctccagaatcatctgttacatcccctcattctcccaatgaggaaattaaagctcagagatgccgaggcatttacccaagggcacacctggtcctgggcctacgacccttagacaatattccttccacctctttgctatagagtctcagactagggatcttggctggctgagaaatcagggaaggcttcttagaggaggtgagattggaggtggcccttgtagggtggcactaagatgtcgcttgatatcctaattttttttttggccctgcccaccatgtgtgtgcctgtgctgccatgtcacactaagcagagtaaaatgaaggaaggaacggatgaaaggggcaggaaagcgactcccaggagctgaaagggcaatagtataggtcccttcagcacctaggatatgttgtgggaagcccttagaccccagatactaccctgtgcagatagggataaaactccacctgtcccagctcagtgctctccccggctcctctggcctgcttgctgggcagggcccaaaccagttcaggattcctttttctctgtgacctaccagttagggttctctgtttactgtgtctcctcctccttgttttgtatacccagctgggtgggaagaaggtcacagcccaggtttgcacgtggtggaggagcagggccagtaactggttaggcagagaccccgcccaccaccctccactcccaccctagcagggcctgtgccatccccaggacaccggagaccaccagggggctggagaggctgcgggagaaacagccttcctggacacacccagctacggctcacttcccagcctgagctgttccttaggaattgcttttctgggaaacacaccctcttccagacctgcagccttcctttctatgtggtttttggttttgctctctggtgagggtttctattttttcctggtatacatgaatggcatgcaggaaagtggaatgaggacatcatgaccaccatgcaaaggccattgctcttaaggtttgatgtaagctccccactctccacccccactacccctctgcctcggcctggggtatgaggtcttggttttgacaatcagacaatgttagcacactgctgtgtcttccacctgcaatggagcactgtaggacgattttaaaaagcaaagtggcaggccaggtgcggtgactcaagcctgtaatcccagcactttgggaggctgaggcgggcggattacctgaggtcgggagttcgagaccagcctgaccaacatggagaaacccccgtctctactaaaaatacaaaattagctgggcgtagtggtgcatgcctgtaatcccagctacctgggaggctgaggcaggagaattgcttgaacctgggaggcagaggttgcagtgagccgagatcgtgccattgcactccagcctgggcaacaaaagtgagacttggtctcaaaaaaaaaaaaaattacaaagtggctgaataccaagatcctaggaactaggttcagccaaactggctgtgtgtcctggtagaatgcccaccctctgtctctgggcctccatgcccatctctgtagcatgagggattctgatgaaataatttccaagagcccttcccacactaatactccaggattctgtaaggttaatttggcaagaattccaacggcggaagaaagatggagggaggaatatgtccagtctaataaccctatgctcaagtcagaaagcccctcgggcagtgtccgagagggctacagccctggccccagaacctgagtccctctaacctgggtcaaacccctaaaagccactccagcaagagacaggcaaagcccgggctcttgctccaggctggcattgccttgccgtgtggctgtagacatcgtttcacctctcgaggcctcagttttcccttctgcaaaagacaggctgggggaggttgggcattttcttcttaactaccaggagtctttcctccaataaaattgtgatggaaaccggatgtcacacaaagggaaaggaaacactggcatttctggagtgtttgaagcatgtgaagtattgtttaagggctttgcaatcattaatgtactttgtgctcacattaaccccacaaagtaggtgctattattatccccatttgacacatgaagaaactgaggccctgaggagttaagccacttgtccaaggtaaagagtgggagctgggcttctgatagggagtgggcctcagtcatgaaaccacaagacttgtgtagttccaaccccctggggacatctccaggcacttgacccatgctcttccaacattcatgtatgcacgcacacgtgtacacacacgtgcacacacaaacacacacatgtgtgcacaaacacatgcatgcacacacaaacacatgcatgcacacacaaacacacacacatatatacacacaccaacacaaacacacatgtgcacaaacacacgtgtgcacacaaacacacacatgcacacacacacacaaatgcacacacatgcgtgcacactgtggctactcctctgtagcctgctggccacactcggctcaagccccaaatcaaaggtgactagcaagattgcgagacagatttctggagatgggaaactgcgtcatcaaattgtctcagggacggaacacccatcagagccctgggggagagaagagacacggggtggctgccaattttgctgacctatgctgctgactttccagcagcccccgactcctgtggccagctgagcccaggtccaagctgccccctgcacagggcttgttccctggagggctataagccacagcatcccctccaagacagccagtcctgtgaacctgctcaatccctcactattccttggggcctgccctgggagaagggagagttccctggaccccttcttgggacttgcggtgacaggggtgtggctcacttgctcaaatcccttgtgtgaggggaagcatgcaagcaagtgggtgctggggccggggcaagcgcttttgggctctggccctacagtaccgtctagggttgtgttacaattaatgctcttttagaagttgccattcactgatggctaagtgttaaccaactcagtggagagtgagggtgacagccttttacaccctgccctcttggtacctgggtccttgtctggcatccaggaagaatcaggtcacacggacttgaaggatggtgaatgcagaggttttattgagtgatggaggtggctcttagtcgggtggggagctggaaaggggatggagtgggaaggtactcttccagatggctgaactcttctccaactgtccagctgcctcttccacattcagacacttcttctcttctctccttctctgccatgctgctctgctcctctgccagtggagtttggggtttttatgggtataggatggggggcatggtgggccagggtggttttggcaaaagcaacactcaggtgggaaaacaggaatgtgaagttctcatttagggccgtgggcccaggcttgtgggtggggcttttgccagagagctgtcctcctctacccagtatttccctgcctcctgtccatatcacctgcaccaagaacctcactgggtgggagccaatccagagccagagaaaggacttgacacttggcctcaggcagacccaggcttgaatcctggccctgcctctgatgagcagggtgacctgaactgtctcaggttgcctcgctgactctgctttcccatctggaacatgggaatagcaatgcatcagccactcagtgcagtgttgaggctggaacaggtggggcacactgtgagctccatttccttttgcctccacccagcaattatgtctgctggggagaagaggagaaataaggatcacaccctgccctctatcagtcagtcaacgaccatttattaaacacctactaggtgtcaggcacttgacagagaaatgaaataacaacacaagcaactcttatagctataccctataataaatgttatagaagcaggaggcaggtagaggtggaagagaaccttctgcttgcagggggatatcagtcagagaaacagaaccaataggagacacagattaagagatgtattgcaaggaactggcttatgtgattgtagggatgactaggcaagtcagaagtcgcttgggaatgccagaacactcagccttggaccgaagctcctgcccgcaagctgaatttcttcttcttccaggaaacctcagatctgctctaagtcctttcaactgattgactcaggcccatgcagggagttgaggacaagcttccttagtgaaagccagctggctgtgggctgtcaccacacagacaaactgcttcaccccaacaccaagattagcttgaaatggaataactggggcctgtcatccagccaggtggacccacagactcaccgcagcagagcacctagaggcggccacggagggttagtgacagagcagaatcaggcagggcacccgggcagggggcagacccagcaaaggctcctagggcagattgtagaagaggtccttggagatcagggagtacagcaacgtggctgtggcactattaaattaaattaaattaaattgaaaataaaattaaattaaaaaggattggtggctcacgcctgtaatcccagcactttgggaggccgaggcaggtggatcatgaggtcaggagatcaagaccatcctggctaacacggtgaaaccctgtctcttctaaaaatacaaaaaaaaaaaattagccaggtgtggtggcgggcgcctgtagtaccaactactcgggaggctgaggcaggagaatggcgtgaacccgggaggcagagcttgcagtgagccgagatcatgccactgcactccagcctgggctacagagcgagactccgtctcaacaaaaaaaaaaaattaaaaaggattggaataaaggaatggtttagtaaacaaaaataaacaaatgcaatgccttttttgaaggcgtcattactacagccatgatggagcaacacggataaattcccatgacaggaggtttcatgtaaaaccacggtgacagaacatagttggatgtggcatacataaacagctgtgcccagggatggaactctgggagattttcccattagttttaaatgctctttcatgtagttattcttttatttttatgtttttgagacggagtctcgctctgtcgcccaggctggagtgcaacggtgcgatctcggctcactgcaacctctgcctcctgggttcaagtgattctcccgcctcagccccccaagtagctgggattataggcgcccgccaccacacccagctaatttttatatttttagtagagacggggcttaatattagttttaaatgctctttgctgtagtttttttttttttttgagatggagtctcgctccgtcacctaggttggagtgcaacggtgggatctcagctcactgcaacctctgcctcccggttcaagcgattctcctgcctcagccccccaagtagctgggattataggcacccaccatcatgcccagctaatttttgtatttttgtagaagtgaggtttcaccatgttggccaggcttgtcttgaacttctgacctcaggtgatccacctgccttggcctcccaaagtgctgggattacaggcgtgagccacagcacccagcctagttatttatttatttattttttttttaaagagagagatgttattttttttaaggggaatgagtggtattaggatgtcaaatgaaattgcttatttaataaaactgaaaagcccagtttggggaaagaaacaaaacacactgagcagaataatctaaccacagtgaacaggaaaaaaagccaagaataaaataagttccggggtatccaagggtgagcaaagccaggccggcaggcctcctcctcccttgcagaaagcaggatggatgaggggctctgcttctccaggctccctcatgtccccactgaaagtgtttccagaacattccaggcccataaagtgtccaaatgctggaaggacttacatgtatatgtctgggattgaatcaaatcttctgactcaattctctttgggagttctgagaatggaggtcacttcccagaaccccgtcttccccctacagacagctttggccttcttttcagggaagaaaagaaaagggactcttggaaaccctgctgagggccacgcagctctggttgttgaggctcatatggtttatgaggcgccatcacccccttccgccaccccctgcctgctgtggcctgaggcttaccttcgtgactgccctaaaaacagcatccagactcagtaaccacgtcaatcagcttttagaggaaaacatttattctggggaggtgtcagggaaaggattcaggagatcttggttctttctagctctggccttgacatcgacttgctgggtggtctgaaggatttcacttatttacagagcgaatattgttcaagagtttgggatgtgcaaaactcagctgcaggcgtgatgcagggtgggaagatgagcaaggcagggtcctcctctccaagtacagcgaatatggtgggacagatgcacatgcactttatgcacgcatgcacgcacaccatgtgctcagctgccactgagaggagataggagatgcagagggagagggagaacagccgccctctgactaaggatggagcccagctgtctcaagagctctcctggatggacagactggtggcgtcccagcaaaatcccccatctctccatccggctgtgtaatgaatgactggaaacctcagctggcctgtgagcaggagatctggccaggtggaagggaatccctgacaccccacagcccctggtgtagctaaagcagacgggcctcctgggctggtgcaggaagaacagcttatgttctcgaacacattgaccacgtgctccatgcatctgacacacacggactcgtctactccacacagcaccctaggagatggggctgtttaaaataccaatccccactgtatagttgaaaaaaacgaggtgcaatgaggttaaataacgagctctagagaggaggactcaattcacagtcagcttccagagcccatcggcctaaccgccaggctggcttcccgtccgtaatgcacgtttccagctagaggctttcaggctgtgtttcccacacttagccattgacattcacgttcacagtttttgccacatccatgtcacctgtacaaccatttctttagtagtgacttacttttgaactgcaacttcatgtcaccaatttaaatggaaaatgagtatcacttatcataaaaaagatgataactgtacaaaataaaagcaatagaatgtgaacaatgctattagagcctgggtagattcggggaccagccaaggctctgaacctgctcagtctgttgaaaaaggagattacgcacatagaaaggcgttgaagtgcacggacaccacgctgagacgttcttgttggcctaatcaggaggaacgactagattattcaattcaaggttgtttaccaggccaaactacttcccttgctgggaaatgcttcccagctctaacgtgcagtcagaaaatacgggacacaagttgacatccgaaggaaaaatatcttttccttctccacttccgagttcttggttgggggccctgaaacaaaaaacagatgaacaagagaaaagtgaacaaattaatttaatgtaagtttaatgtgacatgggaaccttcataaggaaatgaagtgattaagcctgagtgcctttttgtttttttgagacagagtctcgctctatagcccaggctggagtgcagtggtgcgatacggctcactgcagcctcgatcaccccgggctcagctgatcctcccacctcagcctcccaggtagttaggaccaggactacaggtgtgtgccaccacgctcacctaattttttggtactttttgtagacacagtctcggctgtgttggccaggctggtctcccactcctgggctcaagcgatccgcctgcctcagcctcccaaagtgctggggtcacaggcatgaaccactgtgaccggcctgagtgtttccattagatgtcatgaacagtggagaatcatggggctgtggtgggaccagggggcacgagcgaagtacagagaactggagaaacagcaaggcctgtcggggctcctctcagtgtccccagtgctcggagtggacggtgcccctttcctctggctgtggagtctggtgtcctgcttcagggaacaatcacatagtccttctgcgcctgctgtttcttggattctttccacttaaaatattcaacatgcgaagctgccacattttggggtagcgtgccctgaatcattggctacaaggtcgcgggccccacatgaggcacagttggcccttgagacagtgacactatgtatttcgtggaggccactgcttcaaaggccctaaggtgtggattcctgggaaaccaaaacaggctgtctccaaggctcaagtggaattgatttctaacagcccaggcccacggtgtctgtgcgagtaaatgaagaaagtgtttttacagtaagtcttcttggatagaattctgagggagagagagaatgagtgaatcagaatgttggatgttccctctaaggcatctgtttaaaaaatcaggggaaaaacccaggagcagagtcatcacctgtccccagctctgaggatctgtgtctgtgaggcacatgagtccaccctcctagctctgtagacaaggaaactgtggtccagagagatggagatcccacagacaacggcccacctggagcaccccctccccgcctgactttatattcccaggatgcattcatcagggtctcagtaaaaaaaagagggcacattccaattgggtaataggaagaggatgttaatgaagcgtttctttacagtgctgtaggcagcatattggggttctgcgaagagcaggcagcaccctgggtgcctcagggctggtacggcaaagcctcagcaccctccctacctccttcccccctcgcgatcaggcccctgataaaagcagtgaactctgctccaggtctggccagcataaaggcccccaagagaggagccaacaacaccccatcctccctctcaccctccctcaggctcctgctggggctcccactggccaaacccaaagagaagccggaaggcaaagagctccgtggtacccatcagggctcccaagcaggggccacagaggagaagccaggaggtgacctggagcaggacacagcagctccctgacagggatcctcacccagggcacgcctctagagcagatggagaaaacaactcagtagacttcagactcccaaattctcccagttcctcaacccgcctgccctctggacttcgggagaaagttgagagggaaagccctcaactttgttttgaaaatgagagcaatgtttacagccactagcaagcaattaggatccagctgggctgatgtggccagatctggggacacccagccaggtagatgcacaacagacccataatggaggccagcgaggaaacgctggacacgtcccccatgactgagctgtgaggacctgacttatctgtgcggcggtcactgtcgtgtagaaatggaagctgtacatgcaggctgaggcttctcagctggacagttcagcccgagtgagccccaagaggacaggggaggctggtcttcattcttcccctctgaatcaccagcaaatgatagaccgtcaataatttgttaaatgctttttaaaatgaatgctttaagccgggtgcagtggctcacatctgtaatcccagcactttgggaggccgaggcgggtggattgtttgaggtcaggagttcgagaccaacctggccaacatggcaaaacctcatctctaccaaaaatacaaaaattagccaggcatggtggcaggcacctgtgatcccagctactcaggaggctgagacaggagaatcgcttgaacccgggaggcagaggttgcagtgagccaagattacgccattgtactccagcctgggtgacagagagagactccgtctcaaaaaaaaaaaaaaaaaaaaaaaaaaattacgcttcaaacacatgatctctcaccactgttgaattttctttctatgagcccaggagggcctctcagagaggaaagctcctaggtcttcctttccctctgcaaactccctgccttgaaggatcagaaggactgtgctgctcgttgcatcctttgcaagttccaaaccctgatcccagctgtgcttaggggttcctgcaaaccttttccaggtgttaattacctcccacttcatttcctgtttaccaactcagctttttgttttagtgtgtttgaattccctgaactgaccgttgtctgatctccacctcccaactgaattaggggagctgggcttctggaaacccaggtgccgggtgttgcagagtggctgaaagctgggatgtggcagatccgtggctacattcatgcacacacacacacccacatacccacacatgcacacacacacacacacctgcactcacacacttgcacatgcatagaccacagctttccacacccttcctagacaggggtcacttggtgtcctggagagagtgtgaagtctggaagggaaagaggggggattaagccccacctctagccatgggactgagacaagtcacccccacccatctgcgccttgtttcctcctctgtgaggcaagcacagagcccatgcctccctccctggatgggagtgatgtgaaacttgaagaggggtagagacaagggtcgtcaatggaagccccttgggcaaaaaggccctttcaactaggggcacagaggaggccctgggctgagaacttgacagcaccttgtattggtaaccagccggagggactggaaatactcagatgtgtctgtctcccttattaggttcaaagtccctcgagaccctgtctccatcacagtgctccagtccagacccctcctctgagctccagaccctgctggacccaacagccatccccatccccacctgcctggaattctccaaagaacctcccctttaacagttccagcctttaacagttccagtctaaacacatgacctttctcctctaaatcagccccccatctctgcctttgcaggagatggaagccatgacacctgcctcgcccctgtcctcaccccatccatgtccaatcaagcactaggcatgtcaggtttaccctctaaactcctctggaatccagtctctcagtctccatcatcccaggtcgaagctaatgggctaactggtccttgcttccactctacccccactgcagtcctgacttcctgagcagcagccagggcctaatccatattcacaccaagcgccttcctgactgagatatcctcctgcaccatcatccctccaccctgtttagttctgctcaccctcagtgttctcatcaataatccactcgccctcacaggcgcgtttgggaccccatgttctatgctctcacaggaccttttgcttgatttttcactgtactcaggtcagtttgcagttattaagtgactgagcaatgtctggcttctccagtagactgtcagctcctagccattgtatccctagcaccgctgtgtgggagcacttcacaaacgtccattgagtcagggactcagcagtctccatttctcctccctgctggagaatgcgtgtattttgcaatccccagcccctgtgccatctaaccatcttttcttctctgttcagcccaggtgtggcctcactcacatcccactctgagtccaaatgttctctccctggaagatatcaatgtttctgtctgttcgtgaggactccgtgcccaccacggcctctttcaggtgagtcaaagggattcctcagttcactagttaggggaggtgggcagacaccctggagaactccctggaaagctcaactctcatgccccggacaacagttgaaggaaccagtgatgttaagcccaaagacaaaacctctcaggtgtccaagtccctgtaggcctgttgggagcagagggaatgttctgcggaactagaggaagaggggctcagggagaagaagggcacattcctggttgtcatatgtgatctatcccagatgaacttggaagtgaagggaagagagttaaacattaaagtaaatacccagtggatcagacagcaatgtgccagattgccttggagacaaaatatctccaacacatggctgacatttggtgggagatcagaacaccctaaagagagaatttaaggggagggggaggaggacctgagccagagtagaagcagaggatagggagatctgttcttggggacagcatttgcaagaaacaaggctgaggggtccactccaacctctccaccctgctgcaggtgctgcctatgatgaagatgagcagatggccatctcagctggggccacagtgcactggacctatagtttccaattccgcactcagcaggcatctttctgatgatccgatggcttctcagagccagggatgggccaggatccatccccttggctactgtcttgctgagaaattaataagcagcatctggtgctatactttggtctctagtgagttagctcatgaaagatgacagactctccaagccaggggtatgcaggaaatgggttttctgtagctacagaaatggggttgagggttggaccaaggggactacccaggggaagtcttaccttcagaggactctggaaaggaggctgcaagttttcatgggtcaagaattcagagcccagtagagacagcttatctctgttccaagatgtctggggccttggttggaagattcaaaggctaggaaaccaggagccaccaaaagcgtaactggggccagaggatccactttcaaggtggcaagttggttccccccatgtggctgcttgagtatcctcacatggcggctcacatccttccaagtaagcaatgcaaaaggccaagaaagatgctgcaaagcatgttatgacctagcctcagaaatcacacaccatccctgccaccattagtaagaagtccagcccacgtccaggagaagaggaagcagattcctccttttgaaatgaagaatatcaagtaattcggggggcatatgaaagccaccacacaccacagggatctttttagagcatacttcttataccatcactgtagttccttaagactcaggggcaaagcctcacttccttagcacccagtgaagaccacgcttactccctcactcaacctcttgctacttcccacctctcctgtccaacatctagtgtcactttccagaacataccaacagcttccccagttctgtgcctctgctcaggctgttccccctgcctggtccacttgtcctccttcttgtcccgtcaaaatgcttcttatccttcaagacccagctctagagtcacctccaaccccttacccaccagccccctctccaagtctgtgtcccacaacccccctgctccctccagggcaccctccaccctctgggccacagttgtcaggagtcaggcagggcaggggccgggtggtgtcttctttgtgttcttgcactcagggcagagctcagcacagagcagacgctcaaaaaacatttaaaggatagaagcattgatttgtgggtcccccagtctggctccaggatgccagccagctgctcctagaagcaaacggacttttcctgggaaatcccagaggtgatgatcagtatctctcccgtgactcgtagttcagctcttcctccatgagcctgactatcagtggaccttccagaaagagccccttttccttctctcacccacagcacagggcactgggaaaatgcccaatgagtcctgccctctgggttgtgctttggacttttcagtgtgtcttcgcatccactcttcagcttgaatgttgcaacagccatgaaaaaagaaatgcaaagcgattcaggatgagagcaataccctactccaaagaaggcaaaatagaagctcagagaggtcaagcattttgcccaagaccacacagctaggagtggaactcatggctgtccaagccccacgcctctgctgaaggtagagatgaattacagcaacaagtctagaaaggtgcctgccctatggtctgtgagtcttgcctaagaatgaaagaggagccagtgggttaaagatgaggtcaccaacaaacggtggtgttggagtttaccactggttattttaatgggtttgcaagaattgttaattactaatgtttattgagcctagtgcagtgcttggggcattttgcacattgtctctgatccctatcacaaccctgagaggtagtttttttaactcccattttacaggtgaggtcattgtggttcaaggacgttaagtaacttccccagcgtcacacggcttataagtaaggcagccaggatgtgaacccagtaggactatctggctgcaaagtccccaccctccctcgccatctgtatcctccaatcatcttcagtgctttgctgatagaaggtacggaaatacgatgccacagactgtccaggaagacagaaactaggcagatgggctggccatggtctccaagccagactggaatctccaggtctggaatgatatcatttttctcttttaataaattaactcacccaccacacggctttgagaggctcaaaggtgaccaactcccttgggagggccccggttgataaggaaggaatgtgaatcctcccatcacggaagcttcaaggaggtcaagggtccaacacttgagattgttagtgctgttggtggatactggccaaggaaatatcccagtggagcctcgagatgaagaacatgaggcccccgtttagatccaaggatcagagggggctctgtaagacccaggggagtcaggtgcactggagcgcgggctgcagaaaacagcctgagctccacctcggcttctccttgccctggctggttgtccttaacccctgtctccttctggaccagtttttgtccttcccttgtgaccctgaggggtaacagcctcttttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacagagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccatctgtccctgcctcagttccctcttctgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaactggagaggctagaaccaagaagggctagaacctggaggggctagaacctagagaagctaaaacctgagctagaagctggaggactagaacctggagggctggaatctggagagctagaacctggagggctagaacctggagggctagaatctggagagctagaacctggagggctagaatctggagagctagaacctggagggctagaacctggagagctagaacctagaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtcaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcatagctctagcatttgttacaactcccgaaacccccgagtttggtccctggggtaccgccttgcacactcagaagcctttgggaaggggtgctattcatttctgctcaatctgttaacaggcttctggcatgtagatcagtggtctccaagcttttgtgattgtatattcctataggaaaaaaagaattgattatgcatacccagtatgtatacttattaatctgtatgaagatgtacattctaaaatataatcaaccagtagaaatttaagaaagaagatgt

SEQ ID NO: 36810 - DNA, 20845 bp, Homo sapiens
ggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgagtgctcctcgcggccttttgctcggagggagttgtcaaccgcgccagatccccttgatggctgtggcttcggaacctcgcggccagcactgccttttcgcctttttaaaatatgggaacaccctgatttaagcagcggttgtcttccagaaggtcctttgattttagggggaaatgcattagccaggtcaaacagccgatttgaaacacagaaggctaagttgacattttacgttattttctaaagtttaggccacttggttcttggttctaagcagagatccttggaacacacctaccaccaccatcagaaccatcactacccatgcatggggacccattcttgtgacaagtttgagcggctttagatcttatgaagcccactgtctcccttgggcagtgtgagcatgggaggagccagacacaggcaagagatgaaataaatttattcttttatacaaccagtaaactgtgctaggtgcccaaacgtgaggaactgcagctgaccttacaatgaacaaaatacaaaaactgtccttcatggagcttacattctagttgaggagtgagtgaagtcttgaggactcccagaaagagaaatgttttgagtgcaccttgcatctgtacttgggtgtctcaaggcaccttaaactcaacacgatcatttcctggaaacccagtcctcctccagcacttctagcatggtgccggcaaagcagacattcagagaatgatgaccagatgttccacaaggaagtaactagcacgactctccatccagtggcacaaagcgactcttcccctttccttgactctacatctaatttatttggaaagcatgtcaagcttaccttcttaatccttctctggagtctatcctattcacattgcttctaccagctgcctgatctgtgttaccatgagtcctctcttgaacaatggtctgctaaattggtttcccatttccagtcttgactccctacaagtgaggcttcacatcacattctgagtgatcttttcaaaactcaaatctggctgtgtcttacacagatatacgtgaacaccctttttttttttttttttttttgacggagtctcactctgtcacccaggctgaagtgcagtgatgccatcttggctcaccacagcctctacctcccaggttcaagagattctcttgcctcaacctcccgagtagcctcagcctcccaagtagctgggattacttgtgcccgccaccatgcctggctaatttttgtatttttagtagagacggggtttcgccatgttggccaggctggtctcaaactgctgacctcaggtgatccacccgccttggtctcccaaagtgctgagattacaggtatgagccatccgcacccagccatgaacacccctaatgaaagccctttaataatttcttatttcttctagtgtgaagaccagaatccttaacatggcctgaaaggcccagcctggtttggccctttctcactctctgggtcctggctgcactaacattctttgaattctctctgcttctttacaatacaggaactttatacattgttctttctttgtacattgagtatacttttcattcattcatttccactcatctggttaattcctacttgtccttcagctctcagctccttcaagtcttccctagggaaatgttccaatcatcccagttaagtcagattgctgtcatattataggctttcctatatttgttctcttctgcagttcttaatcacagttgtaattttacatttatctgtgtgattatttgttgaatgtcttttaagctctgtgagtgtaaggaagtatcaattttgctcactattgtacctgtagagcctaacatgcctggcatattgcatgtggtcagtaactattactgaataataagtagatcattgagttctggccaatgagatctcctcaggctttagatgagactcttggaattggatgaaggatagggaaagaataataggatctgttgttttagaaggatcatttatgagtttcagccgggtgtggtggctcatgcctgtaatcccagcactttgggaggccaaggtgggctgatcacttgaggccaggagtttgagaccaggctggccaatatggtgaaaccccgtctctactaaaaatataaaaattagccgggcgtggtagcacacgcctgtaattccagctacctaggagggtgaggcacaagaatcgcttgaacctgggaggtggaggttgcagtgagccgagatcacgccactgctctccagcctgggcaacagagcgagactctgtctcaaaaaaaaaaaaaaaaaaaaaaaaaggatcatttatgagtttgaaccatgttcttaggttgaaaaacatctatattgcttactagatctttccctgctttgctctcaagagtaattcttcccagcactttgggaggcaaaggcaggaggattgcttaagcccaggagttcaagaccaacctgggcaacataaggagacccaatctctacaaagaattttaaaattagccaggcatccaggcacagtggctgacgcctgtaatcccaacactttgggaggctgaggcgggtggatcgcgaggacaggaaatcaagaccagcctggctaacatggtgaaacgccatctctactaaaatccaaaaaaaaaaaaaaaaaaaaagccaggcatggtggcacacacctgtagtcccagctacacaggaggctaaggcaggaggatcacttgaacccaggaggtcaaggtggcagtaagcagtgatcacaccactgcactccaacctgggtaacagagcaagaccctatctcaaaaaagaaaaaaaaaaaaaaagtgggtattttcagcattttctggcaaaagtgggaaaatattgggtcctgaaatgtatatggaactattttttacaggtgatcataaggtccacagattattagatggcatgtcaaaaaatccttcagggaaaaacagagaaactgttccaattaaagataatttcgaattagaggtacttcaggcacaatacaaagaacttaaagaaaaggtaagtgacttaacttgtggtttttgtagctaattcattcacttacgtgtttaaaagcattgtacagtaaaatatacaaaagttgtaaaacaagtgtctagattcatccctatgacatgggaaaagactagggaaagaaaaccagaaagtttaggctgaaagaaactaaattgtgagattcctaatgccaaaggcaagaagaaaaacactgtataccagatccaaaaagagatacaaactgttagggtactaagatgaatttatagcatgtatcttcatgtgaataatacaacttcataatggttgctattttcattagcagctttgcaagaaagcagacacttcatatcaccatctgtaggtccctaagaaaaccaggaatatgtggaattttagttgtgcaaggtatgtgacccagattttttttttttttttttttggagatggagtctgtcatccaggctggagtacagtgacacaatcttggctcacttcaacctctgcctcctggttttaagcgattcacatgccttagcttccagagtagctgggactacaggtgtgcaccacgacgcccagctaattcttgtatttttagtagagacggagtttcaccatgttggccaggctggtctcaaactcctggcctcagcctcccaaagtgttgggattacaggcatgagctaccacacccagcgacccagatcgttaatgcctcttagagcctaaagaatccggccaggcgcggtggctcacacctgtaatcccagcactttggtaggccgaggccagtggatcacctgaggtcaggagttcaagaccagcctggccaacatggtgaaaacccgtctctactaaaaatacaaaaattagctaggcatggtggcgggcacctgtaatctcagctactcgggaggctgaggcaggagaattgctggaacctgggaggtgaaggttgcagtgaaccgagatcgtgccattgcactccagcctaggcgacaatagcaagactccgtctcaaaaaaaaaaaggaatctggtcaggcaaggtggctcatgcctgtaatcccagcactttgggaggccaaggtgagagaatcgcttgaacccaagagttcaagaccagcctgggcaatacaatgagaccctgtctctacagataaaagtgaaaattggccaggctagtggcacatgctttgtagtcctagctactcaagaggttgaggcgagaggatcacttgagcccaggagttcaaggttacattgagctatgattgtgccacagcattccagcctaagcaaccccatccccctccctggcaaaaagaatctgcatgcatgagtggcaagtgtatgcttaagctatcttgatgaatatcagctgtcccatgaacaggcctagcagaccatggtgacatctggttgctgtggatatattttgagtactcatttgtctgtttttcctgtgctttctccatctccccaactacatgttaaaacaaagtacctaagtagttttctcttacaaagttttcacgagattaatttgggatttacagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaaggtgacccagagcatttgttttgcaccagctttgcctgcccactgagttcctttgaccagggttgcctgtaaatcttccagggagatttcaacacttgtttgtcttaaatactttctgctatcatctcattgccatccactcttcttccagggtctggatatattttggaaagggatttagatgaaactctattttgctgtggtagttggtcttggcaggagtaaataactagcttagcatttctagaaacaggtttacattaaggctcttttgctagatcagaaactcaactgacctggcttaggctaaaaggaaacgtattggcttccatatccaagtctgggaagaaccggggtatgctgggaccttaaatgacttaaatcttgccaggacatttttattctctatgctataaacaggctctatacttatggtagagggtgtgttctccagaagctcctgggctcatattttataaatacagagcagaattaagacttagggccacatgcagtggctcacacctataatccagcactttgggaggctgaggtgagaggattacttgagccaggagttcgagaccagcctgggcaactagtgagacctcatctccacaaaaaagaaaaagaaaaaatgaacaaaattatccaggcatggtggtgtgcacctgtagtcccagctactcaggaggctgaggtgggagaattgcttgagcccaggaggttgaggctgcagtaagccatgatcatgccattgtactccagcctgggcaatagagcgagaccctgtctcaaaaaaagacttaggctccctcatctcaagttttaaaattctgagaaaggctctgattggtttaacttgagtcagttgtctgtccctggccaattgctataaccaaaagcaaccaaaagcaaaaaaatgacagctcccattctaataaaatagtcagaggtagggaaattattgaatttttttttttttttttttgagacagggtccagggtttcactctcttgcccaggctggagtgcagtggtgcaatcacagctcactgcagccttgacctcccaggctcaagcaatcctcccatctcagcctcccaggtagctggaactataggcacacaccaccaggcaaagctaatttttaaattttggtacagacagggttttgctgtattctccaagccgttctcaagctcctgggctcatgcagtcctcccaccttggccttccaaagtgctgagattacaggcgtgagccacaatgcccagcctgtttctcagggaaaggaaaatgctattctggaaggaaaaacagtaggtatccagtacctactacaactttccctcagcacctcctcatgcttcaatctcaaggacatgggatcttattctcattgtttcattcagcaaacttagcaaactttaagcacttacctgtgcccatcattaaccgcaatagttaactttctgtataagtgatgaagagcaaggaatttgcggtcagacaaacctgaatttgaatccaggcttcatcacacataagcagtgacctcaaggtaataacttaagctccctggctcatttcccttatctgttccaagacataaccagaaaggttgttgggagactcacacattcttgcacttactgtgtctggtgctgggcctggcgcagagtgtgcttggggaatgatggcagttactgttggctgtagcaactgcaggccagagcagcaggtctctctatactgcacagtgtcttggtaaactattccaactactctgcccaaactttgaggaagacctggaattgtgcaccagtgcgttcgttaataaaggtcaatatgttactgctgacatagggcaccttaccaagctctatgctgggtattttacactcatcattctacttaatcctcccaactatcatgaagacaggtgttttatgttacaaataagttaggattcaaagacattaaataaatggtgggctggtatttaattcttttttttattttttaaattttttgtagaggcaagatcttgctattttgcccaggctggtctcgaactcctgggctcaaatgatcctcccgcctcaacctcccaaagtgcttaggattacaggcctgaaccaccacacccggccagggctggtatttaaaccctcacaaactacccttacaatagagtccagtatctttttagagtaccatattgtctttcagaaagaaagctaatgtttaatattttaggacatttatgtcacagcagactttcatatgtatttttcattgtttgtcttttactggcttgtgattttgaagcccagagatatttttgtgtatatgatgggaccactacaagcatgtttcttttgccttccagctccaatcattgcagtctgaactccagtttaaagatgcagagatgaatgaattaaggacaaagctccagaccagtgaacgagcaaataaactggctgctccctctgtttcccatgtcaggtaatgatggtgctggagggatagttcagttttgcattatttagtaaaaaatctgcataacagtgtcaggctggtcctaaatgaaggccatttagacccctccacctgggcagagatcctcttttcctgaaggattcagaggtggtttagatgaagcttgcatggtttgagacatcacagcataaaggcctatactctagaaatgctgcctctgtatggcactttataaacataattcttcaggactagaaagacctggaaaaatgatctccaaattttgggggtgggctagtctctacttttatgtaatttgtttaactgattttgttgcaagcatgggtgtattttagttccagctacttggaatatttttttctcatttgctttctggggacccttgtccaacagccccatcctttgtggtcagatgtgctcaacttgttttttttttcttttttttttgagacagagtctcgctctgtcacccaggctggagtacagtggtacaatctcggctcactgcaacctccgcctcctgggttcaagcaattctcctccttcagcctcctgagtagctgggactacaggcacacaccaccacgcccagctaatttttgtatttttagtagagacggagtttcaccatgttggccaggctcgtctcaaactcctggactcaaatgatttgccagcctgggcctcccaaactactgggattacaagcatgagccactgtgcctggcgcagcctggaaatttgaacagtgtcagtcagggcatcttctggttttgaactttctaccgcctttgttcataatgggcagtgtgtgaaactgaactctccatgccttgcattgtccacataagacaagagaactgaggggatcctcttcacacatcagtaacagaaagacctcagcattatatgatcagatcagagggttaatactgcttctctaccataaagacattggcactaagttgctcagttttcaacatacctagtaggtttatcaaaattatgatatttattttgatagccctttttctatttaaagtctttgcattctattggaagtcttttttttttgagacagagtctcactctgttgtccaggctggagtgtagtcacatgatctcagctcactgcaacctccacctcccgggttcaagtgattctcctgtctcagcctcccaagtagctgggattacaggcacataccaccacaccaggctagtttttttgtattttttttttaagtagagatgggatttcaccatgttggccaagctgctctcgaactcctgacttcaggtgatccacccgcctcagcctcccaaattgttgggattacaagggtgagccactgtgcccagcctggaagtcttgtgactattaaaaaatcgtttgttccacattggctgggtgcagtggctcacacctgtaatcccaacactttgggaggatgaggcgggcagatcacttgaggtcagtagttcaagaccaacctggccaacatgatgaaaccctgtctctactgaaaatataaaaattagctgggcatggtggcatgcgcctgtaatcccagctatttgggaggctgaggcaggagaatcactcaaacctggaggcagaggttgcagtgagccaggatcacaccactgcactccagcctgggcaacagaacaagactccattccagaaaaaaaaatagtttgttccacattgaaaagatgttttgcaccaggcatggtagctacagaggcaatcccagctacacaggaggctaaggcaggaagattgcttaaggctagcagttcgagaccagcctgggcaacatagcaaaaccccattgctacttaaaaaaaaaataaaattactggccccagtggctcacgcctgtaatcccagcattttgggaagctgaggtgggcagatcatttgagcccacgagttcaggactagcctaggcaacatggtgaaactctatctctagaaataactctatctctagaaagaataaaaagttagccagatgtggtggttgcacatctgtagtccctgtgctactcagaaggatgaggtgggaagatcactaagcccaagaggtggaggctgcagtgagccgtaattgtgccactgggctccagcatgggcaacagagtgagaccctgtctcaccaaaaaaaaaaaaaaaaaattagctggccatgttgatgtgtgcctgtaatcccagctactcaggaggctgggattacagatgggtggattgcttgagcccaggaggtcaaggctgcagtgagctatgatcatgctactgtactccagcctgggcaatggaacaagactctgtctcaaaaaaaaatgttttggtggaattgtaaatagtgataataaagaatagtaaaggaattatggctaatattatatttttggatgattagaaaaatataaaaatgagtaaaagaattttcaacaatttggatcaaaatccctggaattagccagtaacagtggatcatgcctgtaatcccagcattttgggaggccagagtgggtggatcacttgagctcagcagttccagaccagcctgggtaacttagtgaatccccatctctatagagaaattaaaatttaaaaatatttttaaaaagaaaaacaaatgcctggaattttgcactgctcctctgacaaagaatggtagacatataatagataaaacctttggttaaaacacctagacatgaaaagtttaaagtttgttagaaattttgtaaccagatattttgaatggttttagtagaatcattactttgctttcatagttaactttttccagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagagggtaagtccattagtcatctattgatgtataacaagctacccaaatatgtggcttaaaacaattattatttattttctcccaatttctgtgatcagcaattctgacaaggcacagaggggacaatctctgcagggactggaatcactgaaagcttgtcttaagctggaggatctatttcaaggtggctcactcacatggctggcagtgtaatttcttgccacatgggcctctgcacatggatatggggtatcctcttaacctggtgggtggcttcctctaaagctagcaaatccagagagagcgagccaggcagaagctatccatttatggcctagcctcagaagtcacacagcatcccctctgccacattgtatttgttagaagcaaatcactgagtctgggcgtcattcaaggggagaaaccaagcttataccttttttttaatttttattttttatttttattttattattatactttaaattttagggtacatgtgcacaacgtgcaggtgtgttacgtatgtatacatgtgccatgttggtgtgttgcacccattaactcgtcatttagcattaggtatatctcctaatgctatccctcccccctcctcccaagcttataccttttgaaggggagttgtgtcaaagcatttgtgggcctttttttttttttttttgaggcggagtctcaccctgtcacccaggctggagtgcaatggcacgatctcagctcactgcaacttccgcctcccgggttcaagtgattctcctgcctcagactcccgaatagctgggattacaggcacctgccatcatgcttgtgggcatatttttaaaccatcacagcatcaattgaccatgccaaaaacctagctagtatgcaggaatctgtttttcttttcttgtttttttttttttctttgaggcggagtctcactctgtcaccaggctggagtgcagtggcgtgatctcggctcactgtaacctctgcctcccatgttcaagcgattctcctgcctcagcctcccgagtagctgggactacaggcatgcgccaccacacccagctaatttttgtatttttagtagagacaggtttcaccatgttggcctggatggtctcaatctcatgacctcgtgatccacccacttcagcctcccaaaatgctgggattacaggcatgagccaccgtgcccagcctctgttttccttttgtagtccagcttttgagtttttataactcagtccagattgaggggatctgctgttttttagagagagacaatctaacatcagtaggttttcagactgctatgtcagtgtatcttataaatcggatacattgaccctcttcttaccatcaacctttcaaatccttggccatcataacacttctgagaaactgtagcccacttacatttttggcatctagcagctaaaggggcagtgtacagtagtgttacaagcgggcagtagagcccagtagcctggatgtgagtcccagtaatgctgttaactggcttatatgatttgggcaagtcctttagtctctgtgcctcagtttccctatatgtaaaacagacctaatgataaatccttgtagggtcactgaggaacaaatgggctgatgcgtatagagctcttaaaacactgtctagcacgtaacaagcaccatgtcaatgttagtggtcactgttttatctaattgcctcattttgagtgaggcaaacagcttgattttcttttcctttccttgtatgagttcctgttttacataaggaaggtaaaagatgcagggctcttgagccgctttggctcttgtttgttccaagttcgaagaagtagaacagcgtgtgttttaaactcattgcatgtaaaagtttctaatatgcccatgcttctgggctcaagttttgatttacattttatcacatttcagatagtaagccccacagtctgagaggtgactccataaaacaagaagaggcccagaaaagctttgttgacagctggagacagagatcaaacactcaaggtaccagaatccctgcttctcctgcaggggcctgcatggctctgagtaatatgcagaagaattgcccaggcctctgagaaccggtgccccgggcagtccttcagagagtccagggaagtcaaagtatgtggcttaagcagaagactttataaagtggaaagggccaagggcaggtatgtcccagagccttccgcacccacaggcatcttcctggggcttagtggcagcctagaggacagttggcatccaaagaatccttactgtttccttctgaaagccaccgaaaagatctcccatgtcagaaccttctagagtcatcttgtcttctgcaggttccattttgataaacctgctcctgaagcagcctttgatcccagggtcatccctaagcctttgccacctcctgagtagtagttctgagtctcctgctggcacccccctgcagccaccagggtttggcaggtaagcataagactcctggaaagcttgtttgggaaggagcttcctggaagcaaattcctttctggccctggccagcctgagaagtctgtgggaagggcaggcagcctggagaatttggcaggcaggctgtttggggctcttgaccttatctccatcccacacttaatctatttttctttgtgtttgttgccagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggtattaagctgcataggagtcatgattctttgtgggtctcacctgacctcttaaggtctaacccatggcacttgtactttgctcacatcttgacttatctacactagttagttctaaggcttggttcagggagttctgaagtgatgggaagtggggccaaatgggagaaccaaggaagtggtttatttgatttaattctgcctctgaacaacaggtaagcaaaaggcacacatgattaaaggaggctgctaacctctgtggaggagggccctgccccaggacaagggttaagacaaggggcctctgaacctgagatgtgggtaaggtgaagaccacacatcacaagcacgttgaagtttagtggtttccctaaggaagcagaggatgtggagagggtctgcagcccacgggctgaccttgctgggagtctctgcctgtcattgtgcccatctttagcatgcatctggggtggcctgttcttcttaaggtttgtgggtagtatattatagtgaacctagcgaatgaacactgtgatcataaattcctcccttgggattccagagccgcaagattggggagaactgtgaacacaaccagcccaccccctcatccagtaatccagtctccctcagcactctaccaaagggtcagtttctatgttggaatgattccactggctgaatatatcttaaatcatctcatctctgagctcagcactgctgtttcctagatctgtttccatctgaatatttttggttggtctggcccatgctaaaggtggtactcagctggacacagcactgcagtgtagtgtgggcagtgggatcaggcagactcaggactcaagtgcccagcaggggcccagctcatagtggctgtttttttttgttgttgtttatttgtttgtttttgtttttgttttgagacgaagttttgctcttgttgtccaagctggagtgcagtggtgcgatctcggctcactgcaacctccacttcccaggttcaagcagttctcctgcctcagcctcctgagacgctgagattacaggcacctgccaccacacctggctaattttttatatttttagtagagacagggtttcaccatgttggccaggcttgtctcaaatgccggacctcaggtgatccacctgccttggcctgccaaagtgcaaggattacaggcgtgagccaccgggcccagccttggttatttgtttaataattgttaaatgaatgaatcccaggctgggcacagtggctcctgcctgtaatctcagcactttgggaggccaaggtgggaggatcacttgagcccaggagtttgagaccagcgtgggcaacaaagcaagactcccagctctacaatttttttttttttaattagccaggcatggtggcagtgagctatgaccatgccactgcactccagcctaggtgacagagtgagaccctatctcaaagaatcccagaaaccatgtttttactggtggtagacacaccattattccactcctgttgagcttgtccacagggacattcaaaacacagccacagctgggcatttatctatttcatgtactggggctcttcataaaatttcatttaaagaggttcttaggggctgggcatggtggctcacgcctgtaatcccagcactttaggaagccgaggtgggtggatcacgaggtcaggagatcgagaccatcctggctaacatggtgaaaccccgtctctactaaaaatacaaaaaagtagctgggcgtggtggcaggcacctgtagtcccagctactcgggaggctgaggcaggagaatcgcttgaaccctggaggcggaggttgcagtgagctgagtttgcgccactgcactccagcctgggtgacagagcgagactcagtttcaaaaaaaaaaagttcttaacgctatcaaaaaataacttggaaaccactgtggtgtacataaaagtggattttccttgcagtaccttctgcaagtggcagatattggacatcttacagcccaataatgaaaccaggtaataaccatgttaaaattccagcttcccacaaagggctgcacaccctggcaactaaaaagcattgaactttttgtctgctgtgcaggatttgccctaaagtgagttcaccccacatagtgagaccttgcttcctaaggacacactgagggatatcttgaccttctgtgcttagaaactgcagatgtctgaaggggtacacacctggccagaccccatagagtgtttcagaattgccctcctccccacccaccaggccagtccatcgtgctcccccaggctatgtgggttgagcaaacagcagcagttgccttggggcttggtttattggggtaatagctttccttttgcccctgagacctggggcagtatgcccagaacccctccctcctgcacaccccacagtaggcacattctcccactggcagcagatgtgttttctggcaagtagagaaaatggctttccttgccctgtgagaggtctcataagatccagccatagccaaggccatgtttgtcacctctggaggcctggtcagtccttctgtgggcacagaacatttctctcccacctaagttaggacctgcatccctgtttgggagcatgtggaagccaggcatcccagatccaggaggtcatcccacttcctgggcgatgctacaccagataagggcctgtcctctcagctgcagcagtcttgcagtggaagtgcccacttgttcacatgaaacaagtttcatagcaagtaagtaggggtcaggccagcactgaaacccaagtctggctgaaccaactcacctgttcatactgacttgctcaattttctgttacctctagtggagtgtgaaggtaggttatggagctggggttggggagtgtcacgtctctctgggtccctgtcttttaggttccagtgtgtgttccaagtgctgccaaagtgcctcagcccagagacacccctgcctagcgtgctgctggctgttgagctcctctccctgctggcggaccacgaccagctggcacctcagctctgttcccactcaggtaaagcagggtggggcgggcatctagactgctcctgcagatcaagggaagggttggggtgggaacagggtcaagggcctcagagggcttctgcagtatgtagcccacgctctttatgagaaagggcaccctgagtgagaggtgcgctgtccttttcagaaggctgcctcctgctgctgctgtacatgtacatcacatcacggcctgacagagtggccttggagacacaatggctccagctggaacaagaggtaaaaactccagagccccttctggacactgtccccaccccatcctaagaaccaacagaatctcctttctttccgctgaggagaaacggagctttaattcattttagtaacaagagttgataaagcaactaaagaggtaaactcagtttgggggctgtgcaccacacagatgcaatgcagacaggacttggcagagttgcctgatgactgatcctgtcttggctttgggacgtgggggcagaatagggggctggaggcaggtgggttgctggtgacacatgagtgcttgtcctgggtcttccctgggaaggtcccacaccacttcttggaccccatttgtgcagacaaacagttgctgaagcaagtgaactcttatagaagcttaagaaaaccctcgcagggactggtctccttctgcccaggatggaaccactctgttcttgttctaggtggtgtggctcctggctaagcttggtgtgcagagccccttgcccccagtcactggctccaactgccagtgtaatgtggaggtgagtgggtaggggccaacagctggcagctctggtggtaagggggccccgtgcaaggactgtaggccccactgcaaaccccctcacgtgaggtggctaggctgagcggattgttagggtgcaggccatggtggcaccaggcctcagtctgcaccccccctctctcaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaaggtaagcctgccagaggccatcctgcccagcccccatggcttcttccagaggttccccaacaagtcagattcctgggtgtcccctcagcaggcccccgcccactgcagcctgttccagcactggggccattttcttttatcttcctgcctcagttcttctccaagcatattgggatgccttttgcatctatctgttgagtgtgcctggcagagccacggtttttccagaaatagccgtgtctgaattgcctttgtatcactttgtttgcagtagctgagggagcagggcctgggtgtggaagggactggttagttcctgcggacgttgggggaggagaggtgggacctgccctaggccctggcacctttgggccctcaccaggaacctctcctttttgtctcagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttcccgccactgctgccagcgagagccgcgggagagtgtgcagccgagtcactactgcctgcctgcctgcctgctacggtgagtgtggcccccacaatgggatggcgcagggcaggagggccatgggttcccccaccccagactaagggggcactaggggaggggccgagtcatgtgaagagggagaccctctcagacagtcgaatgtgctggtcccactaaggaaaccacctcaccctctccaacttcctgcctgaaaatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccat

SEQ ID NO: 36811 - DNA, 129520 bp, Homo sapiens
gcagtaggtttctgtgcagcattgcagaatccacacctagagaacagaagacacagacacgtacgtctactacccttgttagaaggaagctttggatcttcggtgggtaaggagatctatctagctattttgtccagaaactgtgagaaaaggaatgatcatggaaaagactgttcatcagacatgcttaaaatggattatgttaatttgtcttcctttggtggtggtgggggtgtccagatttgcgactagcaaaatatagtgaggactatattctgataggtgcccttaggatactttttttgctattcataaaaaggctaaccttgatgcatgcaaagcttttcatttttttgctttttaaatgcaagaaaatatccagccactcccaatatctctctcaaatactgcagatatttttaaataccaaataaaatgtcaggctgagcattttctaaacaattttcttcctcaaactaggcagccttccccacgattcgttaagagtatttaaaaataataaggcatggttggattttttgagcaaatgggagatggtggtagactaaaatttctacagccttagtccagtggagagagaaaacgataaatgcatcacagtttgtgtcaagacaagattcattttccacacttcatatgtgggaagaggaaactacattttaattagcacatttttagggaggaggggggggatgaagatgaggcggatggcgtgaggtatttgagggggacgagtctgcagatgaggaaaggaaatgaagtggattgtcgccagtgccttggaaacgaagggggataagggtggggaacgaagtttgttgtgtgtgttagggtggggttggcccaagggaccatgaatcattagaatggcgctcggaggggtgtgcttgcaagtgtactggtgcaggagggacgtggaagtcgtgggtggcagagaaaagtgtgcaccgctgggaggtctatttcaagaataggttgggatgagaaacatgtctgggcgaggggggtgggaggcccggtgtcacctgtggatggatccacagccctgcaattgcgtgttgcaaagtttgcccggccccgcattcattttgaaggttcttggcgatgcctcgacttttcgcctcaaagaagtgagctctcataaggttcagaggccgggagccaaagcgggagtgaagactctcgaggggtccaaatgaagcagaagcgagagcccctgtcctccccctatgtggaggtgaagcaggggttgtggggactaggcgcccgcgaaggcagctgtgctgagagcaaagtccaggccccacggggggcgtgcggaggttgaacctttgcagtggcctcctacagccccagcagccagcgtgggcggccgaggctgactcaaagcggcggctcagcctcgggagtaggagtagggggctcgctcatttagggcgggagacatttccgaggcgcccctcctccccttcgcggtcgggtttctatcggggtcgtttccccctctggccctccggggacgccgcggattcgagctgcacagtcagaagaggacgttgaaaaggcgccaggcagccgccccgaaccaggccctcccggctgccgggcctgcaggcccccaccgctgcggcttcacggacttagagcttgagggcgcggagggggctgcgggggcgggaccaggactcccgaggggcgctcggggcggggccagagagagctcggggctgccagaggcgaggtcttgaggaggcggggccgggaggcttcggagcccaagaggcggggccagaggcgtagggggctgcgaggggcggaccttgggggcgtgaccggggggggcgcttggggacctaggggcggggcgttagggggcgggaccaagggacgctcgaggggcgctcggctagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgaggtaatcttgcggggagaggacgcgccgtcgtcccgcctctcttccgggccgggacgcgggcacccgcgcgggggctagcactggggacgctactgggggtcgcgcgggggtagggagcggcggctggcggggccaaggggacttctcattggctgtccctgcggcctcaggtgaacccttttccggggcgggagtggggaccacggccaggccagaggggagcgtacctgcgggggagggtccgggggtggcggtgcacggcctgcggcgccgccgggtgggcccgacgcttcgcgcgtctgctggttttccctaggaaggcggggagtaccaaaatcagttactggctgaagcttaggtgaccccggggaccttaagccctgaaggtgcgctccaggggagtgagaggttcctgcgcttagaaaaggtggaggaaagggagcgaatgttggttttagttgtttttctcctcatttaaaaaaaattttttttgttacaagttgaaagtgttcagtcacctttctcctataatccgcttccccaccccccaacacagacacacacaaacacaccgcccctacaaacgtatacatgttaggttgagcttcctgctaggggtgacaagcgaagttggcagcaggtctggtgtgctggtgtttggggcacgtccagcctctttggaggtaggctattatagcttaggcaagaccacagacaggtagcataatctgggcctcttttaaaatggcaagaacggcttcaggtgaacttttttgttgcagagatttaattgcaagtaggtgccggttgaaaatgggagcgcaaggaaaaccactaatttccttggcacatgtgctgttgcaattaacctggtagagtgttaaggaatttaacttagccaagaggctttgagggaggattatatgcaagtttggggaaggaattgataagattctggggtatgggactagctacatacacgtgcgtgcaagtttacgttaaattatgtagcattttagatttagcagtattaaatggttgcttttcttggaatggcttctgactacatagtgcagggtacgttcctaattttggctttagaagactcctagtgagagtgtttttaaagattgaaaaaataagagtacagtgcaatttgtcgttttcaagttaaatacttgactgttaaaaatatttgtgtaattaagttatgggaccaacccatttatagggttaagttacttaaccctataaataactggaacattataaatggagcatttgtagaaagtttttatatcgaagtctccattatattgtacttgcattataacttattttcctttgcttaaatggagcagattaactttatggaaggaggaccaggataaaataaaggcagctacatttaactcttcatctttctgaagagttcagtctgtgataacacttaaggtgcccagaagtgctggcatgttggtaatagtttttaaagaagaaacgggtgtatctattttgaatgttaaacataatttgaaggagttcttgagatagttggttatgagacattcaatgtattgctacattttacatatatgatatcaggaaatgtttggtgaacatttgacatagttgatcatatgacacttgggaaatattttgcatgatagaaggatagtattttcgtaatgtaagtttcaagcattgactgaaagggagaaaattacacactttgctgtctcacccctttcttcaatattatgctggcatgaatgtgaattctgcctaattatgtttaaagtgtagatctggcctttgtaaaaccagaatgtcttttgagaccaagagaacataacatcagcaacagcccaactcctacacacaatcctaaaacctagatacagggtggtgcccaacttctgaggttttgaggcttcctgaagtaggcctatcatgtctgagtgcttttgtcacatgtaagcctacaggtggttagctggttaatctctcccatttcaaagcagttggttagcagtactgggtggcatgtatgcatgtcatcagagtataagaagtgtttgagggaagaaatcacataaaagcatagaaacctggctctgaacaaactgtgtagcgtgttggggaacagtcacatcagaactttagcttaaccgagttgttatatgtaaagtgcttagaatggggtttgtattcagtgctttttgtgtttatcattatcagtatgtaaagtgacatatctttttgaaggctgttaggtcatgctacccagcatgtgaagactcagcaaatatttgtaatagccaatatttatttgcctaacctctgtgccaggcactaagagttttatatgatttaatttacttagtccttccaacaacccagtggctaaacagaggcatggagaggttaagtatcttcccaaggtgacacaggttggttctgaagccagagtctggcccaagagtgagcccatgtaaccactgccccttgttgctattgagctcatggtaattactgcaaaccagtgagaggtcttcatagtattcccacgactatcaggtgcacatgtcttgtttaaccacatcctctggtattaataccaccaagttatgcttaaatctaaggagtggtggttaatccgcattaaatacagtcaccttttgacattgaaagggtattctcttttgatacacaacatatgtttagggtgctagagtttgtgctagagtgtgctatctttctaattactaaagatactaaagtctttttttttttttttgaagcttaccagatatgtagggccccaggtggcccagagggcactaattcccattggagattccagttctgcagtaaatcagtaaaccttatcacctttctgattaccaacatcatatcaacctgagataaattttaacttaagtttgttctaaataccacctgagttgcttcctaaaatgaaccctaaatgcaaagatgtaacttgtggcttatactttgtcattcacattcctcaaggaactgtgtgttgctgcttcaccattgtagttgatatgtcaaacaaattataaactaaattaggagctgttttaagtaatgtttagaattattgtagatagatgaaatgtcatttgacaacttagtgcaatgtaatgttaggaaaaaatgtttaaaaacaagcatgcgttgaattgagaaagtgcaagctttattgaagacacaggttactaatctgtttctcacactaaacactgtttttgttataattagtgcttttcagattcctttgaaaatattaaatatgtagagtttgaatttttaaaaaaactttaaatatctaatcgagtgctattcttccttttaaacgtagacctatttgaagttatttaaacccaatttaaaattaattggacagtcctagactgtcatgtcattgagattcaaaataagtgccttaatactttatgtcttctttgttaatactctatggtttgaactccgggtccatgccagagtgtttataggtgagattgttatgaggtctttcaggttctgccagagattcagttctcttggccaaatgccaagacagtctcaaatttttactgtaattttttactgtaatgggttgtatatatcaagaatcctctaaaacatacaggttagaagtctttcattggctgttgcttgaacgaaaaagtgtgttatcccttagatgaatatgattattttttattcttgcagtagctaattatggatgtgtgtgtctatgtatacgtatgtcaaaccatgctacttgagggattctcttccttttaggtaaagttaaaaattattcacctggtgtattaatgtaatatttattgagtaccaacagtatgcatagagtaatacctttatgtgggaaaaaagtgttggagaaaaaaggtttgtggatcttttatttatttcatgtgtattttaatgttgctgaatatctggaccagtctcaaagttcaaaattgaattgccagttgaaaacatgttaaatgttaagaaagtactgtttaacttaaagtcttagatggtagcacagataatgagaatcagagccccttgtttccttaaactgtttttggttgagtatgtttgaaaagctgcgttaacaattcctttcaggcttctaggacattacttaactgcattgaaggaatacatttagagtatcctagaaaccttaaagaatgaatgtggctttcagagttgtctagcataatccaaatagtagtagcatgatcaccaaaaggtataaaatggatgaaacctctctttgattttaaaaggcttactgttcttgtaagtttgtttcttgaagataatattgcttagttttaactccactaaaagctgaaccgttattgtacaagatgtataggccttggcatatgtttatatcttttttttttttcttcttttgtatttttgagacagctctcactatgttgcccaggctggtctcgaactcctgggctcaagccatcctcccacctcagcctcccaggtagctgggactacaggcatgagccacaggcctggtttatatctttaaggtaaggttagatctaaattgagcctttacttgaagtcagactgatctgcatcagcaccatatgttatgtttacttttttttttctttcaatgaaaatgggcctgaggagattggtttgtatacggtacataaactggcatttaagatgactacctcttcaaacaaggctacggtttttttggatttttaggtttttgttttgttttgttttgagatggagtctctctctgtcatccaggcaggagggcagtggtgtgacctcggcacactgcaacctctgccttctgggttcaagcgattcttctgcctcagcctcctgaatagctgggattacaggcgcctgccaccactaccggctcatttttgtatttttagtagagatggggttttgccatgttggccaggctggtcttgaactcctgacctcaagtgttcctccccgctcggctacccaaagtgctggggttacaggcgtgagccactgcactcggccaaggctaaggttttaatctagggttatgaaactcaattttttctgcagtgggcatatgcaatttccataggataaacatttccctcaaccagctaggaggtaaaaacacttctgagaaatttaaggacagtaacataatgtctttaaaaccagtgtctcaagaagtatactatattagtgaaacaataaaataacagtgatcacagatacgttaaggcaagcagtggattaagcaggataacctaactccaagtaatatacacgaaattatttttttaagcttccatacctctttaaatttattcttgtgatttcttactttcccctccctcaccaaaggaagtgctcaccttttcagatggaatgaaagaggagagtgctgatgtgagtgactcagcctgtttaactctgcctctgtggtggtttgttggttacctactagaggaggtggaactcaaacaatgtaaaagcaatcaggttggagaagtgctgagtttttagtgtcatgggaactcggtgtatgtctttgtcaccattagcagtgtttctgtgcagttcttccacaatggctcagctcatcctgagcaaggacagcatttctgttttccttttccattcaatattctcatcctatcatcttttgatttgctagaatgactaaatgctagagcagaaagttgggtttactcatcctcctgaagaagatagttaggcttacttggtatatctaaggaagtaaatttggaagtcaaggcctccccagggacttctaagaacactccacttttacgccctaggaagttagagtgagcaactgttagctgcatcgtgacttctgttctcatttgtcttaatacatgacaaaaaaattctagaaggtcagccttttaatatctaaggaggtggttggaaaatggcaatggtcagagctcaaatggagttgtgattgggcataagtgccttggatgagtggaatgcttcattgcctgagctgcacaaatgggaggtagaaagggatttgcaatgaagttgatgcattgttcgtattccttatttccacagccaactttttaaaggtgaaaacagtgtacctcttaccttgcctttcttttacagtttttttatttttattttttttgagacagagttttttactcttgttgcccaggctggagtgcaatggcgcaattctcagctcaccgcaacatctacctcctgggctcaagggattctcctgcctcagccttcctgagtatctgggattacaggcatacgccaccacgcccggctaattttgtatttttagtagagatggggtttctccatgttggtcaggctggtctcgaactcccaacctcaggtgatccacccgcctcggcctcccaaagtgctgggattacaggtgtgagccaccgcgtccagccttcttttacagtttttattgtcagagttgagttcactttcctaagggaaggtagaattttttttttgagacggagtctcgcactgttgccaggctggagtgcagtggcgtgatctcggctcaatgcaacctccgactccctggttcaagtgattctgctgcctcagcttcccgagtagctgggtttacaggcatgggccaccacgcctggctaattttttgtatttttagtagagatggggtttcaccatgttggccaggatgggaaggtagaatttttaaggtgaattctatctgattgcttaacattttagctttaaattggagattgcactaaaaggaatttttttctttctccacaactgtctgcttgttaaatttcgaataaagattttcaaaatagaagtgtgacaaaccttactcaacatttaataattgggagctattatttattaaagtacacattatcaatgaattagaaattcattgctttaaaaatacttgttttttgaaaaactagagctgcactaattttcatattagaatgtttgattttttttttttttttgagatggagtctcgctctgtcgcccaggctggagtgcagtggcctgatctcggctcactgcaagctccgcctcctgggttcatgccattctcctgcctcagcctcccaagcagctggaactacaagcacccaccaccatgctcggctaattttttatattttagtggagacagggttttaccatgttagcccggatggtctcgatctcctgacctcgtgatccgtccgcctcggcctcccaaagttctgggattacaggtgtgagccactgcgcctggcagaatgtttgattttttttttaagtggacatcaaatttattttcagttaaaaatgctgaaagtaatacatttttacttcatctgtcatagtgaatgttgataatgataaaatcttatttctctaagcactttgccatagctaaataccttagtaaaacatgcgatagacaagggtccggtcactagccacagaaaggctgtcactgttatagcagaatgtaatagggaaggaacattttatgcctcaataagaacagtgtatttgcttgagatagtaataacctctgagaagctgattaattggtaatcacttaagttagatgattttatattgtttgatgtcttataatctaaacgtccctgtgctcttttagagtgtctgccttgaccagtcagcatttcaggagggattgtgactgtcagttaagtgctttgaagagagaacccctgctttgtgtcacacctgaatgtaacaggacatacttcttggggctgtttaatttgggctcaaagggaagagtgccatctactgaatggccagcatcaagttgagcagctcctgttttccttacagaactcagccagttcctggagaaaccaggcccagcttcatttggaggatttgacaggatcttagtaccaagtggaattgttgcctgcttaattttaattatgcttcccagcaggaggcctaaacacatgatgaagaactaattcagtacttgttggaatgcatgggaaaagagaaacctgaagaagttgttgagccttatgttaaaaacagccgagtagtggtgaaattaaattaagtggtaaagaaaattattttaatgagagcagtctttcaatagcaggtctggttggttattgatggctcctgcagacaataatgatgttaaaatctgcttgggcttagaatcagcaaacaaatcatttgcctaactggaggtaagggttttaagaatacttgaatacttcgattgtttttttctcctgccctttttgtctcattttgtaaggcaatgattcctacttgagtgaattcactgtttcaaagtagattttgttgttgttttggtgtatggtagtggtttcctggtttttgtttgttttttctttccctattttccaaaaacttactgtggtagcagccatgggtagaactggaggtagtagaactagttacaggtcagtggaggtttaaggtatctggaataggcttgtcaaagccagacaagaaggaactttgaaaatatgaattgaaaggaagctttgaaattgttgctataaaaatacacttgattgttacatatttatatatattatatgtaattacttaattagtaatcatttttgttagcctttaaaacctgccaaggatcattttaagcacttcacataaattatccaaagtttagtgaagtaacttgcccaagatcgtaccgttaacaaagggcagagccaagatttgaggtcagggctaatacccttaagcactatgctatatactgctgatttatttatgtttatttttgttggtgactgcacagaagagttgaaccaagattagaatgatatttctgccttggctggaaaatactgatgctggggttcttggtttctgttgttgtttttaaggaagtggtaacatgggtaaatacgattgagaattcactagaatcaggacgtatacatgagatgaacttccaaatgttttctatttgattttgtctatgttaacttttgttccttctgctatatttaaaaccacaagaaaagtttactgaaacatgaagtgaattgtttcaccctggggcgtgtgcttaaaatatacccttcatgggaagagttactgaagaggttttggctgggtttattttttgtaggggagtggggatttgttttttgtatgtataatatatacatatttagtttgcttccttctaaatatttttatgtggtagtacttttcaatatggcaataatcatgtccacagtacaataaaattaaaccatgtgccatcctgaggtcctaggggaaaccaagtttttgtgcataccaagtacgttctgtatactgaataagtaccataccttacgtgtatgtactaaaacttcattgaatccatgtattttttaaattaagagatatttaatacctgactactattatgagtaatggtcttgtttgttaacacattttgagcataaaaggtatcttgtttaaaaaggttggggatcattgttttggtataaccaaaagcttctaaaattgcagttaaatgatggttttgctgtgtattcttaacccagtcacccttagggcttctggtccttctcctttatctgtaaggaattatactttaatatgtgtcttccagaaaatccccataagctatgagatacatcactccttgagactcagactttcccagtcaaacataggaatggtcagcaataactaaaacaacaatgcaaaatatgttacttgccagtgtgtgtgatgaatgccagatgacagatacagaaaacaaatgccacaggtcaactggtcaagaaaagagatggagtgggctgggtgcagtggctcaacgcctgtaatcccagcactttgggaggctgaggtgggtggattgccagaggtcaggagttcgagaccagcatggtcaacatgatgaaaccccatctctactaaaaatataaaaattagccaggtatggtggcaggcgcctgtaatcccagctacttgggaggctgaggtaggggaatcgcttgaacctgggaggcggaggttgcagtgagctgagatcacgccattgcactctagcctgggtgacaagtgagactttgtctcaaaaaaaaaaaaaaaaaaaaaaaaagagttggagtggtcagaaaagccctcatgggaaagaagaacaagggtggaccttgaaggaggagttaagatttcattaagtggagaagatggaaaggattttggccagaaattactgtccgtgaaaatgattctttttctatagcatgatgggagatagtttataatagtggttcacaatatcttgccactataaggcatttaacagctacagcaaagacttatttgtagcagtgccaaggactggcctccctaggaaatacattagaatatggcaggagtgaagggaggggatggagtggcagtggtggtcacatgtagacttttaacagtgctccctcttaactccatatgaaaattcctgcttttataggaatatccttatacatctgttttgaaggcagtaatgcttaggaaagttagtattaatagaaagactttaggaatcctcatcattcccagcgctggacaaggaaagcctcattttggggaagagatgtacgattttaaaaatctgtatttgtccatcatttactttgtttgcctaatgctagagcatattctgtcaatgtctgttatataacttttaaatctaatatgtggatgatggatggatggagttgatacgagatatgaccatttcacttaaaatttttgtaaaataacattgtccgttttcagattttagatttgttccaaagtgtctcagttctctcactcagacttgtcatgtttatcccttactatttgaaaaattcttactgtaactctattcaagacattttgagcaagtaactttctgtttgctttttttttttttttgagacggagtcttgctctgttgcccaggctggagtgcagtggcgccatctcggctcactgcaacctccacctcctgggttcactccattctcctgcctcagcctcccgagtagctgggactacaggcacccgccaccacgcccggctaattttttgtatttttagtggagacgggttttcaccgtgttagctaggatggtctccatctcctgacctcatgatccgcccacctcggcctcccaaagtgctgggattacaggcgtgagccactgtgcctggctagttttcttttatataaaatatgtgagccattgggataaagcatttttttaagattcatctgtgcttgaaggtgctgtgattatgcttctgaagaagctgaattcaccagtttgtaggtttacttggagagtggccaagaaacctatgattgtactgtgtgaagattctgggaatggggctaatagaagatgaagaccatgaaggtccttggctctatgtatatgtggcacttaagagaaggacatcattaccccaggagcttgtcaactcccagagtttgttgtcagctcttcggaagctagagcctttggcaaaggacagattctttccaaaatacgtgaaatgagcaaggatagcaacttttcctaaagcaaactgtagaaacattgtggtatcttttcccataaatgctttccactctcatctgaactttattagatgtagtaatattagttcctcatacatatttgtgacctgtttagcccttatttttttgagcagctcggtgcatcctttattcatttattcattcaacaaatatttattgagcaattattatgtgtcaggttccattctaagtgctgagaatttggcagtaagcaaaacagacaagtcctcctgccctaatgcagtttatattcttggaagtcaatagaaataaagtatgtgttacgttagtgataaatgttatggagcaatatagagcagggaagggaaactaagggagtgtttgggcgtaattgcagacctaaatagagcagccaggaaaagtcctcacagagaaggtgaccttgaagatgatgagagagcatgcatgtggatgtctgcggggaagaacattgcaggcagaggaaacaagccaaaggccccgaggcccaagcataactggcatggatgaagcagaacgtggtggggataatgggaagccactggataacttcaaacagaggtgtggcaccgtctgacagatgtttaaagggtttattttggctgtgttttgagactagaccatagtgagcaagtgtagatgcagggaaactacttaggaggtcaatgcaatactcttggtgagagatgatgtatctggtagaggtagtgagaattgattggattctggatatattttaaagatagaatcaataggattttcttactgaaatatgggggtatatgttgagagagaggagtcaaacttgacaccaaggttttgggcctaggcaaaagtctaagaaggagcagtttggagaatgggagagaataagagttcagtttgagacattcatttgaaatgtctgttagacatctatttgcaagttgctatgaggagagatcagtgcataattataggccgactatataaacttgtgagttgtcattttcctcctccattttttaaatggttgcatatttaatccctttgatgactagaataagctttgctctaatatgggtttgaagtatttctatacatctttatgctttgaagggatttaatgtatcttataaaaccttgaatttattttaactgctaaggacacttggtcctgaaggaaaccattttctctagggattgaacaactttattttaatcaaaatgtgaaaataaaaatagtgttgttactgccctttaaaaatggaacagtctggctgttcctcagagttaacgtggttaaaaatggtaacggtttacgatccagcacttctcataggtatatacccaagagaattgaaaatgtgttcccacaaaaaaattgtacactagtgaccatagcaacattattcataatagcccaaaaatggaaacaacccatatgcctatcaactgataaatggataaacaaatgcggtatccatgcagtgggatattatgcagtcataaaaaggaatgaattactgatgcattttatattataaatgaaccttgaaaacatgctaagtaaaaaagccagatacacaaggccacatattatatggttccacttacatgaaatgtctagaatagacatttatagagacagaagggagattagtggttgtcaggagctgcagggagggggaaatggggagtggcagcttaatgggtactgggtttccttttgaaaaggaaagatgatgaaaaagttctggagctagatagtggtgatggttgtgcaacattgcgaatatactgaaaaccactgaaatgtacaattattagtaaattttatggtatatgaattatgtctcaagtttttaaaaataccaggaaaaaaaatctgtgcgtgcaaattcagatgtatggaagaataactaaaataacttatgtggaccttatttctaaaacagaactgttttcccagtagaaagttggatgaaacaagaattaccgcactcaacctggtttagcctgctttgcttaaagaggctaggttaagatgcttttcttgtccaggtagaaatcaggaggtggtttgtgatacttgataactcaggggtgagtctaattttttttttaacacttgattttgtcagggatgatctagagaagctgaagaagcctctatgatgatcctttccatgggtttcagagagttggaactgtcttatgaataagtttattaggtcttaagcaataaagatggtctacttttttctccatatctataattttaaaatatggaataaccaattcccaataattttttttagccaacccaaagttatatttaccttcataaaaaaaacagaaccatcaaagaggatgatactgggttggctaaaatatttctaaattacctttcatataccacttatcgtaaagttatttttttgaggtataattcacataccataaaattcacctcctaattttatttcaaatatatatatttatgtaattttctttattagaatgaaaacttctagaaaacagtggtccatattatttgaatggctgcatagtcatagcttgataagttttcagtattttaaaggaagcatatgtgaaccagacaaaaaccttagtggtgaagatagacatttatgtaagtaacagactccaacacaaacctgcgagctatactatagcaacaattcaaaggaagtacaggtgggcacagagaagggaaatatctcattggggagaaacaattcagggaggagagtggcatttgacttgagctttagagaatccagtagcatttcaagctgttggggaggagggtgaattataggccataatactagaatatgcaaagccacgtaagtctgtgggatggttatgatatgggagaggaagtaggaatagtgaggttgagaggaccagatcatgcaggccctgggtgctactttaagaaatttagattttattctgtggcacctctttcagttgagaagaggcataatcaaatgtctctgagatttggttgtgtgaagaaagtcacgatggagagagagtgtgttggcaaagaggttaggaggcatttagagataagcaaatgaactaagaccatggctttgagatttgaaagagaatggtatttggtgtgtgatggtatttggaggtgggcctttgggaagtgattataagggattagtgcccttataaaagagacctcagagagctccctcactccttcctccatgtgatgacaagcaagatgacaactatctgtgaacaaggaagctggcctttaccagacactgagtctgccagtgtcttgatcttagacttcccaggcttcagaactgagagaaataaatgtttgttgctatattataagctacccagcctatagtattctattatagcagcctgaacagactaagacaggaaggaatgggacattttggaggcagaaatctgtgcaacttgctgaacaatggagaggctgaagaaatatatagtcactgagggtcgaaatctaaatgtggcatttgactccatttccaatactctgatttatgacagaggaaagagaacacttgtactacttagaaatgaagtagattcagcaagtcttgaaggtatatttttcttcccaaacataaacattttagaaacttgactagttcttaatctgctttactgctcaagtgttacccaatcgtccagtctttaaatttgttttcatttatgaatttggaagtggttgaatagtcaccattttggctaaagaatagtctttttgtttacaaatgaaggtgcttcccctatgctgtgtttttgcatttaattttaaacttttgtgcattgcattatcccaagcaaattaacacaggaacagaaaaccaaataccacatgttctcacttaaagtgggaggtaaacattgggtacacgtggacataaagacagaacagtcgacactggggactactagaggcagaagagagggaggggataagggctgaaaaactgtccagcacaatgcttacttcctgggtgataggatcaattgtaccccaaacctcagcatcacacaatatacccgtgtaataagcctgcagaggtacaccctgaatctaaaataaaagttgaaattataaacagaacttttgtgcaatggaataacaaaagaattgaaggcattgggctttgcaatatcaggtattgcatgttgtcattacaggaagtcattgtgccatcttggtttccccttaataacatatggtggtttatcttgaaacttcaaaagtaaacatagcgtaagcacctataataaattattgccaaaaaaaatcacatgcagaattatttttgctatgtgaatttagtggagaatccaatccagtaagactttttgcacatttgaatggtgaaacaagatgatttggctcctctagtagctttgttgcatgcacagttgaccatttttgtttgtagctccttgtaataagatatttaacacagggctttatattgggacatagtgattttataaatgggtgggagaaaacactgaatttgacagaactaacttctagattatttcaatgtaaaattttcatgcttaaaatttttaagtgttagatgtttaaaataacttactcaaaagtaattcttagtaaaatgaaaatcagtgaaaagcactcagttttttaaaagcaagaatgattttattggtttcaaagttaaacttactatttgaatcaaatttttataaaatccatttattttttaaatacttgaaattttgagtaagaaatataaggacatggaacaaaataaggcacaaaagcgtatacagtgaaaagtaagttgtcacccccaaaccactcaagtttcctcctcttttcttttttttttttttggagacagagtctcactccatcacccaggcaggagtgcattgggttcaagtgggttcttgtgcctcagcctcctgaatagctggagttacaggcgtgcgccaccatgcctggctaatttttttgtatttttaatagcgtcggggttttgccatgttggccaggctgctcttaaactcctggcctcaagtgatccacccacctcggcctcccaaagtgctgggattacaggtgtgagccaccgcacctggctgtcattttattaaaacgtttcctttcctagcgtccgttccactaaggcagaggtatagaaagtgggaggtggtagctataataatctttcactcatactatagtataaataatactttttaaatttaataatactaatttaatttaatatttttttaattttagttcgatatttgtgggagagatgggaatcttcagagtggtggtagccaacttctgcctccatggttcaattaaaagcaagtcccctagttaatagaagtaaggggtctctaggcttgcaagtttcttcagatgctaaaattatgcctttgtgtaaaatcagactttctgttatatgagtagacgtaggaattctctgtatactttaaaggagaagcaaatagaaatagagagggtgataaaatctagattcatagaattgtggaaaccttacttcattttaagagtgaagaacccagtctgattaaaggaagttccgtgtttaaggcaacatgttgcttgtggcagatctagactcaaaactgagattcctgcctctgtccagtgcttttttcacttcattacattacgagccatcttaactccattcatgcaattctggggtaaggggttttgtcagaattccacctgaccttccctagagcagggtttggacaggatgagagaccccaatctctcagatttgaggcttcttttcaagatatctgtttttcccttttccttaaaaaagaaaaaaaaaatttcatcgaatttgggaaagttttgtgaagttttttccaaaatctgtaatgtgtcaggatctttcttgttttcttaatagaagccacactgatattatgtatattgttccaattttagtgtgctcaccactgaagcaagtcatgtacatggtaaatgtttctgacatgtttaggaacattatatagaaaattcagaatggatgtatttggctgccttgacattcctttttcttttggaaaggaatgtatttaaatgagaaacagttccacccctccaatgaaaaggaatagttttaggtcatttgagtgaaatagattatagaacttatgaccccagttttcttgttttttttttttttttgaaacggagtttcactcttgttgcccaggctagagtgcagtggcgtgatctcggctcactgcaacctcagcctcccggttcaagcaattctcctgcctcagcctcctgagtagctgggattacaggcacgtgccaccacgcctggctaattttgtatttttagtagagatggggtgtctccatgttggtcaggctggtcttgaactcccgacctcaggtgatccgcccacctcggcctcccaaagtgctgggattacagacgtgagccaccacacccggctgattgtacttttaagtcagttttaataggacccaggtacaaggtcaaggtacttgagaatttttggatttaatgttttacattggtttaaactggttggagtctggctgtgtttcctggtgacaatattcatattaaaaatcttataggtcagtttttataaaaactatgtaatatttcttttaagttaatgattgattttttttttttttaacttctggtgcctttgcctgagattttggtttgtagagaataatatgtcagttaagcagaaatttcagtgacctgaaagtttgggttcttcattttaatgagggccaaatgattaagaataccattggatttcagtaatgtattcgaagtagtatcttctggctgggtcccaaaatcatcagatgctaactataccttttctagtcttctgtacttagaatcaatatttagaatgaagatcctaatatcttgcataattcttaaacagtaaagataaatatgttcatgaaagtatatgaaaccaaaaattggaaagatggcttttaagatgggggaatgaggtagaagactacattagtttggcttattactgtaagaatttgtttgccatttctgatgagagtaataatgtgggttcctcccaaaatgtttgtcttttaagagaaaatctagtgagctatcaagagttgtaatcataaggattaggccttctgttcagtgatgccttttgtacaggttgagtagctagaactacctgcatggtataatttgaagtttcataggaaggccctgaaatagtactgttctctccaccccaaaatgtgagccatatatgtaatttaaaatgttgtagaagccacattaaaaaatttttaaagaaacgggcgggaaattagtttcaatatatttgatttaacctaatatatttaaaatataatttcaacatgtaatcagcataaaaaatttttactcagtcctgtctatattttacacttagcacatcttaattcaggctagccacagttcaagttttcagtagtcacatgtgactagtggctatcaaattggatagcatatccctggaacatctttctcttttatcccacctcaggtgagaattcctccactagcagtttttctagggggactaaagtcttgccatttctttgtatgctccctctataattgaaaggaaaatgagacacttcagagagaaaaaaaacacattaaaccattcctggggcatgttttaaccatttgtgctttatgtgataaccaaaagctagtactactgaaaaagtgcaactgttactgaatgaaaacttcagagggcaggttcagttggttatgcttaagtgagaggagagcttgggtagaaaaggttgtggggggaagaaaagttgggacaggttttgacttcagatcttagagtcctgttggccttgaacaagttagctaccttctctgagcctttttatttgcttcatacatagaattggggttaaatacctctcaagttgctatgagggttatatgagatgacatacgtaaagtgtgtaatatggataatatttggtacatagtaggtgcttagtaaatatgtattgaataaatgcttgctgattatttacatccctgacccccatctccccttatgagacaggaaaagagaggagaaaagcctaaaatgaacgtagaagtatattaaacaaacagcctggctgggcgtggtggctcacgcctgtaatcccagcactttgggaggctgaggtgggtggatcacctgaagtcaggagttcgagaccagcctggccaacctcatccctactaaaaatacaaaaattagctgggcgtggtggcgggcgcctgtaatcccagctactcaggaggccaaggcagggagaattgcttgaacccaggaggcggaggttgcagtgagccgacatcatgccattgcactccagcctgggcgacagagtgagattccgtctcaaaacaaaagaaaaaataaatagcccatttacaaaattgactgggacttagtgtttgacctgagcaaatgagtctctaagcattgtggttgagattttaattcagtacttttatctgaaaagttcagaaaataatgatgtagaatcattcatactctgcattgtttaaatagaaagaaatgagttttgctaattttatttccatgtacttataccattaatagcattagtaaatgtttctgaatttgtttcagttaagagaaaaatcacaattaactctcgtctttccctacatatgatacaaattcatcactttcctttttttttttttttgaaacggagttttgctcttgttgcccaggctggagtgcaatggcacgatctcggctcaccgcaacctccgcctcccgggttcaagcagttctcatgcctcagcctcccgagtagctgggattacaggcatgtgtcaccatgcccagctacttttgtatttttagtagagacagggtttctccatgttggtcaggctagtctcgaactccccacctcaggtgatccgcctgcctcggcctcccaaagtgctgagattatcggcgtgagccaccgtgcctggctcactttccatttcttcaaaagttttatcacagtagttattgcagtttggaatgtagacattttatgtctactttgcaagtttaatatacagagtaatagattgtcgtgatgattataaacttgtagtaattggaactaaggaaaacatctctaaatggaagaaaacagccacttggtgactatacttcttgttataatgcaaatggcatattgttcttcttccggcattaacattaatttgtactttctatgacattagctgtataacaatgtgttctgaatctgttaaggagaagtcctcctatacgtatcatatttctgatttgctatatattttgagatatttatttgaaaatttgaaatactgaaaagtgggaaagcatggagagttctgaatagatgattagataagggctttccaaagctttaagctcaccaatgtgtaggcctcatctgtggtaatgttcttggaaatcagtcacatttgaaaaatccagttttcttgccagtagcatctggttgcactttatttactttgaaagtattttttgaattgcaaaaaagcaaaccatatgacaagacttttcttacctgattgaaagttgcttacggtttagttgaatttttaacaaacttaactaaaggtatgattgtccaaatgcatggaatatcctgacaaatcagatataaagaatttttaaagttattattggcctttaaaaattgcccagactcgtactttatttactttattttagtaacactcttaaggagtcttatttattaaaagttctttcaggtttgtggaattttgatgatagctgacctgactggaatgtactctactaaaagaaagtgatgatggctgggcacggtggctcacacctgtaatcccagcactttgggaggccgaggtgggcggatcacctgaggtcgggagttcgagaccagcctgaccaacatggagaaacctcatctctactaaaaatacaaaattagccgggcatggtggcacatgcttgtaatcccagctactagggaggctgaggcaggagaatcacttgaacccaggaggcggaggttgcggtgagccaagatcgcaccattgcactccagcctgggcaataagagcgaaactccatcttaaaaaaaaaaaaaaaagaaagtggtgattattatgtgattggcatttctccaccaatttctgaaaccttctgacagctgttactagttatatacttgtgtatatgtttgacaaactgactgtgagcttttaatatacaggtgttttatagtaatctaagcaactggattcccttggtaacctagagatttgtgagatgattttaggtggcatggatctaggctaacctgtgaaatgggtattagggtagattctttggaatgggcccaggcttggtgccagaattatagagttccactgacattatggtaaccactagctgtgtgtggctgtttatcgcttgaaatgtggctagtcctaattgagatgtgctgcaattataaaaatatacagatttcaaagacctagtacaagaaaaagaacataaaataactttttttaatatattgattacattggctacagctattccagctgacttggctcgtccaatttgtattacagtgctgttttgagagctattgcctacaagcaacctctactccttctctaactctcccattgatgaagtttaaaaaacgaaaccaaaccacttgctccacccactatctttaatggttggtgactcctgaccagcttcttgaaaacaggtgataaaaataaatttgtaagtccaggcacggtggctcacgcctgtaatcccagcactttgggagaccgaggcaggtggatcacctgaggtcgggagttcgagaccagctgactaacatgaggaaacactgtctctactaaaactacaaaattagctgggcgttgtggcgcatgcctgtagtcctagctactcgggagactgaggcaggagaatcccttgaacccggagggggaggttgcagtgagctgagattgtgccattgcactccagcctgggcaacaagagcaaaactctgtccctcaaaaaatcaaaataaaaaataaatttatggctactatccattgggcacctgccatgtgcaaggtacagtgctaggtactttaggtaaaatcatgaatcctcacatcagttccaccggatttatattctaaattacgaagaaacagattcagatacattgtgactttgctctgggtaagtggcaactagtaggtggcagaatggaattccaacctaagccagcctggttctagaaccagtgttctttcagctgtattatactcccctatgttttcatttccatgtgtgtcctttaacatgaagcggagtactgtttataaaggagtttcttggcaaatggtgttgactgatcagtacttaggatccttaagttgttttcctttgtcttggtggatgactttaatgcgccaccctcctaccctatctggtacctagtgagtggcctagatgttaatgaagagacatgagctattttttttttttaagtaacttttaaaaattgacaaaagttacatgtatgtattatctaaaacatgatttggaatacgtatacatttagaacataaggttttagaatatgatttatgagaatgcataaatcagtctaattgacatatgtattacctcaatacttttttttttttgtgataacatttaaagtttcccctcttagcaacttcaaagagatttaatcttattggcagccagttgaacggtatagatcaagcctatgactttctcacctggaaaatcagtcacaaaaaatgtttcagatgccttcaggaagagatacaagaagagtctcctttgctaaatgccaggaatatcaaatcttggacttcagagactggccatataaggaaagagatttttatagacaaagagggttgaagtaaaataatgggatagaataagcatattaagctggataagtgttatgtaatcctaggtcatctcttaatggccatgtccttgacattgttgcattaagaatgagagctcggagaaatagtccatgtgttggcatgctagtctctaagttagaatagatgtgatcacaaatcatgagtgctcttaaagggtggatcctgcattcactcatccacttctgccttcattcaggctcaagcaagtggtggtgactttggaaagataaggagagaaaaggaaggacaaaaaaggaaaaagggagtaaaaccagactggggaagtgggcagcagggatacttgggcaaattcagagtgcatagtatttgtacatgtacatgcatattgtatttataatactaagagctatgtaaactgtaaaatactatttcaggaaagagtatagtatgctagaaagagaatttctgactaggtggtgtggattcagctttctcagctctaccattaccctaagtgtgtaaccttatgaaagtgttagaatctgaaataatcgctattctattaatacttctctggctttccttcctgattaagatcatgctaagtttgaaaacactttgtgcgtgctcatatgctgtatacatgttgttattgtttttatactgttaattatttctcttcatctaaagtattgcctaccagaaactttatcgagaggaaaaaatttgtacccaagaacacacacattatgattaagagaagttagagttaaattaaatagccaatttaaatagagccaatttggctctcatccctaggctttataaaagagacagtggcagccttgtgggtgaggggaatgtggacctaattactcatttaatttaatcattcatccctttaactcctttaaaacctgacttttataggtcgattatataatgtgtgtgagcacagtgtttctctttgaatgaaaaaccctgttgaatggctttacaaaaagaagattttgatatattcatagtaataaacttggtttgcatttctctgaggcttatggtcttcaacttctgaccaagttagtgaagggctgctataactaccagatggcagtcttttctgatccagtgttagatgccaacagactaatagcagaatagatgtaagcagaattcaagcacagcatttgaagtattgtttaaattggtcatctagcaaatttaatataaagaggataaagagaatatgttcatgtcgccatacaattgtttggttctcagggcagtcccagaatgcatctttagtttgtgttccatgtaaaatgcagggtacagggatattttgccaagtgctggtttgaaatttacttgggatccatccagctggcagatcagctgtgctaatcagatgggcccgtttctggggaatgggatttcatagagggagcagtgttcttgaagtatagttacttaaaaaccagttaatttttaatttaaaaattctcataagtgctatattaaaatgtatatagtgcaagtattatgtatatagtgcaaatactttgtgcattcttgtaaataataaatagggacaataaagtcattgtgctatactcagctgcctttaatttctattttgaatctctgggaccgtaatttgctagttgcctgcagtgtttattaggattaactcatctgcatttcccactaatgtagatcattagttctaagagatttctcaggataaatagtgccaaatatgtttgggaaactactttctgtaccatctcttaaaggtttatattgtaccttagcatagcaaagactgagaagtacagcaattaagtacagggtttgctttgttttgttaaaactcagtgtgtctcaagtatgtcactagaccacagaaatcagtctctagttccatcccgtggagctcctgtttcttagaacactcttagggaaaacactgcccttaagttatgagttaacaaatctctagagtttatttttttgattacattttggaactactacaattaaaatttgtagttacaaatatctcagcctaggggatataatgcttttgttttaaaaatcagtattcataaggtcattttacatagaaatgttaatttctatggggtatgtctttgaattgatattgacatatatcttgggacattttggtattttgtaaatataattttccttttgtttcaaaaaattacattttttgataaacaagataatttctttagcaagtattttataatttaaaattatattttttcattaataaaataaaatataattattttaaattcaactgtaagataaatgttttagtagcaattaaactagtctgtaattctcatttgagctgaaaggaaaaccaaagatttcaatagtccaagatactgccatgtaatcagttattaaatggggctttgagactctcaacctagacaatcatactctaaagataagcaaattacttacgtataccagtctactgtttatattctctaatctgaatataaagggttttaaacatttctttgctttccatgaattccttaaaaatgacatctgagaatgttttttaaaaaatgttatatctaaatgtggatcttgaatcatccccaggttgtaaaacaggaaagttgtgtcgttttgtgagtaataggaaatactaagtatagacaagcttctaagtgtaagccaatgcatacattaagtaaattaaaccaaaaaagattaaccagccatgtttcaggttttggaacatgtaatgtataaatgtaacctactagaaaaatagttctttgccattaaccctcaaaccaaatcatgagacaattttttcagttgcatttggaagaccatgtttgttagctttggcttaccatttgctgaataaataaaaatggcatgtttaatgctaagtagtatttataaccagaccatcaaacaccaagtggaattctgagggagggattctttcatattgaaatataaaataaacgttttgtccttagggtttcattagatggtacaagatctgtaaggtaatgagctcatccatttctcatcattatgtcagcgcccccttgctgctataccttcattgatattccctttccaccctctgctctatcaccaaccccatctatctgcatcccatgttttaaagaaattacaggtaaagggaataaactcactagaacagcctttattctgaagaatattgcttggtgaggaagcctaatgattagagtgataactgactccatcaggaagcgaagcaacttcccatcagcagaagtgccattaaaagctctaaatccaagctagacttgctgactaaacagaaattgcacttgtggcgctttgtcagctgcctgtagtttgaccctctctcttttctactaccagtaatagtatgaatccttttagactagtggtactcagactttagcatgcattggaagcacctggagggcttgttaaaccataaattgctaggccacaccccatactttgattctttaagtctgaagtaaggcccggtaatttgcattctcacacgttaccaggtgttactattggtttgagactcagtgtttttttaggctaagaattgtctttgaattttctcttttcctgtctcttatgccaccactgtccccatcgaagcctatcatctgccaggcgcggtggctcatgcctgtaatcccaacactttgggaggctgaagcggcagatcacctgaggtcaggagttcgagaccagcctggtcaacatgatgaaactcgtctctactaaaaatacaaaaaatgagccaggtgtggtggcagatgcctgtaatcccagctactcgggaggctgaggcaggagaatcgcttgaactcgggaggcgggggttacagtgagccgaggtcatgccactgcactccagcgtgggcaacagaacgagactccatctcaaaaaaacaaacaaaaaacctgtcatctgttgtggactgtcctggaagctcttttcttattagcttttcctatattggtttcatctatagtgaggcagcattttaccatggagtccagtttcattattataacttagaatatctttaccagttttggaattgttcataccttctccaagttatatttctcatgtgataatccccttacatagtttagaaagtgtcttttttttttttttttttttcttgagacgagtcttgctctgtcgcccgggctggagtgcagtggcgtggtctcagctcactgcaagccccgcttcccaggttcatgccattctcctgcctcagcctcccaagtagctgggactataggcgcctgccaccacgcctggctaatttttgtatttttagtagagacggggtttcaccgtaaggatggtctctatctactgtcctcatgatccgcccgccttggcctcccaaagtgctgggattacaggcgtgagccaccacgcccagccttctttttttttttaaatgatcacatttcaatatctaagtagatactttcactctctgaggtattgtcatatatgtaatcttctaaatatatattggctgtttaaggcatggggatagcatttcatagaggagtgtgcaggtcattccccagcagtagaaaatagtgttatgactagccttctggagttagatattaggtgaggagaaagatcttttgcatattcctcttgaagcagccactgctttagccacaaaaaatacagcctctttttacctgggacacggttaactagactagtgctttttgcttcccataagtggtcaggttctaatttctgagggtaagagatgggttttctaggatatggagcattctgggaggactaggtatatcataagaaagaaaatactagttggaaagaattgaccatagacctcagaggttttctagttcagctttctcattttatatgataggaaatggaacatttcctggacttgcctaaagttttacagccagttaaacacacatcagtcgacctctgtttcagtcttaccatgggttcctactgttctttaatactggcatgaaattttgtgacacagtcacgtagtgactagccacacagttcagcttcttaagttgtatagaccaggcaggtgactcaacgcctataatcccagcactttgggaggccgaggcaggcggatcacttgaggtcaggaatttgagaccagcctggccaacatggtgaaaccccgtctctactgaaaatataaaaactagccaggcgtggtggtgggcacctgtagtcccagctgcttggaaagctgaggcaggagaatcacttgaatctaggagacggaggttgcagtgagccgagatctcgccactgccctctagcctgggcgacagggcaagactcagtctcaaaaaaaaaaaaaaaaaaaagttaactatataatatttatttcaaaagtcatgttttggtgattttaaatttaaaggacactgccatatcataacatacactgcattcagcactatttttatgtatgtttgtttctgattgtaaaaacagcataaactcataagatatttggaaaatacaggctgggcgctgtggctcaagcctgtaatcccagcactttgggaggctgaggcaggcggatcacctgaggttgggagtttgaaaccagccagatcaacatggagaaaccccgtctctactaaaaaatagaaaattagctgggtgtgtggtggcacatgcctgtaatcccagctacttgggaggctgaggcaggagaatcgcttgaacccgggaggtggaggttgtggtgagccgaaatggtgccattgcactccagcctgggcaacaagagtaaaactccgtctcaaaaaaaaaaaaaaaaaaaaaaaagatatttggaaaatacagcaacaaattggtagataaaaattagcagtaaaccaccacccagagatagcctcttatattaaggtaggttatctatgctttattaacatctccagaattcagtgacttattttccacttacatgtagttcagtgtggactaggtgggggtagaagagggtttgtgtaaccaggctaattcatctggtggcccccatcccccagagcctttgaattctgccctgcatcttggatcttttgcagccagcctgtaaggaaggagagaccttggaagaatccatagtaggttttaagaactagagctcaaatctgggacagcagcgtaaaaacaattttgtatgctgttttattaaaacatatgtttaacatttgtccttaatcattaagtactattagaatattatgcagcccttacaatctgtcttattattaactgttctttttaaacagatataaaagcctgtctactataaaaggactcttttagctgctctttaaaagcacgttgtcttgatgcactgtttcttaagggtcacacatatacatatatatgttaaaatgtttgtattcattgactcgataattctccaaagaatttacctacagagtccaaatgtgaaaagttaaatgcataaggatgaaaattatgtttgtaaactagtaaagactagaaaaaactggacatgtttgaaagagactggtcaaataagtgttagtaactacacacattatacaacattagcatataacacagccattaacaatgatgtttatttgcttagaaagatgttacagtaaattatgggctataatatgtgtaatatgaaaaagttgattgcatgaatgtacatgtatatgtgaatagatacctttatgtgtgtttggagggtattaccacagtgtttcctagcgattatttctgtgttggcagatttgtggtgatttttaacttttcagaaactcttcagaaatgtttctgtagtttttaattgtaacgacttatatttaagcccactctggccagaccctctcccttaccttgcacattgcttctggtattgagccttcctaactcttctccttccagagtaatcatgttgttgcttgccccactcagtcagtccgctaccacctcctcccatcctttaagaccttctgacttaaaagttctcctaccccaatttaagcattcaggaactgattggagaagagcttgaattggtgaagttaaaaaaaaaaaagtgttcagggctgtaatttaggtggagggactaatgaggaaggaggagtgtggccctgaccttgaggcatgatgcagtggcagagagtcccagccacctggatataatctaggaggattgtcttttgaagttaatgctaattatgtatatgaaagtgaagctattacaaactgctgaagttatttccagtaggaaagcatacagtgagcaccctgtttaaagaaaaaagcaaaaccataaaatactgtattagttatctattgctacataacaaattacccccaaactaagcagcttcagacaacaaacattatctcacagtttctgtggagcaggaatccaagagcagctttgctgggttctggctcaggatgttttatgatgttgcagtcaagctgctggcttgggtcttcagtcatttcaaggcttgactgaggctagagaagctgcctctaacttcgctcttggttgttagcaatgccatagttcctcatgagcttatggtggagagcttcagttccttgctaagcaagcctcatcacagggtcatctgagtgttcttaagatgtggcagcaggcttcccttggaacaagtagaaggatggggaggacccaagatggaagccagtttttaaaataatctcatcttgtgaacataccaccacttctgcccctattgctgttgctctctcagaccaactgtgatacagcgtgagaagggactacacatggttgtgaataccaggaggatgggatggttagggacttcttagaggttgcctgctgcaaatactcatgctgttaggtaaatcgttaggaaagttattattatttttttttttcagatttccagtctttacctcataaagatatgttagacattgctagtttgaatgaggtttgggtgagaatatacttagtggaacatgtgatgcagctttcttatcaacttagtggagatagattatgtaaaacctttgccaagactggaaggtgattaataggccagcttacctgaaacatgattgaacagattgacactggcaggatcacacagcacaaatttagtttggccaattaatatatgtacccagtaatttttgatgattatcatccataattaggagtacttaattgcatatttaagtactcattattccattgcagtataaagcagatagttttatagcaaagattatgccgtggagacatatacataccatgttgtggaatttgggcttttttctgtgggaaatagggagccaaagaaggatttataagaagtggattgatgtggtcagatttgtgttttaaaaatcttcctttggcaacagtattgagagtggactgagagaaggttgaaggtaaagagattactaaagtatgccaggagagagagagtgcctgaactaaatcagtggactcggatagagaggaagagacttttcctgaaaggaaaaatggtaaaacagaaggaatgatggagtttgaaggtcaggttaaagaagtgcctaatttctggcatggagaaagaaaactggaaaaaagaacttgcacgcacgcgctctctctctctcgctctctctctctctcgctctctctgtctctctctgtctctctctctctctctctctccgtgtgtctgtctctctgtccctctctgtctcactcatgctgtatctcttgctcatgctgtgtctctcactatctccctcgctgtctctctgtctttggaagaatatgtgggtgataagagtttgatttttcaacatttgaagattgagatacttgaacagcagaccacagcaggagattttaagtaggtagttgaacatagagatctggagcacaagctagaagtttgacaggactgtaaataacagatctgtgaattaataacaggagaattgagagttgaagttgtgggaggcagatgaggttttccaaggtgaatgtgcagagtgagagaagtacaccagggatggaactctgttgaataccaaggtataaaatcatcctttttatagccacaatccagactaagaaaatgccagtgtagggatccatttcaatcccggccctgcttgaggttacattgaataaggtatcagacccctttgtgacttcaaataaatggtttaacatctctaagcctaagtttcctcatctgtaaaacgaaagggttggttcaaatcagcagttctcaagcttttttcttctagattatgtgtgatataggatgttcacactcacatttccacagacgtgcttagaattatgggcaatttccactgctctggttctctgtcatacaagaaatgcaagattgtgagaactaagctgttataacagtaaccttgggcctcctctgttatatgtttaaaaagcaactagttcagaaattttcgtactgaatcaacaagaagttacttgcaatagatacctgacagctgataggcatgtagcaacaaaatcattacttaaaactcccaggctagttatattacttttaaaattcttttgggatcacagaccccctgtaagaactaatgaaggccatggattctccccccaaaaaatatgtggataatttttttatatttgagagaattcaaataaaatattctaaagttggtagcgtctcttgggatccgtgaccctgtattaagaaattccttttccagataaaaatccccttctggaagattttatgactttatttgttgtaaaaggagaagcatatttctttggaaataaactttgtgattagatctttgtaggtaagtatttctatagtagttttaatttttaaatactgttgtttgagcttgccataattagaagacagccacctattctgtggataaactagtgccactttaagaaaaggtgatttggagcacaattatattagaataactactagctattttaaatattctgttctatactacttgggtgaggggagggtgtcagcgaaggcagtggtagtaaggcagccaggaggtgacaaagagtccaggcattcagggggctttcctggggcaagtaaagcctttcttgttcgtgtttgtcggtcagtcttgctcaagtgacttagaggtgtctggaagtgtatgttcagtgagctgagaaataatcttaaatctttttaccaaaaaaacaacactcatgatttttaaaataaatttatttcaattataataatactatctttaatcaggaaatagtctaataacatggaatgtggattttggtgttatctagaagaagaattagcacactaataaaatattaatagtcttattattgataactgagttttgtctggtgctgtttttttttttttttccatcagtttttttacttcttaggcttgggaaccaaatcgaattctcctggtaattacaaataagtactgcttcaatttctatcatccagttatttcatgagaaagtttacagtaatggtaaagcagtttgattttgttctttgtctaaagtacacccataccaagataatttaaattaatttttattcaaagtagttattaaaactttgaggggaaaacatagaatgcatatttttctacttcagagtttcggtgggtcatatttaatatttttaaataatgatcacgtatttcagcttttcagcaaatggcatgcactggcctagtaatgattaatcttggctcaatgatcaagaatgttgactttgaaaacttacttgcaggctgtggaatagcctacagaggacatagtaattttgtttgtgtttcaattatgtcctgaagatcttggtgtgtgtggttgttgggccagcccagttttcatttgaacggcttggcctttacaggtggacttctcttccaaatgagtatttcttttaacttgcatccgaattaatgttctttagagaaatctataacttaaataaagaaattgacctcctcccaggtttcttttttttaaacaaatcctatttattttttaagtatggctgatctttttttgtatgactttctatctttactacgaaagttgcatttggatgtttctagatatttcactcacctatttgctgttattccatttttagggttaacttagcagcctgctgctttatttttatttttttaaccaaggatgaatagcttggtaagaatgatatagtaaaatgaacatgtatttcttagggagagggatcactattggagccacattttttccactgcataagttctcctaagagtagattgggaaattgtaaaagctatgttagtctcttgaaactaagatattattttcaaattattgcatcagggctctaaattcttcattcaataaatattttaattcttgctgataaacactatgggggatacaatgataaatcagaaatagattcttttctcaaggaatatctagtcaatggagaagatacactgtgtggttaaataactacagtaaaaagtacagattaagagctgtggtagctcaaaggaaatactatttttgggttgagaggagtgaaaattaggggagatatgagccttataaaatttgttgaacaggccgggtgcggtggctcacgcctgtaatcccagcactttgggaggctgaggtgggcggatcacgaggtcaagagttcaagaccagtctgaccaatatggtgaaaccctgtctctaaaatacaaaaattatgcaggcatggtgacacacgcctgtagtcccagctactcgggaggctgaggcatgagatcgcttgaacctgggaggcggaggttgcagtgagccaagatcatgcccctgaactccgtcctgggtgacagagcgagactctgtctcaaaaaacagaaaacaaaattctgttgaacatctagaaaaaggaaacttctgattctataaatgaaactttatagattgattatattaggacagcttatgtgagaatttgtcgctttatattattgtgtcttctggcctattagaccattggctccttgacagtgagaatcatatatttttatctttgtgtttctagaacttcatacttaattgatgcttatcatatgatttttgagagatgaatcaactaggaacctagaattttccatacaaaatcagacaagcacttcatgtattctttgtttaatgtaacataggtgctgccttctgtacattagcttcaaaatgttaaaaatattcatagaacatccacagctgataagtaacaccaatgaaatttttatttcagatacagttagtgatgtaatggggaggagaacaaatatattccttcaaaataaaattgtagactaaagaagtaataggtgtcaaaagaggaggtagcagagagtctttagatttctcccatgagattcaattaataagacccttttaattcaaaatgaagctatgtgatttatactttgggactaggtaactgtatgaccttatcaaatgctgtttctaaaagtgctatactcatagtaaaactatgtgtataactatgcatagtcagtcctcaaaatagattgctatgtgcatttggctatgtgcatttgaattttgactacagtcttacaagtggaatcttactgtaaagtagttccagacctgaggaagaacgtcagttattcaaggtgttgggggactagttggttacttagtagaaaatacttttccgaaacactgggtagtttgaagtaaagtacctggctgggcgtggtggctcatgcctgtaatcccaacactttgggaggccaaggtggggtggatcacaaggtcaggagttcaagaccagcctggccaacatagtgaaaccccgtctctactaaaaatacaaaaattagctgggcatggtggcgtgcgcctgtagtcccagctacttgggaggctaaggcagaagaattgcttgaacccaggagtcggaggttgcagtgagccgagattgtgccactgcactccagcctgggtaacacagcaagactctgtctcaaaaaaaaaaagagaaagtacctatggtgaaagaatagaatggttttgggtcctctgttgctatttagcacttttgagctataatattagttatagcaaagatctgtataaattttatctccttatagttgacgcttgagcaatgtgggtttgaatagcacaagtccacttacatgcagataattttcagtacatgttttggaaaattatttggagatttgtgacaatttggaaaaatggatgaactagaaatatcaaaataagaataaagtcatgaatgcagaaaatatatgtagattctatctacttctatcatttaccaccataaaatatacacatatctattataaaaagttaaaatttatcaaaacttacacacacaaacacagaccatacatggcactgtcacagttgagagaaatgtaaataaacataaaaaggcagtattaaatcatagctgcatataattaactctcgtacatactgtagtcctgtaatcatgtagccacctcttcttgctgttgccgtgagctcaagtgttaggactatttacttaaaaagctgtgtgatgttaatcatctatgtgaacagttcatccttccagtaaattgtgtatttcagtaaaaagtgacctctcagtattattgtgtatctttcattgtgtctaatgcagaaatgtaaaccttgaataacaccatgagactcatacaaagtgatactttcaagaagcagagaaaagtcatgacattctaagaaaaagttgaattgcttgatgtgtaccatagattgaggtctgcagctactgttgccaccatttcagacaaatgattcgtcttgtaaacagatgacataaatttatggtatcaataaatacagtacagtaccgtaaatgtattttcttatgattttcttaatattttcttagtattttctatagcttgctttattgtagagtacagtaatatgtatatatataacatacataatcaactgtttatgctatcagtaaggcttccagtcaatagtaggctattaatagttggggatagtccaaagttatacgtggatttttttttttttttgactgcgtcagaggctggtgcccctaacctcccatgttgttcaagggtcatctatatgtaattctggagacggggaggatcaaaagctttgaaggatataaaatctcatctaaagtgaaatttttatagaatgtacataaatgtataggttaaatggaaagcaatgttacaagagccaagggtattcaaattctacttactgttgtcactttggggaagttgctgaacttttctaggtcttgttttcctcatctacaagatggaggtaattgttgcctcactaaggtagtggtgagtattaagtacgataaatatgtaaatcacttagcatgatgccttgtacataatagttgctttaaaaatagtagctgctaatcaagcacaaaatactggtttggaaatatttggtttgaaattgaaaaagaataacaccttaaataaatactgtcataatccaggataattttgtccttttttttggttttatgaggtttgtattgaagcattgctgaagttcagtgattctgaagtgatgtctactataagcccaaagggtcacaagtgctgactactgagatgtagtagttttcaccccagagacagcagaatggaatttccaccagatcactctttgtgatagatattttaaaagccatgctattctaatgtgccctgaataatatagatagctagttcacagtagctaaataaatattattcattatctttccatttacctttagggcagttgtaaaagtcatgctattaatagatcatttatatgtttaaaactcaataatataggtaactcacaatttacaaagtagatttgccgacttaacacacttttagcaacagtctgagtaatattaggcttagacagttttacataatgtacttatagttggagacttggcttctagtctatgactttgggcaagtcacttggctctctcagcctcagattgctcatctgtaaatgcacactatattaagtggggaaatctgttaaaatcaggtgctagcattctccaaatatatatatcgggtcccattccacgtcttctaaatcagaacctctgtaggttgaggcctagataattttttaatgtatccctgaaaaccattttataaatgaaaatttgtgcagatactatcttttaatattctttgaatcttaagtatttaggaactaatagagaaacttgtcatgctacttatcgtatgacttaggaaaataaggaaagatagttataggaaaaagtctctgttgcaaaatgagaaatgagatagcttcacagaagcacaaatgaaagaaatgtaaattctagagaattatctgtgggaaaaagaaattgtttaatatatatcctcagaatatcttgggagtgtcttcagctggtaaggtaaaatgagtatgtttaaaatccagctcaactaatgagaaccactatcccattagaaacaaacatattattactatactttaaaaagatttagctaagtgtaatatgaaatgtatcctttctcaagtgatatggtgtggctgtgtccccacccaaatcccatattgaattgtggctcccataattcccatgtgttgtgagagggtcccagtgggagatagttaaatcgtgggggcagtttccctcatcctgttcttgtggttgtccttaagtctcacgagatgtgatgattttataaggggtttcccctttcgcttgatcattctctcttgtctgccaccatgtaagacatgcctttccccttccaccatgattgtgaggcctcccctccccagccacgtggaactgtgagtccataaatctctttttctttatgaactatccagccttgggtatgtctttatcagcagcatgaaaatggactaatactgtaaattggcaccaggagtggggtgctgctgtaaagatgcccaaaaatgtggaagctcctttggaactgggtaacaggcagaggttggaaccatttggagggctcagaagaagacaggaaaatataggaaagtttggaacttcctagagacttgttgaatggctttgaccaaaatgctgacaatcatatggacaatgaaatttaggctgaggtggtcttagatggagattaggaacttggtgggaactggagtaaaggtgactcttctgtgttttagcaaagagactgccagcattttgcccctgccccagagatctgtggaactttgaacttgagaaagataacttagggtatctggcagaagaaatttctaaataacaaagcattcaagaggtgacttgggtgctgttaaaagcattcagttttgaaagggaaatagagcataaaggtttggaaaacttgcagcctgatgatgtgatagaaaaggaaaagccattttctccaggagaaattcaagctggctgcagaaatttgcagaagtgatgaggagccaaatgttaatcgccaaaacaatggggaaaatgtttccaggggatgtcagaaaactttgtgccagcccctcccatcacaggcctggaggcatggaggaaaaaatggtttcatggactgggcccagagtccccctgctgtgtgcaacctagggacttggtgccttgtgtcccaatcactctagccatggctaaaaggggccaagttacagctcatgctgtggcctcagagggtgcaagccccaaccttggcagcttccacatggttttgagcctgtgggtgcacaggagtcaagaattgaggtttgggaacctccacttagatttccgaggatgtatggaaacgcctggattccaggcagaagtttgctgcagggctggggccgtcatggagaacctctgctagagcagtgcagaatggaaatgtggggttgaagcccccacatacagttcccactggggtgctgcctagtggagctgtgagaagagggccactgtcctctagaccccagaatggtagatccactgacagcttgcaccgtgtgcctggaaaagccacagacactcaatgcctgggaaagcagcctgagtggtgctgtattctgcaaagccacaggggcggagctgctcaagatcataggaacccaccccttgcatcagcgtgacctggatgtgagacatggagtcaaaggagatcattttggaactttaagatttgactgctctggccaggcgcggtggctcatgcctgtaagcccagcactttgggaggccaaggcaggcaggtcacgaggtcaggagatcgagaccatcctggctaacacggtgaaaccccgtctctactaaaaatacaaaaaattagctgggcgttgtggcaggcgcctgtagtcccagctactcgggaggctgaggcaggagaatggcatgaacccgggaggcagagcttgcagtgagccgagatcgcgccactgcactccagcctgggcgacagagcgagactccgtctcaaaaaaaaaaaaaaaaaaagatttgactgccctgttggattttgggacttacatggggtctgtagcccctttgtttttgtcagtttctcccatttggaacagctgtatttacccaatgcctggaccccactgtatccaggatgtaactaacttgattttgattttataggctcataggcggaagggaccggtcttgtctcagaagagactttggactgtggactttgagttaatgctgaaatgagttaagactttgggggactgttggaaagtcatgattggttttgaaatatgaggacatgagatttggagggtccagaggtggaatgatatggcttggctgtgtccccacccacatctcatcttgaattgtagctcccataattcccatgtgccgtaggagggacccagtgggagatatttgaatcatgggggcagtttcctccatactattcttatggtagtgagtaagtctgagatctgatgattttataaggggtttcccctttaacttggctctcattctctcttgtctgccaccatataagacatgtcttttgccttccaccgtgattgtgagtcctccccagccacgtggaactgtgagtccattaaacctctttttttttttttttttttttcctgaagcggagtctcgctctgttgcccaggctggagtacagtggcacaatctcagctcaatgcaacctctgcctcctgggttcaagcgattctcctgcctcagccttccaagtagctgggattacaggtgtgcacgaccacaccaagctaattttcgttttttagtggagacaggtttcaccatgttggccaggctggtcttgaactcccgacctttcaagtgatctgcccatctcggcctcccaaagtgctgggattacaggcaggagccaccgtgcctttctaaattacccagtgtcaggtatgtttttttagcagtgtgaaaatggactaatacatcaagccatattatattgctctcaaatgtgtttggatgatgtggaaagtgaaccctctcatatatcagttggagtataagttggtgtttggagggcaatttgccagtatcaaaattaatattgtcccagaaagtaactcacatatacagtcaattgattttttgacaacggtgccagcaccattcaagggggagaaaatggtctttttcaagaaatagtgctgggaaaactggatgtcctcatgcaaaaaaatgaagtaagacccttgtacaacatacaaaaataaactcaaaatggatcaaaaacctaaataaagagctaaaaccataagactcttagaagaaaccagagggaaatcttcatgacatcagatttggaaatgatttcttggatgtgacaccaaaaaacaggcaacaaaaggaaaaataggtaattgaactttaccaaaatttaaaatgttgatgaggatctggagaaattagaaactgctgcttgtaatgtaaaatggtgcaactgctatggaaaaactatacagtggttcctccaaaagttaaacataatacaaaatttatataaatatttgcaaataagtatatataagtgcatcattataatagtgaaatattagggaaaatctatatgcctgttatagggaatttgctaaatagtgatatatccatacagtggaatactgtgcaaccatttaaaaataagttagatggctctctaagtcctgaaatagaacatattctagggtataccattaagtagaacaaagcaagatgtagagaagtgtgcattctccaatttttgtaaaaacaggaaatgcatagaaagaatcacagggtggcaaaagtagttctttctaggaaggagttcaaggttgagaggaagagtaacttaattgtatagattcctttttacggttggctttttatttatttacttatttttgagacagagtcttgctctgttgcccaggctgaagtgtagtggcacgaacatggctcactgcagcctcaacctcctgggttcaagcgatcctccaacccagcctcccaagtagctgggaccacaggcccacgccatcatggctaagtttaaatttttttcttctagagacaaggtcttgccatgttgcccaagctggtctcaagctcctgggcttcccaaggtgctgtctcagcttcccaaggtgttgagattacaggtgtgagccttcatgcccagcccagtttggctttttctgtaccactgaattgtttactatgtacaggtattataagtgaattgaaaaaaaatgtaccaataattttcttttatagagggatctttcatatcacctctgtctacctggaaagtaagtagtaggtaccccctccctctttaggaaaacaccaaagaatcactgctcataagatatctgcttcagcctaatggtccctgccaggggttcccattccctgggccccggaccagtacctgttaggaaccgggctgtgtggcaggcaagtgagcataaccacctgagctccacttcctatcagatcagtggtagcattagattctcataggggcccgaaccctgttgtgaactgcgcattcaaggaatttaggttgcacactcctcatgagaatgtagtgcctgataatcagagccacagttccattgggaaaccatcccctttcttcccgacccccagtctgtggaaaaattgtcttccctggtgccaaaaaagttggggaccgatggtctatgctaataaatgtttagggtaaaacagctttcttaaactgcaggctcctcctgtgcataaagatacgtggttactttgacaaatagcttatatcaaaaatgtaaataagtgaatagttttatttttaagcctgaaaaccatttcagaggttatatttgataggaaagtcagtgactcaaatgaaaggaactaaggtccattcaaagacagggttgcagaagttgaagtagaaaaggtgaatttccttagagctttaagaaacattgttcaaatggagtgcaggaacaaccataaatatatagtatgttctatgaagatataaataataatgaggccttgaagagtttgtcctgaggtgggcaaaatacctggtttagaaaatggaaacaaacaaacaaacacatgggaataactatgcaaacacaataggaaaaatagagttttacttttgttagtgagcaaatacagcttcccagtagtacagtaaatacaagccagatggctgagagcataagatcatagcagaatggggaaaaatcaactgaacaatttaccagtgatctgtctacattttcacatttagttcaatagtaataaaaagaatgctgttggattcactttcaagtagatgaatttacataatgccagtttctgcttgggtataatgtggatttttttgttgttgtggcaaatgataatggaatataaaatagctttttacttttcattgaacatttctcaatgtatcttctttttggttataactgttagaaactgtctatctggattctataaaggtcatctctatgtgtttaaattttatgtctgcatttctagtaatactcattagaaattagtacatatgctgtaatacccaagactattgtttttctatgagtaaacttaaagtagtacattttctctcacagggtgtacttgtgttataaatttgtttttatagcttgcttttgttcatttttttaactttaaaaaaatagtaattggaacctttactaaccatcagtagtcttaattttcactgtgaagttaatgactgattcattttccttgaggattattgttctcatcaataggtaaaataagagtaggtaaaattcccctagaacagaaaactccaattctcatgtacacactggtgttgaaagtattaataagtttaacttttatggaaggcaatttgtcagaggttaaatgcaactaccccttgacttgtcagttacatttctagaaatttacattttagttccaaaaaatgccaagttctatgtacgaagatgtttatcataacagaattggtaatgacaagaaaacaaaccgacctggaaatgggagatgtgtatgccataatcatgcacagcaaccgttgaagaatgaggtcatttgatgtgtactgacttagaataaaatgtccactataaatgtttgaaaactaagctgtagaacagaatatgcgatataatagatttttaaaagtatgaacaataaagtttcgtttatatatgctgagaatgtgtgaaagatgtacctgactttgattaaaatttattttgggggaatggtatgtgaatattgagtatgtgttacttttatagtacattttcagaaatcaagaatgtagtataaagattaagagccataaatctgagtctcaaaatatttcagccctatcagataatgctgctattatttgtgtgtaatacagggagtcttgagtttagaattagaagccctagattgataatctgggactatcactcaactagctgcaagatcttgggagaaagccagttttctcttttttttttttttttttttgagatggagtcttgccatgttgcccaggctggagtgcaatggcgcgatctcggctcactgcaacctccacctcccaggttcaagtgattctcctgcctcagcctgcggagtagctgggatttacaggcacgcaccaccatgcctggcaaaatttctttttttttttttttttagacggagtctcgctctgtcccccaggctgcaatgcagtggcacgatctccgctcactgcaagctctgcacccctgggttcatgccattctcctgcctcagcctcccaagtagctgggactacaggtgcctgccaccatgcccggctaatttttttgtatttttagtagagacagggtttcaccgtgttagccaggatggtctcgatctcctgacctcgtgatctgcccaccttggcctcccaacgtgctgggcttacaggcatgagccaccgcgcctggcctccatgcctggcaaactttttgtatctttagtagagacagggtttctccatgttggccaggctggttttgaactcctgacctcgtgatccgccttcctctgcctcccaaagtgctggaattacaagcatgagccaccgcacccagcagttttctcattcttaaatgaaattcatgtaaagtgtttacctctagtaagtgcccaataatattagctgttttaatgctaaaatatcagacaagaaacaggaataagttatgatgataaaaacatatgggcaggtgtagtcaaaatatttttttgaactgttgaacttcttgcccgggtgttctgaattatggtattgcatgaccatagaaaatagtggtaaagcagtctgtttacataagccactcagctacttgttgctattacccttaatttcagaaatattacacgtggtacttcttgaacgttaatttgctgagaaataagcatgttttgggatgagtactgagttcagtgttccatatttggcagttgataaaaaaatatgggttgctgagtttcacagcataagttatttggcaatggtattatctcagattcagcttttaatgaatatttacaatattaatatcttatttttccttgatttttttttctaagaaaagcccagattaaaacaaaaatggataaagtataagtgagtaactatggcagctcaattgtctaagaacaaagaggcaggcatcagagtctttgattcctgtcctaactcagcaacttagtaactctgtgtccttgagtaaatcccttaacttgtctaagccacaaaatggatcttagtctatgtattggagctatgatttttaaaagttgttttgagcataaaatgaaatgaaggatgtaaaagtgcattataaacttgaagacactatgctgatagagattacacagctccttctaatcaagactttcttggcatagtttattaaatgacataaagctcattatacaaattttctcaatggaataagacagtaacggtcaaatgaaacataaatccatgctaacgactatgaaatcttttggcctagctaaatgtgcagactatataatccctttggtagcatatgtatgagtttgtgacctgaaggctgttgtattgcaagcagatttttataagtcagcaaagacatctgaaatcacatcacaattccagtgttaatgagataactagctgcatcactgctacccttccttggctcttgggtttagggaaaaccttaatcctcaaactaacataattcacaataggttctgatgatgctcaaatgtatataatctttagttccatgaataaattgcatactagagttactcactttcattttgcatttgcagactttgtgttcttacattgaatgatatgttttctaatcaactgattcctttaatgattaattttaggcttaaacataatatttacaaaagcaggaaagtgcaattgaaaactagcaaagactaagacaattagtatcaaccccattttatattgggaattaaaactgttttgaagatgacagcacagccgaagtaagggttttttctccttatcacaaacagtagtaggcattaatttttagaagtagaaaatacctttccttatgcttgggaaataaatggaattttttacaaaataattacaggacttggagtagaaagtgaaaaattaattttgtggtttagagtattaatttgctctaagagttaataaaaggaaatgggaaatggacaaatcagatttgtctagtcaacactgaatagattcctcaaagtattgaatttgaaacaattggcacacatttaaattctaagatctctatagcgagtaaaacttgaagttactttttatctcaccttcctcaaaagtacccttaaccatgcacctggagcaaaggaaaaaccctttctttttattggtcttctttagctatcacagggactatttgggcagtggctatactaatgggaagatgggattataattaggttagttttcgttctttctagacccatgtctttatttgaaagttctttggattcctgtggtcagtgatacagggaaactctaggttcttaacagtttccaattattttctcaagaattccttaggttgcaaaatattttgatgcctttatggataagagatgggctggggttagtgacccagtgcattttttcatacccccaattctccccatatcaaccctttctctacccgactctgcacttctctaattgggtattatgtgacaactaactcttctctgcattgaatatattatattgttacttatccaaaaatagttgccagtaatttttcctagtagttctggaaaattcctcttccttaaagatgcaggaaaacagttttactgaccaagaggtgttttttcaaagacccaagttgagaactaatgctttcaaactcatggcctcaatcagtcctcctgcctgggtttcccaaagtgctgggattatgggctaagctaccactcctagccaggaactaatgctttagatctactggtactcaaacattattgttctttggagtcacttggtgcttcaaaattattgatgtctaggtctcactgctgagattttgatttaaatggtgtcggtgcagtctgggtactgggatttttttaaagctcttcatctgattctaatttgcagtaaagtttgaaaaccactgctctagtcaataaaacaaaactaggcaaaactccaggaaggcaggaagcttgttctccactgagaccccagcatgtaaaatggtaaacagtaggcacccaacaaatattttttgttgcaatgaaagaatatactttttaagaatcactgtaatttaaagaataaaccaagcagtgattctttgaaataatccataggagctaatgataagttagtgatgaagtatggattcttttgtgtatgtatgtagaaaagctgatgctagataatcattttcaaaaattatagataaaaatctttgcatgaatatcaagtggaaatatgctatcatttcccttatgcatatttgcatttaaaataacccacagggacaaaatgattttcccactgaagctaactcttaccatgaaatatttctttgatttagttattttctcctttatctcctgaagattttttttttttttggcttgccatatgcatgctattttgcttttcctttgtactttgggtttttgtggtgtattttttgaggagggagatttcttttgcaaataaaggcagcactctgtctctccttttttcaggaaacacctttttttctgtgtgatgcagtcagtttttgtcatttccactttaacgtgaactaagaagtcatccttttcctgtgaacaggaaatttcccagctgttgataaactgtggagccgcctgtgaaaaagggcaagatctcagaattccttctctcgattctacatgttctttattgctttctacatattgctgatcttttcatttctaatgtgtaccatctgattgacgagatggtgacttcctgtttgagagttagctccattctttgtgtatcatacccacggtgatagtactttgtgaggactgtggcaacagtgctgtgctctcctctgatgtaaagggtaagctgggaaatcaagacattgaaaggagtattaatttgaaaataattctatagcattttcttggggaaaaaatgctcaccacctcctctcttttctaaacacaccatttgaggatatcactatttcctttgtattgagccttttatgtatgttgaactatcatttggaatatgatctgctgatgtacctgggcacctctaatcagcatctaagtatctagctcatgattcttttcagtatcacaaatccattctaaagtggaactgtaggaaggatctgtcatattactgttaaattatcattggttgcaaaagttttcccagtgcctacaacactgtcttccttctttccttgactctcatcttttaaaattatagtttataagtgacatttaatttataaatcacttaaaaattacattagatccattgtgaagtgctctcttttcacctccattaccttgggcctgggttaggtgccttgtctgttagctgacacaggatcctatgaaagataaaggaaattctatttttttaaattatatgttggtaccatggaaacactttcagaaatggaaaactaaagatcacccatacaggccgggtacagtggctcatgcctgtaatcccagcactttaggaggctgaggcagttgaatcacttgaagtcaggagtttgaggcctgcctggccaaaatggtgaagtcctgtctaaactaaaaatacaaaaattagctgggcgtggtggcgcatgcctgtaatcccagctactcaggaggctgacgcaggagaattgcttgaacccgggaggcagaggttgcagtgagctgagtgcgcgctgctgcactccagcctgggtgacaaagtgagcaagactctgtctcataaataaataggccgggtgcaggtgtctgtaatcccagcacttggggaagccaaggcaggcagatcacgaggtcaggagttcgagaacagcctggccactatcaccatatagagacaccccatctctaccaaaaatacaaaaattagccgggcgtggtggcttgcgcctgtagtcccagctactcgggaggctgaggcagaaggatcgcttgaacccaggaggcggaggttgcagtgagccaagatggtgccactgcattccagcctgggtgacagagcgagactctgtctcaaaaaaaataaaaaataaataaagatcattcatacaagtatgaatttctcaaaggccaaagttggttttgtctttcttgctacaacctgtttattctgaagagtacaaccaaacacattagtcccacatggctttttatttagggacatcatgatgaaaggttattctgtggactctcaaagtacttgtcatccatagacttgctgacacctcgtcaaggctacttgaatgggtgtattacacaggcttggtcaaagggttaatgcatgctagaaatgtgaagtgaagggaatagagttgaggcttgggaacatttatgttttttagactgcgacttcctgttcagctgagaagatagtcctgtagctttgctgttagctaaggagacagtcttgtaagcttgacagatcacagctgtatcctgtactttgtgtgaaaatgtacttgctttccctcctgttcatttcgtttttctaatttcctaatatattaacgtttattccagtgtttgatggagtaagaagttgggtatatgcccacatgagaatgtgaataatagctaagtactaggttgtaggcagatagtggattaaatatggagtgtgtgtgctgcaaaaactaaatgacaaggaaaaccccccctctgaataaaattttacaagaaagtcccaaaagcacttggatattttagcctagtgctataattgaagcagttgtcttatttctttgcaaatcagataatttctttataaagaatcaaatgcttgctctgtgttctaaccattccaccattttattctctctcaaagcttgaggacaacttcgggacatttctttcatctcactatcctaaaaatctttgccactggaacaatattaaactacttccttccttgggattttgcactctgtctgagcctaatatgctagtagattgtgtctatcaacacaaattcattttttgacatttggacagacagaacttgaagtttttcagtatctcatctcatttgaagtggatgtttcattgttgctatagaggaatgacaattaccgtgttctataggaggtggattccaatttaagcattctttcctgagaggcaactttaaattttatagagtagaaagagtactagcctgaagttaggttacgcacattctgtatgaccttagatagtgacattgggcacctctgaattctcacaagtgaaaagaaagaattggactagatgacctttaaggtccttttgaccgtatttgacattcactgagcctgagctttgtgctatgactatgttgtccctctcattgtattagtgcctattactctgaaaaacccaccgctatataatatgaaagatgagaaagaggtaagccagctgagctgtttaatttagaaagatggagccatggtgttccagatggtgaggctcatccagcagagccataaatgacagccaaagtagatacaggtaatgctgatggcttcctgacagtgtatgtagtagagagggacttatgggattgacttactgaatgacagttttattggtgtagtgcagcctggaaaagggttgtcagtcttttttttgggtggagtggtggtttctgtgtatgtccccttaatgctaattgatgttgaaagtataaatgagacaggattgactggagtcagctttcctttgggaaagcagaatgatagcatcttcaagaagtacttttgcaaggtataaagcaaataggtactgtacttcatagacacttctgcagtgcccataagtgctgaaatagatgaaattcaggtgcttgtagaggaaggaatatccatttgcacagagacctaacttaacaaatggactggctaattaagggttaactatttgcttttcttttgtattgctgtattatctttatctgggtaccataatcatccttgtaaatttctagtctgagatacattctacactagacccattataggatattagaattgtatgaaatcttcaagggcatctaattcagtcctctcattttcacttgagcaaagtgagtgctagaaagactgagtaacttaaccaaaatcattgtgggagttaaaatcagagctagaactggaactagaacctagttctgctgactactagatttttactgtcaagaatgcaaattggccaggccagacacggtggctcacacctataatcccaacactttggggttccagggcaggaggatcacttgagcccagaaattcgaggctagcctgggcaacaggaggacaccccatctctacaaaaaataaaatatcgaggccaggtgcagtggctcacgcctgtaatcccagcactttgggaggccgaggcaggcgtatcacctgaggtcgggagttcaagaccagcctgatgaacatggagaaacactgtctctactaaaaaaaaaaaaaaaaaaaaaaaaaaaaaaaaaaaaatactaagttagctgggcatggtggcacatgcttgtaatcccagctacctgggaggctgaggcaggagaatggcttgaacctggaaggcagaggttgcggtgagccaagatcatgccattgcatgccaatgcaggccattgcactgcagcctaagcagcaagagtgaaactccatctcaaaaaaaaaaaaaaaagatagctggctcgtgagggtgtgtacctgtggtcccagctattaggtggctgaggtggaggattgcttgagcccaggaggtcagggctgcagcgagctgtgatctcaccactgcactcctgcctgggcaacagagcaagaccctgtctcaaaaattaaataaaattaatacaaacctacctttatatatttgaaagtgtgaaatgtacccccaaaattttcaaaatggtaaccgattttaataaattagtgaagaagacaaaattagttttttctaggaatcttcctcccagcctttgctcttcaataacgtatcagaaagtagcattctaccagcagatacgtttccatatcacactctaccagattcttaaactatgagataaaacagtattaggcaaaagtagcataatatggatataaaatttctattacactgagaattcagaaaattctcttaggacaagattggatagggcaagattgtgtaaccctgaaatgtgttagtcttgaacagatatttcgggatctgttctgattatctctccccagcagaaagattgtgattaagggaaaaaataattcttaattatttgttgtgggttagtggttacatgcaggtttttgttttcattttgcataatttagtttcgaacaatgtcttcattttttttaacgactagaaggcctaatttagattttaagtgttttgtgaatgtgttgttaatgtttcttatcactgaaaaatggcatcaggagctgaagatgggagaagctgttgaattcagacaacagaatgcattaatactgtaacactgctgttggccacagtgattgaacattgtgataatttatgctgcactatgtatttaaatccattatattgttgaggtggagaagcggagttaagtagtgtactgatttcagacctaaattttcttgaatttctttatttattatgcctccttgctaagtagttgatattacatggatcacttacattttgtataggagtatatatagagctcatataggagaacttagattacttcttataagaaattggatacgaaaatgctttggttttgtgagaaagaggatttaacagtgtctccagagagctaagctaaccaacagaaaaaatggcatcaagttataaattcttgctatagaaagaggggaggcttttctttcttttaaatcacttaattttttcagataaacttttaaatgcaagtttaacatatatatagaaaagtacagaaatcataacagtacagcttgatgaatatgaatatatatattcattatatatatatatatatatatatatatatatatatatatatatataaagtgaacaccgtgtgtaacctacctaagtcaagaactagaatgctagcaacaccctgctctgggttctcaggcatttctcctctctctgcaaggcagccataatcctgacataatttagttttgaacataccatattctaaattcaaagtttagttttgaataccatagagtagtgttgcctgtttcaggattttatatacatggaatcattcaatatctactcttttgtctccagcttcttttgcccagcattttttttcctgtgggatttgtctgtgttgttaaatgtaacagtaattcattctctttattgtatgtactgtattccattttatgaacataaaataattcatttagataatggtcattcagattgtttccagtttgcatctattaaaaataattctgccatgaacatccttgttgtatggtttttgttgttcatatccatgcagctcttttgagtgtatttctgggagaggagtggctggcttacagggcatgtgtgtctccaacttttgcaggtaaggccagtttcccaaagtatttgtactaattgacataccaactctgagttccagatgttccacatccttgccagtacttgatattaagttttttgtttctgttttcattttagccacactggtaggtagatagtggtatctcactgtggctttaatttttatttcccttataactaatgatgatgggcacttcttaatgtacatactgggtttttggatgtgcttttgcaaagtgctgttcacgtcttttactaatagaaaaattgggttatttttctttttattattgatatcagtggtctaaaaagatatattctggattatcttttttcagatacccttaaaatgttaacatccattcttaaaatccaaagttaatagctgtctcttccctttttctgaacaatacaaggatcttaaaacactcttattttctattcttatcttatatgctattattaaccagggtattagttcaccttgtttttaaccacctgcatttgttattgctatttttttatacagtatttttaaaactgcatgtttcccagcctgggcaacatggcaaaaccttatctctacaaaaaatacaaaaattagccaggggtggtggcacgcacctgtagtcctagctatgcaggaggctgaagtgggaggatcgcttgaacctgggaagcagaggttgcagtgagctgagatcttgtctaggcgacagagcgagaccctgtttcagaaaagaaaaaaaaaattacaaatttctttactcactgttgtttcttccatcccagcctgcccttccagttttaatttctttcttcctagaatttgtcctttaaaagttcctttagtaagttcataaaactttttagtgagacagtgttttattttactcttattctccaaagatagttttgttagatatacaattcctagactgacatcttgtcacagcaatttgaatatatttctttgtctcattgcttttatttagtcttcttttgaagtctgttgcaggtttaattgtcagtcctttgtaggcagtctgtccctggaccactctgcaaaaagtctctagccatgatttccttgaatatctcctctgatctatttcctcttcaggaactttggtatgttggactttactaaagtctcttagtgtgtgtctgtctctgtctgtctctctctctctctctctctctcattttttcttagcctctctctctccccttttttttttttttttttgagaaagaatctcactctgttgcccaggctggagtacagtggctcgatcttggctcactgcaccctccgcctcccaggttcaagtgatcctcctgcctcagcctcctgagtagctaggattacaggtgtgtgccaccatgcccggctagtttttgtatttttagtagagacgaggtttcaccattttggccaggctggtctcgaactcctgaccttaaatgatccacctgcctcagcctcccaaagtgctgggattacaggtgtgagccacggcgcccgacctcttttagcctctcttctgtatattctgtttctttgtgtctctgtgcttcattctcgctagttttttcaagtatgtattttagtttactctcttgggtctcatgtactgttactccattaagttttttcaattattcgatagtccttaaaatctgctggtctttatagcatcttcctttctcatgcttctaattttatctttaagggttttgaacacttaatttaagggtcttgaaacatgaagaccacttcatgtttctctcttgacttggggttttctggaccatgctggtgtataaacccaaatctcaaatctttgtgagtgtaggcctattgttacagattagcaagggagactttttccattcagcgttctggaaaagacagataaggctttttgatttgagtgtttgtttgtttttgagagtctctctctgtcgcccaggctggagggcagtggcacaatcttggctcactgcaacgtctgcctccgaggttcaagcagttctgcctcagcctcctgagtagctgggactacaggtgtgtgccaccatgcctggctagtttttgtatttttagtagagacagtttcactgtgttagccaggatggtctcgatctcctgacctcgtgatccaccctccttggcctttcaaagtgctgggattacaggtgtgagccaccgtgcctggcccttgattagggtttttaattctctctgttaagggatagatttttttttctttctttttggtcaatcttttaactaagaatgaacccttcaacattctgggttttttttgtggggttctctgtaactccccatcttttagaagtctgttacaggcttcgataagcatagcccacaatttgtgagtagaagaaaacctggtttctagttgttgactatgactctgaaattcttttgtaaattttaagcagcttatatttctttgagatataattgtctagaattttttggaaattctaaaacgagtatttccatgagcgtttcttactagtggtgtgatctatataatgacattatgttgagagaggtttgtatatttagatccctcttttgcactctagctacaaatttttgtttacaaactggtaagccaaaatattaaagctacacttggttgctctgttctgactgtgttaagaacacgggtctaggtgcactgattggtttctggtttagcaagcacaccttgacttttgtattatggtgaaagcaaatgcttgttaactgtatagtgccttttaaaaaaattcctgtaggaagatattaatgcttagaaaaatcagtagatttgattaataaatcatctataaaaaacctgaaatatttttcaactttcatttcctagagtgtagtaaaggcagtaactgttaaacgtgaaatcaaataaagtaatttgcacctggaagaaagcctttctaaaattatttctgtagtttctagccacatgattgaaaaatacaataaatgtatattatgttattacttctcatttgcagtttttataaactttaaagcaacttcagaggtgctaacttgggccttctttcttccctccacctcccctttttatttaaagcatcatatcatttattatattggaccagcaggaatgagtttaaagaggttgagaactgtttcagattaataacttggaaatatcccacaggagtcacagtattgcttatcttggattaagttttaagaatccagtcattgagaattatttctataagctgccatatttaaagttggagtgaggaagaaccttacactgatccacataccccaaaattcgtgtcagtgtactttatggggatcttgtagtttgaaggatggcatggtccacaagataaaaagcttcatcatgacagtcaataagtaatgttctgggtttacatagagtttatatttctttcctcaaggttctcagtttttcattttcatgtataaggtatacatcgcttttctaaaacaccaacaatgctagattatttttgctttgatttgctttgtttttttcatattcctttgaatgatttagttattacttctctttgtttaatattttttaaagggataactatttatcctaactttctctatactggaaaaacaccccctttccttcccccatttacaggattgtgcaacctttcagttaaacaaaaccaaaattgttcacttgctcagtgttccacccccttgaaataagccacatagctctctatgggtgtggcccagcgtctttggctgccacagttacttgatccccttatctcatgtcacccttggctccctatattgtctcttcatctggtttcttagctcctccttttcccgcttccaccgagtttttgtactgctcctgtcactttgcttctcagaagttcagaagcaattgtcatgagcttttccacctccccccctcctttctctgaatcttctgaggaagttacagttggccctccacttctgagggtttcgcattctcagattcaaccaaccacagattgaaaatattagagtaaaaatacagaataactacttacatagcatttacattgtattaggcatcataagtaatctagagatgattcaaagtattcaggaggaagtacaaagttttatgcagataccacttcattttatatcagagacttgagcatcctggattttggtggccatgggaggtcctagaactaatccctgatggatacctagggacagctgtacatatacactgtccaaagaattcattgaggatttcctactccaggattaaactcctgaagtgaacgttttgaaaggcaaaaggattttttcttttttgtcaaagtttagatgttgtaggtgtgaattcattagtataaagtacttacagcccttgctttatataaagtatatgctcctaaaaagttggctagtggctggtcatggtggcttattcctgtaatcccagcactttgggaggctgagggagctggatcacttgagcgcaggagtttgagatcagcctgggcaacgtggtgagacctcgtctctgcaaaaaatagaaaaattagctgggcgtggtcatgtgagcctgtggtcccagctacttgggaggctgagctgggaggattatttgagcccggggaggttgtggctgcagtgagccatgatcatgccgctgcacccagcctgggcaatagagtgggaccctgtcttaaaaaaaaaaaattgcctgtatctcagtataacatggttaaatgcaggtgcgattactatttaagacaacctggcaaggaatctttaaataatttacataaataatcctaccttaatttttccattttaaaggatttttcctctcaggttgtcatgattgtatatgctgtaaatgatctgcatattcttcttcataaaaatggaagatttgttatttatttgtacttcagtgtggaagcatcttaaacattaaccctgtggcattttctcatcaatagtaagttgatcaaatgagtgacccagtctcagcaatttaacatatcatccctttcagctttaaatgtatatttaatcaccttagcccatttttcaatccacaaaagtaacctttctcatatatcaacagctttctgggccagtgaaccttagaacttaagtgccttacaaaacataatgcttattagttgtgttttttttttccccttcccaccctctcccattaaatctaccttgcttatacttgatgcttttaaggatttgagctcatagggtgtagtataatgtagtgccaccttgaccatgaaatttgtttactgaccttagtattaacctagaacattcttatgcctcttttcatggtgatgtggtgtcagattacaatttgactggctttcaagataattggtcttaattatttctaagtcattggttaatgcagtgtaagaacaagcattgtttaaaaaagaatataaatggcttttgagtttcttttcttagcatgcaagtcagattagagtgaaagcaaaagcacatgacacaaaactgtggttcgctaatagattgtaggcttcctgtagcttaaattatacacaccacagtaaactgttacccagtggcaattttgatttcccttttgtattagttgtaatctgtgatacttttatttaaagtaaagccatgtattaaaagtttattaaaacatatattgtctttttttaatctttttcctcttcaccccatacatatatactcattccttttagaccaagctccagggtaacttgccctgtaacctttcaaataggctcctttctctgaatatatctgtagtatatctgtagtatatctattataataacagagtgtgctacaattgtctctccctctcccctgccccaacccactaaattgctagtattttagggtcagagacaatgtctcgttcatttcttacattttttaccatgatacctgttcacttgtagcatgtaatagtaggggaatgaatagttagtagaataaatgtatttaagaaaaaagtagaaaagaaatatatggtgaattgatttaccaactcagaatttaaatataaatttaaaaaatctaaaatcaaagtaggttatgtgatcagtactgctgtaggttgcagagaataaattgatactctacactttagttatgtttgggagcagtatgtatgattctgtaaactgaaatccctctaatatgtacagaagaaatacatttacagactagttttgtttttgttttcgttacaccttctatcatgccactgagtatatagcaaatctatcaaccattgagtggaaaaacacattaagatgcttgaaggcaggcagagttatgcaggggttgaaggataaagattggggggtaggggtgcagataaccaaacttgtctctcgccctgtcttggaaaaagcttacttatcatatctgaggactcttaaagcattaattttagaggctgggatgtggctcttgtcatatacaggcagcccaagttctacagctagatctcagagaagctgagagtgttagtaggcctacaaacacatcatgtgggtttttttttttgtttgtttttagttttttgttgtttttggggggggggggtggggagccagctttgcctcctacctatccaacagcagtgtttgaagctaagtgcttgaatttgttttaggaggataatttttagaaacattattgatacttaaatttcccaagattaaaaaaaaattgggggaatggcttttactgggtaaagtatttgaaacgtaaaacatatttttccaagtaaaatgatgtctcatagttggaaaaagcaatttaaaaatgcctacagagccccatatccttagatggaacagctcaaagcaaaagtaacatttttaacaaattgcaggggagagggtttcagtccaacaaaataaaaaggctctttaggtttgctatagaacattgtacctataatcaacagtaatgtatacttaaatttaagaggatagatctcatgtattcttgccacagttaaaaataaaagttatacctcaaagatttagaaagtaaaaacaaattgcatgtgtcatgaatatttcgtatattgtggctatatttcattttgtttttacttgttttctattccgttttagaacttttcccaaaacagaaattattcatgattgcagatttttttaatggcacaaatagatttattcttcactttttattctgtgcttttttctttttcatgtagtctgtgtcttcacaaggtgttaataaaatgcatagttttcagaagtactatgccatcagtagagtcaaagccatattatgtctttctacctctagtttggcaaccttgaagatacaatacaacctcactagtttggtgaatttttgttttaaatggggatcatgcctaatctttagacctaatgacttactgaatttcaacctcagctttaataagctgaacttaccaatcattgtaggttatgttgtgtacatttttttatccagaaaaagcctattttgaacattaaccatatttcacttatccccaaccttgccttttctataattcttcctttttaaatcctggattacctgttttaacaaataaccatctatcacatattaaataggcaagggacattattcatttaccatgtataattttatttatttatttatttttagacggagtctctctctgtcacccaggctggagcgcagtggcgcaatctcggctcactgcaagctccgcctcctgggttcacgcaattctcctgcctcagcctcccgagtatctaggactacaggtgcctgccaccacgcccagctaatttttttgtattttttttagtagagatggggtttcaccatgttagccaggatggtctcaatctcctgatctcgtgatcccccagcctcggcctcccaaagtgctgggattacaggcgtgagccactgtgcccggccaccatgtataatattttttaaactcctttttcaacccctggtctaggtcctgaggggccctgccctcaagttgcacactgtacgtgtgagaggtatacccagggaacagacagttagtgtaaggagtgctatgttggaagtaagccagagggttgtgggacttgaggctttaccgggtggaggcctgtaggaggcttttctttacaaatccgtctttgcaggagaggctaaaccagggcatccctcaaataggaaattatagaatatagtcagaaatgcctgcagacaacagttggatttcaccaacttggatagtctctcattatcttctgaagcatgaacaccatggtcagcatttttatcaaggagttatctatgtggtattatcacttgtgagaacagttaactgggagaacaaaagctctgagagagtaagagctactcttgagcccttctacagttcaagggacatctctgaattaaaactataggatggcagactgtttcatgaagcttcctcctacatagaactcacacaactcttacaccttggctttggtttactttttgtccaggcctttttttctccccttgagttttactccctcagctgaatcccacaactgagttttcttcaacctagaacctccatagtgtgtgtaaaattggcctattgtgaaaatcaccagggatgaaaaaatcactgttcgacttatctccattgccactagttgtatgaccttatttgcttaacctctttgagttttagttttctttttttttttttttttttttcgagactgggtctagctctgtcacccaggctggagtgcagtggcattatgtcggctcactgcaagctccacctcccgggttcatgccattctcctgcctcagcctcccgagtagctgggactacaggtgcccaccaccactcccagctaattttttgtatttttaatagagacgggatttcaccgtgttagccaggatggtctcgatctcctgacctcgtgatccacccgcctcggcctcccaaactgctgggattacaggcgtgagccaccgtgcccggccctagttttcttatctgtaaaggaggcatcatgacagtactaccgatagggttgctgtggaagtacatggaataagtatgtaaagtgcacggcacagcagtctaaattattccagtggcactttaactgctgagcagcatttagatctctgaggacacacaagtttgcacagttggtttttaatctttttagtatttcatgcattttactctgatcatctccttgccccctatttttctgtcattttgctttcctttttggagagtgttcatccttagttgttttgtttttattataactaaatgcctattaccattcagcacttaacggatggtttcagtgggctaagctctaagctctgtgctatctgttggaatacaaaggtgctcccaactgagtagaggaacccatggaagcagccaccttcccacccccgactaacatgaatttaacctgatttaaacagtttagacagaccttttttttttttccttagccagtcttgtagtagatggagaggttactttccatagacatttcaagctagactgaatgtcccacagagctgaagcttgccaagcaaagctcatctctgtggctgttttaagtcactaatagttataccacatttctagaagttggtgtcaccatcagccaaagattaaacttgtctcctctcctcccccaacccgatatatccttgaccagatgatgtttgttcaaaaggaaaagcccttttttttggttttgtacttttagtctaccacatgtttgagatgcctagtagttccttaacaaatcaaactttgtgacttcgggattcatagcactttagttggagacagtttctcattgtgctggtttgatttctggcacttgaaaacatctccatttggaagcttatggaatgtttcattcactcccctatttggagtagacagtttgtcttctcttcattgatcaagccctagaccctagtggtgcccagagtgagtgtcctgtctatgttgtatttgagaatgtacaggcactaggagtgcgtgaactcttgtgcagctgacgttgattggagggcaaaaggggaaggggaaggcccttaggacaatgaattcagtcatggggctacctcatttcctttttttttttttatcttaaacaaagctaaaatatgttttcaattactttgtttttaaaatgctatctttctctttttgctaactttcataacaataactaatcgcaagtcattttatgtactgaaaatacaatatgacagaatgacattttacaaaatttaaatgaaacaaatatttgaaataaaattggagttggaggacaggagagaagggggatagcatgcttcatgagttgcacacaagctcatactttagttgttaagcctctggcactcagtagagtatttttatttaaaatctacaaaactgaggaggcgggagggaaggagaaatttcactgcttgaaagttaccctagaagattggatctgtaaatttacatgaatccctgaaacaggcgtgtatgtgagtgccaaataatatcaagactaaccaagaaaaacttgcttttctgcatgattgtggtggaagcattggttcccaacaactttcacatttataaggattttttaaagggactaactacacattgggcaagtagctgtgtagtccagagtattggctggatttaacatactgagggcatgtggattcctaagaatgtcacaccttgtctgtgccagtaaatcagagtgtctattcttgatactaaatctgatatcattggcagattttctcctttattggaagggtgatattcagaagggagaatattttttcatgtattttgctctctctgtgattggggtgtttttatggttttttgttttttttttaaagctatgaaataatactggcaagtcccaagaaaactagatctggatttcattttgtctcttcaactctgtgtgatcttgtgcacattcctgacatgttacaaacagcttgtgtctctgaatgtgcagtatcaattttcagtggtgaaagccccaaaaggaaacagactgattcttccatgcacaaacagctgggcagttgtggatggaattaattgctgatatatattggctgtgtttttcttctcttgtcatttcctttgcagctgtgaaagtgaagtttggcttgaaaacacattctgccagtgcaaatccaaaaagtatcaagacaggattcttctactataataaccaactggtaactttgaattgttagtttgaggggggagatgaggaagagccaagagatagcagcaggtgattgataattacatagatggttgaaaaaataaatcatgctgttagactatgagaagagtatgttggaatggttaatttatcatgtggcaagagtgacctcataatccaacaaaggcaagatcaatcaacagcccctcactagggtcctgagagaggatgttctaggccatctctcaaaatattgaaatgttcaatactccagactgaattattgttccaatgtgagagagtagctcttggctagagtaacatgacaacatgcatcattaaaaataatattttcctggtgttctctcaaatccttttccattgttcattttaaattctatgtaaacaattacatagttttttatatgcttattttactcaaactttaattttatgattataggaattcaattaaaaataactcttggttgtgtttctgaatatgcgtatacagaaaacagtattggttaaaatcacttgaataagtatcagatgtttgttaatagtttcaataactgataaattattttagatcctattaaagatatttgtacagtatttatacatactgtggaaaactttttaaaataaaattcctacaaaattattgaaaaagtgggtgagtataaaattttttaaagtatggtatgcataataaataattttcttttttacatgtacatttcaatattctaccagagcaactccataaattcaaaataaatcttattttgaagggaactattgctagttgataataaaacgtttttattgtttgtgtattgctaggagaactagagcactggtgaggagagaaagaggtaatttgtgttcatggtcaggacctccagaaacaggctgaagtaatgttttagaatgagcaatgcttctgacaccttgagatatgtaaaagctgctgttgctaaacttagaagttggcatggttggacttcctttatagtactctacttccatctaacattctgttggttgaactgtgtgatctgtcttgcattttatctttactttcttcacaaacaagaaatgagaatacattttacttcaaggcaggaaagctgatctacaaacatgaactctcccccacttttttaggaggactaatgaattaattgtgactccaaggctctgaaaaatgtgtggcaatattaatgtgcagtttgctctcactgaagtctgcctgggtgtgttgtttcccccagagtgagctccacccttgctctaaccacattgagtgtggatatcttgctctttaaaacaaagttcattgttagggcagtattgcaacagaattgccacacaaaaaccagcttaagaaatgtacagcacttcaatttttttgtaagtaatggattgtctattgtaatactgattgctcacagcttaaggggaaacacagataagatagatggttaagctttgtgccagctgctagtaacatgcaatattcttctttgggaggagcctctggctttatcactccactaagttttttttcttttagttcacttgtctgcttttttttttctttctctttcttaaacagtttactgaattgttatttttaacgattttggggatgacactgactgttcaaatgaaggcaaatagtattctcccaaatgtgctagttatttaacttgaaaatgcttgaagcagtgttttgtactgaatttattggacccattaatagcataatctggcaatactgtatttcgagacatcgtgacatgaactttgtgtgtaagagtgggttcattgaattaaaaaaaaggcagcttctaaagagccttttatttctgtcataatgatgctttgtcctgttgctgttgggtatttgtcagaagagttggggcaggctgcagcccaaagttctgttccatgcctcatcagttccgtgcttctgtgttctttctagagtttgtgacgtgaatggtgagttgaactataggagaattattgttgttcattgaggtccatgttcagcaattttttttttcgcaactgggggtctgtctgatcttttttccccctcacacactgagtttctctttgtacctgagttttaaatgcctttggagtgtttaattattcactgactgaagtgggcatgtagagagagagaggctgtgctttgtgttatctatactctctggtgtgtggtcatgtgtacactttgggtagacactcatttggtgcaagcaaactgaataactgcctctgttgaaatcaaatctgaatgttgaaaatggctaatttctgtaaggcttgcaggggtgacattgtgtcatcctttttgaactaagacttcttagcatctccttgcttcagcttcctcctttttacttggtagtaattggatttagctgacttctaacttcataaggatgtaagaataaagcacaggtgtggtatcatagcaaaaagcactagcctgggaatcaagagactgttttacctctttggacattagtttctttacctgtacagttaggaatttaggttagcctcttctaagatcttttctagctttgagtaccctaattttctttgtaaagacacatgactatcccagcaatgctaaagggaatatgctagaattgagagaaaaatgtttggatgttaactcagtaattcttataagtgacatgaaaactaaagctttactttaagaagttgtgtctgtcaggaattttgaaatttactttttaatatctgagtagtagaactagctatataaatcatctcatcagcattttcaagttgaaattaggccaacctcctgccacaagtgttttcgtggacctggctactcgtggacattggctactcagtgtacagctattagttgtgtagccttgggtaaaagtggctttcaaacttttttcagtatattttgcatcatgacccaatcatgacacacacgaaccactttacatctctgaaataaatctctcttacaacacagaaaatgctattttctgttatgtttcatttcaaaaaatattggttacaatgtactgtccctttgaactctggaggaatacagttaaacttcgacttttacagttatgctggagcaaagcttgccaacgaatttgctgttaaatattgaaattagaagatttttaaatagatttttatttggaactttaatagaaaatcatagttaatatctccattaatactcttatcttttcctaaatacataatataaagaaaatggaatattttttaccaagccctgtgaatctgcccctcagtctcctcctttttactccagtctgctatacaagctttgtcttatttatgcataccctattagtgagaactaatagacataccatgacatgaaaagcattgagaaggcttttctagagaactagatataatgtgtcatgtacattagatatagagtgtcagattaccattgataaaccctttctttatcttcatcaccagagttgtctcccagagctccgtggaatttcctttctctgctttaacgtacttttaaaaggtaattttactaaaaaatgcatatggtaaaaagatgaaataatataaaagggcatgtgacaaaatgtttttcccaccctaatccctcagccccactccccagaagggaatttatttttcaaaaaaatgatgagagagagagagagagagagagagagagagagagtgtgtgtgtgtgtgtgtgtgtgtgtgtgtgtgtgtgtgtgatctacctgaacatctttttaatacatataaaattataccattatgtatctactcttttccttttttttttgagacagagtcttactctgtcacctaggttggagtatagtggcgcgatcttggctcactgcaacctctgccttccaggttcaagcgattctcctgccttagcctcccgagtagctgggataacagctcggctaatttttgtatttttagtagagatggggtttcaccatgttggccgggctggtctcaaactcctgacctcaagtgatccacctgcctcagcctcccaaagtgctgggattgcaggcgtgagccactgcacccagcctacttcattctttttaatggctttatagtactttattgtgtggatggatgtactgtaactcagttattcctcctttgatggatatttggatcatttccaagttagttcccatcccctctccatcagacgtacttatgctatcagtcttctcctacctccgttttgggatagaacccagaactggggtactatagggaaggtataatagtgctgtgtggaaatagaaaattcccttaccaacttctatgtatcagactagggctccaaaactaggccgcactatcccaggcattcatgggtcggggtgggtaagaactgccccaggaggaagtcatttctcctcagagcagtgaaagaacattgggttcaaagtcgggtaacttgggtgtggtattggggtgggtcacctgacctccttgaatcctcagttttaccatctataaaataagagattgaaatagatgagttttaatgtcccacccaacttcaatatttatgtagtatttttgttggaatattgatttaaactggataacccaaattatatgaagtttctcatatttaaattaaaaacatctattgtatatattgtgtggtctgtaatttatttgaccttccatgtggcctaagctattttaaagtttaagaatgtaaaaaaggaaagttgaatatcattctatattttacataaactatccttttctcaaaagtcaatttcaaaagtataaaacccattccagaattaaaagcaaatcctttttatcaagcttgaatatttgaggaggaagattgtgaagttatgtttgtttttaaaatggatccttataatttttcagtgagtccgaccattcagaagtaatcctagggctttgaaacttggcttcaggtttcttgtttaaactgtttgcacattctagccctttaatccatctccttgtttcgttaaatgctaaaactgacattacttaacataattaaagttttcagatttgatgctgaggaagctgctttagaggtgaactatatcctgccagcaaagttacaaagttacatggcaaagttataaagtaacaaaagcagtatttttgctgtatcacacataggatatttagcattgggtagcattacctgtttcacagttttagtttcataattcaatcaaatgacagctgttctaaagataaaatgatgtaaggacttcaattgatttgtgtaattacaactggaagataaaagacattttcttggccaataaggtaggagagagagtttgtatgtttgtgtggtggttaccttagtttctttgcagaaggcttaatataccttgaatatacttttctataatctgagatattattattattcaaataatgctagataattattagtgttccttgttaattttcatacgcattttttgacatacaattccacttagcaaaatgtatcgaagaccttctagcagccaagcactgagttaaatgctaggagtacctaggtaactgagacagtcttgcttagaatcctctaaaatgacaactgctcctgttccttgcgttgttggagctttctaatatccactggtgattggaacttggcaaaaaatatatatatatttaaattcgaatctgtgaaaatagatgaaaagtatgttttcagtgtttaaaaagaaggtcttaatgtcttagtacagtgtcagttactttggaggcacactcttctgtatgaggctctgctggtgacaccagtttctcactaattgaactctaagtaatgctgtggtgcttggactaattaattgaggctaaatttttgtctactaaaacgtatctgatgtataaaaaactgttggaattattgtgcttcacctattatgattttttaacaattgcttatatgaaaccacgcttgaaaatggtcaccctctgttttgaagatacatcctgatggcttctttgtcaaattaccccatccattgtggcatgtataactaaggaaattcttcatagttagaaatatacaggatgctgctgtctacaggatgttgaacaaactttgaagcatttgaagccattttaggaaaacagtcctatggtggcaaaatcagtcaaatagattgtagtttgagctgaaacagacattttaaacgagagaaggggaagtctcattaccctggtctgttacgcagtcccagaaggcactgctgtttctgctttggagcccagcatttggctagggtcctgtgacacacagtgggaattcacttcctatcaggaaatgctgtttttcaatgtattatcttgctgagacaaccacagtgaacaataggctattaacgttttagaacaacaagtgtcatgactaagccaatatttgctttgttttgagtatcactctaaaaaaaaactttggctgagcttcagaatacatttgaccatcagtaactgttgggcataaaagtcatgacagttaaaaagatcagaaaaaaaatgctttaatagtggttatgaccttttgcaggcttagcttactctacacacttcctgtccttagatgagaatgaattattttaaacataccttttgggtatgaaaaatgtccatttaaagacctattttgagttttggaagccatgaattcaagttctgtaaaacattaaactgtcttacgagatagcttattcggtttacttctctccacaattattaataaactggaaagtccttaagggcaggaatcagagctgtgccttaaatagtctttataacctttttctaacacctgaattagcatttgctgattgattggatcagtagtttctttggtgtttgaagataacatttttgtatcattatttgtacgtggtctcaaaacatggcggtaaatatagatttttagaaattgctctttttatgtatgtatttacttattttaagtatttccagataccgataatgctcttctcatatcttcacactttttttgtgtaattacttttcagtcagcttaagacatttcatattcaggtcacaatattcattacctcaaccatcttggatacttggccagtcttatcaaaccacgaatagcccagttttcagagtttgctctagaatccctgtcctggtttattctaagacaagtagagaatgggggtattatgagtcaagagccttactcacctcagtgagttaataaacccttattgagtaactctaagtggacagtaaagaaaggaaaaaatgttgacccagttacttggagccaacagacatactcagataattaaaaggcaatacagactatgacaaagtgatttgaacactaaggttgcggggagagctaagatggaggaacttaggaaagtcaccatggaaggggttggcttttgaataagaattcaaagtatggacaaatattggatggacggatggagatgagaggggaaaacagtccaaatgtatgagatatggtgagcatcctggctaacacggtgaaaccccgtctctactaaaaatacaaaaaattagccgggcatagtggctggcgcctctagtcccagctactcgggaggctgaggcaggagaatggagtgaacctgggaggcggggcttgcagtgagccgagatcgcgccactgcactccagcctgggtgacagagcaagactccgtctcaaaaaaaaaaagaaaatagaagaagaagtatggtgagcaaagcaacaatcggggatggcttttttttaggaagagtcatttccctctaaacctaattaatagggatggactttgaagtctttcctatcgttttttcagggcctgaattttagaagccccaggctgatagctaagtattttttaaagatgggacttcctggatgcttttttatttccttggggcagggactgaggaaatggtgtttttggaaaactatagtagttggctttgtgcttctttgttgcaaccaaggatcccagggttgtagtactcttactaccttttaaaggtttaaaataacactttctagcactttacaacttgacagaacctttcctagacaatagagatcaaaagtagacacaaaatatttaccaaactctggagagctacttaagttactaagctcctcatagatagctttttatttgacaataaagtacttgatgtaggctttaagtacagctaaatagacactatagaactaagctgtgagtctagtctttgtgagcctcagaaaaacaagagtcctacttcaagctggaatttaaaatatagcaagcaatttcagtggaccttttaggcatgtgtgagtgggcacaaaaagctgagtcatgaagtttactcttcctggtgaattaccatgaaagcttgaaagaaaagcactctcattattttaaaatagtaaaaattgttttagattcttatggaaataacaccaacaaaatgttttgtatattaatcatgagcacatacctagaaaccctttaaaatcaagaaattgtaacatgaggcattacctggctttttagagataaaagttaacagtttatttaatgtacagtagcacctgaaatgtgcttaaaattgtgcttaccaaaatctttagttaaataaatttctaagtgcagttcatgttttaaatttttcttatatgaacagatcatatggtctacagtcttatgtatctcattctaatgtagataaagtgaaaagtattgggtaagataaattgagggacttgggacacgtcactctctctctcaggatctgttctacctttctccatatgagaaatgaggtagaataagatttgataatatcttacatccttttaagctctaacatctttaaattctaaggatagtattcctcttttggctctcattaggtaatatcagggaaaacaactcctcttgttggaagagttcttatttatatttacaaagcaatgttgtttctctacaatcctaacaaacgtatgaaagttattctttgttgttttaaagtctgcatttctgttgtttttgataaactttcctccataaattaaatagttaattagtttaatgttttctctttttcctgaatttgatattagacttctcaggtctttttccagattttctcactttttattgagagttcagtttccagcagtggactggagacttgggttgttgtctctttatcttctcattatttccagtttcttcatgttagaaataattttaattcccccccattttttgatatgaattagtttggtgtcataaaatatcaatgtatacatacatttttagaattcttgttcatatcaactaggcctacttttcaaagctaaatcctgttttatcaggaaagagcctagacctctttaaatgcacccacaagcttgcatggcagttaatgtccaacacagttcaaaatgaaataatggggcatatataatctggagaccaggatctagagaactttttctaaagttcataattatagtttagattacactttgttgaagatttaatttggtgaatacccaggggattttactgactggaatccaggtaaacagtcaggagcagattcccagaaatgggcaataggaatgagtccaggtatgtgaacagtcaatatgagtgagattcagtaggtgtcaaactgtagcacataggcagagtttagggacagggaatttttggcaaagggtggtaattggtagaagtccagatccaatcagtaccagggagatctgcatggcatcggagatctactgccatatgcaaagatgtgagctatcaggtgacctcagggaacagtggcaaatgatagaagggtctaagactgagacgtgggccctagggttcaggcatagaccttcaattgtaaaagtatttgaagttacctgatagagaaacaagaaagtgaattaggctgcttgagagtgagtggagtggctcagaatttaatgattaagaaacagacttgggccgggcatggtggctcacgcctgtaatcccagcactttgggaggccgaggcaggcagatcacctgaggtcgggagttcgagtccagcctgaccaacatggagaaaccccttctctactaaaaatacaaaattagctgggcgtggtggtacaagcctgtaatcccagctacttggacggctgaagcacgagaatcgcttgaacctgggaggcggaagttgcagtaagccgagatcatgccatcgcactccagcctgggtgacaaagagcgaaactccgtctcagaaacagaaagaaaaagaaaaaggctgggcgcagtatctcacgcctgtaattctagcactttgggaggccgaggtgggcggatcatgaggtcaggaggtcaagaccatcctggccaacagggtgaaacctcatctctactaaatatacaaaaattacctgggcatggtggcacgtgcctgtagtcccagctactcaggaggctgaggcaggagaatcacttgaacccagaaggtagaggttgcagtgagccgagatcatgccactgcactccagcctggggacagagtgagactccatcctcaaaacaacaacaacaaaaaacaggcttgatatggtttggatttgtgtccccacgcaaatctcatattaaattgtgattccaagtattggaggtggggtctggcaggagttgattggatcatgagggtggtttctaatggtttagtaccatccccctagtgctatctcatgatagagttctcacaagatcttgttggttaaaagtgtgtatgtagcacttcctccttcgctcgcttgctctcctgccaccatgcaaagatgtgcttgcttccccttcacctttctgccatgattgtaggtttcctgaggcctctccagccaagcttcctgtatagcctgtggaactgtggtaaattaaacctctttatagattacttagtctcaggtagttctttacatcagtgtcagaacatcagagtgggaacaactgcaagactgacttgatgctgagagatactaaactagtttcttagggtttcccataatccaagggtcccagagcctggcatgaacctgcaagatgtgggttcagtggtctccaatgtgagcagaatagcagaaatgcagcatgtatgtacacatggcaagaaacccactcgctttagaaagtggcttttattttttttttatttttttgagactgagtctggctttgtcacccaggctggagtgcagtggcacgccatctcagctcactgcaacctctgcctcccaggttccagcaattctcctgcctcagctttccaagtagctgggattacaggcgcccaccaccacgcccagctaatttttgtatttttagtagggatggagtttagtagagatgttggccaggctggtcttgaattcctgatctcaagtgatccacctgccttggcccctcaaattgctgggattacaggcatgagctaccatgcctggtcctgagcaagtggcttttaagtccatccttgcttaagtgaaaatatattccgtagtattttatgatttagtaactgctttaacagtgtttccgctatgatggaagcagtagagcctgctgcatctttaatttgtggttggccttcattatgaatcttcagttttacaaagaaatttttgttcatctgatgtgacaagaatgttcatatttttcttgctttagatttccttggaaacactgactgacagggtagttggcaaaggtcatgccattgtggaaaaccagaatgttgcattgtacttatgtatatcagatgtcttgttcaggttagtgttttgacgatttgttatttctgaagagctgacattgattctgcaaaggtgtgctatctattcacactgttgatggtaaaatgctttcaaaaatagatattaggatggaaattcctttggaacagtatatgtgttagtttcctagaactgctatataacaaagtactgcaatcccggtggctaaaaacaacagatctattctcttacagttccggaggccagaggtccaaaatcaaggtgttggcaggattggttcattctgaggggtctgagggaaaaatctattccatgcccctccccgggcttctcatggttcccagcttggtccctaggcttgtgctgcatcggttcaatctctgccctgtcatcatagggcttttttcttcctttgtgtcttttttgttacttggtgtccaaatctctctcactttcctcttataaagatactagtcgttggatttaggactcaccctaatccagtatgatctcaacttaatttgatctacaaaccctattttcaaataggccacactgtgagcttctggggacatgaatttttagggaagacactattcaaccactatagtacagtagtatggctgaatgtcaatctttagatctaaaagatgatacatttgaaaaagcaagtttttgacaaatccgttttgagaaacagatttctgaaattgataaaaatctctttttgtgaacttgcacttaaaaccatcaaccaattgctaaagtggcaggttataaccaaaaagtatttttgcaagtagttttcaagtaccattatctgtgcttaataagatgcattttcatggcacaatattaggcgtttcataaacaaaacagatcaagttgtgatgatcttgaaatgttccttagcagccaaaatcggaaggcagaaactcctccttcaaatccaactgctttgcagttgcagtgtgttgagttgcctacagtttttggattgacttttgcagctgtattttttataagttatgaaagccaaaagtctttagcttgaatatctgaaatagtagatcaaaatgaactcttggtaattataccctgtggttctttaatatttttttgtgtattttcctccaatttttaaaataaggaactttgtctcatttttttgtgcctttccatccctccctttcccccaccgtggcacgtcacaatgactgtattaggaatggaacacagaaacatagtccatggtaacaaatcagtttcctagactagccttttcaatgcatatttattttgcagactcagctcatttttaataataagctttgttggattatttgcatttcttcagttaaaatctaatttcagcttgtgaaataggtagatgtaagattggaatttggggaagttaaatttcctatattatttgtatttgaatattcatttgagaaaaggtccactgagatttgtagagtgggtatgcagtaaagtatgaagtatgtgagagttgatgtttctttaaaaaataaaaataaaaaaaaagctttttgcctagaaagactaccaaataagaatcaaagacttacggtatctcctgaaattgagagcaatgaatgtttatttaaaaataataatttctagtgattcctctttttaaaacctctcatttatcatgagctgtcaagctctggatagtttcctggatctcaattttaaaattttctctaatagcagggaactcaacagaaactaaatgtctgagacgcacatctaagtaatcaatccactagtctctgtcagctttctctaaggaaggggttgggatgtggggtggggaacccttcttttgtttctcaaccattttccaaaactccacattgaagacaaatggtgactaagggaatatatatagaatgttcattatattttgtagaaaggagagtaaaggctcaccaaggctgtgtgtctttgggttctgtaagatacttgagggattgcctttctgtggttgattgttttactcatttcataggaatatatatatatgtacacacacatatgtatatatgatatatgtttataatatatatgatatatatataaaatcagtttcatatttacttttccaaatggtttatgttgggaacaattcaagttaatgttagataatgattaatgattgagtttggacttgaagaaatactttctctgaactttctgtacatgttttcaactttgtaaccctgccccttgtatggccattgtaattggtaaatttgacctaattataataaagatttttatttcaagttaccagtgaatgttattttcacctctaccaatgtctaagcaagtaactgcctctcttcctctcccaacccccaccatcacctcaagtacagaaatctgtttgcctcactgttccttgtaacaggtaacgtagatcaataaaatatccttcgtcgttagtgacacagaggttagactgatcctcagcattgtccaactctgtctttagtctttgaatcaccctgttgaatgattatgttgatataacaagcacctacttgactttttttttttttttttttggcagacagagtcttgctctgtcgcccaggctggagtgcagtggcgtgatctcagctcactgcaaccttcacctcccgggttcaagcgattctcatgctttggcctcccaagtagctaggactataggcatgtatcaccacgcccagctaatgttttgtatttttagtagaggtggggtttcaccatgttgccaaggcttgtcttgaactcctaagctcaggcagtccgcctaccttggccttccaaagtgctgggattacaggtgtgagccaccatgcccagcccctacttgacatttttttacttactgttctgcacctacattatgaacaatgtgtgtgttatgactacatctaactgctttgttccaattgtacaatcacaaggagactcatgtttgccaagagtttatattaattcatattatatttttatttgtaaaacaaaatttgaaactgaaacaccctcttagctgtggcctccaattgacacatattttatcttttttaaatgactgcttagtcagacatcaacttccattaagtacagaacatttagtaccgcagtgggttgctgttactattttattttattttgttattgttgtgggggttttttcccttgactttaagttggattttaaactaaggctcagtcctaacttttactaaacaactatagatttattatttcctggactttatattgaggtttagaatttagttttattttaaagataacaagtcatttcaaaagaacaaaaacggggttcaggaatttaagaataatacggatcaatctgacaattccagcagtaggccagagaggtaggtaggtttccacatgtgtaggtttgatagccatggaagactttgtgcaaattttattgctacttttagaatatttactatttccactttggtattgagtattgtgatcatataatattttcatcccccctcccccaaataaagtcagtgatctaatggctggatatatctttaggaaatgatagtcctttgagccatctcatattttttggctaactccaccatgcctgttaagatctataaccatgagtaatttccttatttgtgagaagaacctttggtaatctgagacaaatttattaaacctcagtttttatactacaagactacagtaactaaaacagcctggtactggttcaaaaacagacacatagaccaatggaacaggttagagaacccagaaataaagccacacacatacaaccatctgatctttgacaaagtcaacaataacaagcaacggggaaaggattccctattcaataaatggtgctgggataattgactagccatcatatgcagaagattgaaactggaccttttcctttcaccatatacaaaattcaactcaagatggatcaaagacttacatgtgagacctaaaactataaactctaggagaaaacctggatttcacgatgaagtctccaaaagcaattgcaaaaaaacaaaaataaactagtatgacataattaaagagccttctgcacggcaaaagaaactatcaacgtagaaaacagacaacctgcagaatggtagaaaatatttacaaactatgcatccaacaaaggtgtaatatccagagtttatgaggaacttaacccaacaggtaaacaaccccttaagaaaatagtctcaaaggacatgaacatccacttctcagaagacatacacacaagtcaacatgcatatggaaaaatgctcaacatcactaatcatcagagaagtgcagatcaaaaccacagggagataccttctcataccagtcaggatgactgttattaaaatgtcagaaaataacagatgttggcgaggttgtggagaaaacggaacacttatacactgctgtccagccactgtggaaagcaggaggtttctcacagaatttaaaacagaactaccattcaacccagcaatcccatttactgggtgtatacccaaaggaatataaattattctaccaaaaagacacaagcgcaaatatgttcattgcagcactatccacaatagcaaagacatggaatcaatcacctagatgtccataacagtggtctgaatgaagaaaatttggtacatatataccttcgaatactatgcaaccataaaaaaaacatgaaatcatgtcctttgcagcaacatggatgcagctggaggctattaccctaagcaaattaacacaggaacagaaaaccaaatactgcatgttctcacctataatggtaactaaacattgaatacacatggacacaaaggtgggaacaatagacacccggtctacttgagtggggaaggtagcaggagggtgaaggcggaaaaactgcctatcaggtcctctgctcacttacttggcttatgaaatcatttgtactccaaaccccaatgccgtacaatttacctatgtaacagacctgcacatgtaccccctgaacctaacataaaaggggtggggaaacattatgttgtatactttaaataaatataattttattttttaaactgaaaaaaaaaacccctcagttttcttatctataaagttggggatactggtcgccttttcatagagttgtgaaggatttttcttggaggctggagagacagagtctcactctgtcacccatgctggagtgcagtggtgcaatcttggcttattgcaacctccacctcctgggttcaagcaattctcttgccccagcctctgagtagctaggattacagacacatgccaccatgcccagctaatttttacatttttagtagagatggggtttcaccatatttgccaggctggtctccaactcctgacctcaagtaatccgcccaccttggcctcccaaagtgctggtattaccagcgtgagccaccacacctggccagagttgtaaaggatattaaatgagaaaatctgtatagagcatagtacctggaattctgtgattgctttaaaatgtttcattaaattactgcttttgtagtttagacatgtttatgtatacatgcatttctatttagtatctatattagaccaatttctattaccacttatttcagttggtgtattatacttgtcttaactctttaggtcccaacaggatatttttctgaggtttgttttgtttcataatacagccctcaactcttttaatatgatgctaaattatattaaagtgaaacttaaatacaatttattattacccagagcacagtcaatgtcattttgttaatagcttctaattaagtcatagtggtcatctgtcaggtaaagagttaagacttcctatatactgatcaatagccaacgtagtctccttttcagatggacttgagtcaatttagtggtccgtaccttgcatgtagttcctttttgtttggaactcaaagttgtgtggaatgttccatgacattttattataccatttatctgcctgctcattgagcttcttcatctgcccatctcctaatactctttgtctttatgcatcttatttatatgttttgctaagtactgatggcaaagatactaagtgtctttatggtgtgtgggtgtgtgtgtgtatgtatgaaaaatatatagttatgtgaatgtggtctttccctgtatctcaaaatcttattgtactatattcgcctatttttgaacagtggttgaccacaggtaactgaaactgcagttaaggaggggaactactgtattgataaaatgttagtgagtactttttaatatttaatgatgtacttaaaacttgtccctttggtatttaggtcaaataaaccaccattatacaactaccccacttgtacatctatttttctgtgcatgctaggcaaacggaccattaagtctattacaagcactagaattttagttcttcttaatagcctgttcctctcagtggatggtatttataaaatacatccataaacatggcgtgatgggtctgttttctttcttatatttcattgaaggagtaaattttgattatggggcaatctggatgacatggtaatgctaataaacatcattattatgattttataatatgatatttgagcaatgtaactttagaaaagtcactcaacaccactgagtatagtttcctctcatctgtaaaaagtgatcattgaatctagtctgaaatatttcaagagaagctcatataaaatcaatagccttttaggaataagagcctagtgctttgtgggataattaagtttttctccatttgtgcacttagtgccatctgtattactcagtgctgctcaatgccaggttcatttgggttttttctcccatttttcttcatttttatctatttctgcttcaagttttcagatctgtcaatttccatgtcagttgtatataaaattttggctagcatttaaaagcagctcatgtcttttagaacttaaaatgaagaaaatttcactagtgatctaaggatagtagcttgtcatagtttgtgtagggtctaagttgttttctagaacttcaaataactttaaaatttcatagtaactttcatcaagaaaaactgaaatagcatttgttgttttgttttttaaccaaatatgctgctttgcggtcttggcatatctttgattattctttgaagtgtggaaaaataggtctggtagttgaaagtacagccatctctttgcttattctaaagaaagctattcaaactgccaagaattttaagtttggaaagatttttttgtaagtaataacttcttttcaaaagattgtttttactattcccagcctataaataatgcaaaccagatttatttggaaggagttgtgatatagtaaagtaacttaattcagcccccatttatggagttctcgcccattgtgaggactacaagagagtccccattcccaagcttgcaaggtggtcagtagcttctcaggttggatttttaaaataacagttttatggagataattcacataccatgccatttggccatataaagtatacaattcagtggtttttaatatagtcacagagttgtacaactatcaccacaataattttagaacatgttcatcactccaaaaataaatctcattggcggccactcctcattttcccatagtgcctggcagccattaatctgttttctacctctatagatttgtcttttctaaacatttcatataaatggagtcatacaatatgtggtccttggtgactagcttctttcacttacaatgttttcaaggttcatccatgctgaagcacatatcagtattccatttccttttattgccatgtaatattccactttctggattaccatatgacaaaatactatactttgtgtttgtcagttgatagatgtttgggttgtttctactttttcctgttaatgaaaaaatatgctataattttataatagtcaaagacgagaaataaccagttgtctttgagtagacaaatgattaaacaaataatgatacagccataccatagaatagcattcaacagtaaaaaggaacaaattattgatatgacagcctccacaaatgttcagtaaatgattgagtgaaaaaagccaatccccaaaggttttatatgttgcatattttcatttgtataatattctttaaatgacaattatagcaatagagaatggattagtggttgctgctgattaaggagggagtggaaatgggcattgctattaaagggcagcatgcggagtacttctggtgatggaaataatctccttcttgactatattactgtcagtgtgctggttgtgatactgtaatatagttttgcaatgtgttgccattgggagaaactggggaaaagggcataagggatgtctgtgttatttattatagattattatataaaaatatttttttggaaaaaaacaatactcagttggctctttcagcattctacctagaaatcttagtgagctccacattcgttaagcatgttttctagttttcaagttaacacattcttgttagtttgtgctctcattatgcaacataaccctctctccagtctccagtagcagtctcctcactgccttgtcagcctccactaatagcctccccactgcctaggccccagagctaatgccaggttttcagtttttgttattacagcaccagtaacaccagttttcactttagttatctgttgctgtgtgaaaaacagaaacaacaacaaaaacaaagctttgtgtgtttaacaatttattatttctcatgattctgtatgttgactgagtagcaccttacctgcttttacctggactcattcatgttgcgatagttagctggggggggtctgctgggaacctggcttactggggacagctgggcctctttctcctcatttttcattatgggcttcttcatggtgtggcagctgcacgaccctcaaagtgtataatgtcacttcagccacattgttttagtcaaagcaaatcacaagtccaaaccagatttaagggataggaaaatagtctctacttcttagtggaaaaagtagatcgcagggaagcatggaagaattcttgaggccgtctttgaaaaacgatgtaccacagagcccaaatcaggagtccagctcatctagaggcatctaacaggtaactcaggtggaaagggctctacaagtggacctgaatacaagcaacccagattgtaagataggcaagaatggcactagcagtgctggtgagctcagaattgaacataggggtatttttctcagtctgtgaacactttgggttaatttgataatgaacagctttacaaaatacatggtatgagcatatgtcagatactgtttaagtatattaacagttatacaatgttactacctctgttactttgagttttgagggttcttatattaatctaagtggattgggaatatagctttcatatgtatgactgtttttgtttaatagctcaggtattgtttgggggttttctttttgtaagtgtgttttgtatcctatcttacctgtgagcaaacttttaaaaattctttggtgaggaaagaacatggtatactataaaattcaggagggccctgaaaattgtggtattaatattttcctttgactgtgttgagattggatttgtcttatattggattaatgtttatgtatatattttggattttttgtgctttgttttgaaattatttcagacttacaaaagagttggcaaaaatagtgaaagaattcctgtttgtcctttacccagattccctaaatgataatatcttccataaccatgttgtaattatcagtttcaggaaattaacattgatgtaaatactattatcaaatttacagattctatttaaatttcaccaattgtctcactgatgtccttttcctggtctaggatctgatccaagattacatgttgcatttaattgtcacgtcttagtctcctttgtcttctttaatctggaacagttccttacagttccttagtctttgtttttctttttttttttttttgagatagagtctcgctctgtcacccaggctggagtgcagtggtgtgatctcggctcactgcaagctccacctcccaggttcacaccattctcctgcctcagcctcctgagtagctgggactacaggcgcctgccaccacgcctggctaatttttttgtatttttaatagagacagagtttcaccgtgttggccaggatggtctcgatctcctgacctcatgatctggccgccttggcctcccaaagtgctgggattacaggcataagctaccgcgcccagcctagtctttatttttcatgaccttgacatgattgaagagtactggccagttgttttgtacaatgatcctcaatttaaggcagtcaattgatttgattcagaggagcctggtcttctgtagttctgctttgaaatggttgaatatactgaaacattgcagaaatattattcttatctatgaataataatcctaggagttggatggctaagggactggatagaaatgtaatgattgggagtatttttaagtggctctgtgtttagagtatctgttttataggtacttattttcaaaaatcctcccccaaaaatgtgctttcagatgtataattcatagaatcataaacagccctttgtaatatcctcagagagcttgaaaatgtttttatctttctgcagtgctgacattgatgtgttttaaatgggtagacattgtgctatttgcaaagccttctatctaaactaagcagatagttgtaacattttatctgtgactggctaaagttcttttaacacccatatttcttaaagcaaattgtgaactattttcatgaatacagaatttttttttttttgagatggagtctcactctgttgcccaggctgcagtgcaatggcgtgatctcagctcactgcaacctccgcctcccaggttcaagcaattttcctgcctcagcctcccgagtagctgtgattacaggcacctaccaccacgcccaactaattttttgtattttcagtaaaggcggggtttcactatgttggccaggctggtctcgaactcctgacctcgtgatctgcccccttggcctcccaaagtgctgcgattatgggcatgagccactgtgccggcctgaatacagaaacttttttgcctcactccatcgcccagactggaatgcagtggtgtgatcatggctcactgcagcctcaacctcctgggctcaaggaatcctcccacctccacctcctgagtagctaggactacaggtgcatgccaacacgcctggcttttttttttttttttaatttattttgtagagacagggtttcactatgttgcccaggttgatctggaactcctgggctcaagtgatcctcccacctcaatctcccaacatgctgggattataagcatgagccaccacgcccagcttaaactctatttaaaaaaaaaaaatacaaaaatgtgatttactgtaagtactatttttaaaatattaatatgtaaagaaatatgtaataagctacaatatttcttcaaaaaaatcaatcttactctcctctctagcatatattcattctcaattaacatttcctaccccttctcccttccgtttccttcctgaccataacttagagtttctagggcattgtttttcaagttgtgggtcacaacccattagtggatcatcaatcaatttgactagcgtgtattaaaatgaagtagattaaaatagaaaatatcggaatataccacatagtaagggaaagtatgtcattaatttatctcagttatgtatcttatatatttgtatgtgaatacaatataaaatgtttgaaagccaccattctggagtgtttcatctatttgtgtcttgaacctaatgttttttaaacatgcatgttggatagttgttgcataaatatttgcataagatttttaaaactagaattctgtatatacatgataccttgtttctattctgcatggccaaaggctacatcagagggaaacccttagtgttcacaagttttataactactttttaaaaattcgttctttgcagcactttaaaagaatgttgtttaagactattttttccctaatgtaattcatactggtttgtactagttcctattactctgaaatacttagaaagtatgactttgcatatgtggtattaaaagtaggagttgggggccaggcacagaggctcatgcctgtaatcttatcactttgggaggccaaggcaggaggatcacttcagcccagctgggcacagtggctcatgcctataatcccaatgctttgggaggccgaggtgggcagaccatgagatcagtagttccagaccagcatggtcaatatggtgaaaccccatctctacttaaaaaaatacaaaaattagctgggcatggtggcacgcgcctgtagtcccaactactcgggaggctgaggcaggagaatctcttgaacccaggaggtggaggttgcattgagccaagatcacgtcactgcactccagcctgggtgacacagtgagactccatctcaaaaaaaaaaaaaaaaaaaggcagttgatgacattaacgtaatttaattgaaccatgagtttctgttagctctgaaaatatcaattacaaatcgagcattataatctaagatctttttatatgaataaaaaattgttctaatatttttgagaagctactttttaaagtgcacctgttaactctgagggcaaaatgtaaaagttctgcttgacccatgtaaattttgaatttaatgaatttatcatggatgtccttctttgtgtttattaatgcagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgtgagttgaattagaaggctgtaatttttctccctctttggaaatgttagtataataaggtagaagttttctcaaactaccctcaggttaaaagaggggtggaggaggagtggtgaccagttgcttccagtctttcaaaggagaaatggacatctaatttgtgtatttgatttgcagagccttaatgacaacctagtattgtgtttggtggtttaaattttgtgtgttttctgggtatagcactttattaaaggaggatacccaattcagactgaatatgtaaagaaaagaaaggcatgactcaagtcataggaaccaataaataagttaggtatatcccatgcacgtattttcttcttcctttgggtaccttgacgctcagagtggcatgagaagacttaaggtttttgaggaagtctgtgatttggcagcctagtattacatatgtctactgcaagcacacgtgactacacactaaattaactaaattaaaagtagattataggccaggctcagtggctcacagtgtaatcccagcactttgggaagccgaggcaggaggctcacttgagcacaggagtttgaaaccagcctaggcagcatagtgaatccttgtctctacaaaaaaatttaaaaattaactgggtgtggtggtgtgcacatgtagtcccatctactcctgggaggctgaggcaggaggatcacttgagcccagaaggtcaagactgctgtgagccgtgatcatgccactgcattccagcctgggcaacagagtgagaccttacctaaaaaaaaaaaaaaaaaaattcaactcaagtggaaaaatcctgtctgcacagcaatagtcagactttgtgaatcatattcaaatgatctgttttcttacaaaatcttagtggaaatgtattaatacatgatggaaaatgagagaacagcttgatttaaaatgcaaaatgaatttgtaactttctgcatgatgaagatcatgcacccctaagacagagttcagcacacagacatatgatgcccaggttagggttatattaggtttccaacttgggtatcaaaattagcaccaaggcatagagctgcctgaagtagccctggtaaatcatttttgttgtgtccttgtgaatttaatcatagaggtaagtccaaaaccaaaggggaattccactcttaagtaattaattctcccataccagtggcctcggtgaaagcattgaagtacaagttataaaagcaatgtaagcattgagtaattttattttttatagtgcccactttaaagaaactctttccaaatggaaagattcatcagaaaagtcatgagagagtaaatgttcagtgccttactttatgcaaacttgagtgtctaggtttataaacacttgaagagcacattaattatttagatcaaaaatagatatgtttccttctccaaagaaaccccatttttaagaactaacttactagatcggaaatggtggctcacgcctgttgtaatcccagcactttaggatgccaaggcaagaggattgcttgagcctaggagtttgagacgagcctgggcaacatagtgagacccagtctttgcaagaaattaaaaaattagtcgagcgtggtggtgtgagtccgtagtctcatacttgggaggctgagtcgaaaggattacttgagcccagtagatcaaggctacagtgagccgtgatcacactacggcactccagcctgggtgacagggcaagaccctgtctcaaaaaaaattttaaaagaacttatcaaccaaatgattgtagtaacagcatattagtaactgaaagaatgaagtgaagtttcaattttggttaaggttgttaaatattgagatttctttaggaagtatctcaaagaggaccgttgaattctaactgtagagtctaaatgaaaaaaattactaaactccatttttatgccagggtttttgtcttatagtttgcccattaaactaaagttgcataatgttaagtagattaatttttttgtatttagtatttctatttgtaaattggcttaaaagtaaaaattttacttatgccttggggaacttagtgaaataatgtgaaagggcaaacgcatagtgtatcatttccctattcacttaacgagaatgatcactttctgcccagagaggaacaaagaaggctgagatttaaaagaattaaaagttgatatttttttttcctagatcttggctaatgaatttaaaatcttctttgtgaaagacttaagaaagtgtatacattttgtcttcctgccatattttaggacagtggtttttaagtttcttttaatgcaacagaaacttcaccaagggaaatgatacttggtggcttgtattagttatctactgctgaataacaaattattccagaacttagcagcttaaaacaagcattcattatctcaccatttctgtgggtcagaagtttaggagcaggttagctgagtttttctggctcaagttccctgatgaagttgcagtcaatatgttagccagggctgctgtcatttgaacactttactggggctggaggatccactcttaagatggatcactcacatggctgttggcaaaagaccacaattccttgccacgtggactttttctaaagctgcttgagtgttcttccccagagcaaggatccaagagagagtagcctgaaggctgcttttgaactaatctcagacatcacacactgtcacttctgccatatttattagttagaagtgagtctttcaattctccccatgctccaggggagagaaattaagctccatcttttgaggagagaattgtccactctctggttactatttatttatttagagacagggtcttactgtgttgcccaggctagtgtgcagtggctgttaacaggcacaatcatagcacacaaaatcctgtgctcaagcgatcctcttgcctcagcctcttgagtacctgggactacaggtatgtgccaccatgcctggcaggtcacaatttattttaaaggaaccgcagtctgtccttctgccacaatttatttttcttccttccacatgcaaaatacactcttcttctcctagcacctcctaaaaagtcttatcccattccaacattagcttgaatccagaatctcatcatctaaatgtagtccagctgcagatgattgtcctcagggtgtagaaccttaagtacaggtcctgtcaatctattaacctgtgaaataaagattcatgttatctgctccccagtggcaggagagggcataagataactgctacagacatccctcttcaaaaaggagaaaattgagaaattcaaaggagtcactggtccaaagcaattgtgaaatccatctggacaaatgtttggaagtgttttgattaggactcagtcctactatttaccaggactgaacctccctggtgcttggctctgcccactaggttcttggttccactgtctaagtcatccttcctttttcttgaaaggtagcctgtgtttgccactttgtgtttttcttagtctgctttcttcttacagaagttttaggggtgcaaaggccccttttccttttgtactgtctttgttcctttcagcccaagcttacagtgtttctgctgatataattctttaaaaaattttgtcagtctcctgtaaatattgggattcactctgttaaacaaaatccataaccaataaagattaaagtcagattttactaattcatgtttgtaagtgacaaatttatacaccttctatttaaaattctcagctaatttgggtagaagggaaatcaggagagaaattaataaaagcaaagtataatacttttttattaagcacttactatatgccaagcacctattatgcatctttaatcctcaaagcaattcagttaaagaagtattaagatgcctaagttatagatgcataaactgaaacttagagacattaaataacttgctgaagttttacagcttagttaaatgatgtggtcagaatttaaactgcaaagctcacacctgtaatcactaggctgtaccacttacagcattcagtgacaatgaaaaaattctgcctatatgtttttatatcatcttattcatcttcaaagcctgctgcttaagttaattcaacgcaacctggaagagtttataatcacaagacattttggtgtaaatgtaaatttggatgacaaaaatcaccccttattgctttgagctgagaaaataacaaataatttttgttattctggccctcaggtattacttatttctaggaatttcacagcctttttatatttaattttttaaaataaaatatttatcttagaaatcaaataccacttggtaaattaatttggcttgagattttgttgcagtagagaaaatccacaagttctctttgtggagaccctaagttctaatttacccccttttctcaaaacgaagtgttcaggacaaactattggaattaagtgattccttttcaaagttaaagaagcatataaattgaaaaactaagcaatagcacattgaatacaagagatggttactaaattctgaatgcatggatggatagagaatagctaggtgggctttgaaacattaaacatttgaatattgtccaacaggctcctactgaacttgactgcttaacaaaacagttgctgggcttcctaagccttaccaccatgggaagcagtttagactggttgacacaaatgtgcagtgttattctgaaaaataacaggagtgtatgtggtggtagcctgggcacatgacatactaacagtttttaataacagggcaatgcatactgctgtaagcttattttgatgcgaggagaaacgtcaaaggcatatacattttaggatatcactggaagtaaggcctgagtgttaacagggttccttaattcaaattggtcaaaatcaccatgatctgtggtcagttgagaagtttaagatgcaggtattcttaactttatttacatttctgttgtacacagcttcaagaaaaatattctaacctttagcttcatgttaatcaagacttagatacagaagaaagaccatccagaagaaaatatggtttatttgttttttctcctttcaacagggccagtggtattctatttccaaatgagtacatttcttaatggagaaattctaagtaagtttgttatgctcctaatcctgctttaggagagctctaataacataattatagggtgccttgggagcagcaagtctgtaatcttttttttttttttaactttttgccccaattttcctctctagtaattttgaggtaaaacatccagatgtggatatttaaaattcatctctgatgtctcctatatttatcagtgttattatctgagtgtaagttagacattactgataaatgagccaacatggagttttttttttttaagcattaattgaaataattttatcaggtcaggtttttttaaaaaatcaaattggttctcttttctgtgacttaagtattttatctcctgccactttctcctgaaagttctgaccttggatacagagttttaaaatgtgatgcctcaagtgaattctacttttggtttatagtattccggaatatgtgagtacttaaagtatattcttagcctacatgaatctcacatctctgaatatttgacatttttagaagtccatttatgtccatactttatgaattcaaagtttatagcctcactccctcgacattgatagatatataaaataaaagggtgtgagattcagataaggcttttaaggcaccctgtctctaacttaaacattttgcttttcacctagtgatttttttaccatactttttggacctatgtttgaagagctgttcaaactataatgttctgggggcaaattaagttttcaagtaggattttgtttgagttgaagaattaaatggctttttaaaagtttataacattcaatgaggatgaatttcttatttaaagaaaataaatcttacctagtagattatgggtaggcctaattagacagcagggatttctcattcaagtaatagactgataagactgttttctagctaataacctatgaaatggatatttgctacgttaactgggtcaagattgagatcagattcttcactttctttatatctaggaaaatgaaaagaaactcttaacttagtattaattgagcactgaactacacactcagggagaatctagaaatgtgaaagacacagtttcagtcctcagataatatggtatagtagagcaggaaaatagttaaacaatcacagtcatacactaggtaccctaagtatagtatagggaaagttcacagtgaagtgtagaagagaagaaatacagagatccctcctaacttggatgattaggtgacttcaaggagaaggtagcatttgtaatgtgttgaataaaggaaagaattcattaggaagaagaacagtggaagtcaatacttccattggatgaagtagatcgagcagggctagagaagtgcaagttgtgatcagagaatgctgcaagaacctcataggctaaagcatgaggtagtaatggcagataaagcaaaaaaaattacatagcagcagactatggaaattttgcagtaccaagccattttgacctaagttaggagtcagtacattttctcatcattgcccattttgtttacacaattttttataaaagtgtttgttttggatctgggttcacattttactttgcctaccacttactagctatgtgacattacgaagctcgtttaacttgagcttcagtttccttgttggtaaaatggggaaaatacctcacacggttgtgacaattaaataaaataacataagagcatgcagtacagcacgcagcacgtagtcggcaactgttttttggaaattatatatttattgctaatttgaagtacattatgcttttgtggcaacacttgaagattttaattccttagactgtattttggttttttaaggtcttgaatctgttaccctgatggcattctggtttattcatcttcacaaaatttaacaactaccactacctcctcttctatgctcttctgtatctgagaaagaagacatagtttatgccatggttttgtgtatatgttgtttgatcttctaaccagttcttctctagtggagactccagggaactgttggctaatctgacttaagcccagtatgtggccacaccaccctgattagaaatcaagtttctcattatgctttgatgaattcttagctacaagagggcaagtacttagcctggtattccaggatcaccataatctgccagtatatatatatatatttttgctttatctgccattgcagtctaatgctctaatctagcctaagaggtttactcaacatttcagatcacaacatgcctgctagcttattagttgtatttggtttcagagatacaatccaagtctgaataaaattaggaaaagaacttgtgctcagttgagggttccatatttgaatctttattccatttacttattagctttataacctcgagcaaggcattgcctatctcaggactttgtggtgagactcaaatatatcaactataaaggattattaacattgaactttagtaaaaatatgattaactacccatctcaaagataaataaaatttttatcttaatattttaatgaaagctcaataaatttactgataaatttaaaaaatcagctgaaattagtaattagtaattttttatattagtcttatattagtaatttttacacttactgttttatgacttaggtgattatctgaacaatatttgagaaacatttgaaacatgtaaaaatgagtaataaatgttcatgacaaaatattaaaccttttttgcactggaagaattcttacctgttgaagcactgtgaactgtaaacaaggctggggggatttcatatactttgaaaaaaaattttttttatacctatactgcgtagaagctattcgtcagctttaaaggagacattcgtattttccctcttactcttaatttgatttcagaagagcttatacatcgctctatgacaccatagctatcccaaaggttttagaatggtactcacatattgtgggatatatggtaatgaagaaagcatttcactaatgtaaaaagagcattggacttgtgtccttgcctctggcatttactagctgtatgtccgtgaacaggttttcaacctttctttaactttctcatcccacccagcagaaatttctcaccagtttaataaattgtgattctcttgagtacctggttgatttttttttttaatctaaaaaccattgtaaatcaatacactgagcaagctgtcttaattcatgttggctgccagagttgagataaaatttgtcccatctctagcaaatgcatacaattttatggcattcactttgtatcttaacctcattcctggctctgtctaccttccttatgcttattttctcttcagctttatttttcttacctatatttatttttgtagcattttaatctgtggaagctgccttaaatttttcctggaagaacatgggtgcaagacatttaataaaatagataatgcctacttctccaagttattgtaatatatgtaatgagtgatacacatagtaggtatcattaattttggttttttaaaaactgaatcaaagaatatcagttataactactttgaactgagaaaagtttaaatagtttggttttgaagggaagatagagttccaaaagagcagattggcccattgccatgtgtccagaagttttctgtactttacataaagataaatgaggatatctggaacatttttttcctttcagccttaagcatggtaaaatagttatgttacttgtctgtatgaaggtgtccatctatcttgtatacagctctcagccatcttatcttcacagggtcttggatgaacaagaaaactccctaatggagttttctgataaatgaagtatatctttgtagaggatattttacaagacagtttttctgatttaaatcgtgtatttaaatgaactagataccggcaatagaaccagatgtttttgagcttttattatattgtgtgaatgatttacacttaacaagccttgaatttgtaaaaagaaaagccatatttaactggtgcaaactgctccatgaacttaggattcaaatgtcacaattagtatttttaaaaattaatcactcaaatatccacttgccttattagcagaaagtacaccatctttctcttggaatttctgcttttctctgaattcttccagaactttagtgacttacactgactgggttaatcagtggcctccatatccaagatgggtgtgggtcgtgtatccatgcatctgtatatatgtatgtgagggagacacactagagtctgttcagtccaccactgccactgtacttccctgccccatggtagaatgttgaaaaccagtcttaaactgttcaacaggagctataggttcactgttgactcagatgtttgtgcaggccaccacagtgcatcagggagggatcttccggtgctaagctcggtcctttatggttgagcacccaagattacaactattagcacccagctcttagagttcacatcatggaaacttctcaactattgttctaagtgcactgtaaacactgagtcaggactagttctaacatctaccacctcatacccttagaaccatatttccccttatcaccatgagctcgtatgccattttttttttttaaagttcctggctgagtgtggtggctcacacctgtaatcccaccactttgggctgagacaggtggatcacttgaggacaggagtttgagaccaacctgaccaacatggtgaaaccccatctctactaaaactacaaaaattagccgggcatggttgtgcacacctataatcccagctacttggaaggctgagataagagaatcacttgaacccaggaggtggaggttgcagtgagctgagattgtgccactgcactccaatctgggcaacagagcggaaaaaaaaaaagtttcctagacatataggttatttacccaccctctcagaaaggctccatctaagcggagattccaggagattttattcctaccgtcacgaggcagaccactgtcagtgactcaaaagagattcacccttctaaaggaagttttctccattatctcccaggtattcatacctacccttcttggaggaagtgattccaaaataattttctgccttctccctcttaggcagagtgggggaaatggagcttaatttctggcagggcatcctgctacataagtaactaatctcaaatggaagagcaagggttaagtgacttatgttgcaagaaccttcatctttaaaacgaaggagacatgagcaaaagaacaaatgacaaacttaataagtgttggttgggtgtgatggaaagtcagaaccaactatttgtgatatgaaggattgggagaagtttcagatgttgaaccatactagtaactcgagggttactggaatagaggcgttctcttaatattagttcaggattttgatctctataaacactgtttctgccactacctcacccaccccacccccaaaaagatacagaactccagaataggaacatatggaacccaacgttccattaaaaaactgtcatttagccgggcgcggtggctcacgcctgtaatcccagcacttcggaaggcagaggtgggcggatcacctgaggtcggcagttcaagaccagcctgaccaacatagagaaaccctgtctctactaaaaatacaaaattagccgggtggtggcgcatgcctgtaatcccagctactcaggaggctgaggcaggagaatcgcttcaacccgggaggcggaggttgcggtgagttgagatcgcgccgttgcactctagcctgggcaacaagagcgaaactctgtctcaaaaaaaaaagaaaaaaaaattgtcatttaccacagtgttgcagagagtgattagaactcaactcttattaatttgctttcagagtttatggagctaaggaatttccatagaaatcataaagtagaaattattttagtatgtctcagtgaaaacttttgccattgaatcactctgtattcaaagttgtgccccattcacatgggaactctgtctttttttttttgagatggagtttcgctcttgttgcccaggctggagtgcaatggcatgatctcggctcaccacatcctcctcctcccgagttcaagctattctcctgcctcagcctcctgagtagctgggattacaggcatgcaccaccacgctgggctaattttgtatttttagtaaagacgaggattctccatgttggtcaagctggtctccaactccccacctcaggtgatccacccgccttggcctcccaaagtgctgagattataggcgtgagccaccacgcctgaccagggactctgtcttagctaagcaaggagtgggtcacctttttttttacaatggtttcttggtgcttgagttgtatattaataagaggagttttatctgtgcctgtctagtgtagatattataatatctcattttctttgacatgaagaatgcctagtggttttcccccctaaaagcaagcatcttgctgcttcttgcagtgctttgattttattattttgtgttttatatttgtttttaaatagtacaggtaaaagctattcagaaaagggatggggtaaagattgattgtatcggaacaagttacttttgggccattcagtcttgcttgctcagtctttatttttgtgtattacaggcctttcgggaagacttggaatgccttattcaagaacagatgaagaaaggccacaacccaactggattactagcattacagcagattgcagattacatcatggccaattctttctcgggtttttcttcacctcctctcagtatgtcagttttggagagttttaaacattataattttacttccactttggaccactatacatctctagcagcatattctgctcgggttcagtccttaagtttataacatctaatacttagagtaacatagtgttagaccctcctaccttttcatatcaaccaggcatttactacactttgtacagattataagatgatataagacatgattctgggctgggacttgtggcatgtgtcagtagtcccagccacatgggaggctgaggtgggagaaatgcttgagcccaggagttcgagaccagcctagcaaacaaagtgaaaaccttgtctctatttttgtttttttgttgttgtttgttttttcttttgagacaggagtcttgctctgtcgccgaggctggagtacagtggcccgatctcggctcactgcaacctccacctcgcaggttcaagcgattctcctgcctcagcctcctgagtagctggtattacaggtgcgcgccaccacgcctggctaattttttgtatttttagtagagacggggtttcaccatgttggttaggctggtcttgaactcctgacctcacgatctacccaccttggcctcccaaagtgctgggattacaggcctgagccactgcaccaggcccaccctgtctctattttctaaaataataaatctgattttaatgtggctggatataaatcatatcacagttggatttggaagtttgggttttattcctaactttgatgggaagccattttaagcagaaagatgattttaaaagaccactatattttctgtgtgaagaatgaactgggagatttcatagtattattaacaaaaatagaatagttggggatctggtttggcttgggaaatggaggaagttcaactttgggcatgctccatttgcattgccaagacattgcagcaattggaagtgcagtcagagagcttaggagaaacacttggcagatggacatagagaagtagtactcaaagctgtggacattgattaaataatcatacaggagtatgggctgacaaaagattccaaagagaaaacctcaaaagctcaaagaggaagactagtcagggaaaacagaaatagtaaaagaagctgccctggaagtgtcctggattccatggcgggaacaaggagctacaggagacctgggcctgctggctggaatgtacaaaggcatggcaggaggaaagccatgtgccactgtttggagatcaggaaatagcaaccagttgcctgaaatacttacgcagtgaagtgaaaagcggaagttaaagttggaaggttacggggagaatagaagacaggttaatggctgactctaaaattttgtcagaaattatgctattttttgtggcttatgtattaaaactattcagattacttcaaaacatctcaaaattaaaaggttttccattgaaatattctctttaaaagttcttgctcatattctcaggtaaaaagcagtgctttagaaaactcaatggctttatgcataatgaatttacaaagaaaggggctacagtcgagtacaagaatgaggcttattgcagggatccatgcatgagttaagggctgaactcaagagtggacaacgagggaccttatgaagaaaacagtcatgaaatgtggtgacaaattatatatggttacccaggagaggttaaggaggtagaggttactgaaacccagagtttgagcctataggaatggtaatatcaatattagaagcaaagtaaggagaagagagaaggtaagaaaaaccaggagagagaagataaaatcacctttagacccttttaattttcatgttattgcgttgtaggcacttggaaatagcaggctaggctgggcacagtggctcatgtctgtaatcctagcactttgggaggccaaggcaggaggatcactggaggccaggagttcaagaccagcctgggcaacatagtaagaccccatctccactaaacaaattaaaaaattagccaggtgtggcagcatgccctgtagtcctagctactcaggaggctgaggtggaaggattgcctgagcctaggagttcgaggctgcagtgagccatgatcacaccactgcattgcagcctgggtgacagagtgatacccctgcctctaaaaaaaaaaaaaaaaaaaaagggtggggccagttgcagtggctcaggcctataatcccagcactctgggaggccaaggcaggtggatcatctgaggtcaggagttcaagaccaccctgaccaacaaggaaaaaacctgtctctactaaaatacaaaattagctgggcctggtggcacatgcctgtaatcccagcttctcaggaggctgaggcgggagaatcgctttgaacctgggaggtggatgttgcagtgagccgagatcgtaccattgcactcaaacctgggcaacaagagtgaaactccgtctcaaaaaaaaacaaaacaagcaggctggaaaatggggaggaggacctgatcagaactaaagaccagggagtgagtcgtctacacaaaaataacaatagggaggctcaagagtctataatgtttttgtagggaaaagtaaaatgagaaagaacatagtggaggactgagctttggggaagagccaaagctgggcaaagggaacagatgaacttgttaaaggagaaaagcatgtagacaaggaataagagatctaggatagtatcacatgggcctcgagaagagttctaggaatgaggcagtgtaaatagtgtaaagctgtaaagaggtcaaggagaatgaagactgagcaaaagttgaacttggtaacagctgaacttggcaattagatcattagagaccttcaagaccttcaataggacagaaatcatactactatttgcatgcattattttccatctcaaatgttttttgtgtttgaataaaagtcaagagagataatagaaaagtagctttctgttgaggtcttttcatcataaaactagcagtaacctcagtatttaacacttttaccctcggagatatgtgtaaccatttttccccagtggtgtgagcctttgatatagtcactccttagcaagcactacatgaagcaacttttactaagcaatcaaagatagctgatacttatttttactctcagtttacctctctgaaggagaataagctaataaaatattatatgggctgataaatttcagattattatatacaaggctgggatactcccagacgcaggctacttcctggcaactaatttccaggtaagggattgcatgactcgtatctctctccacattttttgctcttttaggtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtgagttcttcagctttcaattccttttttaaaaaattccagctagaaggcaactatactcttcttacctttacctggaagtccagttttcagacttattctctaaacctagtatgctagatcacaaccaaatactgatttaaaccttatacccaagggagaggctccaattcccccacctttcttctccccttactatctatgttgttccaagttcctttggttcagaccaactgtagaatctatccaggaagaaatccttctggcaaaattgtccctctccatgataattatgtctgagcatcagtggctttaaaaagcatttgaggcaaggaagatagaggaggtcagggaagtttcctccctggtctttatttttaaaatatattctttccattcaccatcatatttttattttgccacacttggaaaaagatgctatttggaaacaaaagaggattaaaatattgtacaatggaaatggtacagatgcagtccatcaagaatctttcttcctttccaccttccatctttattttaattccttcctaggaagagattttgttctctttcctttgcccattttgccttaacttccaagttataaattaaggttataattattaccacattggcttgaataatattagcatttatttttcatgaacatagctgaccctaaataaccttagagccccaaaataacacttttaggtaagtccagtaaataagaaactaaagtcagaattttttagcaagtacttgagggaaactttaggaaagtttcatgttgtagacctttaatttttgctttgttggttttttttttcctgatctcttacaattattcattgtaaatatatttgtagtcatgtttccactgcaaaatatgaaccacttcatagtaattccctgttgtttttttttccaggtaagaataagtaaggagcaagaccacattataataattcccagaggcctatctttttctgaagctacagcctccaatttggtataattttccattcctgtgttgctttttctgagctttctttggcttttctgacagttcttagcttttagcacaggacagaataagaaggtatggatggaaaaacatttactagtgaacagtgaagggaatttgaactatgttgttttagggaaaagctttagagaatagcgtaattgaagagactaataaatgagttggtcttatcagttaacttgtctatgttttgaagggaatcgtgatttttttttttttaccaccctatacactcagaaatttgtgtaaaaaaattgtgtaaaaaaaacacacacggccaggtgcagtggctcacgcctgtaatccaagcactttgggaggctgaggcaagtggatcacgaggtcaggagttcaagaccagcctgaccaacatggtgaaaccccatctctactaaagataacaaaaaattagctgggcgtggtggcacacacctgtaatcccggctactcgggaggctgaggcaggagaatcgcttgaatccataaggtagaggttgcagtgagccaagatcgcaccattgcactccagcctgggctacagggcgagactctgtcttcaatacacacacacacacacacacacacacacacacacacacacacacacacacacacaatgttcatagctagatttaaacaaagttcagctggtatgagtataggatctgaccttagtattttatcttttccatgactactcctagccactgtcatcagcttacagagtgacaggagctaccttggttctgggtgcttgctgcaatgttagcaaatagaagttttctagccaattctatacatgccagacttgttcagacctccgatgaagagcttaagtttctccttttcttggaaactgtacttcttgccaagtaccaagttttgttgcacctgttttataaataaagttttatgggaacaaagctatacctgttaacttacagattgtttatggctgcttttgtactgcagctgcagatttgagtaattgcagcagaggcccacaaagtccaaaatatttgctatctgaccttttacaaaaaggtttgctaccccctggtttagcttgtgaaacacaaactttgatacgtatataccagttaaatatgtccttctgattttttccaggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtaagtcaatgaaagtccaaaactgacaggacgctggaagatgtattatttttgtggctttctcaacaggatgctttactatctgcttttcaaaatcatatttgatacaataatctgcatacccagaaagcaaaaggcctttgggaccaaatgctaccattctaggaaacaactggagaaataacatttggattctaaaactaaccagtttgaaaattgggtcattgagttttttggagcaaagcttctttcataatatttgacacagcatataagttgagttgtattccctaagtcctttttgtgtgtgtgtggaagaaacaaaatgggaagtgaataaagtgggaagtgggctgcaatggtgaaacacagtgaataggccagtgttttcctgagctgaccaaacaatcaggttcctatgaaaatgtatttagtaaccaaatgtgttatcttggtatgggccaaaccaaataggtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtatgtagtagagtttgtctaaggagctatttttgttgctgctgctgttgatgaaaacagtgtgagctatgccagttatttcaagtgattgctgtgggcattctattttaggtgctggtactcaggaatcatggtgtggttgcacttggagaaacattagaggaggcttttcattatatttttaatgtgcaactagcctgtgagattcaggtaggaaacattattccccttttttaattgctttgttatttgctcgtttagttggattttgtgtacttatttgcaaatacatattagttagtggctttttgtcttttaagagaagttctgctctacttatgtaggcagggttttcaactcagttatctcttgaattgaaaataggagtaaaggaaattaaaattttctcacacacaatctaagggcctcataaacatcattttccctacaatcctgctttttaagttagtacaattgcatatttctgttttcaccctgtagtggtggtactaattaaggaagaaaaacagctgcaaatcaagaatcaaatgtgttgtggtcacttttgtaaaaagtttgactaggtccagaagttatatgaaattgcagttttcaacaattccacagcctcattatgatgagaggttggatatttattaatcatttttttcatcagagatgttgaatgtatttaaaggccctaattttctttttctttttcttttttttttaattatactttaagttttagggtacatgtgcacattgtgcaggttagttacatatgtatacatgtgccatgctggtgcgctgcacccaccaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattctatggtgtatatgtgccacattttcttaatccagtctatcattgttggacatttggttggttccaagtctttgctattgtgaataatgccgcaataaacatacgtgtgcatgtgtctttatagcagcatgatttatagtcctttgggtatatacccagtaatggaatggctgggtcaaatggtatttctagttcaagatccctgaggaatcgccacactgacttccacaatggttgaactagagagcccgcatcgccaagtcaatcctaagccaaaagaacaaagctggaggcatcacactacctgacttcaaactatactacaaggctacagtaaccaaaacagcatggtactggtatcaaaacagagatatagataaatggaacagaacggagccctcagaaataacgccacatacctacgactagctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccttagaagaaaacctaggcattaccattcaggacataggcatgggcaaggacttcatgtccaaaacaccaaaagcaatggcaacaaaagacaaaattgacaaatgggatctaattaaactaaaggccctaattttctctttaaatcaagcagatttggccaggcacggtagctcatgcctgtaatcccagcactttgggaggctgagctgggtagatcacctgaggtcaggagttcgagaccagcctgaccaacatggagaaaccccgtctgtactaaaaatacaaaattaacagggcgtggtgtcatgtgcctgtaatcccagctacttgggaggctgaggcgggagaatcgcttgaacccgggaggcgaagtttgcagtgagccgatatcgtgccattgcactccagcctgggcaacaagagtgaaactcagtcctcaataaataaataaataaataaagcaaattctcatgaagcaaatggtaataatcttaatttattggaagggccacaagaaagggggaaaagaacaactaaaaaaaaactttttctaccaacattaacttgtcctaacaatcaacttatttttgctttaatggttcctcctcttctcaaatggggctatgaaaagcttaattaaattaagataatgagctgatggcttctgcctaaatatctttaaattcaaagtacagtgtttttgtatttccttaaaattatagcttttagcaaaagtattaactggataaccctgggaaaacttcaagaaaagaaatttaaaatttggcagcagaattccgtggcttaaaatatgttaagaggtatggctctaatgtgttttccatcagggaggatcagagtcttggaaggtttctttttcagataggtggaaaagatacttcagctgtctgctggcacaagagtgtcatcttgtctttgttgttagtagcctgagcaagtattatagatatttgccaaattgaaattgtgcctttttgaaagtaaaatactcattacagtctttatagttttgtgtctctgtatattttaccattgattacaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggtaggttgcaaaattgaagtaaaacttggatttaatgtcttcagattcaagagcagatgcttccatttttgtagaacatgctccatactcttccagaagctgagtttggccctaggaaagcatttcattgttatttaaccacacctttgagaattaaacagaacttacaaatgtcgtgttttttttttaagattacaatatattgttattaactgtagtcaccatagtacaatatatctcttgaactttttcctcctaactgaaattttgtatcctttgatcaacatctccccacccccacctccttgtaaccactattctactctacttttatgagttcaacttttttttttttcttggaggcaggatcttgcttggagtgccgtgacacaatcagggctcacttgcagtctcaacctgctgggctcaaaccattcttccacctcagcctcctgtgtatctgggacataacgtgtgtgccaccgtgcctggctaatttatttttttttttttactttttgtagagatagggtttctccatgttgcccaggctggtcttgaattcctgggctcaagcagtcctcccacctcagcctcccaaagtgctgggattactggcgtgagctgccatgcccaacaagttcaactttttaagactctgtatataagtgagatcatggggtatttgtctttctgtgcctggtttattttatttaatacaatgtcctctaggttcatccatgttgtcacatttgacagaatttcttttttaaagctgaatagtattccattatgttgtatataccacatttatatcccatccatcaatggacacttaggatgattccatatcttggctattgtgaataatggtgtacctaacatgagagtacagatacctctttgacatactgagtacattccctttggatatatatctggtagtgagactgttgggtgatatggtagttttatttttaattgtatgaggaacctccatactgttttccacaatggctatactaatttacattgctaccaacagtgtgcaaagggtccctttctccctacattctaacacttgttgtctttcatcttttttataatagcgattctaacaggacatgccatctcgtgctttaatttgcattttcttgattagtgatgttttaatacacttgttgaccatttgtatgtcttcttttgagaaatgtttattcagatcctttgcctattttttaattgggttcttctcttgttattttttgagtcccctatatattttggatagtaaccccttaaaagatgtatggtttggcaaatgttattttagattttaccctcttctgtgaaggctcagaaggctgactgccttcagacccaggaacagagacttaaatgagcactgagatttgcttccccagaacagttttatagatagaaaagcacttctggtcagcaacttagaactgttcgtttgtcgggaacagttgtgtgagtggaaattgcaatatcagctgttatcagctctaactaggtcttgaaatttgcataatttcagctccagtgttacatgaaagttatgtggtgtttggaaggatgcctttttctttgttttttagcaaaggagtcttttaaatcatttgtatacaaaaggaattaggatccaaatgctgttattgatacaggtttgatgcttcaaatgtggcttttccctcccttaggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacggtatgccagtattttatgtagtttgcctttactaaatattttgcctagttactcaagaattgaatgttctatattgaaaatatttggaaagtaaaataatattaaaaatattactgtcacttatctggctttaactttgtgcaagacactcttctaagtgccatacacgaattttctcatttaactctcctaatatgaatgatgctgtttttctattttatagatgagaaaaccaaggcaagaagggttaattaatcatgttttaatggtaaactcgggatttgcatgaagacagtctgactcttgagcccagttcttgtccactacatgatactgctttgtagtttctattaaactacaccagtagtttaattcaccagtgaattaaaactgtaaaagttatcaactcctaattgtaccaaagctgcatgaatcactgcacatagctacccttaggcaagatcttgtaggtagagaaatgggttattttatctttttcagaattttgcattagatttggtttggtttggttttggagtgcataccaccaaacattctctaggtcagtcttgtccagtccatggcccaggatggctttggatgcagctcaacacaaatttgtaaactttattaaaacattatgagaattttttgtgattttgttaaactaatcagctatcgttagtgttggtgtattttatatgtggcccaagacagttcttccaatgtggcccagggaagtcaaaagattggacaccacagttctagatattcagaattagttcatcttatataaactaatggcattcaatatgaaaatacctaggcatcaaaatgtcttttctgtagtctataagatttcttgcctcccagtaaaagaacataattaaactcattggtttctcagaattcattttgtttacagagattgatggtcagccatcattaatcttgatcgagattcgctttctttaaggattataatatggggtaaatgagaagaattatgtaagctccttccaaccccgtggttctattttgctattatataccagattatccccattataaaatgccgattagggcttggccttttctgtcagccaaaaataaaaagtgaagtctgataaactaaaatcttaagatatttcttaagttttttttttttttgattactcctttgccatcttcatctgactgctgtcttcagtgcagaagacaaaacactgaatgtgagtgaatgtgagatcatgctctctgtgcttgaagtagtttcagcatcatattttcacttgacacaaggagaaagtttaattagcagtataattgaatatttatgtgaatcgtaatggcatttattttttaagtaaatgttgattttgagccttttctaactagtatgagatgaaactaattcaccactaagatactgcttagtgaaattatttaaacattggcaatgcccctcttgagactataagcagttatctaacaatctactaatattttcttaacacaaagcttcattttagaaaatttttgattctttagtggatgaaagcagaagactcatctaaagttagtggtggaacacctatcaaaattgaagatccaaatcagtttgttcctttaaacacaaacccgaatgaggtactagaaaagagaaataaggtaagacatggtcttctatagccaggggagacattttaattgctttatgtttaaatcaccagtggttgaatctggttaatgccaaacttagaagtttgaatacagaagaatttggaatttaattcagtataattttagcttatattgaatgcctccagctctgtgctagtaattggtgaacaggctacatggggaagatgtattgaacatttttctgcgttagagaaccctgctattagggggaaaatgcagttctctaacaacctaagacgaaaggaaataacttgccataaagagcagaggagactaatatgagttgttaggatggtaaaagaggtctttatggaggtgggaattgaagagactctcactctggaaatgtcaagtagtaagcttttatgaaaagataaagcaaaggtcatctgcatagttgccctcaagaactttatattgaattgtttttcaattcagattcgggaacaaaatcgatatgacttgaaaacagcaggaccacaatctcagttgcttgctggaattgttgtggataagccaccttctgtaagtttatgaagtagtatgatctttgttttttatttaccacattaatttcattgatttttaaatatgaatatttatttttactaaggttaatataagcacaagttaaaaagtcaactcacaagatttaaaatgtcacccacaattcccagtttccaggtgcagcaactttctgttcttttcattgcttctaatgtttactttggtgtttctggttagttagttgagatgaggtctcactctgttgcccaggatagtcgtgaacacctgatctcaggtgatcctccagccttgacctcctgaagtattgggattacaggtataaaccactgctcctcgtcctcctttgatgtttctaaagagcatcttctgctttttcttggtctatcagttttagaccttgactatttttcatcaaatctgtgttatccgttataagaagtaccattgttttatatgtcactaaaagagaaaaaacactgccaattataattgttcccaatttcagagatggaaaaagttcatcttagaattaatgaaatatttttgaaagatggggatttagcctgtttatacagtgcttccctttttccctctccccattctcccagtaaggatacatcacagtttttgttttttgttttttgtttttttctgttagatcagctttcgttatttatattactacatgtttgctgctaagccaggtagtatttcctttcttacataagtcacccctccctactctcaccttgcctttttttcattggcttattatttggggtacattggcttagttcttcccgaactttttaaaagaattataaagtcccggctgggtgcagtggctcacgcctgtaatcccagcactttgggaggccgaggcgggcagatcacgaggtcaagagatcaagaccatcctggccaacatggtgaaaccccatctctactgaaaatacaaaaattagctgtgcgtggtggcgtgcacctgtagtcccagctactcaggaggctgaggcaggagaatcactcgaacccgggaggcagaggttgcagtgagccaagatcatgccactgtactccagcctggtgacagagcgagactccgtctcaaaaaataagaataacataaaatctgtcctaatattattttccacagggtgaaagtcaacaggtaatctctctgttccagccccccttcattctgatccaaatctaaattggttgctctcaggccagctgcacaggttcatctggaggattcctgtgctgctgatctatattgtattccgtttcctgtatcttgtgtcttctgctttcttgatttcctcctttactgtagaacgcaccctctaatagctttccgagaaaaggatacataggtggtaacagtctgaaatgcctttattctatcttcaaatgtgcatataatggatatagaatagtttagaaataattttcccctgaaataagaaaagcatcattctgttccctattttattgttgaagtaggaaggcattggaattcctgaacctttgtttaggattttttttttttttttttttttgcttttagaccctttctgcatccctgctgttctgaaattttatgattgtgtgctgatctctttttagtcttttttctaagtaattagtaacccttttcaatctccagagtcatatccttcagttctggaagttttttaaaagtgtttcttcaagagtgttttcttcccatttctttttctgtcagtatattatgttagtttggatgttgggcctctttgagcctctgatttttttcttttctctcctacttgccatctctttatctttgtatcctactttctgggagaatgttttctaacccttttaattttttattttgatgttaacttttttaatttattttattttatttattttttttgagatggagtctcgcactgttgcccaggctagagtgcagtggcgcgatcttggctcactgcaagctccgccttcctgggtgcacgccattctctgcctcagcctcccaagtagctgggactacaggcgcctgtcaccgtgcccgactaattttttttgtatttttagtagagacagggtttcaccgcgttagccaggatggtttcaatctcctgacctcgtgatctgcccgccttggcctcccaaagtgctgggattacaggcgtgagccaccacgcccagccaacttttttatttttaataagagttcttattccctgaatgttcctttttaataacatcctgatctttacactttctcttattgctctaagggtatcaattttaaattttcttcatttgcctttgttgtctttgtctattctgagttgttccgtatgtctgtttatatggaagaatgagacattaaagcatatcagaagctctgggtatacacagagctcggggattggtgggcttcactgtagggtgattggatgtggaccaggttgtttctctggggaatccccaaacattattctctgtaattcttttatctgggactatttagtttatctggaaaagaactccagtctcctgccagtttccaaccatcattctaggagcctgcaactgtattttgtgtcccctagttagtttttctttctttctttctttcttttttttttttttttgagacggagttttgttcttgttgcccaggctggagcgcaatggcgtgacctcagctcacggcaacctccgcctcccgggttcaagccattctcctgcctcagcctcctgagtagctgggattacaggcatgcaccaccatgcccggctaattttgtatttttagtagaggcagggtttctccatgttggtcaggctagtctcgaactctggacctcaggtgatctgctcgccttggccttccaaagtgctgggattacaggtgtgagccaccgcgcccagcctagtttttctttctcaagcctctgatcttctgcagagatgagagagagggaaatgcttggctctgtggaatagggaagggaacctgggaatctgtttcctattcagactttgaacatgttcctctattttcaccttttccttaccaccaccttctatggtacctattgcctctagtttatgggccttaccagacctcttcagggcaaataagcatgcttctcatttgcatcctttttttcaggactgaggcttcaactttctcagctctgctacctgctgttccacttgcattccagcttccaaaaatatgttaacatttctcatcctttgttgtttcatctcacattcttttgtccttaagggtgttttgttttgtttttttctattcctttactatcattttagtggggttttgggagggatgaaaaataaatacatgggttccatatgccaactgcaactgaaattctcattatttcctttcctggagaaaacagctacaagcttattttcgtaacagatttaaagaactacttttggtacagtttcatttctgtaagccttttttacagtggtctttaaaatggagcaattcttgtttttttcaagttttttttatgtgaaacttattagaacttggcataatggtttttaaaaattattaagatttacttatacaggcttattgaggaaatatcactggcaattttagtccattggattagtagtttaagggcatcaatcttacaagagcattttaaacaaagcatgttaccttgcatttcttaggattgttgtgaaataaggcttcacaaacatcatatttgcatttatgtgtatatagatggatggatggatagatatataagtaaaactcttggtaatgaatcgatttttattttttctttgtaagactatgcaatttgaagatgatgatcatggcccaccagctcctcctaacccatttagtcatctcacagaaggagaacttgaagagtataagaggacaatcgaacgtaaacaacaaggcctagaaggttagttaatctttacattcaacctagggtaagccacactgataacaataaagtacctcacgttggatgatagaaagcagtcagtgtggccgggcacaatggctcacacctgtaatcccagcactttgggagaccaaggcaggtggattgcttgaggtcaggagtttgagaccagcctggccaacatggtgaaaccccgtctctattaaaaattaaaaaattagccgggcatggtggtacacgcctgtagtcctagctactctggtggctgaggcaggagaatcgcttgaacctgggaggcagaggttgcagtgagctgagatcgcaccactgcactgcagcctgggcgacagagagagactccgtctcaaaaaaaaaaaaacagaaaaagaaaaaaaacaatctgaatgctactattttatagtaaaatcttctagaaagtgagattcccagatgagtaaagaattactagccaaagtagatgtagataaattaatggatttaaacatttcataattatgtggctttttaactctcttaattttaaataattacagattcataagtatgtagttttgatgctttgtaaaatctctatttctggttatctcaaggtgccaacattgtcacttcaaaatttaaaactaactgctaaaattttgatgtgactttccttaagcacacggacactctagtaggttgagttttctggctttggaacccttagtaagtagattgttaggattatatttaagacttgttaatgaaaacatcttaaacaattgactactagctccctttttctctggaataagagattcttcctagcaggagttctctatcttgagtctttggataagcttcaggcagtccatgagccacctgaaaaatacatgctttattgtttaaggtacacatttagggagggaagggttcagggtcaggaacaagcctgtcacccaaaaagagggtaaggagcctctgctttagagcatccacaacatacagttgaaattttcatgcaaagcaaaataagccaatagttaatgaatttttgtccatgttagatatcatttaggaagaactaatgacatcttgatcatccaaggaacagttttttgtgcctttgtcacaaaagggagttgtcctgattcattaatgtaattatactaaattttctaaatggtgttattgaatttgtttattctaacataaagttgggagctttctctgtttttcatattttgtaaaatatccctctttaatctcttgttttttgaaagcctaaagatgccaggtaacaaatgttgcactctagaaccgtcaccttttttatataactttatagtagtttcttccacatttattatgaccttatgaattagctcagtaacattgctctgacaggtatcactaattaaatattgttcaaaaattctgtgaagcattctgcctcattaatgtagcatcattggtgaggctttataatttttttcatctgtctgcgcagtatgttttggttttctaatgctagcaagagctacatgcaacatatcatttgcctgggctgccagcagctgtgcatcttttgtaacctgtacgtaaaataaccattagcagccagaaatgttaacacattaacctcctcttaatgtataattatggatatatgggataactgttagcatgctcagctcactgctgaagaatttatcatctctttgtatacaggcatttgatgtatgcactaacctccctaaaatcatatgctgctttgttttgttttgcatggcttttaactaaactcttatccaacagatgctgagcaggaattactctcagatgacgcttcatctgtttcacaaattcagtctcaaactcagtcaccgcaaaatgtccctgaaaaattagaaggtactcaatgtaatttcccacatagcattcactgagttagtcttgagtctgtccctctgtgttttgttttcacgtgaggaagttgaatacctcatcacagtaagttttccatattttacttatatctcccaataattacatattttatatcattaaaaatggggcgctacttttgttcagcatttatattgatttaccttaatctgaattttggcaacccgcagttcttaagaatttgtggaattggctgggcgcggtggctcacacctgtaatcccagcactttgggaggctgaggcaggtggatcacgaggtcaggagatcaagaccatcctggctaacacggtgaaaccctgtctctactaaaaatacaaaaaattagctgggtgtggtggcgggcgcctgtagtcccagctactcgggaggctgaggcaggagaatggcatgaacacgggaggtggagctggcagtgagccaagactgccactgcactccggcctgggcgacagagtgagactccgcctcaaaaaaaaaaaaaaaaaaaaaagaatttgtggaattaaacatctcccaatcagcagcatgaaatctttttcagtattgattgccaaatgatcccaaaactagagaaaaatatgttgtcttcctcatttatacttaattgatttacaatgaaactgttatttcatcaaactgggattatctagcttttgctctttggtttaacaactttgttcctttcccctttatatcattaaagaaaattagcttcttgctaatagatcacagtttattaaaataatgatctgtcttcattggaatcaaagtaatgccttattacattgctaaaacatttcagttttgtaaagtagagcaaaaatgttaagtatgtaaaataacccccaaaaaaccctcccctttcgtagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 36812 - DNA, 11511 bp, Homo sapiens
ttcctgagtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctgtgagttccgggcttggggcggggaccgggctgagatgaccacaaggcttcaggccctgacgtgcttaggtttccaggtggggaagtctgggggtccgccagtccagtgtctgcaaggcctttacgccgacccctcggcagtgaccagagaaagcctgcggcctcggtcgcttaccttcctccatgtctgagtagatatcgctgagtcttgttgcttttttcttgtgacctgtgcagcggcggcagcgtgggagcctcgtggccccaagccacatggctggcagagtgcagcggggaggtagagtcttgttccactgaggacgttggttcttcggcatcttctggggggcttttcgttgggtgaggcaaaccgtgatttgaccttagcctcagtcacatttactgggattcaaaagcaagtgaaatttctttagaatgaagtctgggattttcgtttgtaaagaagaaaatgaatgaaagtagaagcagagttttgttttgagttacactgagaattgagagtcatcaacagccctaccaagtaggcatagtagtgggcttggagctttggctaattgaatcaaacaaacctaggtttgggaccaggctctgccactttttagatacgtgacccgggcagtttatttaacctttctgagtctttctacagggatgtcatcatccactttataggatttttgtgagtttcagtaagatgatgtgtaagagtagcaatctcagtgctggtacagaggaatcttgtaaaagtgaaagctgtaccatagttatggcaatttaggatgctccaaacacatgtaagagtaagagaaccaggaatgtgaaaggtttgtaatctacatcaacggacattcctgcatgggaagacactttgagagaggagagagggggggtcttcagcagggatgatagcatgactaggaaggatggcttgcacttttagcagaatcaggctgcgaaagcaaagaatcagatcagcctcaaaacttccttaagctgggacaggctgccatgtgatctaactgctttcttaatgaaactgtttagagttgactgttaaggagactgcggagagtgctttcacagtggactggatggaattggacatttcagaattaggattcttttttttttttttttttttttgagacggagtctctgttgcccaggctggagtgcaatggtgcgatctcggctcattgtaacctccgcctcccaagttcaagtgattatcctgcctcagcctccccagtagctgggattacaggcgcgtaccaccacgcccggctaatttttgtatttttagtagagatgaggtttcaccatgttggccaggctggtcttgaactcctgacctcaagaaatccacttgcctcagcctctcaaagtgctgggattacaggcgcgagccaccgtgcccggcctcaggattaggattctgaaatggttttatgtgagaaaagctaatctttgtgaagagctaactaagggtcagatgctacgcccttcacatgcatttaattttttttttttttttttttgaggcggagtctggctctgtcgcccaggctggagtgcagtggcacgatctcagctcactgcaacctctgcctctcaggctaaagtgattctcctgcctcagcttcccaagtagctgggactacaggtgtgccccaccatgcctggctaattttttttttttttttttgtatttttagtagagacggggtttcaccatgttggccaggctgctcttgaactcctgacctcaagaatctactgcctcggcttcccaaagtgctgggattacaggtgtgagccaccgcacccggccaacatgcattatgtcttatcctctcaataacttaatgagatgtgtagtattatctccattttatagaaaagaaaataatctcagggagataaggtaatttgtccaaaggtgagttcccatctgtactgactctgatcatttactcttttttggaccacagagtctcactgttgcccaggcgggagtgcagtggtgcaatctcagctcactgcaacctttgcctcccaggttgaagcgattcttgtgcctcagcctcatgcctcagcctcccaaatagctgggattacaggcgcccgcctccacgcccagcttatgtttgtatctttagtagagatggggtttcaccataccagccaggctggtctcaaattcctgatcaggtgatccacccacctcagcctcccaaagtgttgggattacaggcccgtgagccactgcacctggcctgatcctgtactcttctgtgtattgttttgtgtttgtttgtttcttttagagggtctcactctgtcgcccaggctggagtaaagtgatgcaatcatacttcgctgtagcatcgaactcctgggctcaggcaatcctcctgcctcagtcactggggtagctaggactacagacatgtaccaccacacctggctaatttttttttttttttttttgtgacagtttcgctcttgttgcccaggctggagtgcaatggtgcaatctcggctcaccacaacctccacctcctgggttcaagcgattctcctgccttagcctcctgagtagctgggattattacaggcatgcgccaccacgcccagctaattttgtatttttagtagagacggggtttctccatgttggtcaggctggtctcgaactcccgatctcagatgatccacccgcctcagcctcacaaagtgttgggattacaggcgtttagccaccacaggccaagcaaccgcagtgccattgcaatccaacctgggcgaccaagagcgaaattccatttcaaaaaaaaaaaaagagagagagagagagatggaggtctcactgtcttgcccaggctggtcttgaactcctgtccttaagtgatcctcctgccttggcctgccaaagtgttagcgtacctgcgcccggcctgaatgcatttttttttttttttgagacttactctgtcgcccaggctggagtacaatggtgtgatactggctcactgcaacctcagcctcctgggttaaagcgattctcctgcctcagcctcctgagtagctgggattacaggtgtgcaccaccatgcccagttaattttttgtgtttctggtagaaatggggtttcaccatgttggccaggctggtctcaaactcctgacatcatgatctgcctacctcgacctcccatagtgctgggattacagcagacctgagccaccgtgcctggcccttaaatgcagttctttacattcaatacagtacttactagtcttgtttctttctttttttttttgagacagagtcttggtctgtcgcacaggctggagtgcagtggcgcgatctcagcttactgcaccctccgcctctggggttcaaacgattcttctgcctcagcctcccgagtacctgggattacaggcgcctgccaccacacccggctaagagacagggtttctccatgttggccaggctggtcttgaactcctggcctcaggcgatctgcccgccttggcctcccagagtgttgggattataggcgtgagccactgcatcccgcctggaggcttatttctaatgatttggtattataatccacattgcaggaaaaaccttcttgtattagtgtttgtaccctcaagtaatggataagattacattcttagatagtacattgctagagtaaagagagagccttttttttggcagaggggtagagatgggggtcttgctatgttgcttaggctggtcttgaactcctggcatccagtgatcctcctgtctcagcttcccaaagtgctgagataacatgagataacaggcataagccactgtgcccagtcaaaagtgatttttttttttttttgaaatggagtcttgctcttgttgctcaggctggagtgcagtggcgcgatctcctaggttcaagtgattctcctgcttcagccttctaggttcaagcaattctcctgcttcagcctcccaagtagctgggactacagacatctgccatcatgctgggctaatttttgttttagtagagatggggtttcaccatgttggccaggctggtcttgaactcctgacctcttgatctgcctgcctcggcctcccaaagtgctgggattacaagcatgagccaccgtgactggctgattttttgttttgttttgttttaggactttgatcaatatagattggcaggcagggggttagatggttagatggtgccgcaaacataggagtagcccgttttttacatcagaaattgggaaatccacaaatagaatatttttctcctgatttatgcacgtagcaaaagttttatgaagatgtaacatttataccaaatttagtaattatgtatgtaacaggccacatttaatgaaagcataaccaggataaaataatttccttacccagctctttttcttctacagacacagcaggatgccaatgcctcttccctcttagacatctatagcttctggctcaagtaagcctttcctgttccattttggctattttctcccccaagataggctgggctgtgtttcttggtttgggaagattccagtcccctagaaattggtccaatctacctcagcaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctggtaaggcagagtagcaggtgggcttggtggtgccaggaaaagaatttacagcctgcttgtttcacatggctgattcttactgggacctgtgtgtttgttcagctgtacctgccaagcgagtcggtctgcctcctgggaaggctgcagccaaagcatcagagagtagcagcagtgaagagtccagtgatgatgatgatgaggaggaccaaaagaaacagcctgtccaggtttgcagctttgggaagaaaaaggggtttaaggattagaaaggaagaaacctaaaatcttggcctctagcttgtaaccaaggggtgatggcggcaatacaataggtgattatgaggaagaaaatctggggattttcagggagctgataaaagtatgaggtctggaagggatgtgtgaggttgaggtcaggctccgaatctagaggaaattaaacccattctgcttgaggagtttgggttcttctgggacactattcagggctccaagaataagagagagtgttttcctgggagctttggcaggataaggcaggaacagggccagtgtatcaagtggctgaactttgttgttttttgccctttccgtatcctgtccttagctttcttttgctcttactgctccattaggcccctaaaaataaaaggaacctaggatgccctttgggtacccggaagcttttgctgatttctctccttgtgtcttttctaacagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccaggtactgtttctgttcccaagaggctgggctggggaccagattgctctggggactggagttaaaattgccgatttggcacaggggtgaaatggtactgtttgttgaactggaggtgttgattactggtcttttaattttaaaggttttactaataaataacaagatttcataggagctagtaaatagagaaagttattgcagcaagaaaaaatgtgtattttttttaatggtatccatttggtattttgtgacatttcatagacattttatgttttcacacatcccattccactgtaatcacttaaatatctatttgttgtgcttttcactgccatttttactcttgtatgttcattctatgagacaaatgagaatttttctttttttctgtaacttgtgatgagggttaggttatttctctgaatggaggttgaagtgaaagattttagagggcgtattgagattatttatgtcatcttttctaagaagacagttttattcctgccatgggataggaaaggtatcctttgatgtggtaaaccatggctggcattctcctcgatggctgctctaaagttgaaagaattggtggactcctggccaggcacagtggctcacacctataatcccagcactttgggaggctgaggcgggcggattgcttgaggtcaggagttcaagaccagcctggccaacatggcgaaaccctgtgtctactaaaaatataaaaattagctgggcatggtggtgggcacctgtaatcccagctactccagaggctgaggcgggagagttgcctgaaccactgcacactagcctgtgcaacagagccagagccagactccgtctccaaaaaaaaaaaaaaaaaaaaaaaaaaaaatggtggactcctaagttctctgctcataggaaggaggtttttcatggtcctgacttgccctaatactccttactctttctttttcttgggtattccagctcgagcagcacctaaaatagccaatggtaaagcagccagtagcagcagtagcagcagcagcagcagtagcagtgatgactcagaggaggagaaggcagcagccacccccaagaaggtctggaccataacttctgtcagggcagaggtgaccagggtgtgatgtgtgtgtgtcttccttccctggcaggattggttgggtcagcattttcctgtggtaatcaattttctttctaatgcagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtgactggacatggggagcgaagctgtgtgactgtggtcagggcccagctgcagtaaccacatggacctctccatagaggtgcatgagcgtcctcatgacatgacagctagcttctccgagcactagtgatccaggaaagcaaggagaaatctccagtgccttgtgtaacctagactcagaggtgacaccatgttctgttagaactgagtcattgattctggcccatactcaagtgaaggggaattaagcttcatttctacaagaaagtagtatcaaaaaaagttgtagacatatcctaaaaccatcacactatcctttttaaacaggtccctacagttcagtccccccgccttctgctcccccaccaaagaagtctctgggaacccagcctcccaagaaggctgtggagaagcagcagcctgtggaaagcagtgaagacagcagtgatgagtctggtgagtcagagggatgcagcctcccctcagcgtgggtctggaggaggggatgaggaataagggagagagaaagccttccatccttcggttgctttttgcttaaagcaagacagagctaaggctctgtgcgtgtctttgcattctttttattgctgtcctggttgggttgggactctggacccagcataatgctacaggttctcctcagattcaagttctgaagaagagaagaaacccccaactaaggcagtagtctctaaagcaaccactaaaccacctccagcaaagaaagcagcagagagctcttcagacagctcaggtaaggcatatggaggccctcagttcagtgagatgctctcaggcagctgctaagggctcccctgaatccaatttggggagctgttgattccatcccttctgtgtctagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggtctgtacccaatgaacatgccctctgggttttgtccccccaaatcaggatgggatatactctttgagagtagggtagtgagaggaggcccaccactgggcttccagttgtggaaactgggaggaagaacaggaaactggttacctttttttttttttattagagtctcactgtgtcacccagaccagggtgcaatggcatgatcacggcttgtgcagccttaacctcatggactcaggtgatctttccaccccagcctcctgagtagccgggactacaagcatgcaccaccatgtctggctcatttttttaactttttatagagacagaatctcactatattgcccaggctgatctgaatttcctgggctcaagcgatcctcctaccttggactcccaaaatgctggggttacagttgtgagccactgtactcggcctgagtctggctttttgttttgtaggttcattaaagaagcggaagcagaatgaggctgccaaggaggcagagactcctcaggccaagaagataaagcttcagacccctaacacatttccaaaaaggaagaaagtaagttgtctcactttcttctcaggagccagctctttaaaagtagaaaaatctaggatcatcttgacagctctgcctggcgtgacctggtacatgtgcccatgtgtatcactcaggagaactgttacatgaccactctgtctttaatttcctacttcattcttctgtagggagaaaaaagggcatcatccccattccgaagggtcagggaggaggaaattgaggtggattcacgagttgcggacaactcctttgatgccaaggtgagagagagatctgtgccattcttgggagggaggatgggtagtgtcagagaggacaattcttggttcaggttggtgggaatcttctctgggttcaggtttccttgagcagggagtagaaagaataaagtgacagggctccagcatggtcctcctctgtgttaatctccctctctacttaccagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 36813 - DNA, 14408 bp, Homo sapiens
gtgcggagcggagcgcgaggaggtggagccgcgggctgcgggctccggcgcctgcgtccgcccggccagcccggctctgcgctgcgagaggccggacggcagtcgcggctgcgctcgggagagagcgcgggggacatggggcgcggcggcccgcctgggcctcgcaggctccggagccccgaggtaccgcggggcggggcacgccgggcagggcgggggacccgggctgtcccgggcgtggctgggcctcggaggggcgcttgggccgggagcgtgcatccggctcccgggtggggggcgccagcgcaaggaacctgaccccgccctcctcccccagggctccccgctaggccccctcagtggcccctccttctcacctgggtctcgggtcccctagtgagcgagagcgtccccagccgcctacctggccatggccaacggagtgatcccgccgcccgggggcgcctcccccctaccccaggtgatcggcgcgcgcgggggcgggggagagatgggggaggagaggggagggaccttagggtgggcagaggagtcctctggccgaccccgggaccccccagatccagggatgagctgggctgggggttacggagaaagaggggggtttttgatattttccagatccgtagccctctctctttacaagctctgggagcccagagagggtggtttctgggatgctgacacaggcctgggagcaaggggagggggcccgatggtgtgagagcctgctgagctcccccaactagggcttggagttggggtgggtgtggggccttcatgggtcaggggtccttagcagaggccgtctgggcctgcaggtccgggtgcccttggaggagccccctctaagtccagacgtggaggaggaggacgatgacttgggcaagaccttggctgtgagcaggtttggggacctcatcagcaagcccccggcctgggaccccgagaagcccagccgcagctacagcgagcgggactttgagtgtgggtagcctggggacccctagtgcggccgccctcgccaccatcaccttcatcgccaccatcaccgcgctcacctccggcttggtcacccagtgccatcctgtgccggacactgtgctggactctgtgctgggccacatgccgtgttcagtcatcctgcctcccccacccatcgcctgtccgcctgcctggggaggtgggccccagaccaggggagatctagggagctgggcctgggcccttccacggtgaccttccccttccccttcgtccccactcactccctccttgtcccacctcggctagtccaactccgcctttcccctccttgctgtatcacgtctcccctcccagcccccttcatgaccttccctgtccatccaccctctcctcccactccaccagacctcatcaatgacaggcacgtggacacaggtgttggggggtcatggccctggaggaaggactagggtgcccttgtttgcggccttgagctggaaggtgtgtgccctcgggtggggagggcccctgtttctgctgtgggggcctcaaccggatctcctgcacccccagttcaccggcacacatcccaccacacccaccacccgctctcagcgcgcctgcctccaccccacaagctgcggcggctgccccccacctctgcccggcacaccaggagaaagaggaagaaggagaaaacctctgctcctccctccgaggggacccctcccatccaggaggaggggggagctggagtggatgaggaagaggaggaagaggaggaagaggaaggagaatctgaggcagaacctgtggagcccccccactcagggaccccacagaaggcaaaggtaggggcttccctttggaggggtggcaggtcaggggtcagggaggggtacagagaggaggagaggagtgcgtgttgggggcctgtgtgaggctgggtagggttgggggctgtatggtaggtcggggcaaggccccagggcacattctatgtctgcagttctccattggaagtgacgaggatgacagtccaggcctccctgggagggctgctgtcaccaagcccctgccctcggtgggcccacacactgacaagagcccccagcactccagcaggtactggctgcagcctctactcagcagggcccagcccagagccacagggtccagagctcctggcagtcacctccttcctgaccctggggagtgtccccagctctgaccctgagaaaagaggagcagggtgtgggaggggggtggggatccttctctgtcctcatgatttacaaggaggagagaacaaggggggggggagaaaaacagagaagagcagagtgaagaggttaggagttccccaggagagagtgacagagtagagagggtgaggagaaaggtggaggaaagggggagccacgggatggggagggggcctgggtcagcatcctttgctgcccaggaggggcctgggtctcatgctcagggtctactccaggccgtgctctgagctgagggacggtgatggaaccaccgacctggccctgtcaagtccaaggctgctgtgttgcctccccagctcccccagcccccgggcccgggcctcccgactcgctggggagaaaagccggccctggagcccatcggccagttatgacctgcgggagcgactgtgcccaggcagtgccctgggcaacccaggtggtccagagcagcaggtgcccacagatgaggcggaggcccagatgctgggttctgcagacctggacgacatgaagagtgagtgagaccttgtggcagcccccatggtccactgcgacggactcccagcctgcgagtgaccttggagaggctctgagctgtcccctgctaagggctgagtcctctctgaatccctgtctgctgggatgtggccagtgatggggacctcactacctcacccagccaccctctctgacggccagagctgagatttcctttcctgacacctcacgcctcagtcctgattctgtcctctgagtcacccctagaaaaaggcagctctctttttcacattactgtatccctccccaaggcccctcttctcggggtgaactctctgtctcctctttgatcccctccaaaccaggccctgagtctgagccattgctccggacccctgcctctccctgtgtcaggacccttcactcccatcccactacccttggggggggcctggctgtgatctcggcacattccttccatcttatcagtgccctggtttctgtgccacctgtcatcacccgtggggctctgtgcccaggccaggggcatcactgatccctccccctcctccgagccacagtgtgtgggtggggtggggggaagggtagggctttgagctcaatacgtcatggaaagttgccagggcctgaggacagggacaggaacaatccgatggcagcagtagcagcaggatggggggtgggggagggcgtgtttacagacccagggtgggggctggatgccgcagggagcaggcttgtggacttggggagttggggtcgggaggctgtgccaccttcagctctggttggacagaagccaccccgtccaggctcccaccttgtaggagagccgaggggtctggtagggagcggaggccgaggtctcggccaccgggagaatgacgagcccactggagaaggaccctgagcccaatggggcactgagccctgggcctggggataccaatagctggggctttgggagggatccagcccccagtcctcgagactcactggccccggaagacttagagatgtttgtgctggactttgaggatggtgacctgtgggagtccatcaggggccagctgggccccatggcagggccaccaacttgtgagtaacggggctgctggcctttccccgactgctgctggcctgggtggggcagacaggaggaagggagcgaagccctgcctgagtctactgggctgtgtaccttcggggaggggacgtgggtgttgagatagggtgcacggaaaatgttgggggctcagtgcctggggactctgactcagtgcctgtcatgggacccagatggagaaggaggggcagtggccatggcaggggctggagggtctggctggggctgtggactgagctgggtctacctttggattgcatcttggccggtggtcccaggtgaccatggggaggtccttccctctttctgagcttcagtcttcttatcaatgaaatggccacatgggattatgtggttcccgtcggcatggcctgttggtgactgtagagctcaccaagtagatgggttgggcagaaggagctgggccgtgaccccgagggccccagctggacctgtgggacccccaagcccatcttctctgcaggtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtcaggatgctgactgggtgggcctgtggcttcctcatgcccctcggccccggagccctcctctctttgcccccctgccttgccccatcacggtgttccccacacctgttggcccctgggccctcacctttggcacgccccccaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggtagggacccccaggcctggcccgaggctgcaagccctcttcagtctgtgccaggctgctcagttcccaggaacactctctagagtcctgggcacaggcaagatccaactgccacctgggaccgtgggggtccatttgcctgggcagcccgtgagccccgaggggcagggctgtatctggtgcatgcagtcagtcaacaaatggcttccccttccttggtggggaggggccgtgccctcgtttccatgctccattttcacggcccctctctgactggcctgtggcaatatggagctgtgtatccatctgggtacattgggcgctttgcccttccagcacattcgcatgcttttggggggcaaggcagagtgggaggagatttttcctgtctgatgggactgtgccctctctgtgcctgactgtccccctaggagctgccctcctggacctggagcaaaccaccctgccaggcattgcacacctcgtggtggagaccatgattgtgtctgaccagatccggccggaggacagggccagcgtcctacgtaccctgctactgaagcacaggtgccggggtgggtccctgggaggggcctgtccagctcagctgcccttccaggagcacatcctcttccaagtggctcccagcctctgcttgaatgccacaagtgacagagagctcatttctatcttttgacactttcaatcattataaagtttctttttacactgaggcagagggatggaggtcctgaccctccactactcacctcatgacctcagtctaccatgagcctctcctcctcacctgcctcaccctgccccttccagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggaggtcagtgcccttgctttggcttgggccaggggactgagagggtgtccagtttcagtcgaggtcatcgacgacttcactgagtgggttgggaaggttggattgctggcatcatgctgggcattcggggacctagaggagacccgcatgaggggtccctgccctgagacgcaggagttttgaatgtgatgatgtggcagacccacaggagctgtttaaacaagataaggctgaggtggtagttggggacatcgaggcagggtccacatcccagctggtggctcccagtgtggggccacagtgcagtacctgcctactctgggagggagaagcaggtctcagagccagggctggagccagggctgggagggcctgccacggcctccggtctgggtcccagccctattccagttctgcgtcctcagaagcccctccacatgcctgggggagatggtcaccgggggaaaagcctgaagctgctggagaagatccctgaagatgctgaggccacggttgtgcttgtgggtgaggagggccgggcgccgggggcagggtctgcagtgtgtgtgtgcctctcctgggggcctgcttgtctgagctctggcctcgaggccgcctcttccatctccctccaggctcccacctggtccctgctcttcctcacaacctgtcttagcccagccctttctttcgtagtcccctgcctgcttcctgtccagttttctgctatcttggagttggaattagaaaaaaaagcaacacttctttaataccctgagtttccatctgttggcgaattgtaatcaatgtgtagacacataagcgaatagtgcccttttagactggggtttctttgcgcagtttacaacctgctcaactgtccatgatagccctagatagctgccccagggcctgccttgactgcttctctttgcccagcgccctgtgctttcctcttcccctaggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaaggttgggcgcgtgctggctctcaaggcctcttctcctaggccctgcttacccctgtccctcattgtccacagtggtgcccatagaggcaagggtgctagaggcccctgggtggaggccatgccctggagggtggtggggggagctgttggcccaggggagaagagagagccttgggctgtggctgtgggagggtctggtgacataaggggaaaagcccagaccccagagctttggatgtgatgtgagacttgatcaggagggctggatgcgctggtctttgctgtggcttctcctgggattagataggagggtcctttagccaggggcaacgttcacaatatttatcagcctgtaaggtgtagctgatccaattggaatggctctggaagcccctgctctgccaggtgttatccctttagttgctgcatgtggaagtctggcatctcctgggggaatggagggcacctggggctttggggcagtggcttgctggcctgcagggatgggtgtcagtgttccaacagccaacactgttggactggcccagtatctacgactgaatgtccaccctgcctgtagctcagtgacccaacacccgcctcaagtctccctcctggaggctcccttggctgtccctgagggtcctggccctctcattgcccccagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaaggtcagacccttggaggctgagtgcccccaatacacactcccccatcccagggccctaaggctgtgaccccagccccgtcctgactcctggagtcctttgcatccctgatcccaacagcccggggcctccgagccagagggagtggtctgtgccccagcagccccttgttcccccagaactgtctttggagttggggggctctgaagcaacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggtaagggactggggcttggggagttgaggggctcctctagtcacttctggtcccagtgtcacttgcaggattctgggtctgggtgtgatcacattagggggccaatggttagatgtgctagcaaaggtgtaagcaccttacagagatgctggatcagggaatcccagcgatcacctttggggagctataaagtgagggtgtgggagaggtgtaagggatgagggatcctgtgatcaccattgggggctagtggggagggtttgggagcaatggggtatggaaggggccctgtgtgtcactctaaggggctgctctgcttttgttgggggccccagtttaggacaagctagatgaagaagggggcagatagacagagccaggctagggccatcctacccgtgctatggcaggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaaggtgaggcgaagccttgccctgctccatccatcctgccccacactcttccttacctacatcctgccccacactcttccttacctacatcctgccccacactcttccttacctaggggatgggtccctgcattctccctcttcctcggagttcatccgctgcctattccagggggcattgacacccagggcagtccacctgtgggtaacgaccgctcctacccccacctagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtggaggtccagcgaggtcttgggggtggcagagatggaggtggacattgccctggggaggacagcatgggagggggaggtatggagaactaggggacaaggagagggactgtgttgggagtgaggggttctagggacaccctaggctaggtctgagctgaaggggagggagtcagacccagggggtgggtgccaggtcacgactccaagcacctggttggaggcttagtaataaggactcacttgcacaggtatgtgatggggagggagctgtcagtgctaaggggctgggtgtccttgggtcaccttttgtagaggagtgtgtgtgtgtgtgtgggtgtgggtgtggtgtgagtatggtgtgttgtgtgtgatgtatgtgttgtgtgtgtgtgcgtgtgtgtgcctgtgtgtgcatgttgtgtgtgttgtgtgtatgtatgttgtgtgtgtggtgtgtatgtggtatgttgtgttttttttgtgttgtatgtgttatgtgtgtgttgttacgtgttgtgtgtgttgtatgtgtgtgttctgtgtgttctgtgtgttgtgtgtgtggtgcagctggatgtccgtgcattactgttgtctgaccaggtattgaggggccaccctctctctcacaggtgtactgatgacgatgaagtcaggtcacctgccaggtgagtgacaaggcatccttgttatccacacacaggtgttcacagagcacccactgctgccgttctacccccctgagggggccctggaggggtccctggatgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccgcttcctggggggcaaggtgcgtggctgctgggtgtggagcccccaagagtcccacaattcctgctgtaggagctccccagagaggctgcaccccttccccggtcagcccatggaccaaaacccagctcgggcagcccctcaccccttcggaagcctcttccctgggtgtcttcttgccctttgctcagagaagtctaatcaagacaacagcctcccaggctgcgctggcacctgtggggttgagaggcacgtggggggccttctggctccagcttggacccaggcagggccagagatggcaagccccgtgttagtctgctgaccttgcctccaccttttgctcccttccccaactggcccctctcaaggctcgtcgcatcatcggggactttggcatccccatctccatcctggtgatggtcctggtggattactccatcacagacacctacacgcaggtgagggagccccagcctgtggcagctgctgtcacccccaggccaggagagggagcccacaacacacttccatgggccctgggattgggatcaggcctgaactcaactttcccagtggagtggccgccctgggggctgagggccttccccagggagcctgagtgatgaatccgggagaagcaggtgtggggctgggagcagaatgacagtatcccacacaggtcccctgaagctctggggctcagggaggaggcgcttcatttccctgccctctattggatccttgaaaggacagtgacttctggaggatgcaaaactaattttcccctgacctgttcacaccccagctccctgaagtcctggactggggacgcagcttagtgggctgcttggtgggctttctagcatggggaggctgtgtccctgaaccctgttttcctgccatgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgtgagagagatgggaggaggaggtgggagggacgaggccaagctccttggctccttggcttggtttcagggttatagcagggacatcattatcagtatcagggtgctgggtggtgggagctggtggcaatccttgaggaagagagtgtgtgtggaggagctggcaggggtgaggaggaggtgggggaggagcagagagcagtggcatccggggcaggggcatggtttccccgtgatggtttgacatgacatctatctgttgccaccactctttgcagggtggcacttgacagtgctcagaacactctagcagtctaagcttgcacccagggatgctcacatgtatctaattttggttaaaccacaataacgtggtaagatctggcatctggcttttgtggtgttttaaatattcacagtatgagaatttgtctcacatttgcttcaatgtgagaacttcaatttgggaacttgaaagaagaagctggcagtcctagggagaactgttgtctgcacgtcctccccccaccatctcgtctctgtgtgcgtgcctgtctttgtcccctgcccctgccaggccagccacaccccgctccccaccttctccctgcaggcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggtgagagcccgcctccaccctgcacacccccttccttgggccccacggtcttacatcttcactatcccaggcttgaccctgaatctcccaatgtgctgtgtgttgccctcaatctgacccccaaacctgcttcccagcactcccctagccctttactcctggagtccttttctggctctctgtcctgccccctcttctctctctttttttttgagacggagtctcgctctgtcacccaggctggagtgcagtggcgcgatctcggctcactgcaagctccgcctcccaggttcacccattctcctgcctccgcctcccgagtagctgggactacaggcgcccgccaccacgcccagctaattttttgtatttttagtagagacaggggtttcaccgtgttagccatgatggtcttgatctcctgacctcgtgatccacccacctcggcctcccaaagtgctgggattacaggcgtgagccaatgtgtctgcccccccccccgcccctccttctcttgttcagggtgataaggccaagttgattggtccagtgggtccatgtcgcctccccccaggcctctccatcctcacgggggctgtctgagggtcaggcagatctgtgtcacctcttccaggcctgtccatcctcacgggggctgtctgagggtcaggcgggtctgtgtcacctcctccaggcctgtccatcgtcatgggggctgtgctgcgtcggatcccattggctgtgctctttgggatcttcctgtacatgggggtcacgtccctgtctggtatccagctgtcccagcgtttgttgctcatcctcatgccggcaaaacaccatcctgagcagccctatgtgaccaaggtagggccgggaagcatgggggtagggcagtggggtgacgggaaggggatccagagggatctgggagcattgatggatgggatgaatatgaaggagaagctgtgacctgggagccaaattccccacgatgtgggtgggtgggagcaggccgggacgctgtgcactggggcccactggctgctcccctaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcggtaagggggtggtggtctggggaaacagtgttagggcaaatgggcactgggttccaatctctgtttggccacccactagttgtgttagttgtgaaacttgtgtaacttgtgttgcaagttatctcaccttccgaaatcttattttcacctgtataataggggtgatcatagaccctaccttataggactgttgggagggtcaagtgctagtccaggtaaaggccttaggatggtggttttgtaagggagttggcacggggctgctgcacacagctgtgcaggtggtgcctgaccaaaaacacccggctgagaggctacagggttgatgtggcactggtgtccaccctgagccctgtttttgtcaactagaggaaaagacatctttttgcaatttatccatactcaaacatggtgtacaaaggtaccatagcaactagaagtggcctcaggaaagagcttcataataataatcattattattatcaccaggaggggccaggtatctggtctgggaggtgacctgaaggctttggccaagggcagtgctgccacccagggtcatggtacttgcagagaggcccaggaaaggtcagggagcagggagggctgcaggttggaggaggagctggagaatgggaggggacgagcatgcttccctgccttccccaaccttctgttccctctgcagctggactcggaagatgctgaaccaaacttcgatgaggatggccaggatgagtacaatgagctgcacatgccagtgtgacccttgaagacagtgcccctcagagaccccaagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgt

SEQ ID NO: 36814 - DNA, 181821 bp, Homo sapiens
gcacatagattctctctttgaacaatgcagctgctgcaggggatggggaagggatggcactggcaattcaagactgcctttcctacttcttcagtgcctctttcaccaatatgaagttaaaaccaggtactgtggtcacttacctgatttttggttcttatgatggtgcttttttttctgtgaatagttgttcaatttggtgttccttcagggaggatgattgatggaggctactatttggccatcttgctctgtctccatccatactaatttttttttttttttttttttttgagacagagtctcgctctgtcgcccaggctggagtgcagtggcacaatcttggctcactgcaagctccgcctcctgggttcatgccattctcctgcctcatccatactaattttttttaaatctgcctgggccctgtagctagagtaaggtcagagtctggggcagaactaaacatggaagcagagtctgctgctccagctcagagactagagggtcagagagttgaatgggtgctgacattgtggatccccagtgagaacttgctcctgcaaccttacaagaaaaactgcttttctacaggagaatcaccacgttacattagcagtttatttatttattttttttggaatggagtcttgctctgtcttccaggctgaagtgcagtggcataatctcagctcactgcaacctccgcctctcaggttcaagcaattctcctgcctcagcctccaggatagctgggattataggcacgtgccaccacgcccagctaatttttgtatttttagtagagatggggtttcaccatgttggccaggctgttctctttctgatcacttattgataatcttgacctaaatttagaagtaacttgggtatcactagatacatatgggcaactggaatgcattctaaactgagtaattagaattgaaataatctgctcaaaagtaggaacactgctttccattttatatttctttatttactttgggggtttctttagtgactcttccaggacttgtatgtgggttcattatttacttgacagttaaaaagttggtcagaaaagttatgtctgcctcctagtcataaatgaaaaggtaagaaatccagaggaaaaaattacatattctctcttagtttatttttattatcaataaaatgtcagtgccctttaaatgctgaactttatcatgcatatgaactttgaattatttttgttcagaagagagaaacatggaaagaaattatatgctccctcatataactcaaaggcctgatccatcaaagctagaaaagttattgtcatcttgggtgacttttgatttctcccttgttcttgtaaggcctactctcttccactcaccaatatcttctagtagcttccccctggtgatgtgtggctggctgagtagcttcttgagaacatagccattattgagcttaattgtctttcacttattattctagtgacattctattacctcaagataacatacaagtctaatttacctaagtggatactgcttttgtgtgttacattatgctttagaatttcaaggttctgaaattattttatgctttttaggaatccaaaaattaagctgttttctgttattttctttaatcttcactagtaaatgagattaacatgcatggaaatctggccttgggagaactaaacccaagtggtcacataaaacccaggaactatgtcagccttaaaaggccaatccatcattcctagcaaggtgaatgtaccacacagaattatcagagatccccccttacaaaatggtaataacaaaaatatttgtcatttttggggtactttctaggtttccttataaaatgataataacaaaagtattcatcatttttggggtactttctaggtttccaactctttagagatattattctaaggcaattaactgggaaaatagaaatagttaaaaatcactttctttgcattgaagggcttccagtataccatggtgctaacttaattctccagttttagtttccattcctctataaaaaattattttatctaatcagaatggtctgtttctcaacaaagcagtctctcaataccagtacaggatgctgattaggaaattaaaattgttcttctggagactatctttggtttttcactgaatttcttattctactggacgttttcagaacatagtgcaggtattagtcactgcagattactccccttacccctcttctgagatcttagaatgttctggatgatctgatggctggttcagagatggctgttttataagttaagagtaattcatttaaaacagggtccccaacccccagaccacggtctggttaggaaccgggccacacagcaggaggtgagctacaggtgagtgaacactatcgcctgagcagtccacctcctgtcagatcagtggcaacattagattttcataggagtggtaactatttgtgaactgcatatgcaagggatctagattgtgtgtgccttatgagagtctaatgcctgatgatctgaagtggaagagtttcatcctgaaacaacctcccactctggtccatggaaaaattatcttccatgaaactagttcctggtaccaaaaagtttggcgaccactgatttaaaaggacaatttacacaaaatcaccctcaaagtgcatgtgtgagtctagcatatgttgtagtgtacattttttatagggtgtgcatagtggcaatatgtcctctataatagagttgagatatctgctttctcaaggctagactctgagttaattaggtggagtgatcctcctgatgtgtaagacagttccaggcaagtgctatttatgcctgcttctccattggtgccagcagtaacttgactctccccttaactccctaagccttttatctctctcttactgagagctttcatcacctccatcctgtgttgtagatctagctatctactctttttctcccttcttgtttttcacattgcttgactcataatgtttgcttaatacatatggtaatcattgatattgtacagcaaatatttccagctctcagtcttctgagcagatgataagattgtactttccaccatctttggccaaatgactcactttgaccaaagaaatgtgatcagaagtgatgcaaattattttcaggtgaaatcatttaatagccactgctcaactcctacttttccttcctattcactgtgatggtatgtagagatgaagtctgagtccctgaatgactgcaatgtccagagtctcctgctgacctgcaaagtgcatgtagtttaaactagaaatatacttttgattctttgagccattgagattttggggtggtttgtatacagcataacctgacttattctgacaaatgcactggacctgtactttccaatatgatagccaccagctatatgtggctattgagcccctgaagtatggcatcttatttcattttctgttgctgtaacggaatactcaagaccgagtaatttatagagaaaagaaatttatttctcacatttctggaggctggaaagtccaagaggatggtaccagcatctgataagggccttcttgctatgttatcctatggtgggaggtaagcaggcaagtgagtgtgtgtaaaaagagagagcatgggggccaggctcacttaataaaaacctagtcttgcaataacaaacccactcccatgacaatagcattaatccattcatgagagtgcagtccccatgacctaatcacctcttaaaggtgccacctcttaatactgtcacaatggcaattaaatctcaatgagagttttggagtgaacattcaaaccatagcatgtggctagtccaaatggagatatactataagtgtaaaacccatgctgaattttgaagacttagtatgacaaaaagtatgtgaactatctcaataatttttgaatattagttacatgttgaaataatattttggatatattaggttaaataaaatatagtattacaatttattttacctggtgctttttacttttaaaaagttacacatggtttgcattatctttctgttagatagtgctgcactgaactacaagcttattgaagacaagagttgtatccgttttacctttttttcccccacaacatccaacagtgtctgggatatgagatatgcaacattaatgtaggtttaatgaacaaactgtgtctccatttatatgtagtttaacatttaacaaataatgccgttctcaacatgaagtttgtttgtatttttgtgtttaataattccttcttgtaattccgttagctaaagaataactcaaatctttttcaatcatcagataattgaatatcatattgtgatgttatgtttatgctataataagaaggctggggttatgcccattaaatacttctcctgatgaaattttttagcaaggtcactccttatggctaacattttcttatctttgtaaaaataacaaagaagtccctgtttgttcagtcatagttgtgacttttatttcttttccaatatctgccacttaggatatttattaaattaggcccctttgcatggggccttgtgctacaaaccaaaaggaaacagaaaaagagaaatggagctgccatgaagtccttctgcagcatcagctgtggggactgcacatgtgaggaagcagttctttggatttttagatgagtgagacagaaagtaaaataggtggtaaaaagagtcactgaaaggaacaacataccttaacaaataaagggtgggggaaacacaaagtaccaaataggctggaaaacatcttaagcacttaataaattatagctattgccatgaaagtgtacgaacccagaaggagttatggacggatgcatactaggctgttccattggctaaggagcggcaggggaggtgacacaggggaaggggaagatagatactctcatcaaaagaccatagaattagcaaaaacttgtccacaaaccaacttatatactattccatgtgcataaaatcacatattatgtgtatgtgcatagaaagatattacaacagtggttaccaaactgtagtgattctttctctgtatggtggctgaatctcaggtgacttttactttctttgttacacattttgaatttttctccagatgagcatgtatcatctgtatactcagcaaataatctgatctagcattttttcatttatgggtaacatcaggacaaagattaagaacccaaccaaaaattgtctatattatttgcattctgttgaatgctaatttttaaaataaaactgtcaaattattataaatataaaagtaatcagaagtatactgccagtacatgcattttggttatcacagaatatttaaaatgtacatgtttataggcctagtatcctcctccctgggttaggctccaattgattttctaaatgacacagggaagtagctgattcaggtcatggtggcatcttatctgaaagtgaacatttcttcagaaataaaaaatgcttttgtaagattatagaagatttgggaattatgccatgagggcacatgctgagtaatatgtttttgaggcaggctgccaagtttcgtcaaagaaaggcaagtacagggtttgttttgcaatgtctggaaaacttggaactctaatttcttggaaaatctttccaaaataaattcagtatgaaggcattctacctcaacaaattacatgtagcaagaggaaaggaaaaacaaagtgtaacaagatgtgagatgagaaaaggagattttttttccccaagagatgcgaccttgttgagttcaattacatgtctgacagcatcagagaaaacatcctcgtaatgttaattttactcaaactcctgagtgtgggtaaagtaaagaaattatccttcatcatcagttcacttttatccatctttaaaaatgtacaaaatataaggtgtcatatatccaaaaatattctgaattgctggagatcttcagcaagccgtttacattttctgggtccatttttctcctttgtctaatctggagggtttagatgtaaaaagtgctatggtctctcctaggtttaatttttttaagtaaaacaaattattatttttgacatattcacatactctttgatatatgtcagcaaaattttttccttatcaaggtctaatttttatatggtgtgaaaagcactgtggttacttcatagacatgatcgaaaactaggaccttccccattgtcccttccagttctccatacactttgaagcctttgcatggttgtcagaagggttgtagtgattgataaacaggaagaatccaactgacacaggttctgtatcaatgagatggctgtgcagagcaggagacagcaatattctccccctggcaaggataaactacccttgtcctcaagtcttcttggagctgccctgctgctggtgactctgcctaatgaggtgggagatctgctcaggttctttaagaaacacaatctgggtcttcatgaggcgagtccctactgttcccagaggctctcagccacagtagtgcatggaggtatgaactaagaagctgtagaaggatacaagtgcactttgcttggcgactgcttaccaccgtctttccttatgggcttgggagctggtggaaaccaattcagcagatttttgagtgacttttgaattgaaggtgaattctaggagatctgactgtcccaagtaggatgatactttaagcctttctgatgtgtttaccataattcaattgaagaacatttatgtatagtttattcatgaatcctacatttattgagtgcctgccctatgccattttggtggggagaagtataaaaataataaaaaagtataatttagtacagaatgactaggtactaattaaaattgagacagactcatagaggaggtaacatttcactcttagtgaaaagaagagcaagccatgaaaaggtttgatgtcaggatattccaggagagggattggcaagggaatggtggggaggagcttcacatgttcagggaaaaggaagaagtccagtgtggccggagtacatgagcaaaggggagcatgacaggagttgaggtcagggaggtgggcaggcgtgaggtcaagtgggccttgcaggccatggggaaaaatttggattttattgtaagagcagttaaccattagagggtttaaacaagagaatgataggccctgatttgtatactcttcttggttcctctggctgctaggtgaagaatggatagtggaggagtagagagaatagggaattagttatctagtcatccaactgagatgtgatggtgactcagacaaggttagtggcagtggagaaggagagaagtgtcatggctttgggatgtatttcagagtagagctcacaggacttgctgatggctgcctgtaagagaataagaaaaggcataaatcaaggaggattcctatgtgttggacttggaaaaactgggtgtatggtagggctatttatgaggagggagagacctggggaggaactggtttggagacttaccaagagttctgattttgccatattaagtttgggtggcctaatagatattgaaggaaagatatcagacaggcagcttgaattgctatggaaagtcctgggctggagatttcaatttgggaaccattggcatggatctgatgtgaattgtgaaaagataagtaaaagtttaaaccagtcctgtaattcatcttgagcatgtgctactttcagtcaggaaaaaaaagaagccctcctttatgaaatgatatggtaattattgcttactacttagagtctttgtagcagttgattttcaggcaattagaataaccacatcacttttatctgataattagagctaatttgcaagtactgatgataggctcattcactgaataaacaaaatgcagagcacaaagtttgtttctacagccatatatgtgaagttcctcttcaggtcttttgcaccacagggctgctgaattagtgcagagtttaattcagaattttcactcttgttcattgctaagctcatggctttattctgtaatggtattgtgtactttgggaagaatgccgttgggggaaattctgaccccttctcccaatctcagctgcgctgtcagaagctgtttgccctgacaggcctgggagcttggaagctagctatagtaagagtgatgcttggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggcgtgaacccgggaagcggagcttgcagtgagccgagattgcgccactgcagtccgcagtccggcctgggcgacagagcgagactccatctcaaaaaaaaaaaaaaaaaaaaaaaaaaagagtgatgcttcacattattgagtgtccacgaaatgcttatgacaatgccagttgttttgcatagattatctctaaattatattaaaacccctgcaaggtaggtatttttatttccattttaatgatgaggaaacagaagcttaaggtgacatggctagtaaattacaaaatcaggcctagggtctgcttgcttctgaaagcatctacaattttcattctgccaggctgttaaactgccaaaatttgccttagtttattcttccagtcctgctttctcctatcaactcttatgtctttccagccaaaaacccaattggctatcatctacatttctgtctttaaaaatcatccctaagggccaggcacccctgcaatcccagtactttgggaggcctaggtgggaagattgcttgaggccaggagttcgagaccagtctgtgcaacagagtgagacccccccatctctaaaaatacttaaaaattagctggatgtggtggcacatgcctatagttccagctactcaggaggctgaggcaggaggattgcttgagcccaggtcatcaaggctgcagtgagctatatttgtgccactgaactccagcctggcagcctgggtaacacagcgaggctcttttcacccccatccaacaacaacaacaacgacaacagaaaaaacagaaaaaagtcccctgaagtatacacacccctaccccgcctcttacgcctctggtttctgtctaaatatttcagccccatcctcaaattcatacctttcttctccccaaccataccttcctagtacactctaggattctattacttacacagacctctcattctttaacttttcccttaatatttccctacactcttgccaaaactcactcttggccttattctaaattacaagttcctgagccacattcttcactcgtcgtcatttctttcaattttctggctctcagagtgaggagcaggagccagagaatttcctgcttcccaccagcacatccagtctattgcttgttcattgcctctcaagaacttgtgttgtgaattccactctatcctgtgtaccacacttcttccatcttacattcaactcacaccttctgctcacttctcaacctagaagagtccacttttgctgactctctctttcttctatcatctcatggaaactgctaaacactttacctggtgttccaatccctggcctcagagatctttggcctgaggacattacggaactttcctttcctttccctttcccttctcttccctttttctttctcagagtctcactctgtcacccaggagggcgtgcagtggcatgaactcggctcactgcaacctctgcctcctggattccagtgattctcctgcctcagcctcctgagtagctgggattacaggtgtgcaccaccatgcctggctaatttttgtatttttagtggagatggggttccaccatgttggctgggctagtctcgaactcctgacctcgtgatccacccaccttggcctcccaaagtgctgggattacaggcatgagccactgtgcccggccaaagaactttatttctaattcactcttgctccttataggcacaaccacacttcagacctgcttgacatttgaaactgccccttatctgaaatgatcttctcggatgatacccagttatagttctgcctctttgcaatcttctcttgggctgaatcttggctttattctcagtgtaacagcttcttgcctcatccattgccttgacatgccacactggcctcacctgcctctctactcatgtggaccgtttggtctgccatttgagctcagtttttgatagttccatggacttcaggctctgatcctattttacttgctctgcaaatctccaattctaggtatcaccatctgatttctctccgcctcctcttgtattactgagtacaaaaaaaggacatgaatcttgatttttgttaacaataaggaaaatctgctataacgttttagcatgtaactcacagtcagtcccatgattggttaatttagcgatccaataacatcatcaaagaccttggatcttcccatttccccccgccccctcacctaaccccctgttgtcctattaggacagcttcagtctctagctagccaccagctgctgcatttccaggggccgtgcagagaccagactcagcagaaaaattggtttgattggttttaccacaaatatcaacccacaattagaacctcttctggcttcattgcagtctcattacaaatttgctcctacttgtgtttctcactggaactattctgagctttttccaattccaatcttatcaagccccacctacttgtttctttttttgtttcaaaagtgtcttccatatctgttcctattgcccctaccctaacttgcacccaacaattgtttaccttgcccccatccattcattcccctgtccctttcctgccaggttactgttcctgaagctggcgctgagtgtggcacttttttgttcactctgcctctagtgggtccctgaagttcagatggcttattgtagcatttgggatccattaagacctggccctggactacattctcagttttaatttccattatttctatttatgtaccccataagccaatcaaaatggaaatccctggctattcttttactgctccccagattttcccacctctgtctttgttctctttctctgaagaggactacccctcaactctgcaagtgaaattactgcacactttaaggtctaactccggtggcacttcttttaaaagctttcctggcctctctcatcctcagcaagaaattatagtcttttccgaattttgtagtagattatcttaggttacttgttaactctgtatgatattttttattgtagagtaaatccgcactttgttcatatgttcttggaaactgtgaagttaagtgaaaccaattttaccataggctgattgatataaaaagttaagttcaggccgggtgtggtggctcacgcctgtaatcccagaactttgggaggccgaggcgggcagatcatgaggtcaggagatagagaccatcctggctaacacggtgaaaccccgtctctactaaaaatacaaaaagattggccgggcgtggtggtgggcgcctgtagtcccagctactcgggaggctgaggcaggagaatggcgtgaacccgggaggcagagcttgcaagtgagccgagatggcggcactgcactccagcctggtcgacagagggagactccgtctcaaaaaaacaaaaacaaagcaaacaaacaaaaaaagagttaagttcctaaggcatatttctggccacaaaaacatcaccaaaactcgaaataagacaaaacacttctaacattaaacattaaaataaatgtaagctatacatacatttaagaaagatgaataaaaacaagtaagataattatttagacacttcttccaaatcagagttgtgagtgatcagagcctattctggcagctcagcgtagctcagggcacaaggtgggaaccaaccctggccaggagccattccctcccagggtgcactcagacacacacccacactcactcagactggcaccatgcagacacgccagttcaccgaagatgcacgtttttgggatgtgggaggaaactggaataaggggagaaaacccatgcagatatggggagaacctgcaactccacacagacaatggcctcgtctgggaatcggtttttgttctcatcaacataataacagagtgacgctattcaaggacctgctgtacatccactgtggattgctctgtaggcccagttttcttagtttccactaatatcatttgaacaatttttcagttgcttggtgtttgattgttttagttgtttagacttttttccattttcctgacctatgatctcacgaaagctaatagtatctgttatggacttagaggacatccggcttctgaggccctttgggactgtacatgattttgcttggaaaaagcccaaatactgtaactaaaattgttcccgtggttattttgtccaattgatatgaggttgtttttgtctttttggttttgatgcagtgttttggtagaaaaacatagcaaacaagattttactaatatcactaagttaactttgaggtacccagttgttgctaacgtagttctctacatcaccaaatattactgatcccaccattacaagacctctgaaatctatccctttctctcccttcacactgtaggggccggatttctgaccctcaccacctctctgccaccagcttcatcctactgctatctgtctgcagaagaatcatctctggtggggccacttctctgcttacgcacattttctgatttcctattgcttccagaattaagtccaagtccatttgtgggacctctgagtccctttagattcaaatcccagttgccttccccaggttcatctcttgtcacttgcttagctgtgtctcctgtccccagccacattgagattttcactactcccagaaagacccatgttcttctggggcttgaaagatccctctaatttcttcccctgacccattcccattcattatttaataaaaactcaagtattacctcatctgtggtgcctttccctacttcctcagagagcagccccctttctgtgttcctataccattcattcactcattcacatattgaaatccaggtagttaaaaagtgctgggaattaagtgacctagaaaccttagtccctggactgtaaggggctgtatagggatgtaaaaaagaaaatgacaacattgagggcagggaggggaccaaattagagagactccatgcattagaacaaactcgaggagttagtgcctgactctgtgtgtgggaatgcagaaagcggaagagaagagaacaatccccatattcctgccttgaatgacacaggtatgtggctgtccatggacacaggaaatgaaaggaaggagcaggcgaggtgggaagtgggaccagtttaactttgaggtgactttaggacatctgagtgatatgtccagtgtgcaatgggatttatggatcaagagctcaggagaggaagcggagattaagttaagtttctgggaggttccaacaagcaaatagcagttgatgttaggaaaatttctgaatttaccaggtgctccatgcccttcttttgttccgtatcatattgtatatctggtgacatagcctgctttcccataaggacactcacttattaattcacctcgtatcctcagtgtctactacactgctttgcacataaaaatttcatttcaagtgagagaatgaatatgagttcactcagccatgtcttactcatgggtgagagaatattgaaattgatccatttaataaataatgtattgagcaccttctatgtactgggaagtctcctggccactggaaatacagcagtgaaaatgatagtgggggaacagtaacacagtaaataagcaagataatatcagatcataaaaatgatcatagctaatactatggagttcttattatgtgtcagggcctgtcctgagcatttaacatgaattttaaaatttaatattcacaatatcttataaggtagggaaattaatcgagtaatatggtggcaaatggtcagagaaggctgtttgcagttataatggagctgaattgtgaaggagccagcctcaatgagatctgggggaaggatgtttcatgcacagttcaagtaaatttaggttttattaggttcgtttttgccattaaaagtaatggctaaactgcagttacttttgtaccaatctaataaaaccttcttcttttaatgtgaaaagaatacagacttttcttaatcactgcaagttgcattcactagccttcaaatactctacaccttagttcacctacaaccaatcaaactagcagtagttaattgtagaatctaaggttagggcaaaagacctttccacgtacattaagacacacatgtagcttgtagtgagtggagattggggaattttacctcatttgtactcactaatgtattatgataaagatcaacaggaaaatgatatgaaaacacatgtagaaaaatgatttagattctaaggtagattaagttaggaaagagcaaaatcataaagatatacctactttatctgctcactcaatcagactaaattcttaatggaaaagtttcttaggaacaagcaaatataaacaattactttttaattcatttttcctgatctgtataggttatttgcatgtaaatcatattgacacacaaactttactttgtcaatcatttagggcaactatgaaaagattaatacagtagttggacttttgattttccatcttgttcttacgtagaatttttgatgagactgtgatggctaaagggagggaggaagttcatcaagggcccgaaatgtctgtctgttattagaaaggagccttcattttccagaacgaatttatccatagcaatctgtaaaataaatctgtgtagaaagacgtctcaaactaggcatgataaaagttagggccatactgcaggaaagaagcttagaaggatcttctcatccagtgccctcagtttataacccaggagaggccagctgtcttatctaaagtcacaacctagaagggatgagattctgggtagcatttcttgataaacttgcatatttacttagaattatgcattttaagcttatctatgtattttaattattttaagttagaaaactgtaatatagttttaatttttaaatataattatattttattgccttaagtttaatagtttaatagtttaatttatgtgggcattttgtatttaatcatgggaaagtaaaaactgttataattcaatttgatttactgaattagtgaataaatttatttttgtctgagtttttattaaaagagacgaattttaatcaatagaatttatgtatatatatatgtatatatatatatgaaagtctaaaattggaacaaaataaaaaggtgatgcaactaggagcccctttgtatctctactgtcttttgggcttcctatttttgcattatttccacttttattgataaccaaacactttccaaatgttaagtgtataatctcagagggctagttaggaatttgctgaagagtggtagagaaagccatacttttaactatctttaagcctcctcatgctttctaagaaattaatcttctttttctgtttcccgatctcttcccttctgtctgtttcacttggtactagatcagctcttatcattcctcctgcagttgaatccacattctgtttccaggattttacgaatctcaaaaatttgaaagctactgaccattctggaaaataatcagttatgggtgcacttacatatgtaaactttaatatatcacttcacattttaagtggaccttaccattgtttttgcctccttttgtgatataaatgtggggtaacctgatctgctgagggagtagctgtgatccaaacatgtgagttgagtgcccacaaggcagggctgaagccttggaggacctcgcatccatctttagctacaagtcaactggcttctcaaaaacagaacagcctcaacaatttgttgattcaaaacttttaaatatcaatatttttcagattaatacttttatttgtctaacatttaaatttatatatttttcttagctaaatgtttgtttgcttaattttaaattggtaataataaaaattggcttataagtgaacaattttgatagattttagttcattatttagttcattatttgtaaaatgcatattttccttcccctttatccctgtgttcaaatgaggagttattatttgcttcaggaagcttctcttggggattaaataagcattttcttttcttttcctttctttctttcttttttctttttctttttcttttcttttctttttttttttttttttttttttttttttttttttttttgagacagggtcttgctctgttgctgaggctgccaggctggagtgcagtggcacaatcacaactcactgcagcctcaacctcctgggctcaagtggtcttctcatctcagcctcctgagtagctgggaccacaggcgtgtaccaccacgcttggctaatttttaaaaaactttttgtagagacggagtctccctgggttgcccaggttggtctcaaactcttgagctcaagtaatcctctcgccttggcctcccaaagtgttgggattacaagcatgagctgctgcatcagggctaaataagcattttctataaaaggtttattagcataatatctggcctataggaaggatggaatttatgttagttgttgttgttgctactattattgccagaccctgtgctaggcaccgaagatagaaaggagataaaagtgtactatctcaaaaggatcaaagcctggtgatgaggcctgtagggatcgagttagaattacgattgttttctaaagatggaactttgtggctattttgtagtttgggtctggagccttctgccattttacacaccaggtctatgcatctgttctttaatgcaatacatagacctgcaaaaatacacaaaggattacagaaggtgaataaagagtagtatttccataacatagcatggaacccagcagcctctagttaaaaagttttactgtgcttcccaagttcttgatttaactttattagttgaatcttccatatgccttcaagggaagcataactgaaatacaactagcagttgtatttatattaagcttcatctagtttgttatcaaagtataatttttgctttgttgaaaattttttagatttgttttgattagtctgtgtagtgattaggcagatctgtggaaaacgggtactttccaatttcttgaaattctaaacatgttttaatggtttgtttcaacatgttttactttcaatgttttagtagctaaaggcgcattactgattagaagacaaataagctcttttgagttactttacaaattttcatttatctctcatggtaatttacaattactagagaacttcggttaccttaaaaacatttgagagtaatttttcttagcaccatagatggtaatgttgatatgtggaacaaaatcttcaatagtgactggctctgatttccaaggaagttgaaggtacattgaaaacattttcagtattaagaaaatacattaaaaataacccatttaaatatgctctactagatcctcaatagtaatagtatcatgttcacagtttattctgttaaatatttggatttttcaataatgggtttctttccttttaacagttttctcctgagtggtccataataccaacttgttaaatttgcaaaagagatttgtatttcaaatttaagtgcaagaaaaagctaatgtttctactgatgttgtttataacaagagagtgagaaggcccagtgaaactgtgagaagaatgatttatcttacttactgcattagaaatcggcctgttattacttcgttggcttctacaaaagagcttgtaaataaaatgttatagccctaattgaaaataaaaggatagtgaatggaatttagccctattcatccttttggatttaagcatgattcatttcagctaaaaattttaaaaatcctcactttcattatggtttttttttttttgtttgttgagacagagtctcactctgttgcccaggctggaatgcagtggtgcgatcattatgtacattttttaatgcaagtttaatgagtatccatatctcagattagcacagcaattttttgaggcatttagaaattcccagatgtactaccatgggcagctgaatgctttggtgcaagcgcaaggtaggatcagagcaacctagggtgaaatcctactagctgtgtaactgttgcccactagctgtataactctgagccagttggttaagcgtgtgaagtctcagtttctttacttgtcaaatggggaacaaaacaaccacctcacagggtagcttagagaagaaagagaaattcattatgtagagcatattgcagtgttttgttaattatacttggaatcctttttaaaaggatggcagtaggctgaattacattcctgcatggcagtaggctgaattcttacccagtttagtatcatctgatattgaatacagctcacttcatataggatgaagtgaataaatagtctaagccagaggagttggcaaactatagggccttctgcctgtgtttgtaagtaaagttttattgctaattaccctgatttgagaaacatgacactgtaccccataaatatgtacaattattttatatcaatgatacataaaaaagttgttttattgcagttcagccttgcttattcatttaagtgttgtctgtgtttgctttcatgctatcatggcagattagttgtggcacagaccttgtgacccataaagcctacaatatttactgtctggccttttacaggaaaagtttagctactcctggtctaagctgttgtcaggggattgcttaattgatattatgaagtgttgtggtttgcacaaatgagaggatccattttaagtgaattactgtaggaatagactacagcattacttagctatttttgggctcaccagagaagtccaaggattatctgtgattagtggtgagatcctctggaatagatgggaataaaaacctagtacctacagaagggcatttggacaggaccaaaaccttctgtggttcagtttcagagtggggagaagccagggagtgatattagattcctatatgacatcctttatcagcctacagctatggaaattgttccaagcattcattacaaagtggatttagttattcttaaaaggtctttgtgaatcatcctaaatcttaaattaaaagattgtaacccgatattactatgtagagaccctggaattaatgcattttacctggttattagagtagctgcttcaggtgccagagtaggcaaaactagacaaggctctgtgtgctgcaaatgactgaaggtctgaagccatattccacttaatttaatcatttttaaaaattattattttagagcagggtctcaccctgttgcccaggctggagtgcagtagtgtgatcatagctcactgcagtctcagactcctgtactcaagtggtccttccacctcagcctttgagtagctaggactatagtcatgcaccacaatgcctggttaattttttaaattttgtagagatggagtcttactatgtcgccaggctggtcttgaactcctggcctcaagcaatcctcccgcctcagcctacccaaatgttaagattataggtgtgagccacagagtctggcttcaatttaataattttgatagatttaacatcagatcaattgctggcctctactggaagttctgagaagtctttcatttttcataataagtaatattctaccatcccaaagtctgcttttctccttaattgatctttggggagttagacaatacaatcatcattcctgagagctatttggtgctttagagtttacaaagtgcttccatttacacaattttattcaaataacataatcaccttacaagctagaagggttggaatcatccgtatttcatactgataacaacttcaggttctacgaagttaagccacttgcctaaggccatacaactctaaagggtgaaggagggacttgatttgtcttctgacttcatatcccatgttttctctgccaagttattttgtctgatgttaactctccgccaagtttactgaaaaatagctaaaatataaagtctcattagtttttaaagtaagcatccagaggagagaacatagagaccttttcaccagaaacacgtatcatctagatcagagctggcaaactgttggaccataagtctcatctggcctgcagatgtgtttgacttagcctctataatatcggcctgtacatggctttattaaacaattacatggatttagctgttaagtaatatcacaaataagtccagatttccaacttctttagaaaagtcagatctggccacactgtgcccacattcatgcatggcagtaggctgaatttaaacagttgtctcctttggagggggcatttgctttctagtttctacaagtcactataatgccctgttgccctcccattcaaacctcacttcaatcatttagggtacctacctgactcctggaagcatttgagtttgtgatccctgatctagactaggatactcattttgtgaatgaagaagtgacattcgaagtagtaagtcaattaggcagcaccaagattacaacttgttttcctgagacagagcccttttttggatcctggcttcatggccagattatcattactgaagaataacagaacagcaagggaatagtaattagaaatgccaaaatgatgcacacttttaaataaatggatatggttttagtgagggtctgctatatattttatatttatgccatattagccagacttaaaatatttcaaacatcagactatgtattgtatgtttcagttttgaaaacatgggtcactgtaaactgaatgaatgaatttcattttcttatgttggagaagttgattggagggtgcatttttgaatgaatttcagcactgagactgagtttcagttttagaagcagaaggtgcctcatgttagataatagcacatgttaaagagaaactgagggaaagagcagtgatcggtattgcgggtatatactgagaaactgggatgagtggatgcaggagtggactagcactgtcagccacaagtaggagcatgtagaagctgagtgagaataggcagtttaaaggaattgacggtgggacctacccagtgataagaaggggtgtcagatatataaatgagctgagtgagtatagtgttgatcacttattttatttcaatggcttttgaggtacagtggtttttggttacatggatgaattgtatagtggtgaagtctgagattttagtgtacctatcacccgagcagtgtacattgtacccaatatgtagtattatttattcctcaccctccttccttctcattctgtgtccattatatcactctgcatgcctttgcctacccatagcttagctcccacctataagtgagaacatacagtatttgattttccattcctgagttacttcacttggaataatggcctctggctccatccaagttgctgcaaaagatgttatttcattcttttttaatggctgagtagtattccatggtgtatatatatcacattttctttaaccactcattgattgatgggaacttagcttggttccatatctttgcaattgtgaattgtgctgcaataaacatttgtgtgcagctgtctttttgatataataacttcttttcctttaggtagatagccagtagtgagattgctggatcggatggtagatcaatttttagttctttaagaaatctctgtactgttttccatacagggtgtactaatttatgttcccaccagcagtgtataagtgttcccctttcaccatattgacaccaacatttattgtcttttgacttttcaataatagtaattcttgcaggagtaaggtgatatctcattgaatcacttattttttgtgaagtgtaatttctaggatggattatatagttcaaacccaaggggataaattatatcctattgagtgaaagaactaactaggggacttgcaaaaaataactataataaacaatgaagagtagaaattcttgttttttgaatgaacctacaaaatgcgtaaaacaaaatatttgatgaaaacattttcagattatgatggctgttcttattactattcattcattcattcattcagtaattatttatagaagtttgctaggtgtagggcaccatactgagcattggggaaacgtctctgcctttgagttgcttttgacctagttggggagataaaaaaggaagacatggagtattctacataaggcaagcccatgttaagttaatgttttggtggcttagagaaagagacaccacttctcctagcttgactttctgagggatgaggaccaggaatttgaactagatctgaggggatgagtaggatttgaaataccagaggaatggtagaagtttgtttagggagggccttgacttccaggctagataatttgcatttcaaagagatggtttccaaaactgaccaagtgagcttggtgctaagatcataatatacatttaaaagtgttttggttactctggaggctgaggcatgagaatcatctgaacacaggaggcggagtttgctgtgagctgagatcgcaccattgcactccagcctgggcaacagagtgagactctgtctcaaaacaaaacaaaacaaaacaaaaaacaaaaaaaaaagtgttttgggatggattactttcagtggagtttgtaaaatgcctttgtgaatagctgcgatttagaaaacagcttgctcaggagagaatcaaaaccttcctaagcagaaataacccctcagacttgcacctggagtccacttggagattctcccaggtattacttaggatacacagagactaatatacaaatgaaggaaaatgtacagatagtgcctactggtaatagattacagttggagaatcccattttgctaaagatagtattgagtctggaatgttatttaattttcagttcctgtataggcctatggaagtcaccttatattggagtctttatagagtctctcatgttacagggcgctgctcaattaccttattttgagcagcagaccacttgaggaagacacattagacctaaacgagctcatcagagctatttttatttgctcatagagatgtagctgacatgatgggtaaaaaaaaggaggcaaataaatggaatacagtttctgttattattcctagagatatgagtttgcaattgcaggtgctggatataattttaaacatgccttttaaagcaatgcagcagatattttgtggatattacaaacatacacctcaggacaaaaggaaagctaacctaatatgactggaattcaaggtgtatggtaagatttccagtgagggtatgtattagtccattttcatactgctatgaagaaatacctaagtgtggttccacatggctggggaggcctcacaatcatggcagtaggtgaaggaggagcaaaggcacatcttacatggcggcaggcaagagagagtgttcaggggaactgcgctttataaaactgtcagctctcatgagacttattcactatcatgagaaaacccacccccatgattcaataaccttccacagagtccctcccatgacacataaggattatggcagctacaattcaagatgagatttgagtggggacacagccaaaccatatcagggtagattcagaaaatgtttctctaacagtttagactgatgcaaaggtgtactttttggaaaactctttgatgacttaaagtttaagtggaaatgtagagtctggataaaactcatggaatttatagcattccaagattaatatataattttataggatgtgttatagaatatggataattaaattaattatataaccattaggtttgaacaagtattaatcctggagggagtgaaggttaattttacggtcaatttgagtgggccatcgggtgcccagattaaacattgtttctgagtgtgtctgtaagggtgtttctggatgagattagcatttgaattggtggactcagaagacttccctcctggtgaagtcgggcatcatccaatccattgagggcctgaatagaacaaaaacaaaggaaagagaaactcaccctttcgcttcgtgccttcttgcttgagttgggacctctcatctcatcttctcctgtccttggactgggatttataatttggctcccctggttctcaggccttcacacttagactgggaataccactggctttcctgggattccagcttgcagatggcagatgatgggatttctcaaactctatagtggcatgagccaattactcataatctctctctccacttccctctctcattctctcctttcctctctgtgcatatataacctcctttggttctgtttgtttggacaactctgacaaatacagatggtcattataaagcaactttatttttgtcacccacttttgttcttttaaatttattctgtgctcctacttattattgttctggtttgaaatttagacacagcctcatggttcttccagtcacttctacttccactggaagtacagtctgcttagtatatttattccaaacttcagaatttattgaagttaaagcttcccctttctcccagtgcaggactgctgcagacgagccctcattagtgggagatgtgctgagaagcccttctctttcccactcagtgcttctacttcctctcatcctctcctagcttactccccttgaagcatggtggggtatgtcatcagagtgaggagaggttggagctgaaagcacccactgtcttctgtggggcctggaaatctctccctcaccggagatcgctcatctgtgcttgtcttccatgggtgaaaacatttctcctggttcgtctctcctgatgctttgctcagctctgcacacaacttcagtttccttttgatgaggccccttgcttgcttctcagcattcattttttttttttatgattagcaagatttttttaattatactttaagttttagggtacatgtgcacaatgtgcaagttagttacatatgtatacatgtgccatgttggtgtgctgcacccaccaacttgtcatttaacattaggtatatctcccaatcagcattcatttttaaaactgtggcaaaatatatatattacaaattcatcattttaactattaaattaaattaatttatttttgagacagggtctcactctgtcacccaggctggagtgcagtggagtaatcatggctcactgcagccttgacctcatgcgctcaggtgattctcccacttcagcctcctgggtgtctgggaccacagacacacaccaccatgcccaactaatttttgtgttttttgtagagacagggttttgccatgttgcccaggctggtctcaaactcctgggctcaaccaacccccctcctcagcctcccaaagtgtcgaaattacatgcatgagccaccatgcctggcaatttcaagtattttaaagttataattgtgtgattttaagtgtatctatagtgtagtgcaaccatcacaccacacatcttcagaactttttcatttccccatactgaacgctgaaactgtactcattaaacactaaccctccatttgctcctccctccagctcctggcaaccaccattctcctttctgtttctatgaatctgactactctgtaacctcacataaaataaatcatatgatatttgtctttatgtgactggctgttttcattcatgttgtagcatgtgttcaaaattttcttgtttttggaggctggataatatccgcattttgtttattggttcatcttttgaagggtacttgggttacttccatcttttagctgttactaataatgcttctgtgaacataggtatgcaaatatctgtttgagtccctgttttcacttttttggggtatatacccagaagtgtaattgctggattgtatgacaattccatgtttaattttttgaagaactgtcacactgtcttccatagtggcggtaccattttacattcccatgggttccaatttctgcataccctagccaacacttgtacttttctgtttttatttgtttgttttataatagcaatcctaatgggtgtgaagttgtatctcattgcggttttgatttgcatttccctagtgactggtgatgttgagcattttttcatgtgctttttggccatttgtatatcttctttggagaaatgtctattcaagtcctttgcctgctttctaattagattgtttgtttttgttgttgagcatcagcattcttgggtaggatttctggtgaccctgtgctggtccctgtgtgctccatcatcagggtcagggaagcatacagatggcacactccagtggaggaactgaggagagcttggtgaagagattattctcagaagtgtgggcagtgttgagatactaacaagggatgttgaagtgccttgtgtaacagtgtagagtcattatcacccctgggcctgaggggacaaggagaaggcatgaggacagagagcctagagagagctacatctgcaggagaggactgcccagcagaagctgtcaacttctctagaacctgtgctaacccagcagggagaaaactggggggataaataccccattctctctccccttccttgttcttgtcttctgcaggtgcctcctgttggacaaatgtagctggaagtctgtgataatttccatcaaggtcagtctcttgggcatagagcaggatagtaacaggtggaggctgggtctacagtggtagacaagatatatccagcacatgagtggaattcctctttggtccacaggatcttctacccattgttgggagtgcagttacttctcaaaccacaggcttttctctgctgccctaggctgcttcagtgagtcacttaccctttagggttctcaagagtgtgagttagtcgccattccaccacaaccaggaagcatgtgagctctaaaaattccactgaagctccttactctaggcttgaggtgagggacaaattcttccccaaattcttcttgcggggaagatgagactcatagcacaccagtaactttctccaaatagtcttctgtaatctccaactacctagacttttatgccctcagtagagatgaggagaagggtaaaatctaggaaactgcaatctttacgcagtcctttcacacctcactgtgaaatatgctggctatgggctaggaactttagcagaaactggggctgaattggttgtattttaacatcctgtaacaaacatcatatgcagtccatatccctaaaagtttgtatattttggtaaatataaacacatttttaagaaagtcatctgagtcagaaatgggaaagattgctttatatttgggattacttcatatttggggatataagatatgctttctttgacattttcccaatgtagaaacacaggccaaataggataactcatgaattccatgaaatttatccaagtatctcttagctttaagtagctaaaacctaaattaggtaaatgaaaatatttcaacatttggtaaggtgtgcctaaattaaagttcacactagaaacattcttgtttaatttcaggtgagttcagtagagtagtttccttggcataaataatttcacatctaactgtttatacttttaaatgtattttaattgtgaaggcctaatttctgaatttagtttagaataaacctctagccattttctttcttatgtatgtgatccccaaagcagacgtgtcctaggcatcagttttcttatctaatcagagaaccagtgaagaaaggaggaacctgtcatctccatgcagaagcaagggattaagtgattaagctgtcatttctcaaagcctttctccaatgcttgccccataagttttgggttttaaatgagtttagtggaattctgcagtcttaacatatggcacatatccatgacttcagtaaattacaggtactaacttttgttctttctggtgcagatgtgttatcattttgctctgttttgttttataatgtcagccttctctgtgttattaatgtagtgtcatgtgctaccattttaggtaaaaagctttttctgttatttcctatgaatctcctaggaatggacccatttggagaaccagactgttcattctttcctttccctccttttctcttcttccactccttcaaagtattggttgagttgctatattatgtgtcacaggcattgttccaggtgttggagaatctgaaatgaaacacaaagtccccctgctccaggagcttgctatcgccatccaatggaaaggaaagcaacaagtaaataaaaactgccacatgatatacatgtcagacaggagacacatggtataatgagaataccacaaaggggcctaatggggtgacccaaggtgggtcctgagggtttatgaggcaatagttccataatcaaggagaagaaaggcaaccctgggcggagagcacagcatgggaaggccaagaccagggaatccctggcatttgagcagtcaacaatctcagcgtcagccatgttcatggtgtggtacagtggtacttttgtggaggcatacattttaaattcatgccctgggtggccagtgtacaggaggaaatcacttaatgggggggcgtgtgcccagctggctgctggtatctgcttctttgtttggctctgtcttttgcttgctatcctagatgcaataactcctatgaaatgaaagcaagaactttctgtcttagtgacaaatggtcatcttatgagagttgaaaggttaaattgtcacatgagtttatgcacaggaaatgtgatttgggggagaaacaagtgcctctgcaaacatttttgtatttgggaagtggggatgattgcaaggtttatgcctgcagcgacagggagggggctgcatacatcatgttgtgtgaagagacggggcattggaggaagagcaggtttgttcaaggtgacgggcaagagggaaagggaaaggagggagaagaaagatggaaggagatgatgaattctgttgagtttgaagagagatccaggccagaaatgctggttaggaaggcattggtgctgcatggtagtggaagtcacaggggtggactaggtcatttgaagaatgcacagagagatgagagggctaaggaaaaatctgaggaacagcacagggcatttttagggtagtgaaactattctgtatgatactgaggatatggtagataaatgacattatatagttgtcaaaagtcatagaactacataacacaaagaaaactctattgtaaactttggaatttagttaataataatgtatcaatattggtttatcagttgtaacaaatgtaccaccagaatgcaagaggttaataataggagaaattgtgcagtgtggggagaggtgaatattgtaggagcactgtattttctgtaaacctaaaactgctctaaaaataaagtctattaattaaaaaaaaaagccagtgaagatcagttatgtgcatagcagctatacttctgcagaatctccttggtgagcgtgcttttttcaggcttacataatacagttaaaagaaagaaaaataacactcccctcacagagaaataatcagctgaacaaatcactagttatcagaatgcaggctgtagtacatcctgtttttctaactcctctaaatttactagtaaagcaacccaaattgcatggaggaggggaggtcattgcttgctgtcaaggctgcactaatgacattagggtggcattagcgtaccagggctctcctagtcctcactacaccacattttgaatgagttttgcttggacaagtgttgagggtgaggtggcgggagagggaaggagagagatagcttgtgctttgtcctattacctgaaccagactcaattgtcaaacatttttagtgtcgttttcctgtgctcacggaatcctgagagtgtagcactactgtggggagggcaggagccaacaggtatagctggcttatcccagcatttcttccttcccatctgtgcacagcgtaagtggcacagtccacagagtccgctcccattttctctcttcccccttaatggggcgggggcgtgagcccagctggctgctggtatctgcttctttgtttggctctgtcttttgcttgctatcctaaatgcaataactcctatgaaatgaaagcaagaactcaaagctcaagtggtcaaagctcaagtggcagccaagtggtttcttgtgatctgctgaggtcggcttctgataattagaagtgacaggtgatgactatgttatcataacctgcagccacaccaccttcttctggttctgagacaatgtgtagtagaaatggttatttgttcatcgagctggtccccacaattcacacccaaagaggccttttcatggccctgcacgcactgatggctgtttcaggtagacaagcccagcagtgtgggaacccagatatctcccattctgtgtgaaggagctacctagtttctggaatttaactagattagaacctcaagtgatgcattataggtctgaagaagcatgccaatcatgacctttatcttccattttatgaacccttggagtggagcctttagaaagaggaaacagcagagagagggccttaccttgtggcccatgtggtgacattttaggagctgcaaaaagggtccctttgcctcccaaaaagttccctgaggctgattcattcaattctatatttaatgtttcatttagtaacactttagattgaggattattgttttatgttaaaatataaataccttctgggtattaactcttttcagttatagcctttatggtaaaggagttgccaagggctcagaatttgataaggcaaatggaggagaaagcatgagggcttagtgggtgggagtggtggagagtgatatggagcgagacagaaactgaaaactgaggccagaggagaagaaactgtgcctatttattcagtttttcctgggagtttccttgagaagaatggagctatgtgtgtgtgtgtgtgtgtgtgtgtgtgtgtgtgtgtgtgtgatatgagattgcttgtgcgcctgtgtgcatgtgtgtatgtgtatgtgttgaacgatactgtggaaagtttgggataagaaatgataactgggaagagccagacatcgaatgcaatattctcaactaacattcttcttagaatgatgcttggttccctggagactttatgatcatgagtgctaaatgtgtgaggggtgtgtgtagggaggcagaaacagtgatggtttcatagatgtccaagttgctgctacctttgtaaaatcattatttgtcccttcatctctagcctgttaggtaccaatgtatttattgcccactcgaactacttcctctcatcatgggggcctcctgtttttgaggcaacataggaaattaggactgatgacgctgcatcagaaaagcttttgttttcacttggtttaagtctgatagagaagttggctacatagaacctccacaggcagttgctccaatgacttaaaatgaatttgtccttctgcctcaactctccacagttagcatgtgctcattcacccactcctttttatggcccttggattcacccaatccaaggtgaactacttccttacttctatgtcttcactgtcttacgatcttgatcaaacagacaacacactcaacgaaggtgtgggtgggaacggaacccacccacatgattgtgaatcacctagagactggcagcagaagaaaatcactgccaccctaagccttgagtggccagaggagagagacacattcattttcagaactagtgagagctacagctctggtaaggaacctcccaacaggagttgtggccatgggtaggacagctcaagaccataagctggcaaggaaagatcacagaggaaccagtatcctgatctttctctattcagctatttcttcccattggtggaagcccaagagaaacacaagaccagggtccctaaaggtcagcttctcaaggcacagagcagggcacagaaaggtggtgtgtcatactggaggggcaaaaaagctggcaccatctcactttctgcatgtataaaatgaagacgtaaactgccaggattgaatgtgatctacatacaatcatttagcacagcacctggacaataaaaaggaccctataaatgtagtttagtagtagcagtgatagtaatattagaacatttttactacattttagctatatcataagtaagtggctctccctgtagcctaataattaacatcccttatcatatcctaaaatttgtaagaaataggcttaagtgagacttgcttgtttagtgatattcatacctgtagatgtgaatgtatagctacatgcttctttaatttggacagagagaaatgtagagagttgtgatttcatgatttcaattctacagaattctatagattagatgtatagggcgttgctgccctaatggataccataacaaagaaataccccatcttttcctctctccatgactgagcatctgccttagtgcagattctggaaaggaggggatggaccatgaaatttaaattgcatatatagatgtggctatggaaatcatatagaaccaacattcctccctttcttccctctcctacatattgtatatgtaatacgtatgtgtgtgtgtgtgcttatccacagaatgtgtgagtttgaggaaaaaaacaagataaaacacattccgtaggtagtgcagtcacacatagctgaaaaacctgtatcagttatcaattatctatttgtttggagcaaattcctgcaaatcattaaatatacaaatttccactttcattgttaaattacccaaagtataatctcaaataacctctgacctcctggagttgatgacagttttatactgaaaatagaatttttttttgtacatctatagtgtatcttaaattacctaaaagaaagatgatgccagggtagttaaggagggaggtttcagttttggccaagtttcgtacatcttaattgcgatactttgcaccccatggatacctgtgagtgcaaaaatgtctgctttgtttggacttatatttatttttattgtcttcccacttttattttagattcaagggatacatgtacaggtttgttatctggctatattgtgtgatgccgaggtttggggtacaaatgatcttgccacccaggtactggtcatagttgtttgtagttttagaagaaaaaatgaatgagactcaatttaacactggtaatatcccttctttcccagggaaatttagtgagttgaaagttgcaagagtaatgctgttagtgttagtcacttttcaaaagtgttttgccatttaatattcatttttggggtcttctgtgtggtcatgtgggcctactatattatactttgaagagatcagtgaagtcatatggtttaaagtttcacttgatgaatgagcaaactggtgttcacaggggcaaagtgacttattcgaggtgataacactggtgagctggagaacaacctgctatcactttatttcccttttttttttttatcttggagacttttattgaaaggaactattcaaacttttcaaacttttaaggtccatatttctgagttctgagtgttctaatttgattattcataaaaaatatgcacagttcctattctcatggagcggatagttgatttatgaatatatgtgtatgtatcctgttaacgagtcatcatgactaaattaacttagttaagctacttaacttttcagagccttaagtttcttataggcccagcaagttttattggaaaaaaatgggcttcgaaggcagagagatgtggtgttttctgtttactagctgtataagtaactcatagaggaataatagcctcctcatggggttgtttagagggtaaaatgaggtaacctacatagaatacctggtttatgcattcctattgtatctgtaagttggagatgacactgtgcaacctatttaccacatggcattgtgattaccatggagacaatggttggaaaagggcactgtgaacagtgaagtgctgctgtcacatcacttattgagggattttttttgtttgcttagttatttcaacgtaagctttctattgagggacaacatgcacacagaaaactacacacaagagtgtacaactctatgaattttcacaaagtgaacatacttgtgtaaccagaacctagataataaaagagaacctcctagaaagccccaaggtacccttttcccatcactacctcatctcaaagataattatcctaacttctaactccatagattaatttctcccattttggaactcttaaccaatggaattatacagaatgttctcttccctttctggcttctttgactcctattatgtttgagaggttgatccattttttttctgtgtagttgtggttcattcattctcatggctctagagcaggggttcccaaaccccggtacggtctgtggcttgttaggaatcaggccccacagcaggaggtgagtggtgggcaagcgagctaagcttcatctgtatttacagtcactccccatcactcacattaccacctgagctctgcctcctgtcagatcagtggcggcattagattctcataggagcgcgaaaccctattgtgaactgtgcgtgtgagggatctaggttacgtgttccttataagaatctaatgactgatgatctgtcactgtctcctatcacccccagatgggactgtgtagttgcaggaaaacagctcagagtttccactgattcttcattatggtgagttgtataattatttcattatatattacaatgtaataataataaaaataaagggcacaataaatgtaatgtgcttaaatcatcccaaaaccatctccaccccctggtccatggaaaaattgtcttccacaaaaccagtccctggtgccacaaatgttggcaactgctactctagagtgtcctattgtaccccacaatttatgtatctattcttcagttgatgggcttgtgggttgtttctaatttttggcttttatgaatagtgctgccatgaacattcttacatgtgtcctttgagaacatatgtatgcatttttgttgtatatatatcttgaaatcaaatttctgggtggtaggatgggtatacaaaggtttgattttaataaatagtgacaaataattttccaaagtgtttgtaccaatttacatgactacaaatataatattttttaacatctgtaaaattgttacattcatagtgggatatacaaaaatacagcttgaatcattgaaaactgggtttatgtttttctcttttgttgacattctattttagttatgttcttagattgcatggaatacagcctcatttccagtaacttagcttgtggggaagaagggtgttattgtaaagattcttatgcatataaactcagaaaaagctaaacagtgaagctttaaaaaggccagaaaaatgtacaggtgccaggctgtgggatcttgagtgttctgctctttaggattgattctggtatcctgagggtctgtccatccttgtgggacctgtattctgcaggcaggtaccataaggtactgctgtaggccagcatcattctgagtgagcatctgttttgtttggttgctcttctaccatgcactttgttaaacatttggtcatcatcctgcttaagggaagcccatatttgcaatcatttgtcaggatttccagccctctatgtgaactatgttaccatttctaagcaattaacttctggaagctacctgctctcattggtccctaaggagtagatggatgtactgtccgcccttctagatttagaggttgttagatactctgtatttatactagatgctaaatgaactacacagaatcataagaaattcataagaaaactttagcaatcacaattttttaactaataatgtgagtttttaaataatagacataattcttaatgtaaacttctactaagactactttacaattttttttaatatcttaaaaaacaaggggcacttcttgccattttgtgctaacttagtctttattggttgaactagtgctaggcaaggaaggaattagctatagggagcagggaagacagatctaaacagttctgcacttatgagcatattagtgaataatagagatgctccttatggaacccaggcatgaaaaccatccttggacctgtcacatcttggaattatgtgctggactcttgtattggttcgttgactttagttgtagtttaggaagtgatagccagaaacttgaactcttgcttctagcttttagaccttctacttaagacagaagaactatgtatttcacctcgtctaacttctagtatttcagataatttcttctcagatacttttttttggctcaacctatgcttaatatttttagctaatgctcactctgtcatcattaaagtggtttgcagaagaatatatggcctacgcagaagaatatatggtctatgcaaataacttctcactgtacattctctatacagacctatacaaatattttcataaaacttctgagctggaggtggaactattacaaagtgttgtggttgaaaaaggttgatggattgaggttattcctcaagacctctttccaccacaaaactgaatatcctaattagagaatccattagaaggaacttgaccaagtctgtggcttaatttatgcctcaaagtgaagtgattaatattattcaatgcatgcataggaccagaaattcttatttgaataagttattcaacttatagggtaattaaaaactgaaagtaaactgtcatttcactgctatattcctatatattaaattaaactttaaacattatttaaggattcaatgtaatatatttagcttttttttttaaaagcaagtctggaagctgggccaatttctacaaatgttctgctcagtagctagccttttgtggaaactcaatagatcttaaacacttggttcatttaaattactcttctttttgctttcaggaaagattgagaagagttacagggaagtttagtggattagtcattcagttccttgatggatcacttgcatgtgccaatgccagggaacatttaactgattaaaacattctgaatgaatttgtcatttgggggtactctttgaatgaatatctttattgcattgactgtgtcctactgatatgacttaggcttacttccaacattaattctaaagaggctctggctaacttatctgtagaatgtgtgtccaagtcaagttcgtgatgtatttggttaaaaaaaactttgtggctcttgaaagaaatacaaagatttagtagtcagtattgtttataaagtctagggtggtcatatttaaataataaatctaagaattagatgagtactgttacacatttttgttaataaatcttaaatactggaaagaatagacttaagaaaaatattccaacattgaaaacctaagtatctaaacatatttcagtctcatatgccaaaaaatatgaaattatagcatttttggtcaggataaacgcctcctgcatctttttgtataagaagtattttgaatgaaaatagacttgccatgtcagactatttgaaatttaagttctgttttcaattttaggttcttaaaaaggtccaacttagccaatgaacataaaagtgcttactgctaatttagctgctgctgcagaacatgaaaggaaatcatgaggccattaacacatctagaaatagtcattttctagctttcggttcctaagatagcttagtgaaaataaaatattcagacaaggcagggtagggaggtgagtttttaaaggattttctttttaaactttccttccttccaccctcgctccctcacttccaccctcctttatttctccttctttatgtgtgttaacttagaacttcacttcaagattttccgagtgctaagtgataggggcagtgagatatacgctttatctccctgcataggcaatgagtaaaaaagatgtgaaattatggcaaattcaccagcagatttcaaaggtgaaaatgcccttcttgtaccagggttaatatgatctccagccatccattcacagatcatgctcactctgttgatggcaaaggaaagttctctttgaggccttgaaatggaaactgcacatcgtgcctggaaagtccctccaggctagtgttcaagaagtctttctttcacacttcagtttcttcattgcattatatttactgactgcctaccctatgttagaccctgtgttaggtcctgcagtcctgttcacaaggatattatagtcttgaggggaaggcagacattcattaaagactcacctcagtgttgacgggcagactgcaataaaaaagtatgcggcactgtgaatgtgtaacaggtgtgggcggtggtcagggaaggctgagactggttaactgggcagaggcaaagggttgcaggcaactcgcctgaggtggagaggcaaggctggtgacaggggcagggaggccgtggacagccgatatcacaaaaggcggtgctgaaagatgcaaggggactgaggacttctttttagctgagcaaacagtgcacatttcttccactcagacttttccttttctaattaaaaaaatggggacatccacatcttgataacacagttaatgtgtgaatataataactgcttaataaatccttgttgaaataggaatgctgattaaggcacttaggccagcagctgaaggaggcttaatatattcagagatgattcctaggtatctagaaaaggatattttaagctaagagaaaagagggacagttcaccagtttcttcccttctagggaaacaacataaaaggactggagttgttaaaagacagggtgagaagtctgttgacataaaacatgagaaaatgaagtttgtgatgttttgatgcagaagtaagttatcattattgttgagtgataatggcattaattttctgaagatgggcagctcctttcatcccatttaatgtgtatgtgtgtgggcatgtgtgcttgcatacctaaggctaaattaatttttggtacaatagggtagggttgctagatttggtaaatggaaatacaaggcatcaagataaatttgaatttcaggtaaaggaagtataacttttggagtatatatatatgtcccaaatgccctaccagagtggaattttcctcttaagaactctggaggcgtgttgcctcatttcccccatgtttttagtcattgcatgtataatgtttatatttatgtttattcgcagtttatttttgccacatatatttttagaatctaaattttcccaatagtctggaacctttggtgggtgtacataatgtgatgaaggattctcttcctggagaggctgctgatatatagccaagattctgtctttgtgctctgggcttctgtctctgtagtgttaatatttcaagaatgagactagagcatttttcttactttagtgccctttggagcaacagaaagctgcctttgctgcaaaggaccctgtggaatgattgttgatctgccttctagaaactgagctgtgcccaaaaccttttaccagtttctaaaggcacctgctttcattttcctaggaaggttctttaggtgagcgatagtcacccctatatctctgcaataccaagtgagcagcttgttgtgtgtagataccatgaaatagaaacagattcatgaagataagattagaaggtaatctttagattacagaaacagattcatgaaaataaggattagaagttgtgaatgaaaacaactgttgctttggatggctggatttaaaaatgttcctcaatattgatgatgtggtattttaattaaaaaataggatcagatcatgacacatagaagaagctataatatgcacaatgatctgcttttccaggaaatgagtatctttggggatcagcattgagctcactacacatgataaaaaataaaactcattggaaatctagaaattggcaactaaaaattgagtcaaaatgtgttttaaccaccccacccccctcttgtttgtttttattcacttctgataacctactggctgtttagttatattttatggttgttttggctatcacaaactcatacagaatagctggaattatcagtctcaacagggaccatgaagacatatgtgtgtaattcagtacatatattaaaaaatagctaatttacaatattacaggcacaagggagcccactgatgtgaagtttcagtgaaacagtgtaaagaaatgatgttagttaaatatcactatttctcaaagtaaaggatgtcattgtattagtagaatgttaaccctctcttttatgggtcagttacatcaacttcatcataaaccctcttcaaaaaacatgcattttaggacttggatatagtcaggtctgtgtttcattaagcatttgttcagattccagctctcttgctccacaaccattgatatttctcaatttatctataatttacaccctgactgtctccataaaagatataatgtttataaggaaagatatatgcaattagataataatttgaatgcttttacagggagagggaaataaatatgccacccaaacctaggctaatacattcattgaaagcgagtactaataattatttctaagcctcccagcagccaaggcaaaaagggactccagtaacataacatgatcattatttcattgtttacttttactactccctattccacgttgagattgttagagatatgttagtgatcacctcaagtcttattacctccagaaatgtaaagtttgacttaaaatcacaatgaactcttccaatttttttcatactatattgcatgtgcttaagtaattctttgggcttggttttagatttttaaaaattatggtaaaaagcacataacattaaatttaccatctcaaccatttttaagtgtagggttcagtagtgttaaatatactcacattgttgtgcagcagattgctacaactttttcgtcttgttacactgaaactctctactcatgaaacaactccccatttctccttctcctcagaccctggaaattaccattctactttctgtttctatgaatttgaccactttagatacttcatatgaatggaatcatacagtgtttgtcattttgtgactatttcacttaacgtaatgtcctcgagtttcattcttattgtagcatgtgacaagattttcttttttttttttaaggctgcataatatcccattgtatatatttacattttccttacttattcatctgttgatggacatttggactgcttctatctcttggctattgagaataatgccacaaggaatgggtgtccaagtatctcttcaagatccttttctgaattcttttggatatatacccacaaatgggattgttggatcatatagtaattctattttgaatttttggaggaacctccatgctattttctgtaatggctgcatcattttacattcccaccaataatacacaagggttccatcttctctacatcttcaccaatgcttggtattttacgctcttttgatggtgaccatcctgatgagtatgaggtgatatttcattgtggtttttatttgcactcttctaatgattagtaatgttatcatcttttcaagtgcttatgggccatttgtatatcttctttggagaaatgtcagtttaagttctttgcctattttagaatcaatttttttgttgttgttaaagtttcttatatattttggatattaaccccttttcagatatattatttgcaattattttctcccattttataggttgcaatttcactctgttgattgtttcctttgacatgaaaaagtttttgtgtcattccatttgtttatttttgatttcgttgtctgtgcttttggtgtcatatttaagaaatcattgctaaattcaaagtcctgaggctttacccctatgtttctttctaggagtttaacagttttaagtctaatttttaggtctttaattcattttgagttaatttttatgtatggtacaaggcaagggcccaaattcactctttttgcatttgaatatcctatttttccaacactacttgttgaagaggctgtcttttctctgttgtgtggtcttggcactcttgctgaaaatcatttggtcatatatgcagtggtttatttctgggctctctattttactccgttggtttatgtatcttactttaggccataccacactgtcttaattactgtttctttgcagtaggttttgaaatcaagaagtgtgatgcctctgactttgttctttttcaagattgttttggctcttttgggccccttaagatcctgtagaattttataattatttttctgtttatgcaaaaagtgtcattggaatttttatagagtttgcattgtatctgtaggttgctttgggtattatggacaactttacaatattaagtctttcaacccatgagcatgggatgtctttccatttacttgtatcttctttgatttctttttgcaatgttttgtagttctcagtgtataagtcttttatctcctgggttaagttttttcctaagtatttaatccttcttgaggctattgttaacagaattattttcttaattttctttccagattggtcttgttaatgtatagaaaatgcaactgatttttgatcatcgattttgaatcctgcaaacttttctaaattcatttattagttctaacatttttgtgtgtgtgacttaaaagaccatgtcatttgtgagcagagacaatttaggttcttcttttccaaattttaggctttttatttctttttcttgtctaattgctctggtaagaacttgtagcaatgtatcgaatagtcgtggcaagagtgggcatctttgccttgttcctgatcttagagtaaaagcttttagtcttttctcatcgaatatgatgttagctgtgggcatttcatatatggcttttattatgttgaggtagtttccttctattcctagtttgttgagtgtatttatcatgaaagcatgttgaattttatcaaatgtcttttctgcattgattgagatgatcatttggtttttgtccattttcttaatttggttattacattggttaatttttatattttgaactattctttcatttcatttataaatccctcttgatcatggtgtgatcaacgtgtgcttgaatttggtttgctattattttgtttagggtttttgcatcagtattcatcagacatattggtctacagttttttttgtgtgtctttttctggttttggtattaggataatgctagcctcatagaatgagtttggaattgttctctcttaatttttttggcagaatttgaggaggattggtaatcattattcattaagtatttgatacaattattcagagaagccacatggtcctgggattttctcttttggaaggttattttttttttttattactgcttcaatctcctcactagttatagatctgtttccgtcttgataggttgtatgtttctaggaatttgtctttttttagattatccaatttgttggcatataattgctcatagtagtatattttttattgctgtgacatcagtggtaatatctcttttttcttttctaattttagccatagagtcttctctcttttttctttgttagtctagctaaggatttgtcaattttgttgtttttttgggaaaaccatcccttggagtcactgattgtttctattctttatttgatttatctctactctaatttttatggtttcctttgctctgctaactttgaatttagtttgtttttctttttctagttactgaaggtataaatttaggttgttgattttagatcttttttcttttttaatgtagatgtttactgctatgcacttcccttttactactgctttcactgcattccataagttttgtatgttgtgtttttcttttcacttgtctccagatattttctaaattatcttgtgatttcttcttagactcattagttgtttatgagtgcattgtttaatttccacatattactggattttcctattttctttctgctattgatttttagttttattttattttgattggagaaggtattttatatgatttcaatcttcttaaatttgttaagatttattttgtggcctaacatgtggtctattttgggaatgttccatgtgcgcttgagaataatgtgtgttctgctgttgttggatgttgtatatatatatctgtagacccagttggtctgttgtgttgttcaggtcctcttgtttccttattgatcttctctctgattctgttgataactgagagtggggtattgaagtcttctactattatcatattggtgtctatttctctctccaggtctgtcaattttgcttcatttatttaggtgctgtaatgttaagtacatatctgtttttttactgttatatcttcctggtgaattgacccttttatcattatacagtattcttcgttgtctcttgtgacaatttttgtcctaatgtctactttgtttgatacaactctggtcacttctcctctctgtaggttcctgtttacatagaatatctttttttaacccttttactgtagcctatgtgtgtctgtaaggcaggttcactgattaccaatcagtaattctaatttctatcaattgtatgagacagaacactcaaacaagttaagtgaagcaactttataggcacagttaggcagcaagggacaacaaaagcctaggattcatagttccccaaagctcagagtgaatggaatctttctgtgtgttacctactttgcagtgcaggtgaagaactttgaaagcagtctactctggattgtatacccaggggcaatggggattgctgggctaaagtgctgcagggcatcctattcttggagggacaggaacagagcccaagctgtttcagatactttctccttatctcaagatgctgcactcctaatatatcctacagttatttttgagaactacaattgagaaagtggggaagagtgcagtcagtcaaggccatcttggaattcgttctgcactgtctctagtgctaaattgagtctcttatagacacaacatatggttggatcttatttttttaagtccttcggccaatatgtgtcttttaattggtgcatttaagctatttacatttaaggtaattactgatagggaaggacttactattgctattttattgttttcttattgtttttgtccctcatttcttctcttgttgtcttcgtgtttcatttttttttgtagtgacatgttttgattctcctctcattttcctttgtgtgtagctgtgtgtatatgtgtatatataaaaatttatatatattacatatatataaaccttaacgagtttgagtaagaagcagttcatgaattgggaaacaccaaactgaaagaggtttagtgttctgatgacaaagcataccttacatatattctatagatagtttatttgtggttatcattgcaatgagataaaacatcttaaaattatgacactgtattttaaactgataacaacttaactacaatcatgtagaaaaccttttacatctctgccccctcccagtttatgttattgatgacacaattatctgccgtcatatttcatatccatgaacatagatttatcattactttttatgctttattaaatagattttaaaaatctataccagatttataagtgttaatttttctagcaggctttgatatggttggctttgcacttgcctggggtgcaggatccttttaactggtttctagatttctctcaggggcattggtccattggtcatttttaagttcatatttttgtggttgaaggggagtccagggcttcctattttgccattttaatgttatcactcctggttctaggttttatatatggtgatattgaagatcagtttgtgattgtaagtgctgagactaaatgagactgttatcatcatcctttgattgtgaccactttattaggactatcgcttttcccttaagcctttttgtttcccagatgaatcccattaattgacttttggggtttaccttttgggtaaatcttcttactccaagactctgtgtctatgtaccatgctgattaatattatactagaaagtggtttgctgttttatttgactacagcttaactaaaaatcttttgactttccctaggaaaatctgagaaagcgtatcataggtggtctgaatttaaggcaaatatgggtggcgattagaccaattatagacaaacatataagaaagctgtgagaatgtgtgtgagatgaataattatgaaacaccaatgaaccagtgcagctggggatttaaacatctaagtgggcttaatgtatcattttatatagctgaagtaaattaaaacaatattttgtgtgaacattaaacttttcttcctttggtatgaatactctggggatttggaataagcatgattattataattcacacctcttttaaaatcttaatgttgtttgtggctagttgagcatgtgagactataaagtagtgaactctgcgctctttatggccacagcttttgttcctaattcttcttggcctgtttcaacctgtgtgtcatgactcccaagctgaactaggtaaaagaatgtgaatggatcatcatttctagaaaagcatctcagaacatagtccatttagataattggtttaaaaagtagccttttatttcatagaaagcagcacagtctaatacaaggaactggtgtgctacacatgaggacatgctctgccttaataattctctggctgtcttaggtagaaaagtttggggttgaaagaaaagtgatgtctgtttcaaaggaatgaaaattcttagggtgtaacaatagcttattagtgaagagcctaactttggctcaagcatcagactgcttgagttcaaatacaaattcctccatttaccatcaatgtgagcttggtcaagttattcctccaatagtcagtttcctcatctgtaaagtgagcacaatggtaggaccacaatttaattgattctgattggaattaaatgtactactctgtgtataaagaagtaattagtccagtgcctggcacatgataagctctcaataggtattagaccttttttttcttgttaattttgttgtttatgttatctttattataaccatgtgggaagttttatgctgaaaaatatataatactgaatttttttaaatagataatatgcaacagcatctgtaatgactgcataaacaattcttgcattttcctgaagtgttcattttaaatgattgattcatggctcggttcaagtatacacacagattagcctttgcaaataattcacttaatactagctacaccctgtggcagttgttttaaggtttttgatctctagggggtgtacagaagtgttctacttgtgcaaattgttttcctttttatgtcatcaattctgaaaacgtaggcttattacaggaatttttccccccatatatttttgagcctcatgcaattttgtatagcagtagccagtgaagttatccatattgcttcctctgatatagtctctgagtcaatttgttttaatgtttaaaaacttattgcctacttttccttgacacttacatgttcggcgtttcagtggaagataaaatgaagaaacttgatttccactccactagaaacaggctattttccttctatttcatcaaatctcaaagcttatagagattataactgcatgttggttattttactgttcttgcctatctatctatctatctacaaatctatctttctatcttgttcattttagggataatgaagaagcatttagtgggaccccacaagcataataaaaagtgtcactgtaagatatatttacaagcataaatataaaaagcaatatagtacttagcaaaaaatataacacattctctcataaggcacattttttccacacttttattttgtttttacgatttaaagtagtcacttaaaaatcagaaagcaaaagttttttgacctagatttagttggtttataataagtcttgttggttatggtgagtaatcagttaatacctgttaagctaataatgaggtaagaaatatattgactttatttcttggtgtggaaatgacttattcattcaacagatacttattaagtgggccaggtactacttgttaatacaaatggtgaataaagtggcttacactctaatgagagagacagacagctccgagttaacaaatggataaaaatatacttacatatgtgatatgcatagtgtaagataacgagggtggtcacggtggtggtaacctactccaaatactgtactcagagcatatgtgtgataaatgaagttgttgcagtatgtttaaaacactggagccaaaattttgagtgctcatttgaaaacactttatagtaaaacagtggtgcttagaatgatgcattaaaaaatatatatgactatcttgctgaaggtaaactttttttacaacttacctgacatgatctttctaaattacaatagattgtatatgttggaaaacatttttgtaaaatgtacaataagtctgacatgtgagtgaaaaaaaccttttttcttaactttcaaaagtgctaaaatgccctgtgtagtatcatgtaaaatagtgacactaatgcctcactcagtggggaggtagatgtggctgaggagggacagatgaatggatctagtcagtagtaacacatttgaagttctggctgatccacagagtcttttacttctagggtcaaggtggtaacagccaattaataggagagcaggttggaagaagagtaaaagatctacatgctcatgttacttgtcgtgctcacagaaaacaaaccagttttgtgtgagaaaattgtttcccgtcaacttgaaaacattgaatttgctcaccctggagctttctttgatgctcctctcttcaagtcccatgtggctgtcttccttctaagaaagctatttataaactgcagtgctctacgcaactgtaagcacagtggctgcagtctagtggaaatattttggggtcacaggtagttctgtattcaaatctcagctctggctctttctagctgggagacttgagcaaattatttaacttcctgatctatagcttcctcgactctaaaatgggggtaataaaactttgtttacaggattgtgtgaggattgagactgacacaggtaaggcgtcttctaccatggctggcacttagtctgttttgcttattacttagggctcaactttgaacgaacttgaggttacaaagctcagtatcaggttatcctcgggttgtttcctctgtaatcctcatttccctcagagcatggtgagagtcttgaagacatgaaacattttatgcttttctaccttccttgtgccttgcagagtcctcagtatccagtcagcacttaatgcttatactgccacttctggactgcctttcaacaaatttctcaaagttagagaccatgaagggcatggagactggtgcttttcatgccgtgcttctgcagattttggtggggaggcggtaataggggaatgaaggtggagccatatgaaataaactcttaaaggcatgatagtgaccaggaaaataatatgtaccatattgtgtgacaatccctatgcattgccaaaattgcccagtgtatttttattatgattaaaaccacaatgacacatatgatgcccatttaacatgctccaaaaacacaacaggaattcaccttcacaaagaacaatagacatggggccaagaccttggattctgaccagttttaaacacctgcttcctcctacacagtcgagaattatcttacacgattcagccttagaactgggggcatggtttaaattgtaatgtctgaggagactcaggttggctgaataagaaggatgacagtgcctttgtccagttaaatctgcagaggttgtcttccatcctatgcagctgcctaccataaaagaggaatctaggaaagattttccatatagcaggcactcagtacttatgtaaagaatgaaaggacaaaaaaattgttctctttgtatgtcttaatgtaaccctaagagttccaagccaattgttgacattattctaacatagcataaagatttggacagacctgggtagcacattgtaatgatatttggcttgttgatttctcagctctaagagaatctctgcttttgccaataggcacacataagaatgttcttaatgctttagtaataacatagttatccaaaatgttaaactttattccgcaaaattttaactcaaaaaatatttttcagcaagtttacatgtattccctgggcaacactggtcaggcattcattcaacagtagacatttaagtatatattatatactgttcttgattgtgtgggaatttcaaagataaatgagattctatctttgccacttaagacttacaattattggctcccaggcaagatggctgaataggaacagctctggtctgcagctcccagtgagaccaacacagaaggcgggtgatttttgcatttccaactgaagcacccggttcatctcactgggattggttagacagtgggtgcagcccatggagggcgagcagaagcagggtggggcattgcctcacccgggaagtgcaaggggttggggaactcccttcctatccaagggaagccaagagggaccctgccatgagggacagtgctatcaggaccagatactacgcttttcccacagtcttcgcaacctacagaccaggagattccctcaggtgcctacaccacaaaggccctgggtttcaagcacaaaactgggcggctgtttgggcagacatcgaactagctgcaggagttttatttcatacctcagtggcacctggaacaccagcgagacagaaccgttcactcccctggaataggggctgaagccagggagccaagtggtcttgctcaatggatcccaccccatggaacccatcaagctgagatccactggcttgaaattcttgctgccagcacagcagtctgaaattgacctgggacactctagcttggaagggggagggacgtctaccattactgaggcttgagtaggcagttttcccctcacagtgtaaacaaagccgcctggaagttcggactgtgtggagtccactgcagtgccacaaagccactgtagccagactgcctctctagattcctcctctctgggcagggcatctctgaaagaaaggcagcagccccagtcaggggattatggataaaactcccatctccctgggacagagcacctgcaggaaggggcggctgtaggcgcagcttcagcagactttaacgttcctgcctaacggctctaaagagagcaacggatctcccagcacagtgctcgagctctgctaagggacagacggcctcctcaaatgggtccctgacccttgtgccttctgacggggaaatatctcccagcaggggtcgagagacacctcatacaggggagttccggctggcatctggcaggtgcccctctgggacgaagcttccagaggaaggaatacacagcaatctttgctgttctgcagcctctgctggtgatacccaggcaaacagggtctggagtggacccccagcaaactccagcagacctgcagcaaaggggcctgactgttagaaggaaaactaataaacaaaaagcagtagcatcaacatcaacaaaaaggacgaccatgcaaaaacttcatcctaaggtcaccaacagcaaagaccaaaggtagataaatccatgaagatgaggaaaatccagcataaaaagggtgaaaattccaaaaatcagaatacctcttatcttccaaaggattacaactccttgccaggaatgggaacaaaactggatggagaatgagtttgatgaattgacagaagtaggcttcagaaggtgggtaataacaaaatcctccaagctaaacaagcatgctctaacccaatgcaaggaagctaataaccttgataaaaggttagaggaattgctaactagaataactagtttagagaagaacataaacgacctgatgaagctgaaaaacacagcccaagaatttcatgaagcatacacaagtatcaatagctgaattgatcaagtgaaagaaaggatatcagagattgaagatcaacttaatgaaataaagcatgaagacaagattagagaaagaaagaatgaaaaggaaggaacaaagcctccaagaaatatgggactatgtgaaaagaccaaacctacatttgattggtgtatctgaaagtgacaaggagaatagaaccaagttggaaaatactcttcaggatattatccaggagaacttccccaactgagcaagacaggccaacattccaattcaggaaatacagaaaacaccacaaagatactccttgagaagagcaaccccaagacacataatcgtcagatttaccaaggttgaaatgaagggaaaaatgttaagggcagccagagagaaaaatcgagttacccacaaagggaagcccatcaaactaacagcatatctctctgcagaaaccctgcaagccagaagagagtggggaccaatattcaacattcttaaagaaaagaattttcaacccagaatttcatatccagccaaactaagctttataagtgaaggagaaataaagtcctttgcagataatcaaatgctgagggattttgtcaccaccaggcctgacttacaagagctcctgaaggaagcactaaatatgggaaggaaaaaccagtacaagtcactgcaaaagcaaaccaaaatataaagaccattgacagtatgaagaaactacatcaactaatcggaaaataaccagctagcattataatgacaggatcaagttcacacataacaatattaaccttaaatgtaaatgggctaaatgccccaattaaaagacacagactggcaaattggataaagactcaagacctattggtgtgctgtattcaggagacccatctcatgtgcaaagacacacatggctcaaaataaagggatggaggaatatttaccaagcaaatggaaagaaaaaaaaaagaaaaaaaaagcagggattgcaatcctagactctggtaaaacagactttataccaacaaagatcaaaaaagaaaaagaagggcattacataatggtaaagggatcaatgcaacaagaggagctaactagcctaaatatatatgcacccaatacaggagcacccagattcataaagcaagttcttagaggcctacaaagagacttagcctcccacacagtactagtgggagactttaacatccacctgccaatattcaactgatcaacgaggcagaaaattagcaagaatattcaggactggaactcagctctagaccaagcagacctaatagacatctacagaactcaccaccccaaatcaacagaatatacattcttctcagcaccacatagcacttattttaaaatggaccacataattggaagtaaaacacttctcagaaaatgcaaaagaatggaaatcataacaaacagtctctcagaccacagtgcaatcaaattagaattcaggattcagaaactcactcaaaaccaaactactacatggaaactgaacaacctgttcctgaatgactactgggtaaataacgaaattaaggcagaaataaataagttctttgaaaccaatgagaacaaagacacaatgtaccagagtctctgggacacagctaaagcagtgtttagagggaaatttacagcacaagtgcccacaggagaaagcaggaaagatctaaaatcagcaccctaacatcacaattcaaagaactagagaagtaagagcaaacaaattcaaaagctagcagaagacaagaaataactaagatcagagcagaactgaaggagatagagacacaaaaaacgcttcaaaaaaatcaatgaatccaggagctgtttttgttttgaaaagattaacaaaatggatagccagagtaataaagaagaaaagagaaaagaatcaaatagacacaataaaaaatgataaaggggagatcaccactggtcccacagaaatacaaactaccatcggagaatactataaacacctctatgcaaataaactagaaattctagaagaaatggataaattcctggacacacacaccctcccaagactaaaccaggaagaagtcaaatccctgaatagaccaataacaagttctaaaattgaggcagtaattaatagcctaccaaccaaaaaaaagaccaggaccagacagattcacagccgaattctatcagaggtacaaagacaagctggtgtcattccttctgaaactattcaaaacaatagaaaaagacggactccttcctaactcattttatgaggccagcatcgtcctgatatgaaaacctgacaaaaaaagaaaacttcaggccaatgttcctgatgatcatcaatgtgaaaatcctcaataaaatactggcaaactgaatccagcagcacatcaaaaagcttatccaccatgatcaagttggcttcatccctgggatgcaaggctgggtcaacatacacaaatcaattaacgtaatccatcacataaacagagccaatgacaaaaaccacatgattatctcaatagatgcagaaacgcccttcaataaaattcaacaccccttcatgctaaaaacactcaataaactaggtatttgtggaacatatctcaatataataagagctatttatgacaaacccactgatatcatactgaatgggcaatatcatactgaatgggcaaatgctggatgcattccctttgaaaaccgacacaagacaaggatgccctctctcaccactcctattcaacatagtattggaagttctggccagggcaattaagcaagagaaagaaataaggggtgttcaaataggaagagaggaagtcaaattatctgtttgcagatgacatgattgtatatttagaaaactccatcgtctcagtccaaaactccttaagctgataagtgacttcagcaaagtctcaggatacaaaatcaatatgcaaaaatcacaagcattcctacacaccaataacagacaaacagagggacaaatcatgagcaaactcccattcacaattgctacaaagagaataaaatacctaggaatacaacttacaagggatgcgaaggacctcttcaaggagaactacaaaccactgctcaaggaaataagagagaacacaaacaaatagaaaaactttccatgttcatggataggaagaatcgatatagtgaaaatgatcatactgcccaaagtaatttatagattcaatgctatttctgtcaagcttccattgaatgtctttacataattagaaaaaactactttaaatttcatatggaaccaaaaaggagccggtatagccaagacaattctaagcaaaaagaacaaagctggaggcatcatgctacctgacttcaaactatactgcaaggctacagtaatcaaaatagcatggtgctggtaccaaaacagaaatatagaccaatggaacagaacagagacctcagaaataacaccacacatctacaaccatctgatctttgacaaacctgacaaaaacaagcaatggggaaaggattccctagttaatgagtggtgttgggaaaactggctagccatatgcagaaaactgaaactggacctcttccttacaccttatacaaaaattaactcaagagggattaaagatttaaatgtaaaacctagaaccataaaaaccctagaagaaaacctaggcaataccattcaggacataagcatgggcaaagacttcaagactaaaacaccaaaagcaattgcaacaaaagccaaaattgacaaatgagatctaattaaactaaagagcttctgcacagcaaaagaaactgtcatcagagtgaacaggcaacctacagaatgggagaaaatttttgcaatctatccatctgtcaaagggctaatatccggaatctacaaggaacttaaacaaatttacaagagaaaaaacaaccccatcaaaaagtgggcgaaggatatggacagacgcttttcaaaataagacatttattcggccaatgaacatattttaaaaagctcatcatcactggtcgttagagaaatgcaaattaaaaccataatgagataccatctcatgccagttagaatggcaatcattaaaaagtcaggaaacaatagatgcaggagaggctgtggagaaataggaacacttttaccctgttggtgggagtgtaaattagttcaagcattgtggaagacagtggggtgatttctcaaggatctagaattagaaataccatttgacccagcaatcccatttctgggtatatacccaaaggattataaatcattctactataaagacacatgcacacatatgtttatggcagtactgctcacaatagcaaagacttggaactaacccaaatgcccatcaatgttagattggataaagaaaatgtggcacatatacaccatggaatactatgcagccataaaaaaagaatgagttcatgtcctttgcagggacatggatgaaactggaaatcatcattctcagcaaactaacagaggaacagaaaacaaacaccacatgttctcactcataagtgggagttgaacaatgagaacatatgggcacatggaggggaacgtcacacaccagggcctatcaggggttggcaggcaaggggagggatagcattaggagaaatacctaatgtggatgacgggttgatgggtgcagctagccaccatggcacatatatacctatgtaacaaacctgcacgttctgcacattgtatctcagaacctaaagtataataatttaaaaaaaggaaaaaaaagcataattatttttatattaacactagcatttcatatcttaaagcaactgatgtttaggaattactacacgtggtggctcatgcctgtaatcccagcactttgggaggccgaggctggtggatcacatgaggtcgggagttcgagaccagcctgaccaacatggagaaaccccagctgtactaaaaatacaaaattagcaaggtgtggtgacacatgcctgtgatccctgctactccagaggctaaggcaagagaatcgcatgaacccaggaggcagaggttgcactgagccaagatcgtgctattgcagtccagctttggcaacaagagcgaaatctatctcaaaaaaaaaaaaacaattactacgagtggtacctttttttgcattagtgtcttttatgtggcatcatgaaaatttctgatgaattaatttccctaattaacgtaattccattattcctagtgactttaacataattcctaatgatacttccataaacaacaggaccattgaatttttgagatttctctgtggttctttttttcctcaggatattttccattgaaatgtatggttgaaatttgatctttgaaaatctacttgatgtataattaggcttatttctatcagtttgttttttaagagttgttttgattttttcctttttatttaaccttggtttttaataatctaaaacttgtacatgattccaaaatcaaaactatgaaacaaggtacatttggagtattcattcctgtctgttctctatacccttttaacaaatgaattttaaaaattagtttttagtgtatgttttagtttacttatttctttttaaaagcataagcaaacccacacacatgcatatataagataataatatgaatatttatacatatatcaattcataaatcttttcccctttctacacaaatgtagtatactagatgcactctactggaccttgttttctcatgtaacaatacattctgaagatcattttatttcttttgatagctgcacagtaccatattatgtggctacataatattttattcattaggttgcacactgatagacataggggttgtcatatcatgctttaaataaatatttcccaagtggctgatcaggtaatctgaatgtctgtccattggtggttatatgtctcttggagactaatacctaacagaaatcaattttttgtgtgagttgaatgtaaaatgatatttatatcattttataaactaaaaaaatgtttagttttggcacaaccttgaggaaagcagtgtgacaagcctggtgccagatcccatggagaactaaccctggacagcctgggaaaactcctatgtaaacatggagaacccagatcaaagagtgtttggagagtgataacaatcacttaggacttaccttttctgaaaatcttaaaaattttaagattgtgaatttttaaaatagtgattcataaactatttaggtgacttgctgtggagccattggaccagagattttgttcaaaatgaaaacaacatgcagttaatcatatttgcaatggggccattgttgtctctttataggtttagttttaaggctggcattaaagagttttgcaaaattatttatttatttttctaattcctgggcactgcatctgccaccctgaaagaggccttcaggtaggtggtggtgtatgcattggtctcatgaactcatgcaatatttgccatagttttctcttgggaacaaagtgtgttattgggaacaaagagttccataatcaaataaatttgaaaagaactaagtttatttattgcaagatttcttagagcttttagtaactaatatgcatataacttctcaagatagggatgtaaaatgctggttttcacagacattttcctttatggagtctatttttcatggagcatgttttgggaaagttagatttaatggttaagtttcttataattgtgaatgacttagtgagttaattggagggagagagagaattaattgaacagagtagttgttatcatttctatgttacaggagaggaaactgaggcttcagtgttagtgacttgcctatcatggattgaagacagatttctagattgtaaattgttaacatcatcatatttaaagacttaaaggaagaaaaagtatggaaagggtttagtaattctcttaaaaatatccaatttatataaggaactcaattaactagaaagaaaacaaataacttgattaaaaattgggcaaaggacctgaatagacctttctcaaaagaatacatacaaatggctggcaggccattttaaacagggtatatgaaaaaacgctcaacattactaatcatcagggaaatgcaaattaaatttagaatgagatatcaccactcacctattagaatggctaatatagaaaataccaaagattacaaatattggcaagggtgtggagaaaagagaactcttgcacactgctggtgggaatgtaaattagtgaagtcattatagaaaatagtatggagagttctcaaaaaactaaaaaaagaactactatatgatccagcaatcccactattgggtgtatatccaaaggaaattagtatgttgaaaagatatagctgcactcccacgttcattacgcattgtcgacaattggcaagatatcaacctaattgttcatcagtggatgaatggatatagaaaatatggtatatatacacatggaatactatttagcctttaataaaaaggaaatcatgtcatttgcaacgacatggatgaacctggaggcaattatgcttagtgagatcaaccagactcagaaggacaagtaccacctgccctctctcatatgcagaatctgaaaaaagtctcatggaagcaaagactagaatggtggtggctaggagctgggggaatggaggaattggggagatgctgttcaaagggcacaaaatttagttaggaggaaaacgttcaagagacccattgtacaacatattgactatagttaataaaaacgtattgtatacttgaaaatctccaatagaatagattttaagtatgcttatgacaaaaaatgataaatatatgaggtaatgcaaatattagttggctcaattcagccatttcacaatatgtttgtattttgaaacatcatgttgtacaccataaatatatacaatttttgtcacttgaaaaaatcctagaaaggggaaaaaagaatattagtagaaaactgatataattcaaataatatctgtggtttacttaatagtgctatacttatgttaatatcctagtttttgataactttagtatggttatgtaaagtgtaaacattagggaaagctggggaaagggtaatttggaactttgaatctttttcttttcttttcttttttctttttggagagatggggatcttgttctgtcacccaggctggagtacagtggtgcaaatcatagctcactgcagcttcaaactcctgagctcaagtgattctcccagctcagcctcctgagtagctggaactacagttatgcactaccatgcttggttaattttttatttgttcatttattgtagagatggggtcttgccatgttgcccagtctggtcttgaatccctggccttaagcaatcctcccatctcagcctcccaaagtgttgggatttcaggcatgagctgccatgtgcggccaggaactttgaatcatttttacagcttttctgtaaatcaaagactttctcaaaataaaaagttaaaagtaaaaatttataccaacatatatgaaatgaattaaataaaaatgcacatattacatcaattgttattatgtaatgcaaaaaatttcctagtcttattaggatttttttttaagactaaaacattttctaggccattcagcaggagtgggattgggcttgccactggccttcccccttgctacggatgtgggcttatggatatatgtaaatactgtacatcagatggtgatgcctttgctcagagtccctgcaatcagaaccctgataggaggatttatcctgctttcaacttagcagagagaaagaattacttttactcttcagacagtttatcttttcagtcgttccttttctctgacatttttccccttgactagagtaaaagtagttatccttaatgtgacattggaagagagagatcacggtcatattttttgtacacaaaccgtctctacatcacatcacattgaccttctcctattcggggagaagggtatttattgcctgctttctcaccaagttctctagcttttgatgtttaaagttgttatttcatgacatttcatgaacttattttctatgaggtttctaacatgactttggcccattcgtacaaatgattccatcttggagctccccctgccagtgccaccacccccactttctgttttttacagaagatacatatgaagtctatttaaagagaagatattacaaacaaatatacagtactattcaaacattctgaaattagatatagttggattcagatgaatttattaaataaaaagacaaattcatgagtgacatttcttaacttggtatattcacagcatatcagtggagaagtaaggagatttacttcattattcacagcgtgatcatgatcttcagcaggtgttcaagaactctctgatgctgagactaaaagtaattcatcttcctaaagactttctatctttgggagggtgacatttcctgtctggcttttctgatgattcttacaacttaattacttttggcatgtccagttgcttgctttatttactacattgtataggtcaaacacttgaacctcaggtttatgtttgttttatcaaacttagagaatataattattcagagagtaattttcagattagcacaaacatacattttctactagagagtatctattcttaaagctcacttgtgagacattatatttttcctgttgtgaggatgagatggcattctctttgggatctaaattgcttctgaggcaggcacttttgtgtattgttatctctataccccgaagaacaactggagtgcaggaaaagcagggttttagacaaatgaaagtgggatatgccgtctgggctgatggctacgcttggcatcaccaaatgggagacttaagagccttctgcagtcacggctgcagtggctgattattcttccagccatgtctcttccttccttcttctcttctcttctctcctcttctctcctcttctctcttctctttttttttgagacagtctcaaaaaaagaggctggaatgcagtggcgcaatcttggctcactacgacttctgtctcctggattcaagtgattctcctgcttcagtttcctgagtagctgggattacaggcatgcatcaccatgcccagctaattttgtattttcagtagagacggggtttcaccatgttgcctaggctgatcttgaatgcctgacctcaaatgatccacctgcctcagcctcccaaagtgctggaattacagatgtgaactacagtgccaggcctttctttctttttttaaattttaagttcagtcaggggtatatgtgcaggtttgttacacaggtaaaaccaagtcatgggggtttgctgcacagctgtcatcacccaggtattaagcctactacacagtagttatttttcctgactttttccctcctcccacccttcaccctccaccctccagtaggtcacagtatatgttgttcccctatatgtgtccatgagttgtcatcatttagctcccacttataagtgagaacatatggtgtttgattttctgttcctgtgtttgtttgctaaagataatggcctccatctctgtctttcttgcttgcttttgttgagcagggggtgggtaacactgcccggtgattgtgtcacctcacactgtcaccccaaaatttcagattccagaataactaataaataaaagtttttccacagttggggaaaggaagataaaaaagtttaggaagcaaagaagatggtaatggggtttttacgagccttcccctctttgaaggccagcagggtagttgaatgtgtgtgtacagaagccacatgctagcaatagtatgatgataatcatagtagttatcattttctggcactcactatgtgcctgaagtggtgtaaatgctttacatgtcattaatgctgttagtttctttaacagctctgtgaggtgaatgtattgttattctgctttgctaatgagaaaactgcagcatagagagcttagtggagcaatctcaccaagtttacagttagcacactgcagaggcggaattctcactgacatgttttctactccattgtctctgatttgacccaggaggaatggtgatggtaggcacctgagctattgagtgttgtaatatagaaggcagactttctgtgttcgtaaggcacaagagtctgctaaggatttccttttttgcttcattttacattttattcaaaggttcaaaattgataagcttaattaaaatatcagttccttaataaagcgctctaaaacatatttaaacaaaatgccatacatcatgccttagttgctttactaatataatgttaaataaatatttcctggccaggcatagtgatttacacctgtaatcccagtgctttgtgaggtggagacaggaggatcacctgagcataggagctcaacaccagtctgggcaacatagtgagaccttgtctctacaaaaaaaaaaaaaaaaatagccaatagctgggtgcaaatacttgtagtcctagctacctgagaggcgtgaggattgcttgaacccaagagtttgaggctatagtgagctatgatcacaacactgcactctagcctgggcaacagagcaagaggccccgtgtctttatatatatataatatataatgttttctaacttttgtggttacataattatagaaatattagcaaaattaaaggaaggggtgagattttatatttatcaattgtatggattgaccgttcagtattggttgattgattgagacagggtctccttctgccacccatgctggaatgcagtggtgtgatcagagctcactgcagccttgacctcctgggctcaagcaattctctcatcttagcttccccagtgctgaggttacaggtatgagccaccgtgaatggccagtgcttttttttttttttttttttaatctctcttcttacacatcacttttgtttttatattattgttattcatatatatgtcttgtcacccccctattgagttggatgctctttgaatgttttttatttcatgggttctcaataaatatttgtgccacaaatgacttaatattacttgttactatgaaatttgtgcctctatatatgttgggtgacaattagaaaactaatgataattattgcatcaaaaataatttgagagcacaaatcttatagcattgtcatgtaagatgggtacatatagatttttgttattcttcatttgttgggcatgtagaataaatccacaataaattcaatagaagtaaagcttatttctgcatgtatatctagataaacataaaatattgattctctgttttggaaaaaaggaaaagataatgactaaaatttctttgtggtctctatgatggtttaatcacatgtctctcaaaaatctaattttctaagaatcaatctgtctgtgtgctagcagactgtgaaaacctactggtttctttaaacatcaaaagaagtcagcctttaaatatttggacgttttcctctgagatacggctgcactaggcaaacacactgacattaacatttctaaagcaggctcaaaataaatgagaataataaaaaaaaaactccttccaatacctaattgccattttaattaaagcttctgtttgtcatcagtgacaagagattgcctcagaaagataaaataagactgtgtgtctttggctttcatgaagacaaaaggtttgtgcaagaagtcaaatacccagataactttgctgttactttttaaattaaacaatttgctaagcatcaggtgaaccaaattattcataaattaacattttttttaggccagtacatctcaaatctagtttatggatggatttcctggtttgggtgcttaatctagtgtgtgctagaatcttatatcacaggctgttttatagagataaaggaatctggaaatggaaatcactttcttaaatggcttttgatttgaaattttatttattcaggttaccttaaggttataagatcaaataagaacatactacaaagagctttgtaaaagataaaatattacttgttatcttaattattattatctggaaaacaaagttaaatgcatgtgtttattccacccctccctctgacccaattaatgcatcaggaaattgggaatttgctttggtgcatctgtttaaatgctaagaactgggacttggatttgctgctcaagaatccctagcccagcttcctaaactttataaagtcaaataaaaatagggtcaccaggtaacatggaaagagcaggcttatctttcctctcagcttctgaatgaagttgaaaatgtgttttattgtagaacaggtaaaatgtgattcttataaatgggaacaaaagaataattttaatgatgaatttgaacctggaatctgaacaacagataaaatgcaatcagagaagcactgagactatgcagtgcatttgacacagaaaataccaagagcagcattagcacttttctgaggccttatcttaattaaacttggccagatgaagtttctttggtaaatgcaggttcttctcacaaagcctttcatcccttattgcagggagagccacattttccaaagaattgccccctcactggagggaacccagacagcaaaccccagaacttactggcatcaagagtgctccatgtgagggtaccatgaagacggagattgggagatattgggtgttctcaaatgcgacagattttaccagtaccgttttctcttgggatcagtataatgtaaacctcttgagaacggtatctgagtctctgtatttcctcacatgcctactatccaagaattcaaaacacatatgtggttgaatgagtacccttaagcccaaactgctgactgtaaccctttatccaacctcatcttgtttacctttgtgtaacattggaaatcacccatccccttttctgttggaaactttctttaactttcctgattctccgtttacgtgatttattgctgctgcctctttctttctctgggttccagtctctaccccctcaagctggctatttcctaagattctgtttccagccctcttctttatattctttggctgactgtgcattagaattgcctgggaggtaaccgcagcctgccctgtcctgcctcgtgtttctgtgtgtgtgtgtctgtatgtggtgcacacgtttctgtttttatttttttattttaaaaaatttgatttttattagctttttcttttcttattattatactttaagttctagggtacgtgtgcacaacgtgcaggtttgttacatatgtatacatgtaccatgttggtgtcctgcacccattaactcgtcatttacgttaggtatatctcctaaagctatccctccccctcccctcaccccacaacaggccccggtgtgtgatgtcccccttcctgtgtccaagtgttctcattgttcagttcccacctatgagtgagaacatgcgatgtttggttttttgtctttgcgatagtttgctgagaatgatggtttccaacttcatctatgtccctacaaaggacatgaactcagggatctagaactagaaataccatttgacccagccatcccattactgggtatatacccaaaggattataaatcatgctgctataaagacacttgcacacgtatgtttactgcggcactattcacaataacaaagacctggaaccaacccaaatgtccaacaatgatagactggatgaaggaaatgtggcacatatacaccatgaaatactatgcagccataaaaaaagtttttgtttttaatgtttgcaagtaagttacagacttcctgtccccttatacctcagtgtgcattttgaaaaacaaggacattctcttgtattattaccacaatacaattatcaaaacctaaaaattaacattaatagacttcattcagattctgctgattgtctcatcaatgtcatctctaacaaagggcaaaaaccaatttttgtggtctaggaaatcaatccaggatcacatgttgtgttgtgctgtcatttttaaagtctcttttaacttagatcagttcttcggtatttcgttgtttttcatgaccttgacatttttgaagtgtacaggccagttattttgggttaatctgatgttgtttaatgattagattcagattatatgtttttggcaagaacaccactgaaagaatgttgtgtcctttttcatgtctcgtcatggtatctatttctgcccttacttgtgttcacttaattaatgtggtatctgccatatttctgcactgtaaaattactctttgtcccctgtaattaataactatcttgtgggagacacaccaagactatgaaaataaatatatctattagtgttaatgacggtcagttttctcattgttgaagaagaaaggaattatagatatgaaaaggtagaatgctagagtgaacccatgtgctgttggattaagattagcaataactgtatgaattcgtggtttttatagctatgtagatcaatctaattgcctagctgtatcctctgacaggataaagaagcaatgataattcagtagcaattagcataagtagtaccattatcttggtttctaaatactattcaccaacaaaaatcaaccaagtcttcttccttgctggggcaggaaaagaacaagataagcctggaacaggtgttgttttttgtttttgtttgtttgtttgtttttggtttttttccatttgaaagtaagagagtgagcaaagaatgatggggacatgtcaaaaggacacacgagccagctccaaggggctcctactagccaaatacaggacaatgtgaccataaaaataaatggtagtaacagatggaataagaatccatgagtccatactgataagaacaaatagatgagcaactatgtaaaatggaaagttagttattcattacaatagaattccaacaaataaatgtgtgtggtatggctggatgcggtggctcacgcctgtaatcccagcactttgggaggccaaggcgggcagatcacctgaggtcaggagtttgagaccagcctggccaacatggcgaaaccccatctctactaaaaatacaaaaaaattagccgggcatggggtgtgcacctgtagtcccagctactcaggaggcagaggcaaggagaatcccttgaacccagtaggtagaggttgcagtgagccaagattgtgccactgtactccagcctgggcaacagagccagactctgtctcaaaaataaaaaatgtatgtagtatgattgattgaaaatcatcatttgttaactaccatagtaatggttgtttgaggcaagaatcatcaatgaattctcttttttaataacatagatttgttctttctgactcctccctatccattcagtgcacagcttttagcacacaattgccttggtcaaatctgttcttaagctgggcttccccttcccattgtaccatgtgtgtgaatatctaagaccacaaaatatgctgcttttccactactgaagtaatatcttacctcatctctgtttagattcttcacacattccaaggaaacacttagctaattttctattagtttgaattaagttgagatgctagagaagtttgctagaatcatttttcattgccagctaacataagtgcattttcaaacatgctattgataaaatctggataagttagagggaactatctgcttgggaagcagataaatgagagtctattgggggcaaatgagacttttggggttccttctatatcatagaatggatggacatataatttcatcttctgccttgaagacaggtgttgagaattgacctaagctgatttggtcattcatagcccttagtggttttttcctccatggttcatacatcaaaagaggtttgagctgagtcagtgttaggcactacacaaaactttgctactagtccataatgaaagcaagccagacaaaattctgctacacacagagaccattgattacataaatacttaacagcaagcaaagtaaaaaacatttttttacagctcgttatacaacttgttaggaagtcccagttctgctaccttgcataaaggttcttccaaggcagacagggcaacatcccagaggctggatcctgttacccttatcaatccagtgggcaatgccaaatcttcttaaatcaacaggtggacactgggccatttaggaaaaaacctcaggtttgtctctgggggagaggctctctggatccttatcctccattacactagagtggagaatatctctaaaatatttttgctactccacatactcttgattgtctttaattttactcgagagagtccatttctaaattcttcatattaataagccactagttttaccaattaaaatccattgctagcatacattatactgattattaaagtcttaggtgttaataaaaatcaggataatagaagtacttatagtgattgcttctggagtattgcctttctgataaaatactggataaatgtacagtcttgatgaaatacactgggagaacattacatactatagtgccatcttggaaattaaaaatgcatgttagctatttagaggttaatgtcctgcaataaaggaaagctgcttagttttgttcgaccttgcatttcccaaacttagttgaccccaagtccttttttccatcgcactcttgaaattagttattcctgggaaaggctttagaaaacattgctttagagattataggagaagcttccttcaacatccacttaactgacactcagcattctctttataaaattcgaggataataggcacctatcttaaatactctctatcaagttgagttctgtgcttacaaagagtcaattgagattttttccaaaacggttttattctatttgtacttgtaattacagttacataacttaattaaatattacataatcccgtgacttttgagtgtaaatataaagagttattgtttctttgaaaaataaactgaaagttttggaaagactctagaaaagaattgctgaaagtgttattaaataaggtgagggtaagacaactatgaaagatttgggaaaaatataaaaaagaatttctaatacaacttactttgtaagtatcttttaagttattgatgcattttcaagaaactgaaatgtatcatttttcaagaaagagttcaagcagagaacttgaattagtggagccatactcaaaagccttacatttaaataaaacatgtgaggtatatgtatgccaatttttattattttctgcttttactgaattttttgattaagtgactaagcataaaccttgtaagagtcagaaaagggcttttgttctagagagagagagaattaaagagaagacttcacaaagcaaagtgtgtacacacacacacacataccccttgtggcatgttttaaaatattccacatagattttgcccatatttcctcaagccaggctcagttgtcttcagaaccctttggcattcttgacacactgcttttgtgttttttcaactttattgtaagtctgtgggattgcttaataccttgttaaagaaaattagagttaaaaatctaatttctccctgggagtggtccatatatatatacatagttcatggctgggaacaaagtttactactagtgtattttttcagtgttattttgtagtaaaagttcttaaaatattgtgtaataaataatatttgatttctatctatgttctcttaggcttggtcccatggcagcctataattcaaggttaaggttatgttgttatttaagaatttttagcatctgtacttgtatgtgctgcataaacaaaacagttattctattgcagaccagtttttccttttgaaatgtagaatacaacaatcacttctcaggtttaattaagactgtgtttgtacagaggtctgtagtttataaaagcagttaagcaaagaaatgcttttgttatatacaaacagaacaaaaagggaaaatactgtcttgatcctttcattaaaggtcaaaaaaaaaaaaaaaagaaaaaaagagttcactcaattttttatctcgtgttttttcacaaataccagaaacagagctgtaagatagtaatttgttaaactacacattaagctggtatttgaatatgaaaaggtatttccaccccgtgcaatattgcttttttgaaatactaaaagcccttacattagggtggtaattgaatgactgcttaaaaacaaaccctgtctgcttcattttgacaggttctttatacatttttgtggagggtaaacatgtcaggatgtagcagactaaggaaggagctggtattgaacagggttcatagtcaaagtgacatagtttctcattctcaagaagagtagttggcatggttgttttgggacctgcaatatagtttttctagattcaacatggaaaacattattctaaactctagtgatctatctgcccatagcttatgccaagcagcatggattatacatttttgatacctgtagacgttttaggagccttcttgatgttatgttgaaatcttattcctgtagttatccacataattttctaccaaatcaccctgtagaactgatgcataattacttcttaggatttgtttgttactgtaataatgaaatattttcctgtctcttggtatacccatgtgtatactgtgttttttattttgtaagtcccatgaaggagaaaggacttctatttttgttttattggagttgaacacttcttgagcctccttcttggagattctcaggtttctgatcattcttgttatagttaactgattatttttgtttccttagatcaatttagagggtcacaatatagcactttcagaaaatttgtcagagcttttattacattaggaagagtagccatttaagtgtgcaaacacatcactcattgactggctcactgaacatctatgagtcaggtagctgctgagaactagagatgttaagctagatgagatagttctctgcaagattggtcaatattcctttttcagctgctatgttctagaaaatgtatggtaccatatgaaaagataattgaaatggagaacatgttatttgctagaatggggcaaacatatgtcttaacctacatgaaaaatatgggagtgacattgagattggagttagggagagggaatagatcagatttggacattttgtccgaagtagggcaataaattatgtcttaaatacgacttgataccaaatccaaaagtagaatggttgcaacaatatttcttctagttatacttctttttctgaatcttactttgttatggaaatcatagagcatgctgatattctcagcatagacgaggagttgaggagggtaagggaaaatataggcaaacaggacaagattttcatcccgtggacattagtgcatttgaaaaactggctcttgggcttcatgttttggacagtcaggacagaggtctcacaggggttatttgcaggttttgctttttttgaggttgcagccatcctaggactatcatgactgtcatgtggtgttgagagaaaggaagatagaaaaaagatgctttttgaaaagcttttccccaagacctatcattgggtcttctttctcctggtggagataggggaggagaggcagagaggaacccagctgtcagcaatggtgcagtgggtccaaactgcttctccttggtgggtggaatttccgttctagaggaggatctgaggaggcttatgagcttccctgggaattgctttcttcttccagcttctgaaaggttctcttcatttggccccaggaggaatgaggaacacactacaaagctttccattctacaggctctgtgagctgagtggtgaagttgcacattttctaattggagaaaacatggtcccatacattttaggttggctaagaagaaatgcctgagattcatggattgaagtgtgccttcaattggtcttctgctagagtttcatgtagaaactgatagatgaaacaatacatttacccaaatatgtgaaccaaaggactatgtgaatagagagggactgattgtgtctactcagtaaataggccaaagaaagggcaacaagcgaatcacaaggactgtttaaagccctggccaatggggggttgggggaattgtgtcttttgcataagttgctcccagtttgaaatcttcttagtacactcccaaagctgctctgtggctgccagcagtgttagcctgagatctcttaatcctcatatagatcagcatctctctaaaataaatcacttgactgttttctgcctaacattgcaggaatggcttgggagactaacccttcggtttgaaatgtctgaaaactgcttctctgttttacaatcttgaattttacttagctctgctgctctttttagctttctcagaagtggattatattttgctacctttgccactgaagtacaaatataatcgttgttattttcttgtctcacagagtatattttgaccgaaataagtagacaatgttctgttttctaagttccaaccacagtgttttttttgtttgtttgttttacactcagtaatccacatattgttatttctaggtaattatagaatttttcagtcagtaatttactaagcacatgtcatgttttcagcactgtgtaaggaactgaggcatacaaatgaaatctgaggcatggttcaagtcttcatgtaggttacagtgtttgtggagaaataaaaccaaatcagaggaaacaaagaacaattaaatgttcaactgtgtagtactcatgataggaatctcctggaagtaaatactgaatatggataaattaatgaatgaagtgttcattcaaggaagaaatcattgtggactagaatgtgtcattgaataggtcggatacgaacatagccatgaaacataaataggactggtaagtggaggagagaatattctaggtgaagagagcaaaggtaacaaggttgatgatggagttgagcatggcatgtgttttggacaataagaggagaccaggtgacaaaaatcggtatgcaagagaaacaaaaaaataaagttgggtatccccccttccttgataagtgaacctcaattttgtgcctatctgcaagtgatgaatcatgattggtctaacccattcatgatgattctatcctccgcctttccagtctcctttggagctagggcagctctgtgatcgtgttctggcttcaagctgaagtctgctgatggcatttctggaaatgtttttgttctttgataaaatgttggcacctccttttcctctcctccttgccttgaatgaagatgcaaggtctgtaaatatacagcaaccttgctgttatgaggaaaaggcaaagagttattgtttctgatactgctgaactgctaaacccacaccaacagctgtctacctctggacttcctgttatgtgagagaaaccaacctctgtttatgtaaaacagtataaattatggttttagttgtttgcaatgttttaacattattttagaaaggttaatctgcaatagcacaccagctgaaccggaaggtgatgagaattgaggtggtggttttagcaatatgggtcttaagtgaagaagttctgggcaagacttgtggccaggggaataggaaggaaggcagacatctcagagaagaagcaaaagtattcagtgcagattcagtgaaggatagaagaagccagataacctcaaagtttctaatcaggaagataagtgggcctgcattacagctttggggataggcagataatggtaaagacgagttctgtcttaaggtatgttgagtttgagattatgatgatggaacatccaagtggaaatattacgtgcatagtcagaaatacaacatttgatttgaggcgaatctatacaatgcctatgaccttgggcatggagaaacagaaaagcaataaatgatgccaccagttatttgagaggaagaaaagaggtcatttgcataaacagacagagaaaggagataatacggggttggtacagggatgaatatgtcatcatcagtatccaatgatctagagagatcaagaaaggtgaggaatgaggagagaatttggtaaatctgacaaaaagtgaatctggtaaaaataggacaccaatgatttccaagagaggatatattggctgcccagatctgagcagttaagtgggaagggaagggagtccaagatgaaagtggtagtgacagatcattcattgaaggagctgggaattgagaaaggctgattcttgcaagggtggtagacctagtaaaagatggttttaaaaacagtgaaaactgggaggaaagaatttcatggaaaggcccaacatttaaatggaaagaaaggtataaacacacagagaaagttaaagaaatgtgtaatgttggagaaagactttagtttcaggacagttcagatattcctctgaaattggaggcagggatgacaaggaggctctggaatctaatgagtggaagcaaatatacttgtaaacagctgtctctactgggtaggtgaagtcctgtgttaggagctggtctagtggtagggagaagtgaaaggggagctagccacttcatgcagttacaaaatcatgcagccttgccatcaacgtggcaaggattgtcaagggcaaggctgcgtaattttgtgtctttctcaggcaggaccatagcggagaaccagaagctgaagaggagacccagaatcaggtggaggttcatagggagttgtgaaggtgagagaatctagaacaatgctcctggagagggaggagaaatctagtgttctcaggaagaggttaaagtccaagtgcagattgtccagagaacaggtttggttgggggaggtggcagagaaggggatggtggcttgagcagagtaagtccaaatctcagacagagcttgaaatggtgagatccaaaaattgcttctgagtacctggacacagcagcttgttacaagtagagatttaattcttgttcttttttttttttttttttaaatgagaggctaatttgtcacacatttcttttactttctctgtgtatttgtacctttctttccacttaagtgttggtcctttccacaaagttctttcctcccagttttcactctttttaaaactatcttttactaagtctaccacccttgcaaaattacacaacatattttcagtatattctagtgcattatttacttataaataaaattgaggccaagtataaataaggtacaaatgtactgagttttatctcactttggtgagacttcttaaatacgaaataaaaagccatccatgttccaattctggcaatatattccccttccacacattcaactaccctcttgctgaactcaaccttgggtttctacagtgttactgaaacctgccatccattcacagtggcttctcctagtgatttccatggagcacaattttttaaatgtccttaaaaaagcatgctactttaattatatggcagatggtgtgttgcatggtttcctaactggtgttacttccacactgtacttgaactatataaagaactttgctctcaactcaggaggaatcctgcgaagctcaagtttgtattaacttagagaggaacaatttctgtaggttgggacaaattttaatgtatatgttatagtactaattttattatgtaaaaactacacataaaccaaaaccataggggtttcaaataatcattgcaaattatgattaatttagtaagactttaaactgttgttttcttctgatttttaaaagtgagtcattatcatgtagaaattttgaaaaatggagaaaaatagaaagaaaataaaaattgctcttaatctcaacttcctggagatagtcactcttcacctatttttgggtgaggggaggggcactttattttttaaactgaatcatattaaacaacctttgtttcctacctcaataggtcaattgacttttaattctggtttcattttctgaaaactctgtaaggtcagcaagcaaaggtgttagaagtaggtagcatataacataggaattagcagatagcttatttctgtgggaaatagaaaggctgactaatctgtgacatccagtaactttttactgagaaaaatgtggttgcaatgagtaaagtctcccatgtcactattctgtagaagataaacaatgttttagctttattatgatttataccgtattcttttcaggattaactctaagcgtagaacattttagttttataccttgattagaatcatttatttatatcccaaaacatagaaattaatttggggtgataagtccttttgttgtcaagttatttttctcttaacatttgtatatagttttttgtattatgtttcctaatggaactcacatgtccattagagtcaactgattattcaagacagatttgctttaatctcccagtgtttattcagtttcatttaatattgtacttttatgagggttatgaatcataggaatgtagataatatgaaacatattgcattattttagatggaaagttagactttgtaatttagataggttgtcctcattttattacatagggcattttcactattatcttaactgtggaaatatttgatgagtcagttcatcttgttttatagaatttccaaattgacatgaaaagaaataattgttttgcattaatttatatttaatataagcacttgagaggtaaccaggaatgggaggaaaggaggaagacattcatggatatgcattctagagtaatgaatttcaactgccggaaatcaatggctctgccagattcatatgttaatttttaatgagtagacatttacttagaaattgatttatttggactcagatgaaaagcaaaaatggctgaaaattgtcaataatagcatacaattgcctctttaggtttagctgtgattatttttgaaataaaatcctcagggatgttggaagtgagccctaacagggtacacatgtaccattttatttgacagagatcttcattgcatatatcctaccacttttcatttcaatgtaacgagcaatcaaaaactgcttgttgagtttgaataaaaagggtgactggtggggggtggtagtatttgtcccttttgatgttttcatagtttaagtttgaggttggcaaactatagcctgcaggcctagtccagtttgccatctgtttttgtaaataaagttttactggaacacagacataatcatttgtttatgtattgtttatagctgctttcatgctacagtggcaaaattaagtaattgcaagaggagctatctagactgcgaagcctaaaatattagtatctagctctttactgaaaaaaaatttcaactaagtttagttaaacttttcccttatagtactgtatttcttaaacctgatggtatactattgtttaacatgtcaatatggaatcaaattaccaagatgctaaaggagaaagaaacctggccgaataggaacagctccagtctacagctcccagcgtgagcgacgcagaagacgggtgatttctgctttgaaaaatttttcagataagacataaataagtaaaacagagaaagatatatcactttataatcgagggctaaattgtatgatagtatcaaaaaacccttttcaggctcagtggctcatacctgtaatcccagcagtttgggaggcccaggcaggtggatcacttgagctcaggagctcgagaccagcctgggcaacgtggtaaaatcctgtctctacaaaaagtacaaaaaattagcccggtatggtggtgtgtgcctgtagccccagctacttgggaggctgaggtgagagaatcatctgagcttggaaagtcaaggcagcagtgagctgtgattgagcccctgcactccagcctgggcaacagagtgagaccttttctttaaaaaacaaaatcaaaacaaaaaaccaaaaccttcatatattctgtatcataaatatatgtgaattgaaagtcactttaatgtggtcagagtcagagttctaaagttctcaaaattgcaatgttagcatactaatgtagtaggatatgttttgatgttttcgtctagaaatgggaacatcaacttagtgccatatagttatatggttgtatctaggttagccagggttctaaaggaatctagagcttttctagaaattgtggggtcagaaaggatgatgtactaggcttgcttgagtatgaaccaggagagatgcatgtgtgtgtatgtgtgtgtgtgtgtgtgtgtgtgtgtgttttgttttgagagggagtctcacactgtcgccaggctggagttcagtggcacgatctcggctcactgcaacctctgccacctaggttcaagtgaatctcccgcctcagcctcccaagtagctgggactacaggtgcacgccaccaggcccagctagcttttatatttttattagagatggggtttcatcacgttggctgggatgatctcaatctcttgatcttgtgacccgcccaccttggcctttcaaagtgctaggaatataggcatgagccaccacgcccagccaaaagatgcagtaatttcaggtagttctatgatcagtatatagggatgccaccacaactgtttctgaagaacacaattttaataggacctaggtagggaggcttaggattaaaacatgttgaaaatctgtcttcagggactaaatgaagctggaataaataacatggcacacagttgaacatatattggggaaaagggtgatcttggaaggggcactagaagcaattataaattggtgtgaacttatatgtgaacataaataacacaagatgatacattggtaacttgtatcatttacatttggttttgtatcttgagtgtcttgcataataataaagcagatcccagctttaaagagtggagtgtttctgctctatattgaaataactatcagagggcagggaggttaaaatcagaagtaggtacgctccttgcataactcttccatgcgagtggtggcagattaagaaccttctgtagtagaaccattttgttacacattgccaaccacaaaatttcatagagtcaaaaaataaaaataaaaaaagaggtcaatgtggtggcctggactaactgggaaaagctttatggagaatattggattttctctcagtttctgttctgagtaaagtatgaagctgcctttataaagaagcaagttggtgactctgggatttgaatgagtttcccagtcctgttggggtactataataaaatacgttaggctgggtaaattatagtcaacacagaaatttattgctttacagttctagatgatgggaagttcaagatcaaggcaccagcaggtttggtgtctggtaagggcctgtttctcatcaatgataccttttatgtgttctcacatggcccaaaggggcaaacaagctctcttagacccttttataagggcactgtattagtccattttatgttgctgtaaaaaatgcctgagactgggtaatttataaggaaaagaggattgacctggctcacagttctgcaggctgtacaaagaagcatggcaccagcatctgcttctggtgaggcctctggaaacttccagtcatgcagaaggtgaagggagagcaggtgcatcacgtggtgagataaggaacaacagagagggagaaggagagagagtggggaggtcccagactcttttcaacaatcagatctcatgtgaactcattaccatggggaggacaccaggccattcatgagggatctgtccccatgacccagacacctcccactaggccccatctccaacattggagatcatatttcaacatgagatatggaaggaacaaataaccaggcactaaccatattcacctcctagcggccccacctcccattaccactgcactggggactaagtttcaacatatgaattttggggagcataagctttcagaccatattcagcaatgagcatggtttgtgtagaagaagaacttgggcaaagtgaatggcttatgcctcaagttgagcagattagttgcgtagtaagaaaggtgaggggagataagggtgggagagtgatggaacataagggaactaaggtaccacttgggtcagcctagtttctgtgattccgttacattatgggattgagtgtttaatgctcagtgacatctcatagaatgaatcatagggagaccaagtggtgtgcacaggtctacctggtttgggaatcactgagattgttttgctctgctccaagttgcaactgaagacaaatcacattcctggagggaaaggaacatcaagtgactaaaatgcaacagcataaatcctctctcataatagacagcacctgtagccttttgaccctttgttctaaatcttttatagaagagtgtaggatgtagataggaaataaataaaattgcctcctgattttatgtcactatggagctggttgggagtctctttccttttcagagaagccacagagagaaagaagaaaaagcaaaggcaagaccccttctcttacatatcccaatggactttgagtgttagtgttgctttttaatgaaggtggatggcagagagagattttcaatatagcttaaccataaattttcttaagggggttaggtggtgctgtccaatactccagggtgtggtggtggagctggcagaggctacaaaaagcagcaggtgcctataggtctagaaatccccagctcattagaagtgctgtaaatcatagcatccttcatgtctcttgagtgaaacttggcacctccagcttacaactgtgtggtggtcacactgtccctgacttcaataatgttaacagatgacaacttccattgaacgatgaaactgggtgagccagtgccagtaatgatggattgggtggctgaaagtttctgcagagaggacagcaagaggatgccaaggaagctggtctgtgtgtaactaaaagactagtaaatatgagaattgatgggcacatctatcacccatggggccactgtgtcctgaaagaccttgtatgaaagctttgagaaaggctttggcaaggataaatgccccagcgcttagacaagtatgggtctctgcaggccggactggttgaagagggcaacgaggtgaggtttcgtgagttggaagttggcctcctgtagtgtgcagtctgacacagaaaaggttctagctcacagttgcctggttggagcatggaaacagctccagcttaatattcaggacatctgtctgccgaggcctgttttttttctgtacgttttcatggctgtttgtagacagtggtaggtgagattggaagaaataagagacttgaggaaaacagagttaaacaagaaagtaaaagtaactcttcaatacccagtacatggttaatatgtagatacttgaggatcctttatccctcttatgtctcaggagatggggtgctggggttgtggggagggcaggggaggagtaagggaaaaagggaaaagacaaagaagatatcatctatttgagtaaataaaatggagatgtagtaaagatatcattttgggaaccttgagattgataaaaaaaaatacacaacttactagaactttttcagttcaaagctgaatgctaaaaggttgttttgtgtgctgtatgacagacaaatattttaaaatatgtctcacaacattcctttggcttaggtggtgatatttaagttaagacttacatatatcagttggccagtttgacagataggaaattatttggaattaaaaattccccttctagtttttcccctaaaaagtccctgcttaattcatgattgttctctcctttgcctcttctttcctaattctttatcttctcccatatccaaaagaacatctggcaactatctctttagaggcatctatgatcctggattgaatttgttatccagtcagcaccttcgtgagctgtgtttgattttctgaaattgggtttccgcaaatggtcatatttcaaagtgctatgccatataattatttgaagggaaaacattttaacgtggtacaacgacaacgtaaagaatgaaaattgtgctaagtgagttctgtctctttcaagttcaaattggtaggttttcctggcttgaacacaaaatgaagtcaaattgaagggtcagagatacaagaaaattataaggagaacaaactcattagaaagggaactgaaaaatggataacaagaggaacaaatacagggattttccatatctagggaaaaacaatccataggttctatggggactttaaaaatatagaggattgagaaaaaaactttgtattttgcaacaattttaggttaatagaacattcgtaaagatagcaaaaatagttcctatatactctatatccagcttcccctaatgctaacatattacagttttagatttttaatggttatgataaacatgagtctatgatttatagatgtcactacttttttatagtattagaagaaaattagacatataattttctacttgaaaatttatattcttgtttacactttaagaatatgtaatatcttccaaccacattcatatcaagaagaacaaaaacaagcaaacaaaacccctgatcatatcttaaaaaaacagcccttctctgagttatttacatttttagcaggatgcaaaactttatgcccaaattttccaaatttaggtatgttaccatggcattttatcctggaaaattgctttgactggaagtttctttggcaaatctcacttttatttatttattttattttatttagacggcgtcttgctctgtcgccaggctggagtgcagtggcgcgatctcggctcactgcaacctgtctcctgggttcaagcgattctcctgcctcagcctcccgagtagctgggactacaggcatgtgccaccacggccagctaattatcattattattattattattttttgagaccgagtttcactcttgttgtccaggctggagtgcaatggcgtgatcttggctcaccacaacctccgcctcctgggttcaagtgattctcctgcctcagcctcctgagtagctgagattacaggcatgcgccaccatgcccggctaatttttttgtatttttagtagagacagggtttctccatgttggccaggctggtctcgaactccctacctcaggtgatccacccgccttggcctcccaaagtgctgggattacaggcgtgagccaccgcgcccagcccctaatttttgtatttttagtagagacagggtttcaccatgttggccaggatggtctcaatctcttgacctcatcgtgatcctcctgcctcggcctcccaaagtgctgggattataggcatgagccatggcgcccagcccaaatctcactattttttagattaaaatggaactgttgtggggtataatgtaaaatttatgcatttttaaaaagcaagagatagcttaaaatgggactctttggtggtctctggcagtgtgcagactttggtggtatgagttcactctgttttgtctttatagctatagaggttgaaaaaaaaaaaaaccattaccttacactaattgacataaattttggaagcattatttcagcaccaaccaatacaggtttcccatagtccttattggatatcatagaatttttgataaatatttgtgaaatgaagcaatgagtaaaaataaggaatgtcattttgaaatgtggggccttttctgtgtctcctcaaatcccacctgggaagtgctcactcattccaggtaagacaggctttgctgattctgggccttggactggcagggaagaagggactgactaggttaagtatctcctcaaggtgctggaggcctctaaataaaatgaggtacctcccccttcattcctagcctggaagaagactggagcctcgagattacagttatagtctctgcttattatataaaagtaatcatatgctatatatagcccatgatggtataaatgttgtagctgaagggcaactgacaagagaaggcagtggagacttgggaaaaagtgggattttaggtctgagagaccttcaagttctagcctgggctgcaggatagaaccctaggtttggtactttgaccctcggtttggtacttatcctcttgaggccatatttcattatataaaatgggaagtcagtaatctatagtgagagctacatgtaagagtgaatttatcttatgaactaatcattggccttttttgctgtcagatctattccttttctcccacttcattatctgcatggctgaaggttcaacccctgcaggctgatttcctagctctttcccagctgggtttagccaatgagaggcactggcaggagatgggcaggcaagcacagctgctgtgtttgctttgtggctccagcttgtgtaagacaggcccactgtggttccagctttttccatgactctggccctttggtgctggtaataccatcctctccttctgtccctccagccaaggagtggtagtagctacctgcagttgttagcctccgggttgcctctttattctcttttggcttcttagctcttttagcagtgatgtatctaagtcactgtattacattccctctttttagaatgttggagtggttcctatttccctcattggacccttattgatccagtccatttcggtaatctagctgtgagctgcagtacttcaactaggctggttgtgatagaaatagaaaggaaggagagacctgccaaaggagaaagagagcagtaacctattagatggggaaaagatcaggagaaataaagcaattcagataattgtgactgccattgttgaagacaggcctttggaaggggaactggtttgggtgtagaaccaatgggttttgtgtagagcatgtcaaagaagataaacttcatgatttcactgcctttcccacttcagtgtattgcagctgcaggagtatttatggagttgcctttctctcttgggaaagggtaaaaatgttcagaggaaagagatcaggggtagctacacttatgtcagataaaaatagactttacgtcaaaaactacaaaaagaggcaaagaaggtcattacataaggatacagaggttaattcctcaagaagacataacaattgcaaatatgtatgcacccaacatcagaacacctaaatacataggtataataatgtgattcaagtccaatattcacacatttacacataggtgtaaaagtataattcaagtccaatatttattgattttttgtttagatgatctgaacagaaaatcaataagtgttggacttaaattacattttcaaccaaatggacctaacagacatatgcagaatactccatccaacagcagcagaatacaccttcttctcaagtacacatgaaacagtctctaggattgatcacatcttaggcgacaagacaagtcttaacaaaattcagagaggacagcagtgtgtggcccagaagggaatgccccctggtggcttgctaagcctggaacacatctaacaccattgactccagccccatctctgtaacttttttgggagtagaataggaacccattctttgccagttgggcagcagctctttaccaagggaccaagatgagcaggctgttccttttgtcagtgcaacatttgcaagaggagtgctgtgggaggagataaaaattgacttccaaatggccagcaaaatttcagagacatttttgggactggcttttaggttcagacttaataagtaaaacagcagatacttaagattttgatttccctgtgggttaagatagttcatagtggggatggccaacattgctacagcaagctggaatccacttcctcaatgtactggggcattatggaaaataatgatctctgagggagagaaatgattccacatctttgggaacaatatctagatatattaagaaatgacctcagatgaaaaacaaatataaaaacattttggcaaatcagaaggtgcacattatatggcattcatgatgttttatatagtatatgtgtgttgggaaagaaaagaagagtctaataaatgaagacaaacaggaaacccttcctaaactctcttcccaaatacttcttagtcacgttgtacaggtcgaaggttctgggaagaaacagctagtgctctgacctgcattctgcaaatataacgtttcctgttttgtaggaacttggggctgaaaaatgcataaaccaattgatttaaactcttaaacccataatattcacaaacctcaaggactgctggtcaaagcctctctctctctctctctctctctctctctctctctgtgtgtgtgtgtgtctgtgtatgagagagagagaaagagagagagagagagagagagaaagatctattgcagatgttcttggagtattacattacatctaatttccagatagtctccagataactgaataattgattcatgtgaatcttaaatacatcaatattctgtagtttctcaaaccttttattttgttttttttttttcaactctgagtgaattaggtttagttggagaaaaccgtttatgttatgtacttctaaaatatgatgaggtgaagcatgaagcatggttctccttggaatgatgtttacattaataaggctttttatctcacaacgacatagataatataaaattaaaatcaactgctgatctcagggagcaaacagatttttatgataaggattgtatagccacctttacatctttttctttccttttaaataaatgatgaaagctccagtgctgtcataaaatcacatttatttgtagtgatagggatgaaataatcactgtttcatcaccgtgatcagcggtcacatacacacaatggaacctgacatgctggcagcctcagctcattacagctttccaaccaacctccaagcttatggctggaagtcaaatggggtgggcaggttccaagtaggaaagaaaaataattggctttggagataaagggattatttaaatttccatatgaaatttccacaatttcttggcttcaaattgagagggagttacactaagatgcctgtgtttcaattttaaaattaaaagcattcaaagaagtggagaaaattattatagacaacaaccatttcaataacatttctctgtcttcatgttgtttatcacactattaattacctgctaattaaaaacaaaacaactggaaaattctagcaacagaatttttcatcaggaaggcttttggtttaataatttttttcttatccttacaatatcaagttgttcccctcccccccataaggattgattagtttaaaagattggtgtttgatcggaatgcaaacatcagtgggacaaagtgggacttttctggtactatgtagtttttggagaccaaggcctctgagtcagacagacctaggattacatttaagctatctctcctttgagccagatttgaatctcaatttatctttccacttcgtgatcttgggcaggttacttaatctttcaaagcctcagtttcctcatctgcaaaatggtgataatgaaaccaccacgaagacctgttgtgaggggaaaataggatcgtgtgtgtaaagagcttacataacagagagcctagcatatagattcatagtagctgttttttaacaaaattatttttgcactattttcttttgtgactattagcatttggcagtgtgcttaccgcattactaaattttgtcttgatagagcagtccctgagcgatggttgagacctcacagtgtagatagacctgttgaagtgttgggtgttgctgactttgatttgcacccctggacaccacattcagcacctggatagctttagcagcaatggcaaaagatgaattccatttcaatcaacgctatccacaaccttgatttggggtttttgaataaaaatagggttttatgcttgaggatatagcacattttgagctgctgagtgagacttgcacttggcatgtgtgggtgccctggtgaaaactcagggagctttgcatttcattatatttttaataatgcttggcaagtagcagaattaaacttgtgaatcatttgaacaaccacttttcttaatggagatgagcctctttatcttttaggagtcaatactctgtggttctaaattagagtcctcgatgtgattgtattcctctcaaacagtattaagaacttattttataatggagaggttcataatgaaagcagtctggggaacgaggcatcctaggctcttgatggtgctgggttgaaggacaggaggagctggtgaggatgtggccaggacctgttccctggtgtgggggtagtagggaggatactaacctttttttactgtgtactagatgctttgtacacattgtttcatttagtcttctcggtacacctttaaggcaggtattgtcatgcccatttcaaaggtgcagagagatgatttatccaagattacatagtgaatagaaaagcagtaataaaaggaggaaatatcagttttggttacccagtatattttgtgaaaatccatcaagatgtatatttataatttgtgtacttttctgtatatatgctcacttcaataaaaagttacttataaaaacaaacagatctgcctgacaaagtctatgctcttttctatcatactaccaccaaaaaagtatgatgcatggaactccaagtgctttacaaggaatttcctctgtcagtcacagctaggcgtggcgagaaatagtgctactcttattaactagacctgattttgaaagacttgaatatttccaagggaagatacacttagagaagtatagtttcctaaaactgcagatgtctatgtgttagacttagaagattattccaaaatcgtgttctgaaaatgcatttagcttgttgcagagttgttcatagtaatgtaaaattggaaaaaaatagaaatatccatcaaagagggattcaacaaataaatactatgtgacttaaaacttacctattttgaatgatgcctctgatatagtgtggagtgaaaactggttttcgaactgcagatatagtatgatggtatttttgtagttgttttttctttatgtaacatattcatataaataaatggctggaaagatatttgccaaaatattaatagtgatacctctgcatttttgtgatactggttgaattttactttccattttatgtccttctgtatggttggttttatatagacattgctttcctacaattctataaataaaattttaatttttaataaaacagtacctttaatcaaaggctgcatcccaaattaaatatatcccttctcaaggtgtctactgtaaaggaggaagaattcattttagtgtatgagtttcgatacatcaaaataatattaaattatagtcaaatcatagaaaagaattttcaggaataaaaagtgccatttaataagatcaaatacatgcaattaccagactgcttggcttctgtaaacatttttaaaaaatcattttgagggatatagtttataaaagtaacaattataataaacaattttaattatattaataaatataattaagaactactttaattatattctatataagcaagttgctctatctacctgtaccagatatcatagcaatctaaaagatagctgttttacttatccaaatatgtgtcttatatagataggtcagtttcaaaaattctccgttctttttagattttagtataaagacatatgattgctttattttattttattctatttcattccattttagcgattccttcaatcaggctgaagacagaattaaaattatgcacattaaatactcatgcaaaaacagattatagagcaggatatgactttcatttttgtctttttcttaaagatttccaaggaactaacctaagagaatcctgagtacatcttactgtgggtgtcattgatatatactgtttcattgcctataacccccaacaggaatcatgagctctagctgagttcatataattactaccccctgaacacttagcagtcctgccatttgctccttctggataagcaggttccctattctggctactctcctgtattcttgtgtgactttatccatcagagaccaactcaagcttttggggcatagccaacgctcccctccaaatgtgtatacctatgaaaagggacaacatgacctgacaaaattctctttctgatttgtgagttgatacatatgaaaagtcttagagcatataaaaagaaatcaaatatttaaatttgatgtatctcattattaaaaaatatatgaagaatcaggatgttattatctggaaacatctgtttggtttctgtatagtaccagtaaagttgatttttatattgtatgttttacatactttgaggtagaaaattatctttaggttaactatgcctgacagacatcatctcttttacttaggcaaggcatttcatttgtggaggaagaagtactttgcttgacagagaagaagagaccgcgaggagcctggtgtagttggaagaaagtagttttggcactgagggacgagaaagctgagagaggatgggagagtgggttcagccaagctagccccctgcctcctctacccaggacacacacactcagaattttaagtacaatcatggagtttaattatgtgtggatttctcaggaaattgggaaaggttctgaattctctgttttgcaagcagggaaacctttgagaatagaggtagcccaggcaaacagagtaggaaagagatggcattttttgttgcaggaattccgtcgatgcacggggacagaggggctttgcgctgtcttgggctgtggaattggagacaggccatgtttaaactgatctctaaaggtgtcaggttggcagggcagcgcaaggttatctggctgcatgaggttatctgactgcacatactgttatgggcctgggatgtcccctccctgtgtacaaatgcaggagccacaggtgctgctgacagctcacaagcttctgataccctactgaattcgagtcctttgaaaaagaccactagttggctcttctcacttctttttcattaaaaatgaagaaatcagaaacgaccattcacttaaaatgtggagaaacaaaacctttgatagtctgtccattcatttcctgccatcttcaccgctgaaaagtgtactaactttaagtgactacggtaatgggcagtggaacccaattcaaaattcagcagaaaatttatgatctaattttgatagagatatgtgaattatcagtgagttgaagttgtctctgtgttaagtcattacagatgttaaatttagcaaagacatataaactcctgggtgtggagagtgctgaatgttgtagtgttaaacacaaatgtactgcttgttgaattggtctcagatgaattttcctgctgagctgacacagtacctctggccgagttggaacatttcagtcctacagttcaccatcgtgctgtcaatttgtccatgaagatagtttatgggaatgcattgacacacatgtacatgctgttggaatcttgatggatttctttctttccttcctttccactgccccaaacttttctatagaactttttgattagcatagttcaaatttatgttttgaaaataattaggttcaattaatcagagctttctacctttatatcactgtttgtttaaagaaataatgttgattttttttgttataaaatagtggtagatgtcatcccttgaggtgacttgaaaaatgccaccttcctttaaagtaccattaagtaaaatgaacataaggaatgttaatcggattgtctcaggatcaatgcactgatattgatgtgttaaatattgtggttattagctgaaagtatttattaaccctaataagccagcaactctatggaactttctatttaacttttctcataagctactttgggggtaaacaaatcccaattggaagtaaggactgcaaatcaacccagccaagtgtaatgattagcaatggaaatatcccattgtggaattctagttccatatgctcgtgaaaaaaagattacagataattataattaggaactcagtgtgtgggagtgaaagtaatgattactgaaagccactgatcatggtgggagtaggggtgtgttataaagatgtgaacattttatctaaaacgtgcactctgttaattagtaactttcaatacatttatatcttaccgatacaatttctattgtttcttgaacactaggaaatgcttgaggtgtgaatattgttttccagtgtgatttgtactacctacacattataaagggatgttaaccgttcgaatcctctttaacggcccccagcagtgaaggagggtgggcagggagaggaacagctgttgcctaagaggggaaggaagggagggaaggggaactagagaagctggcttcattggtatatgatctgggataatgggaagcactgatttaggaattatcaaatcattcctccattgcaaatgtatcgtcattattattattattattttgagacaagtctcgctctgtcgcccaggctggagtgcaatggcaccatctcggtttactgcaacttccacctcccgggttcaagcaattcttctgcctcagcctcctgagtagctgggattacaggcatgtgccaccacacctggctaattttttgtatgtttagtagagatggggtttcaccgtgtcagccaggatggtctcgaactcctgacctcatgatctgcctgcctcagcctcccaaagtgctgggattacaggtgtgagccactgagcctggctgcaaatgtattataagggtcaataggtacgttgattcttactttttcctccatacacattacacaatactgagaagaaatgtattccatcctgtctagcacggcagtggttggactttaataaatgacggctcccttcctcttcatctgagtacattgaactgctacaattcattagtcagaaatttgaattgtttaggacatggtaagattctggagcctaattccaggaaataaagtgaaattcaaaggaagccccagactgctccaaatctgcccttcaaattatttgtctcatttacacgttatttttttgaaatggcaaagattatcctttctgataaattttgtgcattaaaagacaagttttatctattctaggggagctccaaatttatacaagacaattgtgataaattttttcttaaaggaagaaatcctttattatgcaaataaagcttctttattaacttctgtatatttgaatggaggttggacttttctcagttacctacaatttatacgtaactcaattatatatacttctctagaactgcttatgtaaaataatatttcttaacacatttaaagtggtgactccctattatattgcaatacccttcctctttttttctgaactaacaatggaattaaaattcaagtgctgaaaaaacacggtttcagtatccttatattcttaacatggagccatcatataattaaatgcaatgtctagtttttttcataagtgtatgaagttgaatattctgatttggtgcagtgttttcaaattttcctgaccataagaatcacttgggggtgagcctagggtatcatttgttaaaaaaaataaattcctggcctcccccctttaacctactgaatcagatgtgtagaacctgggaatatactaagtcaatgagctatctcaggtgattcttataatcaggtaagtttgggaccaatgatgtaatgcagtaaaacttaagggtgtatcagaatcacccttgtcttattaaaacccaaaatttctgaaccccacccccagatccagtgggtgtagagtctgaaagtctgcaatttttaacaaggtccttggtgatgctgttgctggcagtccaaagatcacactgtggggaccactgatgtagtggaaagaatgtagtcttgagatgagacacatctgggttccagtctcatttaatagctggaaattttttagtatagttacttaatactatactaagtacttaatactatactttactgagttttttcctctttattttcaattttttaaaatatccttaaataaatttatacactcatacatatatattatgcttgggtttaaatgctaccttgaataaatatggagcacagatggaaaccgagaagaaggaggcagaaatgagagcaaggaggaggctgataagtaggttcaagggagagtgagtggtctgcacagtaataactgtgtcctagaataaccagaacccagcaaaacaacataatcagaagcaaactcaaagtgaatgtattaaaagtcaagctaactgtttactttgcaaggagaagagaaaggtcacttggctgtacaagtatgatagcattgattaatttgaatgctttgtctgaatcattactgttgagattctgaaagttcagatactgaaaagaggaaaataatgttgacatggagaaaccaatcatgtgagagctgtttttcatgtcagtgaggataaaatgattgctacctgctctttttacacacatgactaatgacatatttgtaaacttagttttctaagaaagaaacatagccatcatatttagggttcataccattatttaaatttgtatactgtgttccatcagcttttcatgggaagtatttttatcctctctgatgatttgaaatagaaaagccaatttgggtgtaaaatccaatgttcaggcagaagccttatgtggagatagtgttcccacagaattgaactcctggagtactggttaagagcaagtactccaggagtcagatatctgggttccaatcttgctttcacctcttagggcccgttctgttgccataggaatgttcaataagctagtaatcattatagtacatagctatgggatttctacaaacttttattcaacaagtatttattgactgcttgagaggtgccaggcatggtggcaggtactggggatatccactctcagggagctctgggagacaggcaagaaacctgtgaataagaaagttcatataataatagtaggtgttaaggatggagcaattaacaaaactaaaacataagtccctagtcctccaagttccattatagtgccttatatcctagtttgtttaccttccataagctcatcaaaagtcaaatgtgacttagatttactgactaggttactattttattcatcagattgagctccttaattcgggaatttaacagaggttagtttgcaacttaaaaaaatcttcatttctatcctgtcttaggcattaatagattttgtccatattaccagtgcaaataacagtgaactttatgtttttattctctatttgatatgcttgtaatttaaggcttagccacaattaaaatgttcactttataatctattagaaattctatataatttaataattttcattttgttgaggtcaaatttaactacaaaatctaggaagctattgattcccactaaccgcaccattgttatagtcttagtatgtttgaaaatttaagtaaaatttgtttccagggccaaaaggagagtactattttagttttgtggaactttgccaaaattgtattaattattaactgtgattcatttatgactgtacttcttctataggattttaactaatttaaagcaaagactgaatgaaagtctttatgttttgcagacaagagagcacccatttatcctcagcaaatgaattgttggagcaaataatttcagtggaccgtttggtatagggaagcttatggagacagaagcttgtggagacagaaaattcaagggattaggatttttgaaatacagaataagactgaggggcagctaagatttatgtagtcttcaagaacatagactatgcaaatacacaaacctacattctgtagactgcattgtagggaataatggacacactcaacatcctctaagattaggatagagagaaaagctccactctatttgaaggaagggaaatttttagcaaatcagaataatattaatctaagtttttcattttctttggtggtagtcctttctggattggtttagttgccaccttgccagaatactttaggaaacttctttaaaaaaacttctttagtccaaggggtactctcaatccaggatgagtaaggctttcaactttccagaccaaataaataagtcagaaagcttttcaagtctaaataacttaattcttcttacagaattctctccaccaattgcttgataaatgtcaattcaatgaaatgacatgcacattcagaatcatggtaaatttttgttttccatatccttcagaatcattttttaaactttcccaaatctttggcttatcaatgatgcattattctgtcaccctattaatgtatgtttcctttgtcattcataaaacggttgtattgtttggccttatggaaggatgttgattaagtgcctgtgaatgtttgctttattggcattgagaaagaagagaaaatgatttgttttgccaacaatgaattattgcatctgtttgtggctgttaaataatttaatagaacttaaagggcctattttcccttgattaaactacaggaaaatatcagtctctgcctcaccttggatacaaagttagatgtaaaacatgtttttaatttgccttttgccagtttaggtgttgataagacactgagggatttttatattatgccatttttacatttaagttgaatatctctttaagcttgagacaaggaaaaagtgttatgaacaattttatttctaaatagcttgttcacttttattatataatattagtaatcgtgtcaaattcctaattataccaaatatcaagggttacaaattattattactgaaaatttcaaggaatataatttatttagtggaaatcctgagattaccaataccactattttccctctcctttgttagcttttctcctaaccaagctcaaaatgttctgcactttcaaaggtcactgctaagtactcttctctttttattctgccttctttccttaagttatctcattcagccccatgattttgaaaaccactaataacctgacagttcctaaatcccaaatttttaccttgaactcagggtttatcttaggatctagttccttatttacaattgtattcttaatactctagagccacttacaaatctgttccttctatagacttctctgtttctacaagcagctcctccagcctctcagttgcccaaaccagagatctggggatccctctctccctctccccattgctcccaacccagttcatcagtagctcctcaaataaatccacttttctcttgttctcaccttagttcagtatactgggaactctcttgcaatcaccaagtggttactccattaatttgtatctccaaatccattctctagcagctagatatattttttcttttgaaaatgtaagaactttcacttctttgccttaaaacctccatagaataaattccagatttataaaaaatggcttttacagccccctgccacagcttcatttcatttcctccctcctctcctatgcatttgctgtaggggcctgtgttagtggagtctcctcaggatcttcccgtgctgtttcttctgcatggaatatttttcccacactatttgcctggcaatttgcctagcttgtgttagttcctcaggggatgcgtagtaccccactccagtctaaattagttcccctctacctaaaatactccatattttctttcagagcagttcttatcattttaaattacatgtttgtgtgattatcctttaatatatctttctcctacaggtgccattacagtatatgcactatatatccagctcagtgcttgacactaaattgggactccataaatatatgttgaagaacttcaaatattccaaaatatgaagaattttccataccatgtcctcttttttgtggccctctttttttttttttttttagagacggagttttgctcttgtcacccaggctggagagaaatggctcaatctcggctcactgcaacctcccctcccggattcaagtgattctcctgcctcagcctcctgagtagctgggattataagtgtgcaccaccacactcagctaatttttgtatttttagtagagacagggtctcaccatgttggccaggctggtctcgaactcctaacctcaggtgatccacccgcctcggcctcccaaagtgttgggattacaggcatgagccaccgcacctggcctttgtggccctctttttgagcggcatttttgccaagtaatatagcactgttgggaagagataattagtgtaagtaacagttcttttttttcaacattcagtgagggaaaatatcaataatggtaaaacttgtattccttcccgtagtgaagggtgagaaaatacacttggaactagaaaagcatagtagtaaaatgtagaggtagtataaacttaaaggaaaaaaatttcaccaggactagaaatacctgggtttggcatctgactctgccactgatttatgtttttggcatgttgttcagtctcctgtgtcttgcattttctcatctcaaatcttcagagatgtcaacagaaaacaaatgtggaaaccctttgaaaaaattaaaacttcttagaaaggtgagatgctcttaccctccttattttgattttcatttttgaacacaaagtggttttacttggaggttcttaaagtaataatgaacacagtcattctcatagataagactagctgtcactttctctcaattcatgcaagtgttattaagaaaccacctagggatgataatatgaaattaagtgtagtgaattcattatggattgcctttctcattttttacaaggtttcctgatagcaaagctaataaagtataaatatgttgaggtgtcaagtattttttttaaagagattaattagagctcagtccctaagctatttgtaaattactatactttttcattgtaaagtgtttagtggaaatgctgttttaataaaatgattatagattataaatggtttcattaagtactttatttccctgtcactataccagttctacagaaataaatgactttaacgttctttttgctgataatttaaatgagatctaaaagatgaaacattattttgaaacaaatttaatttaattgaccctgcatggcttggaatctttgctgcccatgatccttttatgattaaatactaaagaagaaagtgtaatgtgaatatttttcttttatttctacatcatgggattcacacttcctgaggtgaaatatcttattcttttcagataatattagtagatgtattagaaatttatcctctcaggggttgtgctggtcagtttcatcaacaaatggaattcaagatcccttagtaaaacgaatgaacttatgtaacaaccacaccctacacacaattcaaatgtgtgttaaatatctttgtgttcagacaaattgatagcctagagatcagtatgtgctagcttatagtcctgcaaacaagtgtgatgtttattccatttaaaaattgccactgaggcgggcttacgcctataatcccagcactttgggaggccgaggtggacggatcatctgaggtcaggagttcaagaccagcctgaacaacatggagaaaccccatctctaataaaaatacaaaaaattagccaggcgtggtggcaggcgcagtggcaggcacctgtagtcccagctactcaggaggctgaggcaggagaatggcgtgaacccaggaggcggaggttgcagtgagctgaggttgcaccactgtactccagcctgggcgacagagtgagactctgtctcaaataaaataaaataaaataaaaataaaaaaataaaaaaaattgcctagataagcaaacataactactcaaatttcataagattttgtaaacttctctcagtgccaagaaagtaagccacctggcagtttttttttttttttaaagtgaaccaacacacaaggatatgcaccagagctgggcacggtggctcatgcctgtaatcccagcactttgggagactgaggcgggaggatcacttgagcccaggagtttgaaaacagcttggacaacatggcaagaacctgtctctacagagataaagaaacagcctggagtggtgatgcatgcctatactctcagccacttgggaggctgaggcgagaggattgcttgagcccaggatttcacggctgcagtaagccatgatcccaccattgcactccagcctgagtgacagagcaagaccctgaccaaaataaaaaatatgcactagaattgagtgttaatatttcacctgaatttggctcagatttacatgggctatgagagcattttttattttagttaccatttcttattacttataattatattctcattctgcagatattctcaggaggcaataagcctggtggtaattgagcagatttagttttttgaaaaaatatattgacaactatatttttcctgagagtgtaaaaatgattcagaaaatatctgctattttaagtaacattttgagtgtaatattgcattcattagttgaatgtcctgagatttcacatgttaaatgtagagttaagtacaattagtagaagagtattttaagtggcagagatgggcagaaattattttgtggagtgagattagttgagttcagataaggaccctctattaaagaagaaataaaggaatgtggattagaagacaatgaaagactttttggtgaactaatgtatactttctgaagatttgggagtgtgttgcggggcggaatgcaaaggcaaatttgtagttacatatctagacatgaaaatagagggataggccaagttcacctgatggagagcttttaaggctacattctatatttgatgattgtggttgaaattttataattattaatagtatgtatgctctgaaaggtaaaagaccttgtaacctatatgtaattcttactgagcccaatactttgggatatacttaaatcctaattcaatatagcagatttgaatcttattatcagtggagtgcatttaattgaaatcaaattgatttaaacatctagtaaggaattctcaagtttaaccttcttttccacctctgggtacattcatatgcttacatctactctcaaaccttagaggtagaaaaaatttgatttaagagaagatacacattttcattcaaattgattgtttaaatatttataagactaattttccagatacattataaaactgaattgtgctttggacattcttttcaccacagctaactaatattattagttctaaaatgtaagatactaaaataatttccaaatcagaggtctgacatgatatttaagggctatttttacatattgtattagaagtgcattgaccattctcaagaataataaatatttcaaatattgtatttaactaaaataacaccagtgtaattattttaataaaaataatttcaaaagagcccttgaactcctgggctctttgaaattttaaccgttctacttatgactcaaaaaagcttaaaaaagatggatgtcattaatctctacaaagtgtatctattgttctgataattcatgaggtaattataggactaatgctttctaattgtctttaatgtgcaaatatctttaatatgttttctcatagtatatgctaatatatgttaattttaaataatttgagcaatacagagaaagaaaattccataattttgctccctttttctagagataaccactatcaccaattggaatatattcttccagacttgtcataggtaaatggtaagctctcaagctctcatattatactataagtactcttctgttatctgctttttaagtatgcacacacacacacacacacacacacacacacacacacacaatgcattttaagatttataggtctgcatcacccattatatgggctgtataggatcctgttacatgtaatgtaccataatttattttgccagtccttggaatggatgtttagtttattagtttatacttactttttaaaatatcagcagcatggcagtgaaccacctcttacttatatctttgctcatttactcaagtatttccttcagatttctttaaattcctaaaaattaaattgctggatcaaagtagatgcatctttaatgttttaaaatatattattacattaccttccagaaaagttgtacaagtttatattcaatgtactgttgtacaaaaatttccatttccctacctttagtaatctgataggtaaaaatagtcattttatttgtctatacctttgtaaacatatatatatacataatgtataattatttgggcatctttttatatattctctaaacagttatataattttgtgaatttgtcttttccaaaatttgtttgtgaacaatttttataaattaagaaacacatagcaaatatttccagtttcaattttttaaaaaatatcaatacagttttaagtttctatatggtcaaatctatcaatcttttcctctatgctttctggtcttaatatatttgttaagaaaaggtcttcttcacccaaaactatacaaatatactcttatagtttttcctagcatttctgtgttttatttaatctttaatctatttaaaattattttttgtctgacatgaagcagaaatctagcttttttgttcaaatgaatactcaattcgttaacactaataattgaataatgtattgtttcctttgttatttaaaatgcctcttacaactgcatccattgaaactatcccattgggcttttcattacaatttgattgtatttgtctgctaattagtgaagaatttgaattttgccagtagtatgtttttggtaatttttaacatttttatttatttaatttttccttttaactttaagtgaaataaaattatataagttttgcacatatcttgttaagtttattcttgacttgtttataatcttaattactgatttgaatgggattcctctcacccccattcacccctgccattatgtttagaaacaggttggcatataaggcagctattaatttttctatatttatattatattttgccactatcacttttactggttttaataagtttttcatttgatcttttgggattttctcggtaaatagttatattttctgcaagtaataatgatctgtcactttctttacaatattttacgcttaatttcttatctttatcttattgctttggcttaactatccaaaattatattaaaatataaagtaaataaatagtgggcttttttgttttgtttgctttttgattttcatgagaatgcgtctaaatcttcagcagttggtaaaatgttttctctaggattctgaaatggttttgattatgttaaggaagttttcttctcttctcagtttactgagttttgttgtgaattgatactgtattttgtcagatgtctttggggtagtttcagttatgaacaattgtttttctcttttaaccaatttacttattgaattacattgatggactgtctcatgttgactcattcctacattcctggaataaatctgactttttgaagaatatatttctttaatacattgccatatcttacttattttcataaaaagatctataattcacttctctggaattttatcagattgtggtctatgttttacaaagtactttagcatgctttatttccttttttccttgacacagccctatgaatcaggctaggaattatatttttttgacaaataaaaattatagacatagaaatttgctttgcaaaaagtcatgcaagtaggtggtaatggtgagtaaaatttattaatctctaatccaatactttggtttggagagaaggaatttaattagttcagtaatttctatcagtacgatatttatggactttgagttttattatctcaaataaaaactatgcttatgtagttttcttttacatttttctaagttgagagaatgaatttgtttccattttgaccatggaggcttcactgggtatgaatgggggtgagggagagttcaccctaaaggagtccctgagctgagaatattcattctctgatatctgccatctgttccttgaacatgagcagatgctgatgttcagttaatcagaggtaatgcaataaggattaaagtgttagatagttctaacccattccggaagttatgggtaaaacttaaaacctttaatcagattcatcttgacgttgaaaccaagttggctatttgagccaaaggttctgtatctctatgatagctagtcccaaaggacatattctattattgtcattaagagaaaacatattaaggatgtgtttgcacacagcattgggtcaagataattgacattgtattttatatgtggttcagagatctgtcttatggaaaactcagagattgctttaaggggtttgttgcaaaagaaagattcaattaggcagtttaaaataatttaaatgtcagttttacaatacagacttaatacaaatgcaagaaggagtccatttgttgatatatacaccaatttattaaatggtagaatagacttctccaaatctagagaaagatcagtttagactattaatgtattatttcttaagtttgaatagaattaggttttttaaaaattgaaattgaaatttagtctccttgtcccaagtgacatacatttataaaatgtttttaaaaagtaaattcactgtttttaaatcttctacagaatattttttgtaatgaaaaacctacatgtatatattactgtacagtacaatagaactgatttcatttctaagaaataccactagtcgttatatattttatgtcattgagttgaatttgtaagtgatgcatataacctggagttttgtccttaccaaatattgcatagaaaaccataaattcctggaaattgactatttttcaaactatctcattaatgaaaatttatgctctgaagaaaggctaattatgtctcttatttccacttaagctggtataactgtaaatgattttcttatttttataaatcacatctgttctaaaacttagctccaataacactctatgataataaatggcaaaactcacataatattgaagcacattgggtatttccttttcagttttaaatatgcttaattcaaatttagatgattaaagaatatatttggactccaaagtgactaaaatcaatgaaaataatatattggtgtgtcatagttgggggtaaatattaccattaaaaactgaaaagtcgagaatggtgtgaacctgggaggcggagcttgcagtgagccgagatcgagccactgcactccagcctgagcgacagagcgagactccgtctcaaaaacaaacaacaaacaaacaaaaaaacccctgaaaagtcgcaaggaaggaaaaacgattctgtgaactcactacataggacacaaagagaggtgggaaattttgtcaggaatgttcgtgacatgaactctatttaataatgtcttattcccgttgatattttaatttttcagataaagtattttaagtaaatgtgcaacattaattagaataaaatataaaagtatgcgtctatttgaaggcctacctaattacatataattttctgatgaatgccctaattaagcatcaagttatatgtttatacctgtgaaataattggagcattacatttaatctttataacaatacattgaaagagaagtattagccatgtaggtattaaaggtatacatttagctagacttcatcattgactttccttttaaagggacatgacatcctgttttccatcaagagaacatcgaattaatcctcacaccagaaacaacagtcagtgctggcataagctccgccaggattcctgggccctgctgtgcaggggtctcctgaggaaggacagaatcgtatctcggtctccaagcccacttggttcttggcacttctgctaagagttgcgcaggctacctattaattttaaatgtattgtttttgaggatgaggcagacatctgtcttagagggacaggactgatagccgcaagtcgttcctcagaggctgctgaataaatcgtcagatgacctttattgttgtcaccctcattttgttcaaattgacgcagctaaagcacagtattaacaaaactacgcattgcatgcagcagtgggattagtgaaaaggaccatgttgttgactagagaaatggaagttcacgtatctcataactgcgtacgaagcagtggactgggaaggatacaagaggagaatgacaagattaaaataagagacaaggcctttacatgaaagcagctgacactacaaaggacgtagtacttctgtttaataggcctcatcagccttttatgctcccttgtgggcttggctcatgaacatctttaatgttatttaaagctgtttttattgtttatttagaaacattctttatacattttgctctaattattaaatttgatgatctttgttcttatttactgatttaattagctacaaacattcatacattaaaatttattccggacaacattagtgttgggattaatgattttttaaagaacaaatcacttgtacaatgcatagcccagagtaggggctcagtcaatctttgtgtaaatggaagttgtatttgaaataatccattggatgtgtataataagaatcattcttgcagaaaaaccctaactggatggaaactatacagaagaagagcttgagataatcacttttatttagattgtcccttcttaatgagttctaatgagcaaatgattgcagtgaggtacagcacagtggaagcttcttctgtttacaaaaacaaatcaatggtactaactacccactctgaaatggactcttttttttttctcagcactctatcactagctttgcctgtagaacatcaattatttttgcttccaagtgaagagagtcatttcagagaagatgtgtaaaatttagagggtcactggctgcccatattttaattagtatcccatccccaccacagcgtatatatcagtgtgggtttcctaaaggagatggctttagtgcgttttattaaatgaatcaccttttataaataaaatttaatggtaaattcagacatagaacttaatttggctagagaaacttgcatgcatacacttagcattgcctttaattaattctgttgacttagaagatggtgtagacaataaatgctttttttattgatcataaaataactgttcagatccttaccaataagggacccactagggaaggccagtggtttacttgggttatgcttcagctacttctcaatagtggccattaggacctccactcccactgcatcacagtgaccctgggtaagtcacatggtattaaccataaataagtgcatcacctgtttgtgtctctgcattaagtaactggagttgaccatgggaataaaacttgggaaaatttaacgtgaaattaatggtataattctatagttgcagacttcccttttctgaaacttgaaggcaacagatacagtgatgatcccatctctcccaccatcttgaattttgtgtgaactgttaggccttgtgtatgggtaagggttttctccagaacacttaactgccaaacatggatgtgattttgagcataggcccattggaaaggcaaaatgtatgcatcagaactgaattccattctgtgatcacaatccaggttagtggagccaacatttttgaggatagccctctcctggatttattactctctgcctctgcctgttattcggtctcatttggggccactttatctcacttagtatatggtagtagccatcctggctgtctttcccactgaaggacttttgttccttccctggaaccctttactctcagtcttgtcatggcagcagtttgggtctcatttcgttctctatcctaggcatcttaaaaggaacaccatcatggcacatgtatacatatgtaacaaacctgcacgttgtgcacatgtaccctaaaacttaaagtataataataaaaaataataataatttaaaaaaaaaggaacataagacattctcttgcccaagttagcagtaactgcttaactgctgaattcagtaagcttatcttcagatcttaatttccaacacgctttccttttagtcttggcttctgtggaagctcattctcctggttttcttacccctcagctcttcttttcttttaggtcttctctcctgcccagcctctaaatactggtgttcctctgggtttagctcatctctaactgcttttatttaataggtgactgtactatgctcaaggttctatttatccctttacgggtataacttccaacactgaaactgcagcccagacttctccctggaggtttgactcatatatccaactttccattgggcaacttcacctagatggcccatagtcatgtaaaatccaccatggcccaaagtaaacttagtttccacttcaacttcacttcccctgatatttcatacctcatttagtaatatttccactcacttctcactcaaaccaaaaacctagaagtcatcctttactcagtcaagaagttgttttacctcatgtttcttgatatttcccactcttcttcatcctttttattaggaacctacctaatcccttcatcctttttattaggaatcctttttattaggataccttcctaatctacctaataccttcatcctttttattaggaatctagctcaggccatcactatctctttattgtaatgctgaatgaaatagtcatctaatgtaccatcttcagttttgtccgtatcaaatccctttagcacatatgcagagtgatatatctaagataaaaatgaaaccttatcagtttcctccaaactctgtaatgtgctagactttgtcacagagtaggtacctattcttgtttgtcaaatgaataaatgaagaataagaccagaggcttctcagtatccaaggttggagttatctggattctagattgtatattgtctaccatcctttgagaatgtcatgtatcaaccaaatttttgtttctcagttttgcttggaacttcacaaaaccagaatgaatagcatatttttatagtgtataggttgtatatatgaacagatagggtctgtatggtgaaaatcaaacctatgtgcctatatgcttatcttttagtataatctattaaatttttattaataatttcttaagagaacttttcaaatataaatctttccctcccttacactatgtagctggagttcagtgttatgaaacaaagattccttctcatcacagtttgacaactggtgttttgatttctagtctttagagttgtgtaaatttgttctaacaaagaatcattttagaactgtttgcttaaaaaaaacttgccaaaacaccaaaaagtatatgtgatgatataattagatatttaaatatgctcatgaggtcaaaggcagggaagcttgggcttggtatttcctttactcacttttaaatttttgtacaatgcttcagtgtgcattttttccctgtgtgttaaaatatacataacataaaagttacaatttaaccatttttaagtgtgtaagtacacttaagtacataaccatttctaagtgtataagcattaggtagattcacattttttgtgcaatttcagtatactttttcctgaatttatattgaaataatttgatattttcatgattgagatccaaaacttgtattgaataagtagagttttctgggggcttatcaatgtgttttgaagaaaaatgattttttttttaattttgattaaggagcttgcattatatccaatcttattgggcttagggagagcaaatgtcaatgggaatttatggaaacatgtttattaatttggcttatctgaactttgtttccaattttagtttaataaaattattaaatattttaatacaattattaaaaatattaaatatttaggaagctgaaaatattttgctgttgtgacgagtctcatttaatcatgattggtatcctattcctaacagtagtagataagcaacagtgttgtagaaaataatttaaaaattaaaaagacatttggccattttccccttgtattttgaaatgatttctgagtttagaaatcagacattatagcataagattagatagaaattatctttatgatataaatgtaatagaaacagtgctcataggtaaatcaatcttgtgttgttttaacaaaaaagtatttgtctattgctttactagttcatgagactcttcttgattctgatgattgaatcctttataagatattgaataatttcaaaagacagtagatccaaaatgtgaaatattatttagagatgttcagagaccatataaacccaattttgttaattttttttaatttaacttatttaaatgtgattcctttcttgagaaatgataatttggagacttatgcatagaatattaggaagtagaaaggattgaattcaatgtctgactaattattggactcaactacaatatgaggttaagctttaatttaggggacagaggcatgacaatgcactatttatcttaataaatttaaagcgtttgttgtaagctgctcaaagagagactttggttgtggggcaggagttgggtggaaggggtattggtacttcagcctcttgccttcattctcatgtgaggagagttagctttgaaataagctgaaagaccttgtagtttataaaaatctcctggaaagatgttatggtcattggaatcagttcagtcatctaatgagctacacattggctggagcacacctgaactgataataaacttggtttcttttggaaagtgccaaaagtacccatcttcccaatacatacacaacataaaatttaccatttaaccatttttaagtgtatagttgaattgtgttaagagagaattgactctcattcaatcatcatcatcataattatgttttgtatttaccaagaaggaaaactgatactcaaccttcaactttttctagtctgtttaccttaatattcctactttctcaccatcaatctgccaagatcttcttgagggaatacagatgtaggggtgtaggactctggtggtggtgaagcttagaaggagatttggagtcgtccacccttcagtccgctgaggcaccatttccatctcccctcctcccaacctgtcagagccaatagcatggctactgaaagaacagcgtgattgctctctgaatccagacattgtcctttcctatgacagacctggagaaatatcagacaactgaaccttttccagcgtattttgaatgtacgtaatcttggctgtagtcatcagcagacaagataattattcgttcacacatgctctggccaagttttagctcatttggagacttgtaatgactttggattctgtcctttgtaaaatgacaacctaagaatcatgtctttttactggttccaagttttaggtgggattttgatataagttttataatcatgtaggaattgtgggtcaaagcaagaaataagcattatgggcaggtggattcttttgcaggctagatgtaaaacatgtatttcttgaaggcttggcattctaggagggaatgtcttgatttaaggagatatggcagagaagagccttgtaagagaaagctattctgacatgagtggttttgttcttacaaataaacagtgactcaagtcagtagcagggcgatagactgtggagaacgctagcataatatcatacttggggtataggaaccatatacattcatttagagtagcattaatttcccatttaatatttgttagaaactattagagattttatcactctgctgacaacaattctatttggaacatgagctgcttatataaaaatcatttttaatgtgaaagctctcattagcttaaaaggcaaatgaaatggttagctttaaaagctgagtcacagtctcatttaccatcagaattcacagttttcttctttattttaattagtagattaatcctgtctcagcaatgccattaggtgcctgccttgatggtgtggaaaaatacacacaaacatctgatatttctgagcatttgggttgtgacaaatttaaatgtgttctaatagatcatctgtgtataaatagcttaagatttatagatgttttttaacttaaggatgaggaaactgaccactataggataattaaaaacagcaactctttgtaaatgcaggagctaagttgtcaaatgccagggcaccaacaggcaatattctgtaatctaaattgggtaatttatatcattgtcacttgaagatctgatataaattggagtcactgaatcatcccaccaacatctcataactaaagcaaattttgtttccttttcatgggtagggttttagtcaattgaataataaattatcctgtcttttctgaatcataggataggcaagcttctgtaggcagaactgatgaaatgaggccccaaagaagatattttaccctgttttaaaatatttccaatgaaggatatggtccagactactttggttatacttttcaatatttgaaatagtaatcttatgtggttgtttgaaaaatattttcaatttatcaccgaagatttgtctgaaatgttcggaagtcaggaatgaattaacttctatataacacccaatatcctggtcagtacctactcatagtcctacagttactgggtgtaaaaggcaatgctcctcttcctttgaaaagcataacctttcaagcgcttacagtttataaagaacagtcacgcacattttctcttttcagtctcacaatgacactatgttatatgaaaagattattaattcctatcagaaattaagattgagagaggttaagtgactcactcaaggtgatatatttagggagtggaataattacaactcaagaacatggtggcacgttcctgtaatcccagctactcgggaggctgaggcaggagaatcgcttgaactcgggaggcggaggttgcattgcactgaaatcacgccactgcactccagcctgggcaacagagcgagattctgtcaaaaaaaaaaaagttatttttgctccaaggacaaggtactttgcactctacattttgctgactctttggcatgccctataaaattgggcatggtaaacatgcattacgactcttttggaaaatttgttcctggggcaatcacgtgaattgggatgtggttgggagcatcattaattgagtctgtggtcagaacagagactagtataaagaaatacccagtgtaagtggcatcagtcagatattcagtgtaaatgaattgggaatgatagacacagtgaacggtccaagactgaaatgaaatctatcatctcatgagtattcaggggactggaactatattttaggaaggacgataggtgagaaggcctagatacaatcaagaaggaaacagcctcaaaaaataataaacctgcttaagataccctcttctgaatggatggagtttgatgatctgttggccctgttggtcagggaagggtgaaatgggctgaggaaactggaattctgtaacactaagatccaaggacacttccagaaatggcatttacaaggtgcaagtgttccctgtaaatcttctggcaaagggctttgaaatttaacttatattggaagaaccttaaaaagttagtagagccattcatatttctgtttggtttaagctgtgcctgctaataacattgcactgaaatgcaggcgtgaattcctataatgttaaaatcaaattgtttacctcagtttgaaaatttgctcaaatgagagtgattggctattgttagctctcaatttgactttcaagacaccttgaaatagcttcaggaaaaaaacgtgatttctagttaagctgttcagttaagcactttgtgatacaaagtatgttaaggtaaaaccttttatttaaatcaactttaagaaaacctctttagaaagttgcagagtataaatgaggaaacctttaaaaaaatacagctttatttcttttacgtatctattgggaattgagctaggtagtcgaggcaccagcatgaggttcttaagaaatctgctttaatgaacaaatcagagtgatttgtacttaatacttgattttgtttcaaaggccacataggcatttgaaaaataagtttttgcctgaatcctgtaatttcagctttcttagcaatttctcttttctgaaacagtgaaaatgtaaactttagggtagcctctgttcaaataatcacaatatgtgaattgaagtttgaggagttcatagagtgttactgaatttgtctgttttctaaaggaaattgattcatttttttcaaattattttacaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttagaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctgaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcaggtaggagaaacactcacactctccttccctatccctgcttattcctacccgtataatgttttattaataatctgatttgcaaaaatttatcagaaagattgtttaagtctgggtgtggtgactcattcctgtaatcccagcactttgggaggctgaggcaggtggatcacttgaggccaggagttcgaggccagcttgggaaacatggtgaaaccctgtatttctaaaaaacatgaaagttagccagatgtggtggcgagcacgtgtagtcccagctacccaggaggctgacatgggaggattacttgagcctgggaggtcaatgatgcagtgtgctgtgattgtaccagtgcactccagtctgggcaacaacagaacaagaccctgtctcaaaataaaaagaaagaaagatgtgtaaacctgtgtaccattgaactaagttcagtattgtctgtgataaaacagatatattttatgtttctaactgtgaatgctatgttaagtttggactgaactaagatgtagcaaaatgctgtatattaaatatccttagtacaaaactgaatcaatatatggaaatgtgcatctgaaacaatgggaaccaagtagaatatacaatatatgtgtgtaatacataaaaaatttatacaaacatacacatactaattaccagtgtatatataacatatttgcatatatgatcatgaaagaatttgaagtgatataaaacaagcataatgtctattaggttactttttagttttaaattaggtataatgacaacaataataaattactccccacaagaacaagtaaaactaaacaaaaaaaattggcactcaaactggttgaaaaatatttaaccttgtcttagaaatgtggtttaattgaaagaacatgggttcttgatcaaatctatccctgtgcgatcttgaacaaattatttcaggtctctgatcatcaatattctccatataaggtaagaaaaatagttacacttatcgcaaaattattattagagtaaaattagggtatatggaaattgactagcctgaacatttagaaattcaatattaagttttctttccttcattaatgcttataatctgagacagtggtaaacttaaaaaaaattacttaatatacttattaggctagtgttattgagatgcaaacaataacagatattcaccgagtacctgcaatgtgcaaagtggatattattcaattcactttatttctttagctgatgtgtttataataatcctcaccaaaaatccctgttttcaagatagataataaatttgaaaatgttaatgcatttcctaagtattgcaagttaacagatagcaatgttagcctttaaatccaggactgccagtatttaatagaacaacagggtgactatagttaataataactgtacattttagagtaacttaaagagtctaattggattgtttgcaactcaatggataaatgcttgaggtgatgcataccccattcttcatgatgtgcttatttcatattgcatgcctgtatcaagacttttcatgtaccttataaatatatatacctactatgtacctgcaaaagttaaaaattaaagaaaataaatccaggattgcctaataccaaaatccatttccattatcattcatgtgcagaaccacaaacccacggcacagttaaatacttgtggtaggttgtcttagccaccatttaaaaaatagagtcccaatatcagcatattctatgtaactttttctgacataattctagtactattataaatccctatgttagattagttataaaccatttctgcacttaactttatagattagactttacatattttatataatcttgaaatatgtactttgcatattttatattatgtatttaaaatacatagaagtgttatagataaagtgtatccaggtagcgttgatagttcatattatcttaacataaagtctttggggttaaggattatttggagtctaatcagaagaaaaatgaaggtgatcattgtcatgaaattcatgagacacctaataagttaggtactgttcactgtgggtgaaatgtaaaatagtcataatttctatttcaaatgaattttttgaaaagactgtaacatggacaaatgtagctctacatgaaatgtgctttcagtgtgtgtgtctgtcaggtgcctttctgatgaagtgacaaaggaatgccattgattagtcagatggagggtggtgagcagtagcatcctgctaccttgaggaaaaaagcccaagtgaaatgcactccagtgtacaacccctgccattctgttttcctgatcaccatgatacaaatcaaacatgacattcatgatcagccagtacttagttgtgtgactatcccagtggtctgctttgaaaagcactgcatagccttgtgtcccactctgctttgctttcatgggttgtttgtggtgattgctaaaaattgagcaagatgaagtatagttatgaattagccctctattatcttttaaaaatgaatgtacttttctgtaaacctgggagtgctggcggtgatgtgtcaggtggtcagaagtgtgattccatgttttcttcctcacagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctggtaggaaattgcgactccatatttttttacgtgtgtgtgtgtgtgaaatcacaaatagcagggactcctctgtggaactccaatgaataacacagggtgactacctttgaaacatggattggaggtagcatgcagagccggcccattcagcttctgctaagtctcagtggaaaactctgagaaaatgacttgaacctggagctgcacaggttataagtggaaaactctgctttagcaaggaatgaattattaaaaaaccctcaaaaatatgtacactcatcatctaaatgactttagagtgcaatataaccatttaattatatacctatgggaagtaaacatgtctcagtgctgccttatgatggttgagacaaaatttatatagaatctatatttttcagctaattcctagaatgtaccccttatcctcatggtccaaaatgggtgctgagctccagccataatatctgcattccaaccatcaggagtgatgaaaagatgtaagacatagcttcttcctttaaggacgtttctctggaatagaatagatcatgtttgcttttatttcatcagcctggagttgacatatagccacacttagttgcaaaggagaatggaaaatatcatttcaaggggctatatgctaaatgttgtctcttctgttactaggaaataaggggagaatggatattaagggacaaccaatagtctgctacagaggtgaataggcaattcacttaccccccacccaataacaatgaaaaattaaaaacatttaactttaaaataagtttttaattagaaattaagaaaatatagtaagatattcccctcaccattaaattgacatgttttttctctttaaaaatagtacctctgatcaagaatttaagcaaatggatactctcattcatctacttctagtggaaaaataaattgatatagtatttcttggagaaacaattggcaatacaatttaaaatgcttacgagtttgatctatagagttccttttcttggatttattctaagccagtagagagaagcataaacatttatgttaataattcaacatagaaagattagctaagtgaaatataataatctatattatagattcctttgaagatattaaaatcatgtgttagaagaatatgtaatggtatggagaagtccttacaatgttttgtagaaaatttgattacaataaaatgggagataggatttaaattacatttctatgaatatgcccctaagttgctagcaggttattaatagtgaatgtttttatataagagtgaattttattttcttatttatgcttttctgtattttttctatattcaccaaactctttataatgaacccaactaattttataattgcataaaataaaccttaaggaagaaaagatgaagattttgtcattaaaaaacaagtagaagaaagatattggagataaacattctacgaatgaaaaagaaaaatttccacagggcatgttctgcttatgaatgaccatacctgttataaaatgtacttcatggttgctagggggaaagtttacctattacctgtatctcatttttcatgaaatcaactttttcatcataaaaatggggactgaaagctattcagtgaataggtataattgccatctaagaggtgaaattagggtactagttgccatagagacagacagtagaaatcacttattcctccacttctcttttaagctaagaaaaagaaatcattcatggccagggaggtccctgaagctggcctgtaataagcagaaggatacctggtctggggctgggcaattgccatttcacacccccgagtgtctgacagtgtcttattttttgttttatctgctgaagccaagactgaaatattagccttttctcatctgtattattacaatgcaaattgtaattgcaggcagagcatggttttcaaagattaaaataaaaggctacggtggaagcagaaatacttataatgaagtctttcatgtacagttctctatggaaaaccattttgggagggaattgagtgtaaatatccttataccacatggtaaacttggtagaattcaaaaatgattaaaaacaccattgacatctctgttgagtatttatttgggggatggggtgggtagggacagatacatgtaatgatgatattggccttgaaattaaaacaccatttttactttctaggatttgcattgtattggttggcatctttaatgctcttagtgtattactgtgtgttaattttaaataggtcttctaagatctcttcagatctggagtgaacatttaaaaacatagatcaaggggctggattacacttgcaatcccaggactttaggaggccgaggcgggtggatcacctgaagtcaggagtttgagaccagcctggccaacatagtgaaaccccgtctctactaaaaatacaaaaattagccgggcatggtggcacccgcctgtaatcccagctacttgggaggctgaggcaggagaatcgcttgaacctgggaggcggaggttgcagtgagccgagactgcgccatcgcactccagcctgggtgacagagcaagatgcaatctcaaataaaaaataaaataaaataaaataaaataaaataaaataaaataaaataaaataaaataaaataaaataaaataaaataaaaacatagatcaaatcaagtcactttcctgcttaaaatcctccaatgggttccattaaaataaaacggaaactcctgactgtggctttacaaggtcatttatgatttgcccctgcttgtctacctcacctgcctctccatccttgcccaatctcactacatctcccaacctcatccgcctctcacaacctcacccgtctctccagcctcactgcctctcccaacctcacctgcctctccagcctcccctgcctctttagttttacctgccgctcccaactgcacctgcatctccagcctcacctgcttctcccaacctcacctgcctctttagttttactgcctctcccaacctcacctgccagtccagcctcacttgcctctctcacctgcttccccagccccatttgcctctcccaacctcaccagcttgtcccagtctcacctgcatctccagtctcatctgccttttctagcctacctgcctctccagcttcacctgccttccccaacctcacctgcctctccagtctcatctgcttctccagcctcattctcacaccctctattttgctcactctcttccagccacactggctttctttgcacatatttatggggtatggtgtgatatttccgtacatttatacaatatgtaatgatcaaattagagtaattagcatatccatcacctcaaacatttatttcttagtggtgagaacatttaaaatcctctcttctggctattttgcaaggtacttaccactgtaccaccgacaccacctcttctagctatttggaaatatgcaatatattattgttaactatagtcactactgtgcaatggaacaccataatttattcctccttatctcttaattcttagctcaaatgtcattttctcagaaaagccttccctaactactctccccatacattcctttgtcacatagccatgttttatttccatcttcctgcttagaagtattgaaaaatactttgcttgaactttttaattgctgtcctcttttactcctcaatttgaatgtaaactccgtgaggttagatcctatctgtatatttattactgtcacctctggcacccaaaacaatgttggcacatagcacgttatcaggtaatgttcactgagtaaaaacaataaataaaagcatctattgttggtgaaaatcgtgtagtttccatcctataactgaacatgtttgatgataaattattaaatccccttgattttacctctctgacaccacccttgctgaattgttccctatcttatatttggctaaaaaacttacagagtaaggcaaaactatggagacagtaaaaagattattatttgccagggcctttgagtgggtcagggagggatgaactggtggagcacaaaggatttttaaggcagtggaactattctgtatgaaactgtaatggcagatacatgtcattatacactagtcaacaacctatagaatgtacaacacaaagagtcaaccctaatgtcaactatggactttagctaataagaatgtatcaatagtggcttgtcaattgtagtaaatataccacactaatgcaaaatgtaaacagtagggaaaactgggaggtgggggtagagttagagggtgaggactctgtactttccatttactttttatgcaaacttgaaacttctcgtaaaaatacagtctaaccacccccccaacctaccacagactattaataaaaactgatttggatgaataagggaaaaaagcaaatccaagatttattgcctagtggtgtggttggtgtggggagaaggtattccaaaatgaacagcttgggttcaatttagacttaagttgcttaaatttttggatttcttgaaaatggtaatgaactgtgtagatgccatccaagaggaaaaattgttaccactaaaaaatgcagaatatgtttagaataaaaacaacctgaaatctttcctgaacagatacaaatgttttcttttttcagtatggaaagaaagaaatcaggcaacttggtagcctacatttgttgaaagcaaacttgagtgcatcaaattatactattatcaagggaaaataaaataaaatattctagaaaacactgaccctgagttcatctgcacagattttttcccctaaatttagctttccatatttattacccactataaataaataaataaataaatcccactatttattagtcattaaatatttgaaaatatttcctcctgagggttttaaaattcagtcttaaaagtcattttttttctctctctctttttgttttggaaacggagtctcactctgtcgcccagactggagtacagtggcgcgatctcagctcactgcaagctccgcctcctgggttcatgccattctcctgcctccgcctccccagtagctgggacaacaaacacccaccaccatgcccagctaattttttgtatttttagtagagacagggtttcaccatgttagccaggatggtcttgatctcctgacctcgtgatctgcccgccttggcctcccaaagtgctgggattacaggtgtgagccaccgtgcccagccttaaaagtccttttaaattagtcttgcaattataattccattatagcaactgtgttggtatcaagaaatcaaaaatcaaatgtatttgtagcaaaatgggcctattgacgtggcagaatttcagaagaaagggaaggcacactctcccctgtcttagcacatcttacttaaagtatacgttttctgtctgcttcctgggacttgaaatttcaaaattacaaccagttccctagggttaagactttttatcttttttaaaatgcagcaacatccctgtgagtaataacacactgggttatcagtaattcattcttactttcgagtaaatttagcagatcctgttctacaagcaggttttaacctgggagaagcgagagatggtaatgacagagggttcaccaagtctgggtaaggtgaaggtggggttgctcaaagaattgcaatttgcttacgggcagccctgtttactgttaccattaatactctcaataggatgttgccatgtaaatgcctatctagtattttgtgcaactgaagcagagatgactttgctgatataaaacgtgtcacggctggaggtgggaagtgtacagcttctaaaacagcactagagggaactgggagcactatcaatcaataactctggcaagtagaaaaggctctaaaagtcgaaggtagaatggatgcctctttcgcaggctaaatacacaaagagaagagctgttggcattggattgttcaccacagtgccatttcagtggccctctgctcatcaggaaagttttccagaaactgtccctggagcttaatttgaaatcagaagaccatttctaagtgactcttccatttattttactgcgattcttcttcttttttggctcaggtctctgaaagagcaagcatcacttccccactctggatttttactttctctggaaaaatatcccactgaagtaggtagtatagtcacagagtcatcgtcttttaaggctgataatgtcatataattatattttgcaaataaaagtaatatgactttttttcatttaggattcatcttaaattgggtgttgttaagagtaaaaattggttacagaaagagttacttagtgttatagccagaaaatggagatgtttaatttgataaacattttctgaactccttttaatgtgcaagccactgcgttaaatgttgtggaaggttcagcagatcttgtgcttcagcagcttaccagcaggagatgtaacctggtgaggtactacccagccctaggagtctactattggggatgtgaatatgttactcatcatttaacatggagttgtaatagcaggggattacactggaaaacattttgtaattttagtagggcactatcaaaactagtttgtttgaattggtttgacttttttcattctgcaatcgtgtttttatgcatgtagacttagctccagccctaatgttttactctagtcacatttctacgttttattctgtgtaaccaaagatgaataagcagagacggaatcagcacagatagtcatgatagaacgaatgacagttctgtaactcaagagaaataggaaaatgtgtaggaacacatatatttgccacttgtaaaataacattttctcatttgatatgccattttgtatatgtctttaggcttttaattattcaactaaacaagaatattttggatgcctactatgtgcaaggcagtgtgcaaggtgctagagaaagaaatagtatgaagcaaaacttctgtccttgaggaatgggcaaccctgatgggaaaggaggacttacacctaaaaagggaagtagtcacacgcagtgttcagagagttgaccacatggtattttatgtccttagctggagtcttagatcatttagtcctatgatagacttttcacagtgacttataacacacttcttctaccacctctgccacctggtactcagcagaattttatttccaaatacatttgaaagaaaaatattatctgactttatatactttcttctttagatggccgagcttttccttttcagtgttctcacctttctaatttttcatgcagtcaagaagtattttcctaatatatttgatcatttccattattttaagttgttatgaaaaatatttgggtaatatcttaaatatatcattctgaagtggaatagctacaggaggttgcaactgtaagaaataagcccaaagcattctccaaggtgacttctgtgctaccttatttaacattaacataaaagttaaaactttactatggtaagaacaattttttttaaatttgttgttaaaaaaaggaaatcaaaacaatctagagaacataagtcaagggttatttaatcttttactaagtcagttgggggtgatttggagagcagttgatagtgctagagtgagcaggaatctagcaaaaaagagctaattgctgtctaatcacgcttgcaatggaatgaatacactagtaagtattacagttaagccaggcataatggttggcttaaatacattctgttatatcagtgttataaccagtatatattcagcctcaggatgggaaagagttgtagttatgtctatagttccccgatttagttttgcttattgaaatccatttaaattaaaattggattcagtcaaagatagtctcattccatcactgtctcttattgtgaagtttgtgtggaactctattagtttgcatttcaagaagtatctttgcttgtatagtaatagaacctaaaaaaagaactgtctgctggcatgtgcccaaacagagctcggtgtttaaaaacaagatgctgtattcttggggtatggaaacttccttcacatgtgggtacagcaatgtctttggacacattttctgtgtaaggggaaaattatcagcatcttgaggagtggcaaaatttctacttggtaccaggatctctaggaccatggatatcagagatacatatccataagcaagtatttcaggttggcttttttttgtggaattttgtccatgcatactcaaagctggctttgcattcttgaatcctcaggctttgtaacacttttggttaaaggtagtaaggtagtcaaattggcctgaaaattctggagaaggtttactaaggctactcgtctggatattttatgaaggagttaaatcgtaatgacagctggataaaaacaaatatttctaatgactactcaaggtatagctgacaactgtttggggaacaaaacaacaagagaaaaaaaatgatctgtttatgccaaaagggccccctgaagtagattttgtcaccattgtgaatgtggagacaaacgtcctctgacttgctgtgtgcaagttcacttgtcctgcgccattacaaatcaggcttgcaaatgtgatgcattagtcccaggacagagagctctgttgcatacaccaaaggcagtggacttccagtgaacttgcaaatattctgactttacacttgtttctgtatgaccgagagttgaccacactgacaggcttgattgcttaaaaacaacatgccaatctattagcaatgcttttatttgtttcattttaaatatttaaggaacttgagaatgaaaggaaataatcttcattctagttagcaaatatatatgtaagagcaatctgatttacaaatgtaccaagtttaataagagtcatcttgttttaaatgatctgaaaagatgagccactgcagaaccatagaatcgaaacctagtttttttgcttagaaggaaagtaagagctagaggaattattccagtgttctgaaaaggagaggacaaaaaaagtctagagtagattagctttttattgactcacattttctcaagcaatagcttctccaaagttcctaactccttcctgaaaaaacagaggactcaagtaaatacatttcttcctatgtttcatatgaaaaaatgtttatcatgattgatgcatgttgtgaattagacttggagggaaaagcagtcatggcaaaatttattttcatgatgcttaatttgatgaatgttactttattgtttattaccaacttgcacttgcaataggaattctacactttaatatggtctgctcctcaagaatgcctagattctagtctaaattgtttcactagctagttgtgtggctttaagcaagctaagttttagctcagggttttcaactataaaatgtggttgtccatgatagactgtctttaagataacttctaagtagaaagattgtggttctaggaatttaggtctaattcaggataaaatgggaatctatgcaagatttttgagtcctaatatgacgaaagtgcatcttttcagtattattaaataattacattgactttgcaatgattctgggcaattagttaaacttcttactggtaagagctggaaggatagtttcttcacaaaagctggacaatttaatccatctttgagtaacagtatcactgcccccttcagtaaagttttctttttaaagacataattttactcttaaagggtaactttacacacccctgctctggatacatctaatgcataaagtaatgtcaacctttatctgggcaagtcctctattcttttagagacaaagccctgacaaggaaataagatccattaggagatattcatgtgacagaaccagagaaaagctctttgtattactacaacaggcaaaggcaactagcagctcaggctgagacatcagatatgtaaatcaggccactgccagattctatcgactgaatcaacccagccgtcatggctgagtcgtgctgacttcccggctcagggattatctgaggacatcttctcaccttctctgcttggcttttgcgctttgtattttatttccatcagtatcatttagagatcttggaaggaggtgaaactcaaatcgaccattttttctccctgacaacttagataaattacttagttgagaggaaaatttgaaatttttgacttaaattgtggtttggattattggtacattttagctattcatctcatttgttttttctatagctactaataattgaaagctgactgcagaaaatagaataaatttataattctcaatacaatagaagctgttgacagagagaaaaatcaaatccccttatgaaacaatttcatatgagcaatgattttatgttctgagaatattaatgataagatatgtgaggacacaatttgagacttttattactaaaagatttctggttatttctgaggaatctcaaacagaagcttgttttgaggtaaaattatactcgattatctctttatgacgtttattagacaatgggaaaaacagaaacaacttataccatggggttaacaaatatttacttgggggcttttgagaagaacttgaactataaggttttggagtatgttttgatcctaaatttattttacctcaaataagcatgtaataaagttttaacatttgttttactttctgatgtttgagtattatatttctacaggggtaatcctattaaaagctttatgcttatttttcagtacttaatttgaaagagaattaagagcatacaaaattacagaaaaatgaggaagcctaggaaaaataagagtggagaaatctagagacaaaaagagagatgggagttcaaaaagataattacaagtttgagaagtggtcagtaataaataaaatgttttattgcacacacatatgtgggtagcagacagagagaagaaataagtatcacaaaagcaaaacggggaaaaaagtgattatgtaaatggatggatgcatctgggaatacaaagctgaataagattgagtccctgctctactggaattacaatttactggagaagtaacaagatggaaataatataggtaaagaataaatcataagatagaaaataaaaaaattccatgaacagatttaaaaaaatagaatgttttgggaatatggggagtgagaaggagacagaaggggaaatcaggaaactaatagaggagagggcactgaagtgagctttgaggcctggcaggattttgatcagggcagatggcttaagaaagtttccctaatagaaagaaatgtgtgggaggaggaacaagtagggtgtgtttagagaagcgtgattcatccatgtcaactgagacttaggggaactggaacaccatagttctaggttagaaaaattttacttcattcagtaagcaagggagaaaatgacaaagccaggaattagtactgtagttttggatgatgattctggaagtggtacttaggaaggagtgagatcagaaggaccagaacctactggtagctgagtgggacttcaagcccacctttgagtgctgcttgagagaattcggagaagataggagatacttcatttttttggtgggagtggggtgggggagagacagggaggataaaatggagcagataatatttttaaaggtgactttgctgcctctggaaggataaaaaaccctattctggttctcattgctattatgttccaataccacttgccttgatattgcagtaatctttgatgttaagggagtggaattaggtatttatgaatatgacctgggacataaggaatgtatatacatttatttgacagctacttatttggtgcccactgtgtgccaagcatgttacacaagagagtaatcataaggaaggtgacactagcctcagtgttaggatggatgggggttggaacagagcttatccttctccctcccatctgttgtggtgagactatggcttacttttactggaggtatcatgtgggtctctctgtatgtcgtcttcccaatgagccagttcaaggattctgacaaccacctttttgatgtttattttgtaacagatgattcaagagagccggtttctcatagaaatggcggacacagtccaggaaaagattgtacagtgtcagaaagcaggtaattgtttttaatttttttttctgttttttttttctattttgtttggaaactataataattcttggtagatttttttttcagaaactttctgcttctcttaaaatgcagttattttatagcaatgcttaactatactttaagttacactttagtctttgtttagtacagatgaaatccaagtgataataggtgggttgtatgtgagcgtacagggttggggtggtgtctgaagaagtctagagggatgagggtttctgaatctagttttgtggtttggaaccccatcaaaaccttctactgctggtattgaagctatggttccatacagtcccttaaaacccacttcaattttacaattggaaccaaaatcctattaatcttccaggcttttgccccattactagtcttcactttagatttagatttgttctttctttttaagtatgggatgagtcacatatctgtgagagtgtacttgtttatttctgttcaccttcatccacacccttgtgctttcatctcctggatccacaaccttctctatccacatacccgataatgattatgacgaggaagatgacaatagtagcaactgcttgatacattgcatatgctataccaagcacacacactatcttactcatgacaactctgcaaagtaatcatcattatatccgatttatagatgaggcatctgagattctgagagactgagtgacttaccctaggtgccatatcaacacgcggtggagctgccctttgaatccagaccaaacttttaaaatggtgcttttcactggctgaccagcaggcttagatatttctgttgacaggaagcacaaaaataataatacctgatacttacatgatgccaggcactgctctgagatctttatatgtactgattgacttaagctttacctctgtcccatgaggtaaacccacttgttaaccacatgtcacccgtgaggaaactgaagaccagagatgtcagggtctttccgagactcacatagctagtaagtggtagagctgggctccacactcatgttctttactatgtgctatgtttgtgatgttagcaccaggaaagttaacgtggtcttaggctgcattaataaaaatataaaaactagaacaaggagaatggtggtagatccctgacctcatgtaggcttctccaagcccattttgagtacagcgttcactcctggaggcaagttcccacagagctcagctccaggaaactgggcaatgcagtggccttgcctggatgccatctttaaagaagagtttcattggcaagctgaatatgtttgaatggttaactgagagaagacttgaagggattttacccaatatctttcttcaaatatctaaaagcttgcactgtagaaaagagtttagacctttttggtctgtgtccagctagcaccaaggagtagaagttccaaggaaggagatttttggcttgatgtcagtcatagctttctgaagatggaatgagctgttcataagagaatatgatttccatctttaaggtgctaagacaaaggctgaagaaatgtgatggtgatggttttcataatcttcaagctcgagcagatggttgagctaaaaatactttaaggtcattcccaaatctgaaatacttgggtgtttcccaaaatgctatttttaaaaaagcctttttatttttagccaacattactgattactcattgttatctatgtgggttccaggacctactattaagcgacagggatggttcataaagaaaaataagacatatgcattcctcacatatggttgccattgacacatcagaccatttcatgcataaaccaggaagaggacaaacaaggtccatgtaacctgttggaataatttgcttcttacttatttacttattaaaattttttttaatttttaatttttgtgggtacataggaggtgtatatatttttggggtacatgagatgttctgatacaagcatgtaatgtgtaacaattatatcatgaaaaatggggtatccatcccctcaagcatttctcttttgtgttacaaacaatccaattatactgttttagttacttttaaatgtacaattaacttattattgattatagtcatcttgttgtgttatcaattactaggtcttattcattcttcctatttttttgtacccatagaatttacttttttccttctcatgtcattttctatggctcctggctgttttaaatacaatttagcctaatgcattgactgttgtcaatttgtgcataaggacagctacttggtgggatgaacagaatgaaaaggataattcaatttagggatttggaaattatgagaagacaggaatgtgaaattatattttactgataatattttcattataagatgcccatttttctgagatatatactcagatttcttatgcattctttcttcaaagggatggagttccatgaagaacttcataatttgggggcaaaagaaggcttgaagggaagaaaactcaacaaagcaactgagagctttgcttggaacattacagtattgaaggtagatgaaacactcagatgtcccctgtgcctttacttttcttctcctcatctctccaatgtgtagagaaatgtaaaggattaaatatgatggtttggatttttaaaccttcactttagattcagggttacatgtgcaggtttgttatataggtaaactgtgtgtcgcggggggctggagtgcagattattttgtcacccaagtaataagcacctagtatgcaataggtagttttttgaccctctctctcctcccaccctccatcctcatgtagtccctggtgtctgctgttcctctctttgtgtccatgtggtctcattgtttagttcccacttataagtgagaatatatagtatttggttttctgtttctgcattagtttgcttaggataaagccctccagctccatccatgttgctgcaaaggacatgatcttattcttttttatggctgtgtagtattctgtggtgtatatgtaccacattatctttatccagtccactattgacggacatgtaggttgattccatgctttgctattgtgaatagtgctgtgacaaacagacatgtccatgtgtctttatggtagaaggaattatattcctttgtgtatatacccactaatgggattgctggggtcaaatggtaattctgttttaagttctttgagaaattgtcacactgctttccacatggctgaatgaatttacattcccaccagcattgtataaacattcgcttttctccacaaccttgccagcatgtgttattttctgacttttagctattctgactgtgagatggtatctcactgtggttttgatttggatttctctaaggattagtgatgttgaacacctttttatatgcttgttggccgcgtatatgtcttcttttgaaaagtgtctgttcacgtcctttgcctgctttctaatggggtgtttatttttttgcttgttaagttccttataaattctgaatgttagacctttgttggatgcatagtttgcaaatatcttctcccattctgtaggttgtctgtttgctgtcttgatagtttcttttgctgtgcagaagttctttaattagatcccactgtcaatttttgtttttattgtaattgcttttggtgtctttgtcatgaaatctttattaggtcctatgtccagaatggtatttcctaggttaacttccagagattttatagttttaggttttacatttaagtctttaatccatgttgagtgatttttgtatatggtacaaggaagaggtccaatttcaatcttctgcacatgactagctagttattccagcaccacttattgaatagggagtcctttctctattgcttgttgttgttgactttattgaagctgagatggttgtaggtgtgcagcattatttctgagctctctattctgttccattggtctatatgtctgtttttgtaccaatgccatgctgttttgattactgtagccttgtagtatcgtttgaagttgggtcaagtgatggcttcaggaatgtgtggcttgatctctaggttcatactctaggagatggggagctgcatactggaattaacatggtttttgccttaataaggcaatgaggttttcggtgcaggcagggtacagcccatgtgtgagattaatttgcctggtgtgtgtgtgtgtgtgtgtgtgtgtgtgtgtgtgtgtttactcacatgaatacttacgttcaagtcaatatggctgttcttgtttgtggaaagaataatgacaaatgcttctggggaagattccaacacaaatgattttgaagagacaaagtacaaaatatctagggccattgaggatttttattttaagaacagttcctataaatacatttctttttgcaaataactttggaagtcattttcttgagattatgatttgctctctgctgcacatgaattttagaattttgaagtaaatatgccactttttatattttcttacatgaaaaaagaaatgatttaggcagacaatatattcttgacagctaaatgggagaaaaatagctacaaacaaaattaataattgctgacatttaaagaacactcattttgtgctaggtactgttttatgaggtttatatgaattaacaatttaatactcacaccaactcagtatcgttattaatctcattttacaggtgagaaaacggaggcattggaagtctgtgtatatttcctgagggcgctcagctagtaaatggtgtaactaaattttaagctcaggcagtctggctccagaccctgtgtctttaacctgtgctgcagagatgctgcacatgtttatgtgaaagtgttaggttagctgtaagacatattacaaatgtctattaaaaattcagtccacaagtgataagcccctactatgcattgggctctgtgctaggcactgggaatacgtggagaacatgagatacagaccctgacctcatgaagttagcagtctgagtccagtggaggagggggatggataaggcatcatttgcttaaggagcagggatgacctagagctgtagtgttaaagaggtgcttattataaccctagattataatgtggcagtgtgtaccctgatataaacattttatgttcagaagattttatatgggcttgttaatgtgcctgtcacagaaaggtgctagggatacaaatatcaggaggattacctgggtctccaagactagtctataaggagagacagacatgtaactaataatggccatcaattgttcagcacttattttgtgatcagcactcaaggctaggtactttatgtacatttcccctttcttccttgccacaacagtgcaatcttgcaacatgacatgctgactctgataggactctctccatctcacaaatgaggaaattgaggcttgtgggggttgaaatttcttgcctggagtcacacagctagtaaacagccagcctgcaatttttaactcacgcccatggttctatccactacactgttctgcctcctctaaaactccatccatgtggctgagtccctgtattagtcttttctcacgctgctaataaagacgtacccgagagtgggtaattaatttataagagaaagaggtttaattgtctcacaattcagcatggctgggagggccacaggaaacttacagtcatggtgcaagaggaagcaaacatgtcctttttcatatggcagcagcaaggagaagtgctgagcaaaaggtggaaaagccctttataaaaccatcagatcttgtgagaactcactcactattatgaaaacagcatgaggataacctcccttatgatttgattacctcccaccaggtccctcctacaacacgtggggattgtgggaacaacaattcaagatgacatttgggtccaaaccatatcagtcccattgggtccaggcagcctagtgcaggaataagaatgcaggccctgtgtgattacctgatagtggtgagactagccaagttatataatctccctcagggtagtaataatacctacatctcagattttgtgagaattaaatgagataatacatacaaaagatgtaagtcacagtgcacaaaactagacagcatatatgttagctgttatttgtttgtttgccaggtgaggataaacatggagaaatgaggtttttgttatttttatttctttgttaacttctgacttaagcccacttagtgttgtcagagatttcttaatgtttttgtttggtttagtaacagaagctgattgttagatgtgattgagcaaatgctgttcaaattattccaagagagagcttttcagacagaattgattttctattattataactcacatactagctgctggtatttcagcttgagcactagagtagtggactactactaaacaagagtagagaacatttccacacttccaatagctcctttttctcctccattgagtttggggcctgttaatctggtgtcctttccccaagagctggacaaatgacctcctttgaatttgaattattagctgagagaaaaagagcctgggctctgttggagactttttattccagtggtgctgctctaagaagatatctttttctatacgattcttcctttagttcttatgcattagatctgaaacacttgattcccaattaattctccagacttgctattgattttcagagctcctctaagtattttaataaatgctctttgtttataagtttagtagattcaatttaccttgcttccagttggttgaatgattaataaccatcctggaaagacataatcactgaattaggaggctgtggtacaattctgcgttgcctactgaaaaagtttccttatacatgatttagactagtattccctactatctagagagagggagtgggaattaaccaattctggttaaatgtgttggtttgtatttctaaaaatatttaattccagtgtaatttccaataagtaaggaaggagctggaaaaaaatgagaaatgtgccctcagcaagttgggggattgacagcatggagtggtgcaaaggggcattggctttagagtaaattgagctgagactgaaaaataaattgtttagtgttttctgcagttcaatattacatttatctgatattaaaagctggagaaaaaaattgcagaaagaaaaatgactaacgacaatataatgaataagaattataattacagtgtccaaattgttgcagagaccaggacttagtatttagcaaggaaactgaaatcaaggtgcttctggaagatcccacacttgtgtttttctttaattcatattctagcacctacgtgggtccagtatagggacttgtttagcgtatcttttgcatttttccatacttttgccatatgtctatatccaactgtagcagtcaatttgctcttcctttctttctttttcactattgtacatgaaattggtctccttacatagccattgtgtttatttaggatgataggatgattcagtcctcactaccttttcaagacaatcactggatcaaaataactccattccattccaccctcacatgttaaaagacctttccctctgtttcttctccatgatgtccttcttgtgctgatataataaaatacctgagactgggtaatttataaacaacagaaatttatttctcacagttcttggggctgagaaatccaagatcaaggcaggagtggatttagtgtctggtgagagcacagtctcttcttccaagatggtgacttcttgcttcgtctttcagaggggaggaacggtgtctcctcaaatggctgaagggaaagaaaggcaaaagaaggtaaaagggcctagctagttccctccagcccttttacagggcactaatcacctcctaaaggccttacctcttgatattattgcattggggattaagttccaacatgaattttggaagggacacaaacattcaaactatagacatttggttgttaacataatattaaaatctcaaaatggaaatttttcctgttttttaaggctttcagaaagggatactacaacttcacttacgtagccaacatattctagtacattgttagtaattttggaagtgtttcactcatgagagttctgaagatctcttgggagcaagatgtggaattacactatatcactgataaaatgctatttgcaatgaagtggaattcatctaaagtcttgaactctatccagagtgatttgactttttaagtacaaaaagaactgcattgtaaaggtgatcacatctataaaactgaaattagaaagaacccaaggggagcattttagtgagctttcccaatatatatttttctaacttgtcctgttggctattttaagaaactaaattttattactttgtgtttttaaaagttttatgtaaaaatcaattttagcaggctggagaagtatcaagtagagatatataaaaataatattaaagaaatataattaataaatattttattacaaaggaaaaactatgaagtaggtaatcactagagcttaaagagaaataaaagggttaagaagtagctgcccttcttatttattcatgactttcattgattacttgttgaataacaggcaataaataaaaaatgaatataactattacctcttcaatggtcattcctattaaatatgtatttacacttttcctggatagatttccaacttataatttaatgcattccaatgtgtgccatgattctgggctgcttttataaatttatgtttagtatatgtgactattacttttccccataacgcttttgctttttatcactacttaagcctttgctccttctgcttttatctaaaacattttcaatttccgtgggaagagcagagattgaagcttctcacttctccgtgtgtagttatgtttctaacccaggcagattccctcactgaattcccgaatttcaggaccttacagttctggggaatcttgctacaacagaggaaattacatggatgtcagtgtagaaatacgctttcaattagagcctgaaaacacatttgaagtctctgttcattgttgagagacaaaagaaaggaaacagatgatgggctaatgggaaaagaagtatgaggagaggcatccatctctgaaagctgagtgagagtgagaagtgggctacccttcacttactggccatagatatttaaaatcattctatgagatactgtggagagggggctgttagtgtgaatgttcaaaccaggctcttccaacagacatagtgaccatgcctttgggggctgcctgagggtatataaagaaggaacatgcccagtatcatccacattgtctattgagaacttttccagtggtgtctctggcatctgccagctgttgttgctgtagaatctagagaaaggctaggattccttttgagtattcagaaaaaaaagtatatttacaaagtgtagaaacagacctccaaacaacaacaataatgcattaataataaaccatccttaatattgatattattatactatcaattattgagaaacagcaggcaaagtgattaagtgtacagacgctgcagccagacacttcctagctctgtgtctttgggaaaattttgttttgtctctatgctcttgtatcagttggggtatgctgggttgtgctatagtaacaaaaatctgaaaatctactacaatataacacaatggcttatttcttgcttgtactacatgtccatcacaggtaagtaatggtcactcaggaacacaggctaatggggactccatcccagcaaatacttctacaatcccagaggtagggatgcaaaaatggtctttaaaagcttctgcccagtagagtcacatgtcccttccactcacatttgactggtcaaagcaagccacagtcaagtctgatttcatggagtaggacaaatgtaaaccttctcagggaagaggagcagatattggtaaatacaatctaccagtgacaagttcttcaactaccccttataatgtggactaaatgagtaaatatatataaagcagtatctggcacatgctatatgagtgtttgttatttttattattaaaaatgaacattcagtgcttacaataatcaagtgatttttacacaacattttaattacttttaaggataaccctgtaaatttactcttattatacccattttacagataggggaaatgaggctcaggaggttaagaaccttcccattggcatacaggaagtgagtgatggagcaaggatttaactctaaaggccatgttgtcatcccactatgctatattgtcaaaatactgacagcaccataatagtaatggtttgtattaactgagcactttctatgtatcaagtatcctaccaagtgttttatatttattattttacttatctaagggagtgagtgtcctgcccatctagcatgaatatttcaatcaccttgacagaatatgcctactgtcagtagtcagtggttagtgcagaaagctacagcgagagagtgtatcttgagaataatttatttacaacactatatttacaaaacaactctcttttctcaatctggtttcccaggtacacttttctagtggaaaatagaatgaattgaccaagtggtataactagttccatctgcccagtagtcacatttctctttgtaagtaaatcagttaacttccttttttatttgtccatctcctatgagcttggttagcatgaatcagcttcccagggcctgatcacccctgagcgaatggatacagttgagtccttggacaggtacgattgggaatcacggaagcaaagcaaaacaacaacaacaataccaaagcagaagaccagacccaggacccctgagagcccagccagcctcctcttgtttctcttggacagctttgctattcattggcttttagtctggacattgctagctgccatttcttgatgggacagaggaagttcaagagccatgcctctagcaaaaactttacaaaggctatactcctttcatattccttcctcatgccccctcctccacagccacagttctactgttcagacctacaatctgtcctttatcaactgaggagttacagcagaatctattctgtgtctcctctaggcaacatttacttcttcaattttcattttgttgtaaagtttatttcaatttttttgtctattaaacgtttaaaaataatgttggaattttggcaaacagttacggttaacagtcatgccagaaacatttggtgaacgcaactgggaggggcaaaatagggatgaagccaaaattgagggtcttattccagtggcagccagtttagtctcgctcaacctagtaagccctcaactcacttggaatcttagccagctgctttacaatggatatcattgattaccaggaagaaggtgggtggcagaagggagagaatggatggatcacttctagaaaaacagcttgaatctcatatgtcagtaccattatttttatacacaaaagaaaatattattaagccttataaagtgtagagtatacatttagaaggcatagcatctatctgggggttataaactaagtttgatatatttatccgtggacgaggtatctgaaaagatactcctagacacatttgtagaatcttgttattgtttggctaattagtgcaaaataaagacccttctctcccacctcaagaaggtgatgttatttccacactgacatttataaataaggaagtgcaatgcataaatgaggcttctaatccataaattagcaaacaataatttaacaaatttttatttcattttatttttggtgaaaccaaatttattaattcaacaaatgtatctgttacgtctttactaggtgacaggctttgtgcttgggaatgtactggtgaataaaaatgtggccttctggtctcagagctgacagtctagtgggggaagctgtcatttaacaagcacatgatgtgtgttaaatttgtccttatgatgggtgccttaaaaaagtgcatgacactatgagagtgtgcaatgggatttgacctaatgggagaggccagggaagtattccacgaggaaataccagtacagtggtgagtaaatattccagcctttcatggattccaaaaccctgccttgtatcttgatacttgagtgtggttgccaaaacaatttgaaaataatggtgaaaagaaaacacatcaaaataaagatgtgccggacctcttcaacatggtctggggagttctaaaatttctgccttgctcatttaattaccactcattagcattatggctaatttgttattatatcaaatctggccatattaattacaaattaatttaatcatccaccttctaaaatataatctgcagcgaagttttataaccatgtgtatccataaaattcatttaatagcttatagttacagaggaggatgttataaggttggtttctgagaaatttctacaatttaaagctgaaaagatgcagagagagagagagagttatataatatagaatattagtattagtgttagatatatgggtaaattttttgaagtataattgatgcatctataatttaaaaaaagccacaagtttaaaacattatttcaaacagctcttatccaacaatataggacagtttaaatagaatgttaatgcttcttagcaataggcagactggttacatggtgtccagatttctgccttgggtggctgcatcccagctgtgctgcccaggagtttagtagagataaaagccgggctgttgacatgattatggaagcacacaccactttatctccagtagaactaaatttagcatctcttggaggtacacttttttttttcagatgaaagctgcattttataatgaatctgaataattcaaaagtggcaggatcctaatgaatagatgcatcatagaccagaggacttggctccaacttgtgaagttattgaaggtcttacttttctttcaggaaaattttccttagagaaaatttgtttcttacacacagagttttagcctaaggtgagttgtagcttaagtgagtttgatgtcttaactctgcattaagtatttcttacagtgatataagtggaaagaaaacattgataaccaaattgtttcattctggttccttacagcccttgtaggttttatactcacaagctccttttctgatattgttactcaaggaagacaaaaatgggctacatctatctaatttccttattgttaatccaaatcagagcaaaatgagttcacttctctgaatgtgtgtgtgtgtgtgcatatatatatctatatatacatatacatatatacacacatatatggtatgcacacagacattgtcaaataaagtcaaatctgaatttagatagagaatctgttcaaaagaattatcacaataaggagaggggactactgtgataggggaactattgtaatggggagaatgctcctaccttaagatctgtaagcatttgaaaggccaggcagaaaggatttttcttttatagggaagggcacagaaggtcagaaagaagcacatatgagggagtgggtagcgtgatcccacagttgatcctacagtgaggaaacatctttcctgtggtcagtcctttcttggtaagaggcgattaaggagaggctgtgtgctgtctcaggatgagagtgggtcaaagttccagggcctaaggggaagagagaagcctaattaaagtttggccaagtccaggtagtaggtatcaatattttctccagattggttagtggacacaaacagacaaacagttcagctagtcatttatgaggcaagaaagggaatttgaaaggtctgtgtctggccatgtcacagataaacaagggagattccatgagtcttagccaagtcctatggggaagaggggttctttgcagtaagtaaggtcttttgaggaacacaaaaggatgaggggatttcttaaccatccctgatttcctggaacacagggctcagataaagttgagcattgtcaacatatgcatttatatattgtattatgctgctaataaagatatacctgagactggttactttataaaagaaagaggtttaatggactcacagttccacatggctggggtagcctcacaatcatggcagaagacggaagaagagcaaaggaatgtgttacatggtggcaggcaagagagcttgtgcagtggaactccatttataaaaccatcaggtctcgtgagacttattcactaccactagaacagtatgggggaaaccacccccatgattcaattatttctgtttggccccgcccttgacacgtggggattattacaattcaaggtgagatttgagcgaggacacagccaagccatatctcatatataaaaaatttttatgaaatataaaattattaaatatataaaatatatacatataatatataaaaatatacttattaaatatataaaaatagatacatataaatatataaatatacatgtatatataaaatgttatgtgtgtatatatgtatatgtgtacatacaaatatgtaaatgtaaaaatctaaagaataatttaggttaagcataatgaaattagatgctacttttttaaagtcatattgaaaagatcgtgattatggagcagcaaaaaagttaccctggagtcataagtggttattttccagtttaattaaacatttcttatttcaagtagatacaatgtgctcaaagatacatcaaatatgagattacatactcatagtaataggccaggaggataaatctttttttctccttatttcccactttttgtaaaatgattttgtactattaattactctccatacattattgatacttttagtatttgtggtaagtgaagatacctatctatgaatgcaggataattaataactgaattttccctttaaggaaaaactcatggccttatgagattaattatagattctttgaaaaacgtatgcccttggagttttaaaaatatgcttaaattcataaaaatttacacataactcttcagataactacttgaataagacaagaaatacggatcattataataattttattaatgctttgaaaaaaggtaacttccagaaagaaaagactctcacagaaccatgacttagaattaagtattagacttttgcatcattgcataatattatggaaaggttaacaagtcgttatgtagaagctccagggtttcagagacaaagaagagaatccttccctatgcagtgaaatacactaacccctcatgatgggatttgtaaatctgccaggacgaagctatgtgttctaaaaatagctaaagtctttgagtgtttatttaaaagataactattctcaatggatttttgagtcagttatactgagggatggaaagttcttaaattgctttacaatgtattccagggaaaaaatattgcaattcaaatctctcagagggattccttaatcaactagaatattctggatctcccagttgtcagctactcagcagctggccttatgaaaaaaactagaataaaactggttcatgaatgtgttgcctgggaattttccttttcttgggtcaaaaaacattcctgatcaattacaaataaatctagtctcagaaagttgagctccttttcttaagcatgtgttaagagacatatttttcatatacatttaaaatatactggatgccctgaaaatatgacttgggtttcagcaacaaattctgatttccttgggtcagaaatatgggtctctatcagtcattttctgttttttttttctttttttttttcagattcaattgggcttcacttttttgtaagcaaagatatatagaaagggaaggttgaatgtgttagaattactcatgttctctggtggtacattattgtaacagaagtttattcctccaaactgcttggatgggcacaatttgaacatatgctgaaacagtcctatagacacttgagagttccatacagtttatttgctggtgaaatcatggatggttacacaccgcttcctcattcccttaccttccagatggctctccacacttaccacacatgttgcaggaaacaggttcttgtttatcgtgggtttgctatcaaccaagaaactgatatctaagactgctaaaaaacaaagctagcgtataaagtcttgtataggaaaagtatgttttagaggtaactatgtcctagtattaaatctgagtaggtgagactgaagcttcttaacaatgtatattgtgtatcctctgagtcagcccatagagtctttacatgtactctgaaactagagagggaaaaagccagcaacttccttcctgttctcctttatcaatagtacattttagcctgggagaggaagaataccatcaaaaggaacaattatatgtatgcatagtgtgtgcttgtatatgtgttatatcataggctcgtttcttatattaaacaactcacttattaaaccctgcttattgtaagctctgtaataatacatgtagatatgataataacaataatagaggaatgaaattttccttggaggctttggttaactaaatgtattctcagctgttcttatgaaaaacataaaaatgtgtaagcaatataataattacaaatgccatcaagatggaaattacaattttaaattctgaaaaatatagtctttgctactgaatcacagttttatcaaccatactaaatcattcggtcatcctctacttaataaccaccaccttaaaaattgctgggttcatctcaggaagcataattttgttctagagattcttctctggtcagaaagagagagagggagaggagagagagaaaggagcaaataataaagtgactactactgtccttcctctttaaataacagctcctgggaaggtcagatcctttggctgttttgtcaaagatactcaggaaaagttttcatagagatctctgaactacaggagacttgaaaattaattacatgaaactttatgaattttcattgaagttaaacatcagcacaaccagtattattttcctggagcttttgattagacatttctataccagtttgtctgtcatttcttttttgcagcataaggtttaacagtctaatccctgaattggccagagctgctgcatactcctatgtcaattgtgcactgcacaaccgtagggggtgccattcccactgaatgcatgtgagtagtgtcctctggatttgtcatgtagttaccatgaagttgtcagtctaagcatttttctgtctctaaccttttgttctccatgaagttttgagtgcctttaactattattacattaattataattattgtctaatgtagtgattttccctactaaggtttacatttaggataaatcttcagtcatttcaaaaggattcatatacagtagtgtgtcttcatgtgaaactattgttatttgtgtattgaagcacagtagagaagcccaagaatccagagtattacatacatcagatgaggaaaatgtcaattgtaactcagctagatcttaactttgattggttttgacaaccaaacatagttgattcagtttgtaacttgacaacagaaactgtaggcatttggaaaataatatcaagtcctcttttcaaatctaatacatccttcttgtgtaagaaaatttaattaaattcatttaatcttctgaaaaaaatgctctaaattcatttaagagagttaaaaataaataaatcttttaaaaagcctaagacttgagtgagagaaatgatttgatgttagtctgttagcttcaagaaaaaatgccaagttcttgacctggatagaaggtcctctgtgatgggggctttgcttacctccgtgtcttcacattttatattctccaggccctcagttctgtttcttggaaatatcaggcagttttgggattccatgccttcgcactgctgttcctgccaactgtgatgttctttccctcctcagtcacccaccagctcctcttcatcactcacatccagcactagtgttatccattgcctttccagggaagccttccctgctcttgtccctccatacccctcaccctccaattctcatcaaaaccaaattatctcctgtatagtgccagatctgtagcttatacacaattttattcccatgctcaccaccctgactcactaaatgttaatgatgtgtccctatgtctttttctcatacaaaatcctgctccttcagggtggggactgtgttttagtacagtgctgagatttaggagaaagcagaggattacagaagctctgcaagttgttcaagatgatgcgactaactagtaagccgtggggatggatgcacaccttgatctatgtgacaccaaaacctgtccttaatatccacagtcatgatgtccaaggtcactgtagatgcctgtgtaccaaagcttgttcttcatattgggcgttgtgtccaacgtcaccattggatgcctatgtgtcatttgggaagatgggcgtttctgcagttcttggcagctccgttttctcatggggttgaaattttgtcctgtttttcttacttcaacctctggggagtttcatttttcctggtctactcttaaaaaaaataatttttgtgggtacataggtgtatatatttgtggggtacataagatgttttggtacagacatgcaatgcataataatcacatcatggaaaattggttatccatcccctcaaggatctatcctttgtgttttaaataaaccaattatactcttttagttatttttaaatatacaattaaattattattgactatagtcactctgttgtgctatcaaatgcttggtcttattcattctaacttctttttgtacccattaaccatcctcatctcccctcattccccactacccttcccagcctctagtaaccatccttctactctctatgtccatgagttcaattattttaatttttagctcccacaaataacttagaacatgtaaagtttgtttttctgtgcctggcttatttaagttaacacaatgacctccagttccatccatgttgttgcaaatgacaggatctcaatcttttttatggctgaatagtactccatatgtactatcacattttctttatccattcatctgctgatggacacttaggttgcttccaaatcttggctattatgaatagtgctgcaataaacctgagagtgcaggtaactctttgatatactgatttcctttcttttgaatatatacccagaagtgggattgctggattgtatggtagctctattttcagttttttgaggaagctccaaattgttctccatagtggctgtactaatttacattcctgccaacagtgtatgagggttcccttttctccatatcttcgccagcattttttattgcctgtcttttggatataagtcattttaactggggtgagatgatatctcattgtagttttgttttgcatttctctgatgatcagtgttgttgaatacctttccatatgcctgtttgccatttgtcttcttttgagaaatgtcttttcagatcttttgcccagtttttaatcagattattagagtttttcctacagaattgtttgagctccttatgtattccgattattaatcccttgtcagataggtagtttgcaaatattttcttccattctatagtttgtctcttcacttttgggttgttgcctttgctgtgcagaaactttttaacttgatgtgatttcagttgtccagttttgctttggtttcttgtgcttgtggggtattacttaagacacatttccccagacaaatgttctggagagtttccccaatgttttcttgtagtagtttcatagtttgagggcttatatttaattcattttgatttgatttttgtaaatggtgagagatagggatctagtttcattcttttgaatatggacatccagttttcccagcaccattattgaagagactgtctcttccccattgtatgttcgtggcacctttgtcgaaaatgagtttactgtaggtgtgtagatttgtttctgggttctctattctgttccattggtcgatatgtctgtttttatgccagcaccatccagttttggttattacagctctgtcttataatttgaagaacctggcctactcttttactcagtttcatcttttcctaccagagtattccatcttttcagaatacaggcaggctcccatatgcactggactggcaatttgcttttggctttttctctcaataggaccagtgcccatctttatttttctcctccttctggtggccatcttttgactatcaggcaactggtgactgttctcagggttatttgatataattgcacaggtttctagatcagtgcttcagctccttcaagccatttccctcaattcatgctgtgtacaggcatccatatacatatgtacacagatatcctgagtatacattatatacaatttttagtggccctattctacattctactcttctagtgcccatgtttgattttttgttgttactctagaagaagcacacaaaatgtgctcaagatgtgaactgaattatatgaatttaaatctgtgaaaatattaacaattatcccagtgcaagaagacattggtcactattgcctttggttgctcataagaggataaaaaaaaagacactttaactccctttaggtttattgtctttttctagcatggttcagatattaacaatcaaagtgactgaactttagattttttatatgatcttttcttaaaatctgggtaacttttatctttgagtttcttccttcctttgtgaatcatcaccatcttcatcactgccaatctttaagtatttaccaagaactcatcatatatctagtgccataaatatatgaaaatgcttttagaaaatgctctcctccccggtattcacttatgctccaaattggcaaaccctttggtctcagttacacttttggaataatcctctcatcttgagatcatcattatttctattcaataaactagagaattattgtaaaacaaattgggtataccagaaagaagtgggacattttagagaaaatcagaatattcaccataaagctggaattaagcatatgactgattggaactgaatttgttccagttttaaaatatatttttaaaatgtaaaatacacttaacaacaaataatcacttatagttataaaatatgtattctctctagacagtgttctaagtgttttgtacttattaaatcagtaaattctaatagcaattatgtgatatatgtacacactattatgatatccattttctacaggagaaaaccaagggacagaaaggttagctaatagctaatgagtggcagtgccatgattgaaacccaggcagtgtggacccgcagtccttgtccacagtctgacaagactgccccacctggtccatagctgtttcatatacaatgaatgaaaaagctcaataacaatggtaaatccacacttcataataacaattaaactcctgaacttgtaaatatataaaagcagagagatagatgctcatcttcagtggggagggaagggtttgttattcatgttacaataggcaaactatccctcaattttaaatacagaggattctagtgtggttggctgtagataacaagtccacttgcaacagagattggaacattaggaggggttgactgttatggacttgatggtgtccccttcacaaatttctatgttgaaatcctaaacccccagtatctcaggatatggctgtatttggagatagggcctttaaagaggtaactaaattaaaatgaggtaattggtggggcgggggataatccaatatgatgggtgtcattataagaagacaaaatttagacttagacaggtacagaaggaagaccatgtgaagacatagggaaaagatggccatctatataagccaagcagtgaggtctcagaagaaaccaaccctgccaacaccttgatatgggacttttagcttctagaattgtcagaaataaatttctgttgcttaagctacagagcaaacctcgctccgtaacctgttaggaaccagaccatgcagcaatgagcattgctgcctgagccccgcctcctgtcagatcagcagcagcattagattctcataggaatgggaaaccaattgtgaactgtgcatgtgaggaatctaggttgtttgctccttatgagaacctaactaatgcctgaggatctgaggtggaacagtttcatcctgaaactatgcacccctctccagccccccagtccatggaaaaattgtattccatgaaaccagtacctggtgccaaaaaggttggggaccctggcttaagccaccctgtctgtggtgctttgtcatggcagccctagcagactaatacagggacctaggaggagaaagctaacgtttgagtttcctagtgcaaaactcatcaggacacaaacttaaaactccacaattttctcttgatctttggcagaaaaatgtaatttaattaggatgcatttttatgtaaagtggggtgcccttggccacatgacttgttctttatgtgggcagataggacagtctccttaaccagcgtgattagaatttcactagcttatcgctcaacaaatacacacattgttactccactggcttctgcctttcccagatatacctgtcataatataatgtaattaaaataattataattgtctgaccttgaaattactaattagcatgatggtcagtcctttgataattttctccagaaaagtcttgttaaaatgggcctgcataaaaagctgggggcaatgaactagttataaaaggataggctaatttttggttaagttgactattccttgccagaattaagaagttggaagatgaggtttcttgggggtggttagtcatagtcctgggaaattgggacctaggctgaggggagtaggaattcagtggcactcaattaattttttcattcaaaaaacacaaacaaagcctttgattcaacaaacacaaacaaaatcttgctttggccgggccctgtgctaactcctgggatgcctctatgaacatgatagaagcagctactgcattcagagtttatgttcttatgggagatacagatgttacaaagtacaagccataattagttattttggcttgtactttgtagagaatgaaaaataattttatttaattcattatcttgctgaaggttggcactttttagcccgtgctgtccaatgcagaaagcactagccataggtgtgctattttaagtaatacaaaataattacaattgaataaaattagatattccattcctcaggggcattcgtcacatttcaagtgctcagtagccacatgtggctagtgactaccataatggacaacagagatacagaatgtttctgcactgctgaaagtttcaccagagaatgctatctgggctctagagttgtgccagacctgcaaagtcaagaaagagggcccttagcttaattccttagagaacagaagatatatatatttatatctaccaaaatagtccacttttggctgcaggccatagtataaatctcatcttagtctggccttcaaaatgaagaatgggctggttttaaaccaaggacagatttcctttcctcttagtcttatgagtattggggttttgcattttgtgagtgctcatttttgtatgtatgagcaatttgtccataggaactaggggatttttatattttttccttttatttaaaatatatgactacataaaataaacaacatgtggtttacagatatgaggagtattggaatctgttactttaaaatagtatagcaatgtttggacttttcacagctgaaagaattaaattcagcttcagtaccaccaattcccattttttttcaagtacaagagaaaaaagaagaaaagaatatgtgggtggagaataaggaaatcagctgtgttggtttaatacccttgaaggtgacattagtagaagactttattaaaacatgcaacctgaagctgaggattataaaatataatatgtcatggtgggagatatgctttggctgccacacctaaaggtcactctttgaagggagctgagacagctgccaggatccattgatttctttctagtactaaaacatcctctggcaggtgtcagcctgggtgtgtgaacaaaaaaatatggaaaattaaagagtaagcaaaaatgggccatgggatcctcctagtagaccgagcagaatgctccagtgtttgttctgaacagacgtgtaaatttttgctttagcgacacaacagatacatgaagtgttcaaatattagtcaacatatattttctttagtggaatatagcttctcaagtctctaggataacaaagttttaaaatcctgtctaggtgtatataattctttaatttgtttctagtggggctactccctcaggttaagtaggacactttccctacaatagatttcatttttctttgattagtttccacttactccttctgctcctaacatggccatccctctgcagttctccaaatatcccatgtgtgtgcttgcctctatgtctctgcatacaccatttctcttctgtgcttaccccccaactcctctacaatctagaagactcagccttgagatctttttgaacaagaattgcatttatgatgataaatctgtgcctgtcctacaaaaaaagcccttgtctccttctgaggtgattttgcttagtggctaatcttttcaactttttgtctttaggttttgcagaaaatgagaaaagatggaaagagtgagaggtcacatgatttgctgcctgggctgtggggaccacccaggggctgtgtggagggaaccatccctacgttagcgctgagctcataaccatgacgtcaacctagattccaaatctaggtgctcacattcatttcacaccattagcaagttaaaaatgatagagccaggccaagcgcggtggctcattcctgtaatcccagcactttgggaggttgaagtgggcagatcccttgagctcaggagttccagtccagcctgggtaacctggtgagaccccagctctacaaaaaatacaaaaattagctgggcatggtggcacatatctatagtctcagcttcttgggaggctgaggagagagtcgcttgagtcttggagggtgaggctgcagtgagacatgattgcacctctgcacatcggcctgtgtgacagagtgagaccctgtctcaaacaacaacaacaagatagagccatttactaagcagattggcaggtgagggacgctggttttagctagtacagtgaatgagtgtgtgagtgtgtgtgtgtgtgtgtgtggggggtggtgtattcttagtcccttttacactgacagttgaaaaactgacctttgcccttctctctcccatgttatttctgatgttagtaggcagtttgtagcacagcaggatggaagagttgcaaagggaattgtctatggggtgaaccttttcaattgcccttccatccacataccctctttactgtgaataatcataaatgcataatgataacattttccacatgctaaatcatgctaatgacccctaccaagtagaggaaagaatgttgtcttataataccaacagattatttaaacctgagagctttacatcatgttagattaagttgtgtatattaaaattttccaaacagtaagtataaagatactgtcttatacatataagaggtatggctattttaacatattttttaaattatatgaaataaactttattggacatagttttacgttaccattttttctctctttcaccaaattgtgaaagcaaatagctagatatgctttctccctttgaagaggcatgacagtttcaggttttgctaagaaagatagtttccatctgaaaatgtgtgtacatagtgtttacttctaatttaaatgcctatttacacaggttggggatacaccaatgttttttgatgatgtggtaagttttcaaaatctatttgaggtcatttttatatgcttagaatgacttaggtgcaaatctacatggaagcagaggaataaaccacatggttttagaagccatttctgatcattggagcacaagctttttgtggacagcaggcactccctacctaagtccaaagcaggggagccacctgctggacagtgtgaaaaatcttcattttctggaggtagtcatccctgcttttttacttttaagtttaggtagatttacttacatataaatttatgtactttttattttgctgagtaaatttctcacttcacacaaataaagcggctctaaaataaggagaaaaaaattaggatgctatgaaacacaaatttgaacaacgatcagtactagaagtagaggcttttagtcattccattttgtattttgtctttttcctttcattcgtagttcagcctaactgcatttatattgtaaaccaaaaataaaattctaagccccttaaccgactgaatggacctgtcctatggggacaaggggattccaaaaaattccaaaaagctagttcaggccatgatgggaacctgatggtgtaaccacccagttgggttcacctttcatgctacctagaaagagctgattcatctagacaggggaatcgcaatagagaaagaataattcgcacagagccagctgtgcgggaatctggagttttattattgctccaatctgtctccccaggatcagagtttttaaagacaatttgtgggaggggaggggcagtgagtcagggactgctgattggctgggtcggagatgaaattatggagaggaaatcatggggcgttactgtcttcttgcgcttagtccgttcctgggtgggcatcacaggatcagatgggccaatttcttgatatggtggtgccagttgatccgtcaagtgcagggtctgcaaaacttctcaagtactgatcttaggagcagtttagggagggtcagaatcttgtagcctccagctgcatgactcctaaaccataatttctaatcttgtggctactgttagtagtcaagaaggaggtttattttaggaaagggatgttattgttcttgttttaaaccataaactataagttcttcccaaagttagttcagcctatgcccagcttggaggttagaggcaagatggagtcatttaagttggatctctttcactgtctcagtcataattttgcaaaggcagtttcaatggtaaaagggaattggatacgctgcattatactttcctccctttggaattcaggctgaactgatcggccttaaaattaaaacagagatcttaagacacagtaggctctttgtagcaataagataccaaattccaacctgactccagtatagcatcacatgacagatagcaggccctgagaaaaatcaagtattttaccccaaaatatatttctttgacatatttttaaatggccctgcaaagctatctcttgtgggggaaatttacctcctttagagaagccccttccctttccaggtctttttctgatcctgaagagtttagctgagagtctggtaccttttaaaggtatgaataggaagcatttgccatctattgcctctaaggatggccacctataagacttcatctacataataagaccgttggtctccaacaacaccccttatctttgcccagacactcctttctattgattccaggttttttagataataacttaaacccttcaaccaattgccaatcagaaaaatctttgaatccacctatgacctgtaagtctcctgcttcgagttgttctgcctttccctaccaaaccatgattgatgtcttatgtcctcctaaaatttaaaatatcaaactgtaacccaacctccttggccacatgttctcaggacctcctgaggctgtgtcacaggtcatggtcctcacatttggctcagaataaatctcttcaaatattttacagaatttggcttgcttttttcatcaacaatatgtatacaaacgggcttttctaaaggactttcagccctccttcagctcatctccttcctctttctatctcctcgcctacatagtcaaacttcttaacagggttgtttatacttgccgaatccacttccttacctcccactcacttcttagccaactttaatctttcttcttccccgacactccattaaatcattctcaccaaggtcaccaataaccaccttgtcacaaaatctcatggacacttttccagtttttatcttttttgactagttgggaacattctacgtggctaagcactccctactttttattttttttaatttttttgagacagggtcttgctctgtcacccaggctggactgtggtggcatgatcatggctcactgcagcctcaacctgctgggctcaagcaatcctcctgcttcagcctcccaagtagctgggactacatgcacatgccaccacaccctgctaattttatgttttgtagagatagaatattgtgatatttcccaggctgactccccacttcttgcaacactgcttctcttgatttctgggacaccacccccttctctcttcttcctacatctctgactctttcttcccagaatcgtttgcaggttccctttcctctgctattctgttaaatgctggtatttcttagggttctagcttaggctatcttctcactccaccttctgtccctgggggacacagttcatgcaaagggttttgattatcttcaccatgctgtcaaatctcaagtgtgtatttttggcccaggtgtcactctctttatctcttgatgatccctgctcatcctcccatatagtttatatatcaaattacctcccaggcattgtacctgggaggtcactcagccacagcaaggtcggcatgtctccagctgtgcttatccctatccatatgtcctgcttatcctcagtgacacctctggaattcctgcttgaatgaataaatgacaactcagagttatccaaacctaaatcctgggggttatccttgatccttttcttaactctccacctctaattggttagcaagcaccgttgggtcaacctccttaatacctccctaggaaacttccattcccatagccgtcaccttagttatcttcatttatcacctgagttagtgaaaagtcatttctcctctatccttttcccactccatagcatagagctggagtgatctttttgaatgtaaagctggtcatggccattctcccttcctaaagcccttccagggcttcccacagctccttcttaacttctcttctgaaactcattgtggcctgtcttctcagctcccctccttcccctccagcttcgtctctcattgccttcttcttccatgcactactccagccacatggaactttctccacttcctcagtggcaccagggatgctttcatgctgagtagtcacatggactgtcccttcttccttgaaagtgtgtaaccctgcttgtacccctgctccctgggagcccccatcctgttgttttcacactgcatggggcactgttatctgtacttcaggtgtttgctcaggtacggagtcttcaggatgccttcatggacacctcaccttctcctgcctcccatcttcaacagagttaggtatccctgtacgtattcccacagaactctgctattccactatcatagcactttaattgcttttttatctttcacgagacagtctctattattgtaagcaattaggtgatgaattttaacatagcaattttaacctgagccccaattaataaacagtagacatttagcatatgaggtcaaatcaaagaacgtctcgtcaaatccccatgttttggagaaaaggaaactgctgcccacaggagttagggacatttccaaagtcacaaagtcaattcataacttattaatcattcttcccactgcagacatcagccataacccctattctttctatccttttgactgattctggttttctctgcaagaagcttgaaagccttagccaggacatggtttaaactctattttgccttggttatcaagcaatcaaatggtgtggttaaaattgtagcaagcctgtcatttctcatttaaaataaaacgggactcattcaggcttcttgaagtgagactgcatgtgacgatgcagggaacacatctcctagaaagaagaggagccactgaatgggcagcctcatggaatctcaggctagaagatccttcacatttgaagcaggctttagaggactgtgttatcttttccttttccatttcccctttccttgccttaagagcaagaattgtagattttcactctagtgctgtgggcttacaggggctcagctctgctggtcttttattcctctctatattttctagcacttcattctgttcacaaccaactaagactcttagaatttttcagtttcagtctcagaaagagttaatccaattggtttgtctaattgctgtcattactgcctggcatcaggacatctcataggtcactggtcagctactgattggccacacttgggctgtggtgaatccttggtccaaccagttttggctgtggtggttggttcttaccttttagagcagggccattccaactcaaggtcagcgtggggctgttttctttaccagaggtctgtggacatggacagcattgcataaggcctgacaaacttctggattctctacatggtgatagtttaaagtttctttaaaaatgtgtttttttgggggggggagtccacatattcaaagttctaagaaatctcaactactgacatattaaggaattgaatatgaatgtcctctcccactagatactgatagtttgattttcacagtaagatattctgggaagaaatctggataggaaggattagggaggccttatcatgacactcacaaagttgaatgggtttggtgaatgtatggtgaattttttccaggcatatatacttacaaagttgatttaaaaataagaatgtagattctggatattagccctttgtcagatgagtaggttgcgaaaattttctcccatgttgtaggttgcctgttcactctgatggtagtttcttttgctgtgcagaagctctttagtttaattagaccccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttctcagatttgtcaacccaaatgtccaacaatgatagactggattaagaaaatgtggcacatatacaccatggaatactatgcagccataaaaaatgatgagttcatatcctttgtagggacatggatgaaattggaaatcatcattctcagtaaactatcacaagaacaaaaaaccaaacaccgcatattctcactcataggtgggaattgaacaatgagatcacatggacacatgaaggggaataccacactctggggactgtggtggggtggggggaggggggagggatagcattaggagatatacctaaggctagatgacgagttagtgggtgcagcgcaccagcatggcacatgtatacatatgtaactaacctgcacaatgtgcacatgtaccctaaaacttaaagtataataaaaaaaaaaaacttccaagtaaaagaaatctaaaaaaaaaaaaaaaataagaatgtaagagtgatggtatttgacatttagaagaaatgttttgacaagtgcatgtgatgatttaatggtgcatattccataaagtcaacaggagtgaagctgtggaaatgtttgtctttctgagtgagtggtatttactgctgtgaatttgctgttccatttcccaatacactctccctcactcatgcttttactctaacttcacgtaactgagttgctattttcaatgatgctagtaattaatgtgtgtttggattctggatttttaaaaaagtaataagatgttttgggacaactggggaaatttaatatgtactgtatatcagatgcaattcctgagtgaatgttaatttctttggggttaataagagtattgtagttatacagaatgtcctcattttcatggtctgcacactgaggtatttagggtgaagtatacattgttggatagatggggataggtaagttgatcaagccaacacgacacaatctgaaaaattgggaaatatggatgctactcattcaacttttgtgtagggttgaaaaatctttaaataatataaaaagttggaggaaaaagtgtaactagtagtctgttggtgtagatggcttgagtctgagatctgaaattggagccagtctcagattagagaaaataggtcttgactttccttgcagtaacattaatctggtgtttaaatgaatgctttgctgaatctggggcaccgagagtgaatatctcattaatgaccaaatctccaaaccagtcattgtggaggaagctgagttggccacatccttgatttaactaagaagtagcatgttttattttatagctgccttagcctcattcattaaaacctgactcattgggcggagggtggaagaagttgcccctttagaaatatcttgctaataactctttggccacttcagctaacacagaacctggaactcatgccagcatagaagggtggctacaaggctatgggatgggccagccgtacacatgccatgattcactctcaaagaggacaatttcagcctctttaaaagcattatgatttagcagagaataaagaataaatgtccttggtaaaaggacatatctagaccagatgtagtacaactgtcattggctgtagggaatgccatgcacgtagaaggcagggtgaattgtgcccttggaattgtgtaacacgggacagatgtcatgaaaaacaatttacttgctgaaatccagcactgtggaggtggtgaagcagctgaagccatttttgtgatcagttcactctatggtatactgttgttattgtatttgcacttttgttctggcatgtttgcagaattactttttggacggatcaagtaaccaataatttgagcaacaatttaacagtaactttttagagtgaaaccttaccaaccaaataccagaatgtatttaaaaaatattttgctaatatttgtaactatcttgatagcctttgctctggggtttgggccatcctctgtctctcaagctgttataaatgatattttttgaaatgggaatagcatgagttggtcaggtagagatttctatagaagctccttctgtattcggcttatgacactcatggcggtagtatgaattcagatctcagggtcatttattatccatggaaagttaatttgagatgttggaacttttaaacagtgtttgtttattgtgctaatcacgatctgttactaaatttcatttgaaatgcaattaattaccttcatcaccttgctaaagattgacattaatattctgtcctatcctattagttctgttgacacagagggagatgatcacaataatgggaaggaaagagcagagagcaagggaataaacaagcagtgactgctattattttattgaatggttcttttgtcaaaatgactgcaagaaaattcttagaataccagtatcatcacacaaacctaaattcataaggcttcctgcagttgaatcatatttttaaagtttagcttggggttttctattattcagctcactggtgttgaagcaattttgttgacattttctgtaagtggattaggcttgcagtcatttgcccaaagcagacagatggcttcttaaacagagcacccccgtaggaacctatcttatggtatcttcagaaataaaacaggtctgtcacaaaagataatgtttggcattaatttcttttagtgacaaatgatttcagctcatttttactttctctgctggcttaaatgaaacagctgttttacattttttattccaatagtgagcaacgctttggtgtttgacactgaacaatgttgtagcctctaaattatgagtaagaaaataagcttttgagaggggaggatgatgccttttgggatcccccaaggaaagttgccacattaatgcaattgtcatttttattttaaacatggggtctttttttggactaatgagtaatgcaatcctggcttttattgtcgcattttattctctccactttgtcaacttgtctttttaagtttcaagatgtttttgtttcctcacatttttatgaggcaaaggacagtggacttatctacaacattgttatttctgtttatataatagaataataattgctaacgatcattagagttttccatgtatggcaggcattgttctaaagaatttagaggtattatctctcttaatctcacaaaaaatctatgaggtgagtacaattattatagccattttatggatgaggaaactgaggcacccagtgatcttgcccaaggtcaaaaagctagtaagtcttggagccaggatttgagcccaggtacagtaagagtggagcttatgctgtaaattcacttataagaatggcaatatggttacgattcaaagtctctagtctagagactagagactagtctagattgttattctaagagagaaatgaggaatccttagaatcagatttattccttcatcactcctggggttccactcgtcagctagtgtgttctgccatcttgggcagccagcttatgtggaaggcttgtgggggctcatgggtgctgcaaggagaaatcagtacaggggccctgagaattgactgatgaggcctcacattagtagcatccttcaaaacgttcagtggatgcctgtcatgaatatgattcattaataatcttctttttggatctgagccatcagggcttatgacgatacctttgaagtgaaaaccagtccttttttccagcacttatcccactcatgaatcctctatcattgcttttgtatttcagttttccgaaaatctggctcagattaaaattattaaatgcttccaaaccctgtacccacactgaagacaaaagttagaaatcaaaatatcagcacaaggatagtatttatgtctgggacatttgtgaagttctatcaagaaattcttttataaaccaaagaagtcttaagctagtttttcttttctatttgatcaaatagatctatttgatgacatgtgcaccatatcatgtaatgtacctaaattaaataaaaaaacacaaaaaaacaaataaacaatatagagattaagaaaaacaactcttggcctgggaagccggcattattcatttccttcacacttatttctcgtgtgaacctgggcaatgtatttttttagctttcctgtgtccatttattcacctgaaggttataaaaggagtccttcgaatggctcgaaaatttgaaataattactaagaacggttatttagcagatctcagtgatactgtcactaaatgacactttattgttttccactttcagtgtttctttcagtataaatgtcaatgaaacaaaataaatcctaaatagagaaaacgtaaggaaaaatggaatgtattaggcaatttggtgctgtgccataaaggcggtaaccttccagaacactctcccataccatgtatatctgtatctgtaagactggaggaggattcttgcctctcctccaggcaagcataaaaaaatccttgtactgtgtttcactgatcataagatgccaagaaataaatgaagatgcctgctcatcttgcaaatcattgctttcttgttactttttatggggaggcttgtctaatctcctagtcctcacagcaatacattcttttccctcaagtacttagcataatttaaggttagatataactttatttttgtggttattttatatatacctgtatcccacactagaaataggttccgtaggggcagggatgatgtctgtgctcacttttgtaacccccagagtccagcctggtgattctcaatgggtgcagtactgccccctaggctgtgttctgggaagttgtagaggtgattgggaggattctcctggcatttagtggaaacagacaggaatatttgatgtcatgctctgggcagggcagtacaacatgatgaaaaatgtcctgtgtcctgcaagatttctgttaagtcctgcctgagtaaaccctctgtattagtcagttgtcatactgctataaagaactacgtgaaactgggtaatttataaagaaaagaggtttttttgttttgttttgttttgttttctcagtccttcacgctgtacaggaggcatggctggggaggcctcagtgaacttacagtcatggcataaggcaaaagggaagcaagcacatcttcacatggtggcaggaaagagaaacagctaaggggaagtgttacacactttcaaacaaccagatctcctgagaacttactatcacaagaacaacaaggaggaaatctgcccctttgatccattcacctcccaccaaatcccctcctgcaacaccagggtttacaattcaacatgagatttgggtggggacacagagccaaaccatatcaccctctaaaatacaaatcagaatactttagtatatgatattaattaattattattattttttacaagaagttgtttgaaggccagtacttgagtaaaaggtagttattgagaggtaagtctaaatgaaataaagacattgtttccaaattattgaataatttactcaccttgggtattttgtccacttgaccatataattgctacacagtaatattggaacaaattgggcagtcagataatggttttaacctgataccttattttttattattgataatccatggtgggcatccgcctgggccccacaaagtatcagctggtattatcaatcacaagaacaatgacctttggagtacttttaaagatttggcagttttgctgggcgtggtggctcacacctgtaatcccagaactttgggaggccaaggcaggtggatcacctgaggtcaggagtttgagaccagcctgactaacatggagaaactccatctctactaaaaatacaaaatcaactgggtctggtggcctgtacctgtaatcccagctactcaggaggctgaggcaggagaatcgcttgaacccaggatgtggaggttgctgtgagccaagatcgcaccattgcactccagcctgggcaacaagagcaaaactccgtctcaaaataaaaaaaaaaagatttggcagttttgatgtggtgtatggacattatttacttcctcatttatgggattatcagctttttctttccacagtgagggtttgtatttgtcttggcatgttatgccgaccttaattgaggttgtttctttccttcttttattctatgcaaatacaactagtctattgccattatttgttttcatactagtgtctgtctctacatttgcattatcattttccattaaatatgtattttttgagtggaatggcatctgatcttatttctctttcatatctaattgcattcatattaagtacaggcatctgcctacttcaggtttctggtgtgcctgcctgacattcacatatggcaatacatgttattttattttaaatgaccattccctttttctcctttatattacagctagggtattatatttattttaataatacatgaataggttatattatctatgaatttaagtttatgaaaataaagaaagccttacaaagtatttgtttcaaagggttggttttgatagattgagaacctcaggccaaagtctggtatacagtaattgtttaataaatatttgtttgctggataagtgaataaaatgaaaactaaggtgcaagtcctcattaatagctaagagaccaccattgtttccaaagcacagggaagagatgggtgtatctcagttcacatatacatagctttgaacaaggtataacagggacaataaatgagaatttgaaacattaaatttcatacttttttttttttccccgagatggagtcatgctctgtcacccaggctggagggcagtggtgcgatcttggctcaatgcagcctccacctcctgggttcaagcaattttcctgcctcagcctcctgagtagctgggattacaggtgcctaacaacacacccagctaatttttgttcttttagtagagacggagtttcaccatgttggccgcgcctggcccatacttcttttttaagctctggtcaacaagtgcatctcaatgcagtgggttttattgagtgatacagatgttttccaccagtaacaggacctattgtcagcattgttgccactggattattaatggttttttaaattatattattattagtgagtagtgtttaaataatgttgaaagacttcacttatatgtagaattctatatatacaagaacataaaattgtctccttatattaaaactattttaaaaaacatggctaatacaaaggttttctgcttaaaatgcagttaattactattttgaagtaactagggtccttcatttcttcaacattcaagttaaccaagacttcttgataaataaagctattgtaacaaagaaagcttgataggaaagctattgtaacaatgcaggtgttatttgagaaagaaatgtggtaaaagaagatctttcaaatttctttcaaatttaattttcattatgttgaattttaacagagtatgatttcaaaattttctgagcctttcatatggcttattaaacatgtcatctgctgcattttacaattttctgtggaccctttggcattaaattattcttaacatttctttaaagtgtcttctatactttataaattattttttcttgagaattagattctcaggaactaaaaagatttatttatattcagtttccatagttttcagaagtattcaattaatcagagtttgtgaccaatcctaaaatacatcctttatgtaactaattaaaaaattaactttatatacagttacaaaatctaatgtctcaggtgagcatgtccagtgtaattctcttcatgttcctgtacagattatttttattgcattatataataaagatttgaaaagcagagtttcatttgttttgggtttagagtttcagaagaataacagataaagcttcattcagccaagactgttagaacagaactactctacgactattcatccatatttcttgagtgttcatggagtaaaaatttaactttttaaatagcaagtagaatgcagttgaaatatttggttgctgaggtgttgcaaaacagtaaatctgagcattgataacttagtgcagtggacacttctatttttgtgcaaaattaagttatattatatgcaatttcctaatagctgcacctttgtgccttttaactcttgttaacatcttgtatataattcctacacagataggccttcattctagagagcaagaattccaggccatctttgaatagtttcacccagttttccaaacagcgtaacataccaagagtgtaacatcaaaaaaaaaaaaaaaaaagtctaacatgacatcaaaacatttttgatttgttgttttaatttctcaaatgaaggacattgtagcagttgttttacctcttcagagcaaaggattaaacttcttaaatgatagagtcccaacggatggtttttgaattagtaagatggcagttgtgcacagccctccacagtatggtccatcaatggaccaaataaataactactcatcccactatgatgtctgtgactggtttctactgcagcactgtccaagggtgattctactgtgggtatggactctcccatggataaaagaatatcagaaaacccagtctgctgatgagtgtgggctcaaaaatactcacacgagttgacttggagacagagctgcatttgtttatgtgtgtagttttgtatatgtgagggttttcctattcccagagtcccaattagctgctttaaatatttgtggtgtgctctgaaacaacccactcatttcctttacacttgatgagaacactagttatgatgttctcctgctcttttgtgtactaatatcacaagggatagtgcggttcatgggaaaagtgggtgtgaaggagcctgggatgtcttttgtgaataattctgccagactgtagtcaaaaccattttcattggtggggggaggactgcatttttttggtaaaaatggaagtaacagaaatcctaaatatcttttgatgggttataagatatattactaaaagataatttatatttagaattctaccctattttatggttaggatataatgagatgtatttgaactggtttacgtttagtatattaagtgttcagtaaatgttagctgctgtttagtgttgtgacaatatttcttgtcagtagtaaatttattagtagtaatcaaaattgtggtgatatatcaccacagcaatgcacggcagcccaatttgcaatctaaattgcatcagttatttcctgatttctagataatgtactttaattataatttaatgcagttggaaagatttaataaggaatgcttaatgtttgttttttaaatattcactaattatcactcatttttaaattcagaatttctataatgatctctgtggctttgcatgagtccatgttactttctaaatgtgttggacctgccagtggaaccttacattcagaagccaaatcactgtggaggctaaatggtggccattgctcttgggacttctattagtcttgttgtcccatcagcatcagtctacctgaggcgctctctattaccctcactttcctttgagttaaagcatccttctcttttttttttttcatgaaggatccccagtaccagaggatacttcaaatccccatgagattgctagtatagaaatgccggcagcagcttgacatttttttttcaagttgagtgttcagtggtcaacttgtacattaattctgcatttcatgccataacaatcctaaacttattttagtatacaagaggtgtttccatttctatatcaccaaataaaatgaattctcctggggttcctcctcttcccttaagacctctgtttagggagaataagattaaaacactttcttaagaatgacttgttaggttactctttaaatatatactatagacgaatacctttaaatggcttggctgacctgaataccatggtgggtgtcggggggtggtttttgggatgaaactggatcaacctcagatcaacaggcattagattctcataaggaatacacaacctagatcccttgcaggctcagttcacaatagggttcacactcctgagaatctaatgtcgctgctgatgtgacaggagtgggagctcaggcagtaatgctcactcacccactgctcacgtcctgctgtgcagcctggtttctcacaggtcacagggactggtatcagtccatggccccagggttggggacacctgctgtacctaatatattttggaggaaatgatacacaggacaaagacgtttagagggagatctggtataagctggctggttaagagaagtttgggggtgtttgtgacagagtagagagaaagagattgctagatgattagggaaaattgctgcatataaaatgggaaaaaagtcagcatgccaagggaaaatgccagggtggtggttgttaacaatcaaattcaccttctacaattttcaccagaatgtgtcttttctgattctggtgccttgattcggaagacccaaagaagagatgcaggttgtgattcctggaaccacagaacagaaagatgactgctattcctccttcataaaaaaagagaaaacagaagtttatatcatgtttcaatgtacactcttcacaacacagcctttcagttttgcttcttttattagttaatagtttacctattttttttttttcttgcctatatggtacagccagtgtgtgttgtctccagggttatcaggagatgatgtagttgtgttagttatgcactggtacaaactgtttcctcccattggccattgttttctacagagactgacttctatttaccagaaatggcacagtctggcatttggatgccacctcttagaaccaatgagatgacattctggattattaaaatatgtttcatgccatgctgtgggaaaaggggatgtgagaattttatgcgttagtaggataaaatgatgtttttgtacgtttcactgttctcttgcaattaggaaagttgccagttttgctactgctatgcttttaaaattcttgatgaaactttcaaaactaaatgaaaagggaacacttaaaagtaatactctgaaaatgaaggaggatatagtctcattactaatagattttttataaatggaaagattcctttaaaaatatagtagtacatatacattatacatatctctgtaaaacagactctggtagatgcattttaaatgttagtcaaatttttaataaaatatagatagtaccaagatacttattatatatagtagcagataatgttaaccactttctaaatcaccttatatcattgtgattcctatacttatgatcatttaaatcataaagagctcttcaacatattgtctttaatcttagaactgtaaggaaggctgaaggatattttcatcatttttgcagaagagaaaatggcccagataaaaattggttgaagatgctccaaccctcgtccctgctagtgtgttcttgctctgccctgtcttcctgattctggatgctatctctaaattgtgtcaggctgtgtcacatgggcaatgcttttctttttatctgcgttgcttccatgggtaacaatgaataggagtctctagggtgccctgcagagagtgcctgctttgctgttaaaagatgcctatcaggtagtggttaaaaccacagaccccggagccagctgctggattttaagctccagctctaccacttagcagctgtatgactttgggaagggtgactgtgctctgggcctcagtttttttaatcagtaaattgagaataatgaaagtacccatctcatagggatgttgtaatgaatgattgaatgaacatgtataaagcacaaagagtgaccacactgagcaagcacttcatatgttggtctgttattattattactgaagagttgcacttttcaaagtggatgtgacttcacttttttttttaaatttatgttctgggatacatgtgcagaatgtgcagttttgttgagcagactcattcgtgatgtctatagtgttaagaacagacttcccaaagtctgctggtgtagtaaatattttttctttagaaaatacatctctcactgacagagtctttaggctctaatctctagtctttagtctcagactagattgtaaacatggtgtggggaatagagcattgatgcaggaggccaaaggcctgaactttagtcccagctcagcgattaaccagctgtgaccttgggacagtcaattaacctcatcaggctcagcttcatttctcctcaggagaaggcaaaactgtccacctccaactcttcttccaaaatcccataccataattgatgtacttgagaagaagttcgctttaacacaaacatcaggcaaagcccaactatttaatcatcccatataattaaaagctgctattagaaggatttagctattttttacagaggatagaattggcaagtgcatatttaggttttgagaaataaaatattccaagcttttgtaaaatacaagtttcttcatacaccctaaggaaaaagcatttactggcctttcataaaataggtaaattatcctttctctgagcctctgctttgtagaataatgctccagcaatcgtcataaccccatatccacccatattgtcctttcaaggtcacactttcaggcactgccatgagaatggagaggagagggaagaagctacttcttcctctgtctatgggccatagacacctgtccctgcttccccacactcagtcattcagcccttgggccagtatcagtatacgcactttatcttcataacagtgaactaaaataagaaataaaaatagcaggaaaagatctctgttgggcactgatgtaaatgacagctaatgtgttcctgcaatcctcatttcctttttgttttgcctctggagactctttttctccatctgccaggtgggaacatcatcttcaggatgatggaaaaggcagaagtaatgtgggtgactgataatttaacaacaggcagattgcaaggatgacccagtatattaaaaaccagctcaccaagcataagggtatgtgacttactttacagaagacactttgctttgtaagctcttgtacagagggggagattttattttcacttctttaaggaagagcttctttccttgttttctcccaagactaggaatgctggatctgggcggggtaggtattgcagcagtgtgcagagtctcagaccatggtgatggaagagttgatgtcctcagcacataaagaggaggattcctcacaataggaatctcaacggactgccagcaattgcatagccagctggtcaggctcaggttgaggtacttggcttaacaagcaaagtcacttaataatgttagaaaagaaccttgggttaaaccctggaaaagtgagcttgcaggtctgggtctgtttccttattcagcaatgggcagtaagaacatagagtgatgtcactcagcacatgcctggcccataactgtcttctttgatgcctgtttttttctgtttgtagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtggcagagagagagaaagagagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatagatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggtactctgaaacacactgaaagctctgttgcaattaggattttgatgtgacaataatattgttgtataatttcgagatttgtaggaaggtctcattcttccaagctgagagtctagcactcattttctataacagatatggcagcttagaggtgttggctttgtttggatgtaatttagggtactaaatttaaatttaaagatattgttcaaacaatatcatatcatcacattgagctgatataaattctgtgggtccgataatatctttgtgataatttaagagctaaccagttaccacacatctatgatataaccctaacacacacagaaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctatagcttctgtgttatttctgacttcttaacactattatgtttatgttgcacattactgaaagagtaaagatat

SEQ ID NO: 36815 - DNA, 3890 bp, Homo sapiens
ggcggcagcagccacccgatgtcttcggcgcccgagaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccagcgagttcatgttcgaggagggctcctttcggcggcggccgcgcggcttccgaaggaaatgccaggcgctcaagcccatgtacagcatgatgaacgggctcggcttcaaccacctcccggacacctacggcttccagggctcggccggcggcctctcgtgcccgcccaacagcctggcgctggagggcggcctgggcatgatgaacggccacttgccgggcaacgtggacggcatggccctgcccagccactcggtgccccacctgccttccaacggcggccactcgtacatgggcggctgcggcggcgcggcggccggcgagtacccgcaccacgacagctcggtgcccgcctccccgctgctgcccaccggcgccggtggggtcatggagccgcacgccgtctactcgggctcggcggcggcctggccgccctcggcgtccgcggcgctcaacagcggcgcctcttatatcaagcagcagcccctgtccccctgtaaccccgcggccaaccccctgtccggcagcctctccacgcactccctggagcagccgtatctgcaccagaacagccacaacgccccagccgagctgcaaggtgagtggggaggccgagggcgccctggtccccgggaagtcgagtctgagtggcagcgggacccagctggggcgagcccctccacttctgtggtcggaaccccaaggctgaggggaggcaccagctccccaaggtgtctcttggccccacctctcccccttcgaagagtgactaccgctcttgaccctagtttgggccaatctgtttctctttctgttcgaactccagctgccagctgctccaggcctgaccaggtaggctggtcctgagccagatgtcccagaccccagtgccctaagtccttttgtgtcccttaagtcccctcacagcttggaaagatcctgggatggacccaaggctcccagcgctggccagatggctgtccctccctggtggtggccctcaggctgcctggagggctgcctctgcctggggctgggcggaacggaaggtgttaggcccaaagccgctgggccagcgctcagaggctcagccccggcctttcaggggaccagacctggcagacccacagctgagtccaggggcattttgtggtgactgaggcaggagggtgccgtggccaggccccggagggtcagagctgcagaccgggccatgggggctccttgttttttaggatccaagttttcaggtccccacacccccaacacccctgataccccaataccccgaacatgcagaagcatctgccaagggagatgcagcagcctcgcctcctgattctgccccaggccccccgcagcctgcaggcccagctctggaaaaagctggagtgagcttgccagggccagtccagggtcagctgtcagcagccccaggaggcaggagccaggcctggaggccttaggcagcctctctgcgggggactccccggctccggggcctgttctctggagaagcttcttctcacccctgctgctggcccggcgctggccctgcactggcctctccttcaaccccgccggcagtcgtagcctctgaggttgggggtggtggtggctgccctggcggtgacggccatgggcgttaggggccctccacttggtctccctcaccacttcccctatggctctggaagccctgggcccctgcacggtgtccgaggctggacaggcacgcagcaggcaggcaggcaggcaggcaggcaggccgtggcaagtgttctggagtcttttccttgggtgcgcagctggaaggccgggactcggggaggagagcggggaggcggccgtgctctggagccaggctgacaggccctgtgcgccccacgggagcactgctcctctgcctgaactctgagccaccgtggctaactcttctgctcccccaacccctcctgtcgcctcgccttgcaggcatcccgcggtatcactcgcagtcgcccagcatgtgtgaccgaaaggagtttgtcttctctttcaacgccatggcgtcctcttccatgcactcggccggcgggggctcctactaccaccagcaggtcacctaccaagacatcaagccttgcgtgatgtgaggctgccgccgcaggccctcctggtgcaggcaggcgggtcacagggaccctggaccggcacaagaaactgctttcttctcgaggtataaccgtcggcagaagaaaagggttccacctctccccaaccggagtttttggcaaggagtccccaatgcaaagacacagcgctgcggttggcacctccttcctcactccttcaaaattgttaagaaatgttagtggtgggtctgatctgactgcagccatcggtaaataaaagtttttgatcctgttgaacccgcctgagacggtgctgtgcaggggaaagcccccgcacccacacaggaattctgctgaggtcccccctccttccggccaatggcagaagtgggggaaaatttttagaagaaaagcaaacatgtgagaccaatcattatcaaatacttttattttttggttgagtatttatctttttattttttattttttttttgaaagaatgtcttggaatgcgcaagtctccctttagagccgtcttttgcagggagcgggaagtgacaagagctcagatctccctcccgatctccctccccacctccgaagtctcctccgtggaccacaggtggatctttgtgcgaacaacttgcatttcggaagccactgtccgtctttaaacagaaagtcaaaggagccacgaagcaagcggccgtccgggcgtccgcctccgtccccttccatgttcctcctcttccttcgcttcagcctcttctgttatgttttgtcttgaattttatttagactttttcagtgggtatttttctgtctcccaacctctactgtaaactttctggtccgagaacgagccgaacacagcgcgacgcagggactaggacggcccggtgaccgcgcggattcaggattgcggggacgcagaaaggttaaggcacttttaaaaactatagcaaggctcctgtttatttattctactttctttccctaataatcaaaacaccgcgtaggctcctccgtttatcagtattaatggtgtaactttgttggcaatatttgccgtgtagaattttttttagatatccattgtaaatttgaaacaaagaccgatctgtgtaaaaacaaatttccatatgttttatataaatatatatataatatgaaggactaccctccttttttttttttgtattttggctgctagagtgcagcatttgtgacacgtatttgaaatttgaaatttccttctgcactgtataaaaggaccatttgaggatgttttgccttttgtgtattttttcctaaaaaaagaacaaaaataaaaatgtataacatttgtacatggcctttaaaattgtatcaactaga
